United States Patent
Guo et al.

(10) Patent No.: US 11,640,849 B2
(45) Date of Patent: May 2, 2023

(54) METHODS FOR HISTOLOGICAL DIAGNOSIS AND TREATMENT OF DISEASES

(71) Applicant: CROWN BIOSCIENCE, INC. (TAICANG), Jiangsu (CN)

(72) Inventors: Sheng Guo, Jiangsu (CN); Henry Qixiang Li, Oceanside, CA (US)

(73) Assignee: CROWN BIOSCIENCE, INC. (TAICANG), Jiangsu (CN)

( * ) Notice: Subject to any disclaimer, the term of this patent is extended or adjusted under 35 U.S.C. 154(b) by 158 days.

(21) Appl. No.: 15/756,979

(22) PCT Filed: Sep. 9, 2016

(86) PCT No.: PCT/CN2016/098593
§ 371 (c)(1),
(2) Date: Mar. 1, 2018

(87) PCT Pub. No.: WO2017/041746
PCT Pub. Date: Mar. 16, 2017

(65) Prior Publication Data
US 2018/0247014 A1    Aug. 30, 2018

(30) Foreign Application Priority Data

Sep. 10, 2015  (WO) ............... PCT/CN2015/089349
Apr. 21, 2016  (WO) ............... PCT/CN2016/079859

(51) Int. Cl.
| | |
|---|---|
| *C12Q 1/68* | (2018.01) |
| *G16B 30/10* | (2019.01) |
| *G16B 30/00* | (2019.01) |
| *G16B 40/00* | (2019.01) |
| *G16B 45/00* | (2019.01) |
| *C12Q 1/6886* | (2018.01) |
| *G16B 40/20* | (2019.01) |

(52) U.S. Cl.
CPC ........... *G16B 30/10* (2019.02); *C12Q 1/6886* (2013.01); *G16B 30/00* (2019.02); *G16B 40/00* (2019.02); *G16B 40/20* (2019.02); *G16B 45/00* (2019.02); *C12Q 2600/106* (2013.01); *C12Q 2600/158* (2013.01)

(58) Field of Classification Search
CPC ........ G16B 30/00; G16B 40/00; G16B 45/00; C12Q 1/6886; C12Q 2600/106; C12Q 2600/158
See application file for complete search history.

(56) References Cited

U.S. PATENT DOCUMENTS

| | | | | |
|---|---|---|---|---|
| 8,252,538 | B2* | 8/2012 | Croce ................. | C12Q 1/6886 435/6.1 |
| 9,670,549 | B2* | 6/2017 | Mock .............. | G01N 33/57484 |
| 2005/0048542 | A1* | 3/2005 | Baker .................. | G16B 40/00 435/6.14 |
| 2007/0031876 | A1* | 2/2007 | Lin ..................... | C12Q 1/6886 435/6.14 |
| 2010/0284915 | A1* | 11/2010 | Dai ...................... | C12Q 1/6886 424/9.1 |
| 2013/0296198 | A1* | 11/2013 | Gordon ............... | C12Q 1/6886 506/38 |
| 2014/0297194 | A1* | 10/2014 | Yang .................... | G16B 25/00 702/19 |
| 2014/0357660 | A1* | 12/2014 | Mock .................. | C12Q 1/6886 514/291 |

FOREIGN PATENT DOCUMENTS

| | | | |
|---|---|---|---|
| WO | 2008021115 A2 | 2/2008 | |
| WO | WO-2008021115 A2 * | 2/2008 | ....... G01N 33/57423 |
| WO | 2012135397 A2 | 10/2012 | |

OTHER PUBLICATIONS

Xu et al in "A Comparative Study of Gene-Expression Data of Basal Cell Carcinoma and Melanoma Reveals New Insights about the Two Cancers", (PLoS ONE, vol. 7, No. 1, Jan. 25, 2012, p. e30750; IDS reference). (Year: 2012).*
The Cancer Genome Atlas Research Network et al The Cancer Genome Atlas Pan-Cancer analysis project, (Nature Genetics, Oct. 2013, vol. 45, No. 10, pp. 1113-1120; IDS reference). (Year: 2013).*
The Cancer Genome Atlas Research Network et al., "The Cancer Genome Atlas Pan-Cancer Analysis Project" Nature Genetics, Oct. 31, 2013 (Oct. 31, 2013), No. 10 vol. 45, pp. 1113-1120.
International Search Report and Written Opinion for PCT/CN2016/098593.

(Continued)

*Primary Examiner* — Catherine S Hibbert
(74) *Attorney, Agent, or Firm* — Jun He Law Offices P.C.; Yi Zhang

(57) ABSTRACT

The present disclosure provides a diagnostic method based on pairwise comparison of cancers using transcriptome expression data. In one embodiment, the method comprises the steps of: obtaining a first gene expression profile of a first cancer sample having a first cancer type; obtaining a second gene expression profile of a second cancer sample having a second cancer type, wherein the second cancer type is different from the first cancer type; comparing said first gene expression profile with said second gene expression profile; and selecting N genes that are most differentially expressed in the first and the second gene expression profiles to generate pairwise differentially expressed genes (DEGs), wherein N is an integer between 10 and 100.

10 Claims, 15 Drawing Sheets

(56) References Cited

OTHER PUBLICATIONS

Kun Xu et al: "A Comparative Study of Gene-Expression Data of Basal Cell Carcinoma and Melanoma Reveals New Insights about the Two Cancers", PLOS ONE, vol. 7, No. 1, Jan. 25, 2012 (Jan. 25, 2012), p. e30750, XP055557254, DOI: 10.1371/journal.pone. 0030750. p. 8, left-hand column, paragraphs 2, 3; figures 1, S5; table S1, S3.

Kun Xu et al: "A Comparative Analysis of Gene-Expression Data of Multiple Cancer Types", PLOS ONE, vol. 5, No. 10, Oct. 27, 2010 (Oct. 27, 2010), p. e13696, XP055198181, DOI: 10.1371/journal. pone.0013696.the whole document.

Martinez et al: "Comparison of gene 1-15 expression patterns across twelve tumor types identifies a cancer supercluster characterized by TP53 mutations and cell cycle defects", ONCOGENE, vol. 34, No. 21, Aug. 4, 2014 (Aug. 4, 2014), pp. 2732-2740, XP055556415, London, ISSN: 0950-9232, D0I: 10.1038/onc.2014.216. the whole document.

The extended European Search Report of PCT Application No. PCT/CN2016/098593, dated Mar. 7, 2019.

\* cited by examiner

METHODS FOR HISTOLOGICAL DIAGNOSIS AND TREATMENT OF DISEASES

CROSS-REFERENCE TO RELATED APPLICATIONS

The present application is a national phase of International Application PCT/CN2016/098593, filed Sep. 9, 2016, which claims the benefit of International Applications PCT/CN2015/089349, filed Sep. 10, 2015, and PCT/CN2016/079859, filed Apr. 21, 2016, both of which are incorporated herein by reference in their entirety.

FIELD OF THE INVENTION

The present invention generally relates to diagnosing and treating diseases, such as cancer.

BACKGROUND OF THE INVENTION

Cancers are heterogeneous with diverse pathogenesis. The accurate diagnosis of cancers helps to understand disease development and prognosis, thus guide precision treatments. Current clinical diagnosis is primarily based on anatomic locations (organs) and histopathology (morphology of cancerous tissues and cells), which may not be accurate. For example, a metastasis could be misdiagnosed if the morphology is insufficient to identify its origin. An improved diagnostic method is therefore needed. Transcriptome sequencing (RNA-seq or microarray) profiles gene expression, which may be used to describe molecular pathology of cancers and diagnose disease. The Cancer Genome Atlas (TCGA) project has generated abundant genomic data for human cancers of various histopathology types and enabled exploring cancer molecular pathology through big data analysis. It remains a challenge, however, to correlate differentially expressed genes to cancer pathology, such as the tissue origin of the cancer. Therefore, there is a need to develop new methods for diagnosing cancers based on the systematically confirmed correlation between histopathology and molecular pathology.

BRIEF SUMMARY OF THE INVENTION

In one aspect, the present disclosure provides a method comprising the steps of:
  obtaining a first gene expression profile of a first cancer sample having a first cancer type;
  obtaining a second gene expression profile of a second cancer sample having a second cancer type, wherein the second cancer type is different from the first cancer type;
  comparing said first gene expression profile with said second gene expression profile; and
  selecting N genes that are most differentially expressed in the first and the second gene expression profiles to generate pairwise differentially expressed genes (DEGs), wherein N is an integer between 10 and 100.

In certain embodiments, the cancer sample used herein is not a cancer cell line.

In certain embodiments, the cancer sample used herein is a surgical removal sample or biopsy sample from a cancer patient or a patient derived xenograft (PDX).

In certain embodiments, N is between 20 and 80. In certain embodiments, N is around 50.

In certain embodiments, the gene expression profile described herein is obtained by transcriptome RNA sequencing or microarray. In certain embodiments, the gene expression profile described herein is obtained from the cancer genome atlas (TCGA) dataset.

In certain embodiments, the N genes most differentially expressed are selected by ranking the expression difference of each gene using t-test, Mann-Whitney U test, or other tests that compare mean and median between 2 or more groups.

In certain embodiments, the cancer type described herein is colon adenocarcinoma (COAD), rectum adenocarcinoma (READ), lung adenocarcinoma (LUAD), lung squamous cell carcinoma (LUSC), head and neck squamous cell carcinoma (HNSC), liver hepatocellular carcinoma (LIHC), or pancreatic adenocarcinoma (PAAD).

In certain embodiments, the method described above further comprises diagnosing a cancer based on the expression of the pairwise DEGs.

In another aspect, the present disclosure provides a method comprising:
  obtaining a first gene expression profile of a first cancer sample having a first cancer type;
  obtaining a second gene expression profile of a second cancer sample having a second cancer type, wherein the second cancer type is different from the first cancer type;
  obtaining a third gene expression profile of a third cancer sample having a third cancer type, wherein the third cancer type is different from the first and the second cancer type;
  comparing said first gene expression profile with said second gene expression profile;
  selecting $N_1$ genes that are most differentially expressed in the first and the second gene expression profiles to generate first pairwise DEGs, wherein $N_1$ is an integer between 10 and 100;
  comparing said first gene expression profile with said third gene expression profile;
  selecting $N_2$ genes from the gene set that are most differentially expressed in the first and the third gene expression profiles to generate second pairwise DEGs, wherein $N_2$ is an integer between 10 and 100;
  comparing said second gene expression profile with said third gene expression profile;
  selecting $N_3$ genes from the gene set that are most differentially expressed in the second and the third gene expression profiles to generate third pairwise DEGs, wherein $N_3$ is an integer between 10 and 100; and
  generating a signature genes that comprises the first, second and third pairwise DEGs.

In certain embodiments, the signature genes have m genes, wherein m is an integer between 5 to 5000.

In certain embodiments, the method described above further comprises diagnosing a cancer based on the expression of the signature genes.

In yet another aspect, the present disclosure provides a method for treating a cancer in a subject, comprising diagnosing the cancer type in the subject by the method as described herein, and administering a drug that can effectively treat the cancer type.

In yet another aspect, the present disclosure provides a method for treating a first cancer type in a subject, wherein the first cancer type has the same expression profile of pairwise DEGs as a second cancer type, the method comprising administering to the subject a drug that can effectively treat the second cancer type.

In one embodiment, the first cancer type is colon adenocarcinoma (COAD), and the second cancer type is rectum adenocarcinoma (READ). In one embodiment, the first cancer type is rectum adenocarcinoma (READ), and the second cancer type is colon adenocarcinoma (COAD).

In one embodiment, the first cancer type is neck squamous cell carcinoma (HNSC), and the second cancer type is lung squamous cell carcinoma (LUSC). In one embodiment, the first cancer type is lung squamous cell carcinoma (LUSC), and the second cancer type is neck squamous cell carcinoma (HNSC).

DETAILED DESCRIPTION OF THE INVENTION

Figure 1A:
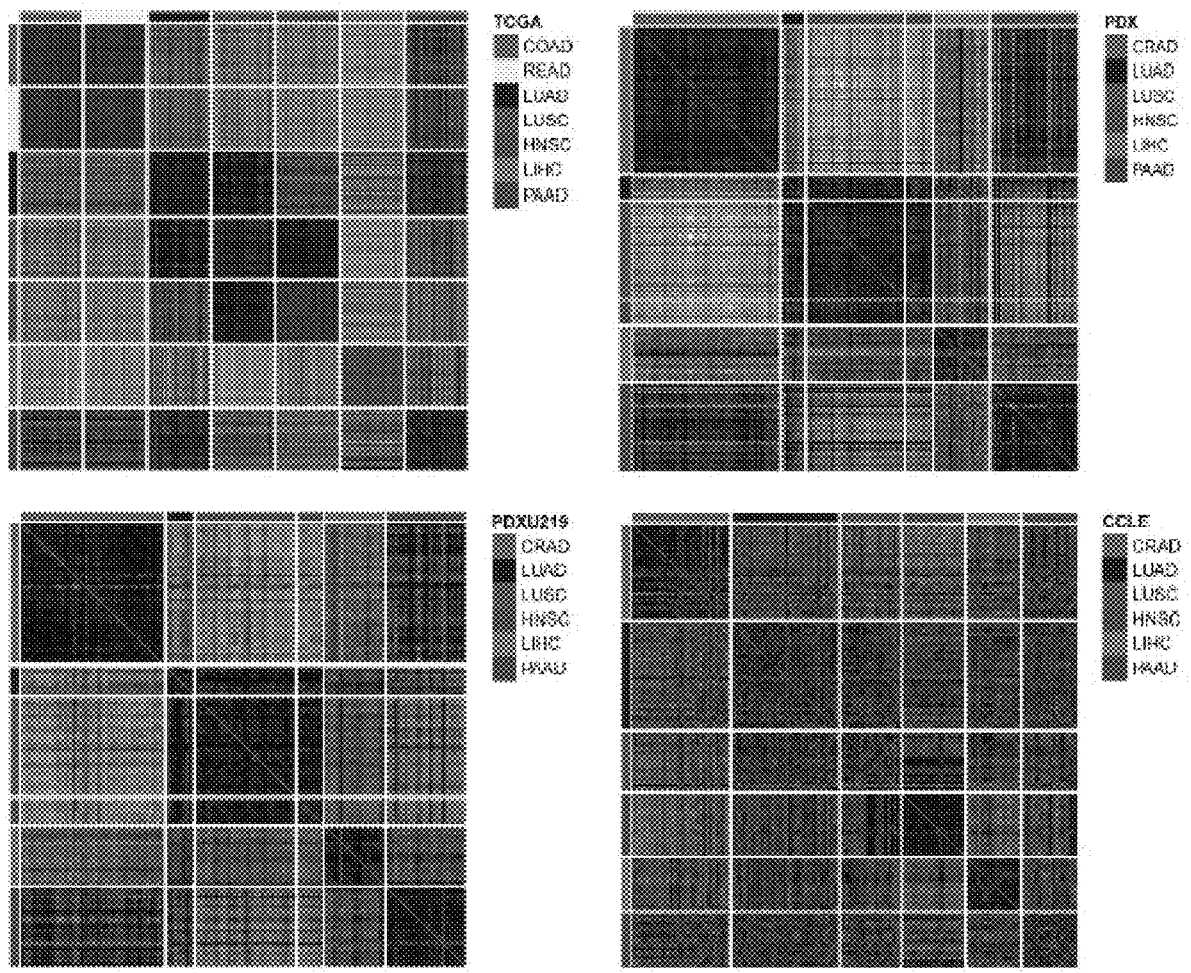
FIG. 1A illustrates comparison of gene expression for TCGA patient samples profiled by RNA-Seq, PDXs profiled by RNA-seq (PDX), PDXs profiled by microarray (PDXU219), and cancer cell lines profiled by microarray (CCLE). The number of pairwise DEGs is 50, at which there are 686 unique genes. In the heatmaps, Pearson correlation coefficient between two samples is color-coded; the length of a color bar on the top or left is proportional to sample size within a dataset.
Figure 1B:
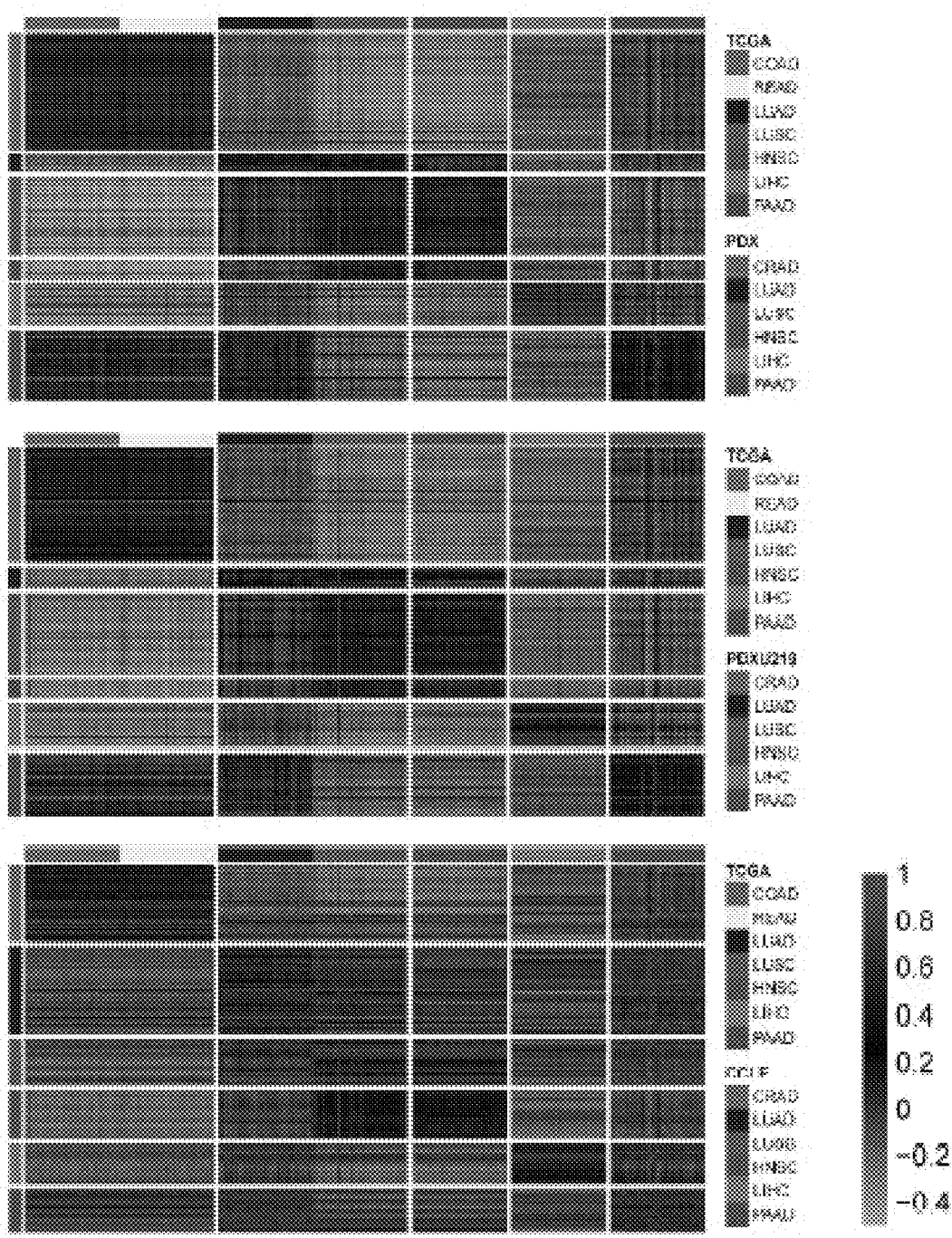
FIG. 1B illustrates comparison of gene expression between TCGA and the other 3 datasets. The number of pairwise DEGs is 50, at which there are 686 unique genes. In the heatmaps, Pearson correlation coefficient between two samples is color-coded; the length of a color bar on the top or left is proportional to sample size within a dataset.

In the Summary of the Invention above and in the Detailed Description of the Invention, and the claims below, and in the accompanying drawings, reference is made to particular features (including method steps) of the invention. It is to be understood that the disclosure of the invention in this specification includes all possible combinations of such particular features. For example, where a particular feature is disclosed in the context of a particular aspect or embodiment of the invention, or particular claim, that feature can also be used, to the extent possible, in combination with and/or in the context of other particular aspects and embodiments of the invention, and in the invention generally.

The term "comprises" and grammatical equivalents thereof are used herein to mean that other components, ingredients, steps, etc. are optionally present. For example, an article "comprising" (or "which comprises") components A, B, and C can consist of (i.e., contain only) components A, B, and C, or can contain not only components A, B, and C but also one or more other components.

Where reference is made herein to a method comprising two or more defined steps, the defined steps can be carried out in any order or simultaneously (except where the context excludes that possibility), and the method can include one or more other steps which are carried out before any of the defined steps, between two of the defined steps, or after all the defined steps (except where the context excludes that possibility).

Where a range of value is provided, it is understood that each intervening value, to the tenth of the unit of the lower limit unless the context clearly dictate otherwise, between the upper and lower limit of that range and any other stated or intervening value in that stated range, is encompassed within the disclosure, subject to any specifically excluded limit in the stated range. Where the stated range includes one or both of the limits, ranges excluding either or both of those included limits are also included in the disclosure.

It will be appreciated that for simplicity and clarity of illustration, where appropriate, reference numerals have been repeated among the different figures to indicate corresponding or analogous elements. In addition, numerous specific details are set forth in order to provide a thorough understanding of the embodiments described herein. However, the embodiments described herein can be practiced without there specific details. In other instances, methods, procedures and components have not been described in detail so as not to obscure the related relevant function being described. Also, the description is not to be considered as limiting the scope of the implementations described herein. It will be understood that descriptions and characterizations of the embodiments set forth in this disclosure are not to be considered as mutually exclusive, unless otherwise noted.

With the available of The Cancer Genome Atlas (TCGA) datasets from multiple genomic profiling platforms, molecular taxonomy methods have been developed and tested (Hoadley K A, Yau C, Wolf D M, Cherniack A D, Tamborero D, Ng S, et al., "Multiplatform analysis of 12 cancer types reveals molecular classification within and across tissues of origin" Cell (2014) 158(4):929-44; Cancer Genome Atlas Research Network, "Comprehensive molecular characterization of gastric adenocarcinoma" Nature (2014) 513 (7517):202-9). Many such methods analyze samples from multiple cancer types simultaneously, and may be biased toward certain types.

The present disclosure provides new methods for cancer diagnosis based on most differentially expressed genes (DEGs) per pairwise comparisons. The methods disclosed herein are based on the finding that the expression of pairwise DEGs is highly correlated within types and of low correlation between types, thus establishing molecular specificity of cancer types and an alternative diagnostic method largely equivalent to histopathology. The methods disclosed herein are also based on the finding that pairwise DEGs derived from surgery removal or autopsy samples of patient or patient derived xenografts (PDXs), but not derived from cancer cell lines provide reliable biomarker metrics for cancer diagnosis. We found highly similar patterns for within- and between-type correlation between PDXs and patient samples, confirming the high relevance of PDXs as surrogate experimental models for human diseases. In contrast, cancer cell lines have drastically reduced expression similarity to both PDXs and patient samples.

In one aspect, the present disclosure provides a new diagnostic method based on pairwise comparison of cancers using transcriptome expression data, an approach different from the methods using multiple types of genomic data and complex algorithms more commonly used (see Hoadley K A, Yau C, Wolf D M, Cherniack A D, Tamborero D, Ng S, et al., "Multiplatform analysis of 12 cancer types reveals molecular classification within and across tissues of origin" Cell (2014) 158(4):929-44; Cancer Genome Atlas Research Network, "Comprehensive molecular characterization of gastric adenocarcinoma" Nature (2014) 513(7517):202-9). Compared to these methods and algorithms, the method disclosed herein has the advantage of being simple and unbiased in assessing and describing cancer type specificity. The method disclosed herein is able to define cancer type specificity and establish near equivalency between the resulted molecular classification and the traditional disease classification based on tumor origin and histopathology, thus providing a molecular alternative to traditional histopathology for diagnosing cancer with better accuracy and precision. Since there is little limitation to the level of classifications done by the molecular pathology method disclosed herein, it can reach a degree significantly beyond existing histopathology based method, and can be more accurate, reliable, and with better objectivity. The advantage of this molecular diagnosis method can be exemplified by its ability to correct the wrong diagnosis made by hospitals. It also could be used for molecular diagnosis, a complement to the existing one based on histopathology, with certain superiority.

In certain embodiments, the method disclosed herein comprises the steps of:
  obtaining a first gene expression profile of a first cancer sample having a first cancer type;
  obtaining a second gene expression profile of a second cancer sample having a second cancer type, wherein the second cancer type is different from the first cancer type;
  comparing said first gene expression profile with said second gene expression profile; and
  selecting N genes that are most differentially expressed in the first and the second gene expression profiles to generate pairwise differentially expressed genes (DEGs), wherein N is an integer between 10 and 100.

As used herein, the term "gene" refers broadly to any nucleic acid associated with a biological function. Genes typically include coding sequences and/or the regulatory sequences required for expression of such coding sequences. The term gene can apply to a specific genomic sequence, as well as to a cDNA or an mRNA encoded by that genomic sequence. "Gene expression" refers to the process by which information from a gene is used in the synthesis of a functional product, including protein and functional RNA (e.g., tRNA, snRNA, and microRNA). In certain embodiments, the expression level of a gene can be measured by the transcript (e.g. mRNA) of the gene or the derivative thereof (e.g. cDNA).

"Gene expression profile," as used herein, refers to the measurement of the expression level of a plurality (e.g., more than 100, more than 500, more than 1,000, more than 2,000, more than 5,000, more than 10,000, more than 20,000) of genes, so as to create a global picture of gene expression in a cell (or cells). As disclosed herein, a gene expression profile can be obtained using methods known in the art, such as DNA microarray technology (see, e.g., Pollack J R et al., "Genome-wide analysis of DNA copy-number changes using cDNA microarrays" Nat Genet (1999) 23(1): 41-46). Sequence-based technologies used for gene expression profiling include, without limitation, serial analysis of gene expression (SAGE) and RNA-seq. The methods for gene expression profile analysis has been previously described (see, e.g., Yang M et al., "Overcoming erlotinib resistance with tailored treatment regimen in patient-derived xenografts from naive Asian NSCLC patients". International journal of cancer (2013) 132(2):E74-84; Chen D et al., "A set of defined oncogenic mutation alleles seems to better predict the response to cetuximab in CRC patient-derived xenograft than KRAS 12/13 mutations" Oncotarget (2015) 6(38):40815-21).

The methods of comparing two gene expression profiles are known in the art (see, e.g., Robinson M D and Smyth G K, "Small-sample estimation of negative binomial dispersion, with applications to SAGE data" Biostatistics (2008) 9(2):321-32). In certain embodiments, the N most differentially expressed genes are selected and are called pairwise differentially expressed genes (DEGs). In certain examples, the DEGs are identified and ranked by t-test, Mann-Whitney U test, or other tests that compare mean and median between 2 or more groups.

In certain embodiments, N is between 20 and 80. In certain embodiments, N is about 30, 40, 50, 60, 70, 80, 90 or 100. In certain embodiments, N is around 50.

In certain embodiments, the gene expression profile described herein is obtained by transcriptome RNA sequencing or microarray. In certain embodiments, the gene expression profile described herein is obtained from the cancer genome atlas (TCGA) dataset.

In certain embodiments, the method described herein is computer-implemented, i.e., the method is carried out in a computer, e.g., a computer program executed by a CPU. A computer, as used herein, refers to a device (for general or specific purposes) that can be programmed to perform a set of arithmetic or logical operations automatically. Computers, as used herein, include without limitation personal computers, workstations, servers, mainframes and supercomputers. The computer can be a stand-alone system, networked system or a virtual machine residing in a computing cloud. The methods described herein can be implemented with multithreading or other parallel computing methods.

As used herein, the term "cancer" refers to a group of diseases involving abnormal cell growth and division. In general, cancers can be categorized according to the tissue or organ from which the cancer is located or originated and morphology of cancerous tissues and cells. As used herein, cancer types include, without limitation, acute lymphoblastic leukemia (ALL), acute myeloid leukemia, adrenocortical carcinoma, anal cancer, astrocytoma, childhood cerebellar or cerebral, basal-cell carcinoma, bile duct cancer, bladder cancer, bone tumor, brain cancer, cerebellar astrocytoma, cerebral astrocytoma/malignant glioma, ependymoma, medulloblastoma, supratentorial primitive neuroectodermal tumors, visual pathway and hypothalamic glioma, breast cancer, Burkitt's lymphoma, cervical cancer, chronic lymphocytic leukemia, chronic myelogenous leukemia, colon cancer, emphysema, endometrial cancer, ependymoma, esophageal cancer, Ewing's sarcoma, retinoblastoma, gastric (stomach) cancer, glioma, head and neck cancer, heart cancer, Hodgkin lymphoma, islet cell carcinoma (endocrine pancreas), Kaposi sarcoma, kidney cancer (renal cell cancer), laryngeal cancer, leukaemia, liver cancer, lung cancer, neuroblastoma, non-Hodgkin lymphoma, ovarian cancer, pancreatic cancer, pharyngeal cancer, prostate cancer, rectal cancer, renal cell carcinoma (kidney cancer), retinoblastoma, Ewing family of tumors, skin cancer, stomach cancer, testicular cancer, throat cancer, thyroid cancer, vaginal cancer.

In certain embodiments, the cancer type described herein is colon adenocarcinoma (COAD), rectum adenocarcinoma (READ), lung adenocarcinoma (LUAD), lung squamous cell carcinoma (LUSC), head and neck squamous cell carcinoma (HNSC), liver hepatocellular carcinoma (LIHC), or pancreatic adenocarcinoma (PAAD).

The term "cancer sample" used herein encompasses any sample obtained, directly or indirectly, from a cancer patient. A sample can, by way of non-limiting example, include cerebrospinal fluid (CSF), blood, amniotic fluid, sera, urine, feces, epidermal sample, skin sample, cheek swab, sperm, amniotic fluid, cultured cells, bone marrow sample and/or chorionic villi. Cancer cell cultures can also be used as samples. A cancer sample can also be, e.g., a sample obtained from any organ or tissue (including a surgical removal, biopsy or autopsy specimen), can comprise cells (whether primary cells or cultured cells), medium conditioned by any cell, tissue or organ, tissue culture. In some embodiments, biological samples suitable for the invention are samples which have been processed to release or otherwise make available a nucleic acid for detection as described herein. Suitable biological samples may be obtained from a stage of life such as a fetus, young adult, adult (e.g., pregnant women), and the like. Fixed or frozen tissues also may be used.

In certain embodiments, the cancer sample used herein is not a cancer cell line. The term "cancer cell line" used herein refers to a population of cells isolated from a cancer patient and being cultured and immortalized in vitro such that the cells have evaded normal cellular senescence and can proliferate definitely. In certain embodiments, the cancer sample used herein is derived directly from a cancer patient, i.e., without cell culture. In certain embodiments, the cancer sample is a surgical removal sample or biopsy sample.

In certain embodiments, the cancer sample used herein is derived from a patient derived xenograft (PDX). "Patient derived xenograft," as used herein, refers to a graft of tissue or cells taken from a human patient donor, and grafted into an animal model (e.g., mouse, rat, rabbit, etc.). In some embodiments, the xenograft tissue or cells are tumor tissue or cells, or cancerous tissue or cells. In some embodiments, the xenograft is pre-treated before grafting into the animal model. The term "pre-treated" when refers to tissue, generally relates to any processing methods known in the art to treat a tissue before its engraftment, such as washing, homogenization, re-suspension and mixing with a solution (e.g., saline, PBS etc.) or a matrix (e.g., collagen). The term "pre-treated" when refers to cells, includes any processing methods known in the art to treat cells before its engraftment, such as culture, sub-culture, activating, treatment with an agent, centrifugation, re-suspension, filtration, and mixing with a solution (e.g., saline, PBS etc.) or a matrix (e.g., collagen). After grafted with xenograft, the animal model is allowed sufficient time to develop a lesion of the human disease for further use. The xenograft can be grafted to the animal model using any suitable methods known in the art, for example, by grafting cells subcutaneously, intraperitoneally, or intravenously through injection; or alternatively, by implanting a fraction of tissue through surgery. In some embodiments, the xenografts are tumor cells or cancerous cells, and are grafted to the animal model through subcutaneously injection.

In certain embodiments, the method described above further comprises diagnosing a cancer based on the expression of the pairwise DEGs. The term "diagnosing" or "diagnosis" means the identification of the nature of a disease, e.g., a cancer. The diagnosis of cancer can be carried out using the method described herein alone or in combination with other methodologies, e.g., methods based on histopathology. In one embodiment, to diagnose a cancer of a first type rather than a second type, a sample for a subject suspected of having a first cancer type is obtained. The gene expression levels of the pairwise DEGs between the first cancer type and the second cancer type are assayed, based on which whether the cancer is the first type can be determined.

In another aspect, the present disclosure provides a method comprising:

obtaining a first gene expression profile of a first cancer sample having a first cancer type;

obtaining a second gene expression profile of a second cancer sample having a second cancer type, wherein the second cancer type is different from the first cancer type;

obtaining a third gene expression profile of a third cancer sample having a third cancer type, wherein the third cancer type is different from the first and the second cancer type;

comparing said first gene expression profile with said second gene expression profile;

selecting $N_1$ genes that are most differentially expressed in the first and the second gene expression profiles to generate first pairwise DEGs, wherein $N_1$ is an integer between 10 and 100;

comparing said first gene expression profile with said third gene expression profile;

selecting $N_2$ genes that are most differentially expressed in the first and the third gene expression profiles to generate second pairwise DEGs, wherein $N_2$ is an integer between 10 and 100;

comparing said second gene expression profile with said third gene expression profile;

selecting $N_3$ genes that are most differentially expressed in the second and the third gene expression profiles to generate third pairwise DEGs, wherein $N_3$ is an integer between 10 and 100; and generating a signature genes that comprises the first, second and third pairwise DEGs.

In certain embodiments, $N_1=N_2=N_3$. In one embodiment, $N_1$, $N_2$ and $N_3$ are around 50.

In one embodiment, the signature genes are generated by combining the first, second and third pairwise DEGs. It can be understood that the first, second and third pairwise DEGs may have overlap so that the number of signature genes may be less than the sum of $N_1$, $N_2$, and $N_3$.

The method described above can be extended to analyzing data set with more than 3 cancer types. For example, for a dataset with P cancer types, n DEGs for each pairwise comparison between cancer types. In a global comparison, a total of $P(P-1)/2$ pairwise DEGs can be generated. A signature genes can be obtained by combining all $P(P-1)/2$ pairwise DEGs. The number of the signature genes is capped at $P(P-1)n/2$ but usually fewer due to overlapping of the pairwise DEGs. Samples in any cancer type pair can be distinguished by their n DEGs, while other DEGs that are capped at $(P-1)(P-2)n/2$ but usually fewer due to overlapping, can be viewed as background noise.

In certain embodiments, the signature genes have m genes, wherein m is an integer between 5 to 5000. In certain embodiments, m is between 100-1000. In certain embodiments, m is between 100-500.

In certain embodiments, the method described above further comprises diagnosing a cancer based on the expression of the signature genes. In one embodiment, to diagnose a cancer, a sample from a subject suspected of having a cancer is obtained. The expression levels of the signature genes are assayed (e.g., through gene expression profiling using microarray or RNA-seq), based on which the nature of the cancer can be identified.

In yet another aspect, the present disclosure provides a method for treating a cancer in a subject, comprising diagnosing the cancer type in the subject by the method as described herein, and administering a drug that can effectively treat the cancer type.

In yet another aspect, the present disclosure provides a method for treating a first cancer type in a subject, wherein the first cancer type has the same expression profile of pairwise DEGs as a second cancer type, the method comprising administering to the subject a drug that can effectively treat the second cancer type.

In one embodiment, the first cancer type is colon adenocarcinoma (COAD), and the second cancer type is rectum adenocarcinoma (READ). In one embodiment, the first cancer type is rectum adenocarcinoma (READ), and the second cancer type is colon adenocarcinoma (COAD).

Drugs used for treating colon cancer include without limitation, Bevacizumab (brand name AVASTIN®), Capecitabine (brand name XELODA®), Cetuximab (brand name ERBITUX®), 5-FU, Fluorouracil Injection, Irinotecan hydrochloride (brand name CAMPTOSAR®), Leucovorin Calcium, Oxaliplatin (brand name ELOXATIN®), Panitumumab (brand name VECTIBIX®), Ramucirumab (brand name CYRAMZA®), Regorafenib (brand name STIVARGA®), Trifluridine and Tipiracil hydrochloride (brand name LONSURF®), WELLCOVORIN®, Ziv-aflibercept (brand name ZATRAP®).

Drugs used for treating rectal cancer include without limitation, Bevacizumab (brand name AVASTIN®), Capecitabine (brand name XELODA®), Cetuximab (brand name ERBITUX®), 5-FU, Fluorouracil Injection, Irinotecan hydrochloride (brand name CAMPTOSAR®), Leucovorin Calcium, Oxaliplatin (brand name ELOXATIN®), Panitumumab (brand name VECTIBIX®), Ramucirumab (brand name CYRAMZA®), Regorafenib (brand name STIVARGA®), Trifluridine and Tipiracil hydrochloride (brand name LONSURF®), WELLCOVORIN®, Ziv-aflibercept (brand name ZATRAP®).

In one embodiment, the first cancer type is neck squamous cell carcinoma (HNSC), and the second cancer type is lung squamous cell carcinoma (LUSC). In one embodiment, the first cancer type is lung squamous cell carcinoma (LUSC), and the second cancer type is neck squamous cell carcinoma (HNSC).

Drugs used for treating head and neck cancer include without limitation, Bleomycin (brand name BLENOXANE®), Cetuximab (brand name ERBITUX®), Docetaxel (brand name TAXOTERE®), Hydroxyurea (brand name HYDREA®), Methotrexate (brand name ABITREXATE®, METHOTREXATE LPF™, MEXATE®, MEXATE-AQ™, FOLEX®, FOLEX PFS™), Pembrolizumab (KEYTRUDA®).

Drugs used for treating lung cancer include without limitation, Afatinib dimaleate (brand name Gilotrif®), Alectinib (brand name Alecensa®), Bevacizumab (brand name Avastin®), Carboplatin (brand name Paraplatin®), Ceritinib (brand name Zykadia®), Docetaxel (brand name Taxotere®), Erlotinib (brand name Tarceva®), Everolimus (brand name Afinitor®), Gefitinib (brand name Iressa®), Gemcitabine Hydrochloride (brand name Gemzar®), Mechlorethamine hydrochloride (brand name Mustargen®), Methotrexate (brand name Abitrexate®, Methotrexate-AQ™, Folex®, Folex PFS™), Necitumumab (brand name Portrazza®), Nivolumab (brand name Opdivo®), Osimertinib (brand name Tagrisso®), Paclitaxel (brand name Abraxane®, Taxol®), Pembrolizumab (brand name Keytruda®), Pemetrexed disoldium (brand name Alimta®), Ramucirumab (brand name Cyramza®), Vinorelbine Tartrate (brand name Navelbine®), Xalkori®.

The following examples are presented to illustrate the present invention. They are not intended to limiting in any manner.

Example 1

This example shows the expression similarity within and between histopathological cancer types.

Materials and Methods

Engraftment and Molecular Characterization of Xenograft Tissues

Methods and parameters regarding xenograftment of patient tissues (Crown Bioscience SPF facility) have been described previously (Yang M et al., "Overcoming erlotinib resistance with tailored treatment regimen in patient-derived xenografts from naive Asian NSCLC patients" International journal of cancer (2013) 132(2):E74-84; Zhang L et al., "A subset of gastric cancers with EGFR amplification and overexpression respond to cetuximab therapy" Sci Rep (2013) 3:2992; Jiang J et al., "Comprehensive characterization of chemotherapeutic efficacy on metastases in the established gastric neuroendocrine cancer patient derived xenograft model" Oncotarget (2015) 6(17):15639-51; Bladt F et al., "The c-Met Inhibitor MSC2156119J Effectively Inhibits Tumor Growth in Liver Cancer Models" Cancers (Basel) (2014) 6(3):1736-52). For transcriptome sequencing of PDX tumor tissues, snap frozen samples were used to extract RNAs per method described previously (Yang M et al., "Overcoming erlotinib resistance with tailored treatment regimen in patient-derived xenografts from naive Asian NSCLC patients" International journal of cancer (2013) 132(2):E74-84; Zhang L et al., "A subset of gastric cancers with EGFR amplification and overexpression respond to cetuximab therapy" Sci Rep (2013) 3:2992). The purity and integrity of the RNA samples were ensured by Agilent Bioanalyzer prior to RNA sequencing. Only RNA samples with RIN>7 and 28S/18S>1 were proceeded for library construction and RNA sequencing. RNA samples (mouse component <50%) were used for transcriptome sequencing by certified Illumina HiSeq platform service providers (BGI, Wuhan, China). Transcriptome sequencing was generally performed at 6 GB, PE125 on Illumina HiSeq2500 platform or equivalent. For Affymetrix U219 GeneChip profiling, RNA samples from tumors were processed and assayed as previously described (Yang M et al., "Overcoming erlotinib resistance with tailored treatment regimen in patient-derived xenografts from naive Asian NSCLC patients" International journal of cancer (2013) 132(2):E74-84; Zhang L et al., "A subset of gastric cancers with EGFR amplification and overexpression respond to cetuximab therapy" Sci Rep (2013) 3:2992). Standard immunohistochemistry (IHC) was used to analyze selected FFPE PDX tumor tissues as described previously (Yang M et al., "Overcoming erlotinib resistance with tailored treatment regimen in patient-derived xenografts from naive Asian NSCLC patients" International journal of cancer (2013) 132(2):E74-84; Zhang L et al., "A subset of gastric cancers with EGFR amplification and overexpression respond to cetuximab therapy" Sci Rep (2013) 3:2992). The antibodies used for IHC were: anti-human monoclonal antibody TTF1 (ZM-0250, mouse), CDX2 (ZA-0520, rabbit), CK7 (ZM-0071, mouse), CK20 (ZM-0075, mouse), are all from Zhongsan JinQiao, China.

TCGA Datasets and CCLE Datasets

Level 3 TCGA RNA-seq data for seven cancer types (COAD, READ, LUAD, LUSC, HNSC, LIHC, PAAD) were downloaded from the TCGA Data Portal (February 2015 Release). We only used the RNA-seq data generated by the Illumina HiSeq platform and processed by the RNAseqV2 pipeline, which used MapSplice for read alignment and RSEM for quantification. The TCGA dataset contains 285 COADs, 94 READs, 515 LUADs, 501 LUSCs, 519 HNSCs, 371 LIHCs, and 178 PAADs.

The cancer cell line gene expression data were downloaded from the CCLE data portal (October 2012 Release). The expression was profiled on Affymetrix U133Plus2 GeneChip. The raw Affymetrix CEL files were converted into gene expression values by the Robust Multi-array Average (RMA) algorithm with a custom CDF file (ENTR-EZF v15). A total of 210 cell lines were used, including 47 CRADs, 52 LUADs, 28 LUSCs, 30 HNSCs, 25 LIHCs, and 28 PAADs (Table 1).

Bioinformatics Analysis of PDX Transcriptome Sequencing Data

Gene expression in PDXs was profiled by both Affymetrix U219 GeneChip and RNA-seq per methods previously described (Yang M et al., "Overcoming erlotinib resistance with tailored treatment regimen in patient-derived xenografts from naive Asian NSCLC patients". International journal of cancer (2013) 132(2):E74-84; Chen D et al., "A set of defined oncogenic mutation alleles seems to better predict the response to cetuximab in CRC patient-derived xenograft than KRAS 12/13 mutations" Oncotarget (2015) 6(38):40815-21). The Affymetrix CEL files were processed using the same method for CCLE data. The RNA-seq raw data were first cleaned up by removing mouse reads mapped to a mouse reference genome (UCSC MM9). The average mouse content is about 10%. Gene expression was estimated using the TCGA RNAseqV2 pipeline. A total of 175 PDXs with Affymetrix U219 data were used including 58 CRADs, 11 LUADs, 40 LUSCs, 10 HNSCs, 24 LIHCs, and 32 PAADs. A total of 241 PDXs with RNA-seq data were used including 82 CRADs, 12 LUADs, 54 LUSCs, 14 HNSCs, 30 LIHCs, and 49 PAADs.

Comparison of Transcriptome Expression Datasets

The edgeR package (Robinson M D and Smyth G K, "Small-sample estimation of negative binomial dispersion, with applications to SAGE data" Biostatistics (2008) 9(2): 321-32) (version 3.10.2) from Bioconductor (version 3.1) was used to analyze the TCGA RNA-seq data. Genes with at least one count per million in at least 94 samples, the smallest of all 7 cancers, were kept. Differentially expressed genes (DEGs) were identified and ranked by the exactTest function. For the 7 TCGA cancer types, 21 pairwise comparisons were performed, and certain numbers of top DEGs were retained. Expression values of DEGs were normalized to have zero mean and unit variance, and used to calculate Pearson correlation coefficients between samples. In FIG. 1A-D, 94 samples for each of the 7 cancers in TCGA were used by random sampling. For the other 3 datasets, the expression values were normalized as well in calculating within-type and between-type Pearson correlation coefficients. All expression values were in logarithmic scale in the correlation calculation and heatmaps. Graphs in FIG. 4A-D were generated using the plotMDS function in the edgeR package (version 3.10.2), and the first two leading log-fold-changes (logFCs) were used at the 2 axes.

Results

Figure 5A:
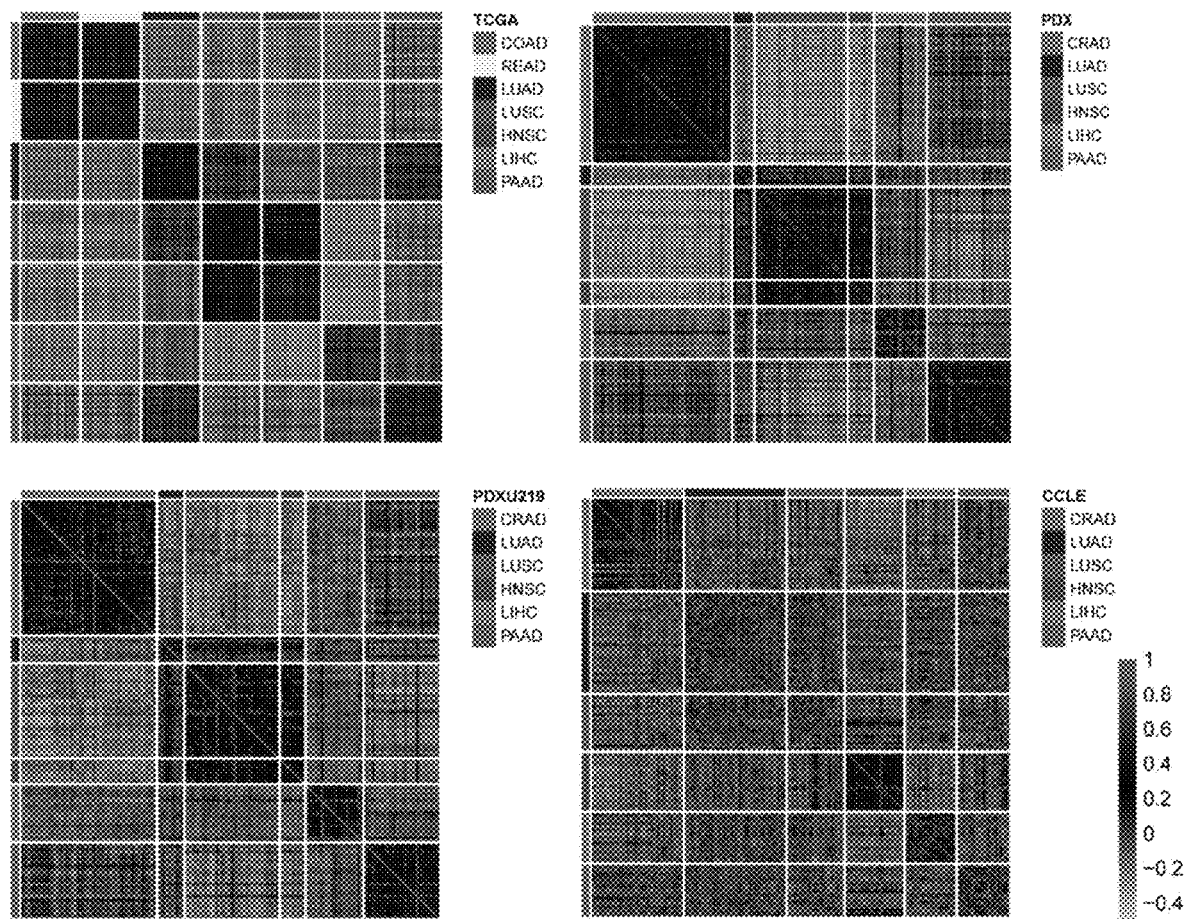
FIG. 5A illustrates the comparison of gene expression for TCGA patient samples within and between cancer types when the number of pairwise DEGs is 3000, at which there are 6651 unique genes, about one-third of genes profiled. The gene expression for TCGA patient samples was profiled by RNA-Seq, PDXs profiled by RNA-seq (PDX), PDXs profiled by microarray (PDXU219), and cancer cell lines profiled by microarray (CCLE). In the heatmaps, Pearson correlation coefficient between two samples is color coded; the length of a color bar on the top or left is proportional to sample size within a dataset.
Figure 5B:
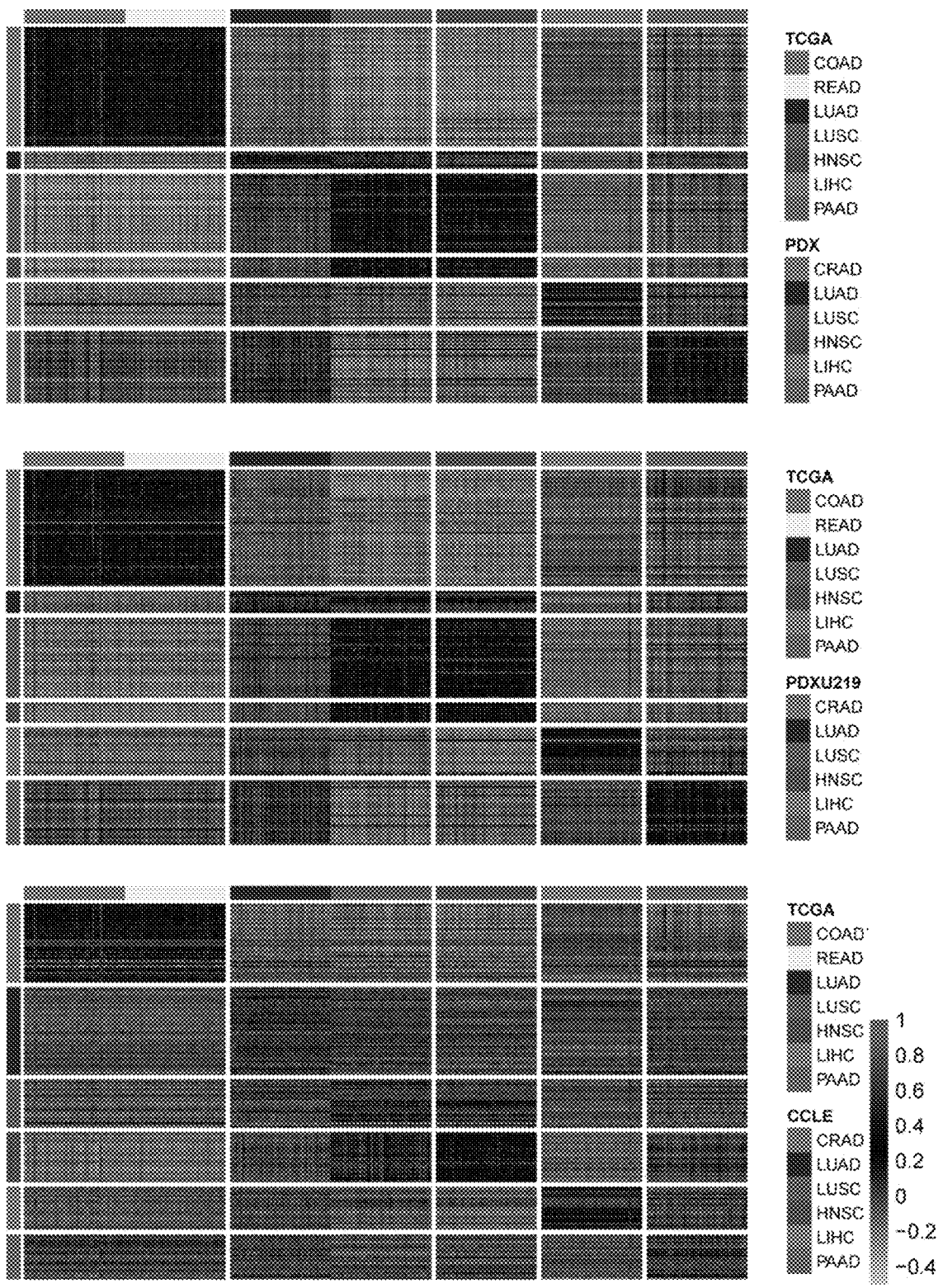
FIG. 5B illustrates the comparison of gene expression between TCGA and the other 3 datasets when the number of pairwise DEGs is 3000, at which there are 6651 unique genes, about one-third of genes profiled. In the heatmaps, Pearson correlation coefficient between two samples is color coded; the length of a color bar on the top or left is proportional to sample size within a dataset.

We set out to inquire whether cancers of the same histopathological diagnosis have similar expression profiles, as compared against different histopathology types. We examined 4 transcriptome expression datasets: a) the TCGA transcriptome sequencing (RNA-seq) dataset for patient tumor samples obtained through surgical removal or biopsy ("Comprehensive molecular characterization of gastric adenocarcinoma" Nature (2014) 513(7517):202-9; "Comprehensive genomic characterization defines human glioblastoma genes and core pathways" Nature (2008) 455 (7216):1061-8; Ge L et al., "Integrated analysis of gene expression profile and genetic variations associated with ovarian cancer" Eur Rev Med Pharmacol Sci (2015) 19(14): 2703-10); b) the RNA-seq dataset (referred to as PDX) and c) the microarray dataset (referred to as PDXU219) for patient derived xenograft of various diseases; d) the microarray dataset for cancer cell lines from the Cancer Cell Line Encyclopedia (CCLE) project (Barretina J et al., "The Cancer Cell Line Encyclopedia enables predictive modelling of anticancer drug sensitivity" Nature (2012) 483 (7391):603-7). First of all, we aimed at establishing an algorithm to define human disease types by transcriptome expression, postulating that distinct gene expression signature is the molecular hallmark of both normal and tumor tissues (or types as defined). To this end, we performed 21 pairwise comparisons of transcriptome expression for 7 TCGA cancers: colon adenocarcinoma (COAD), rectum adenocarcinoma (READ), lung adenocarcinoma (LUAD), lung squamous cell carcinoma (LUSC), head and neck squamous cell carcinoma (HNSC), liver hepatocellular carcinoma (LIHC), and pancreatic adenocarcinoma (PAAD). For each pairwise comparison, we retained the same number of the most differentially expressed genes (DEGs), ranked by p-values from the exactTest function in the edgeR package in R (see Methods). The total DEGs, by summing up from all pairwise comparisons with redundancy removal, were used to calculate the within-type (histopathology type) and between-type correlation coefficients for the TCGA dataset. The correlation coefficients were used to quantify cancer similarity (FIG. 1A). A total of 686 genes, which is the non-redundant set when the number of pairwise DEGs is 50, are used in the illustration in FIG. 1A-D. The similarity patterns hold true for other numbers of DEGs, up to whole transcriptome (FIG. 5A-B). This pairwise comparison approach is intended to minimize bias toward certain cancer types, as opposed to the methods that select genes by simultaneous-comparing all cancer types, e.g. one-way ANOVA.

Figure 2A:
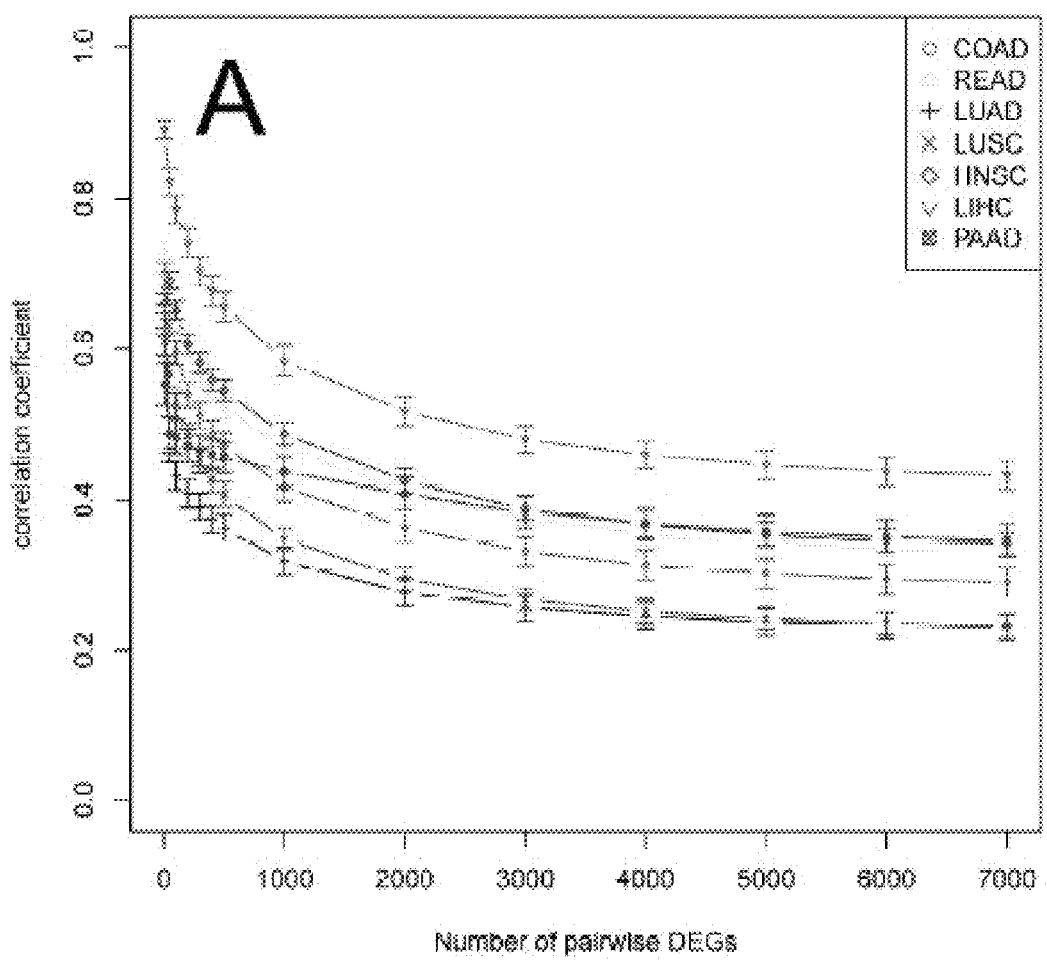
FIG. 2A illustrates the gene expression similarity within each cancer type at different numbers of pairwise DEGs in TCGA dataset. For each cancer type in the dataset, Pearson correlation coefficients for all pairs of samples were calculated based on the normalized gene expression values. Values are the mean and SEM.
Figure 6:
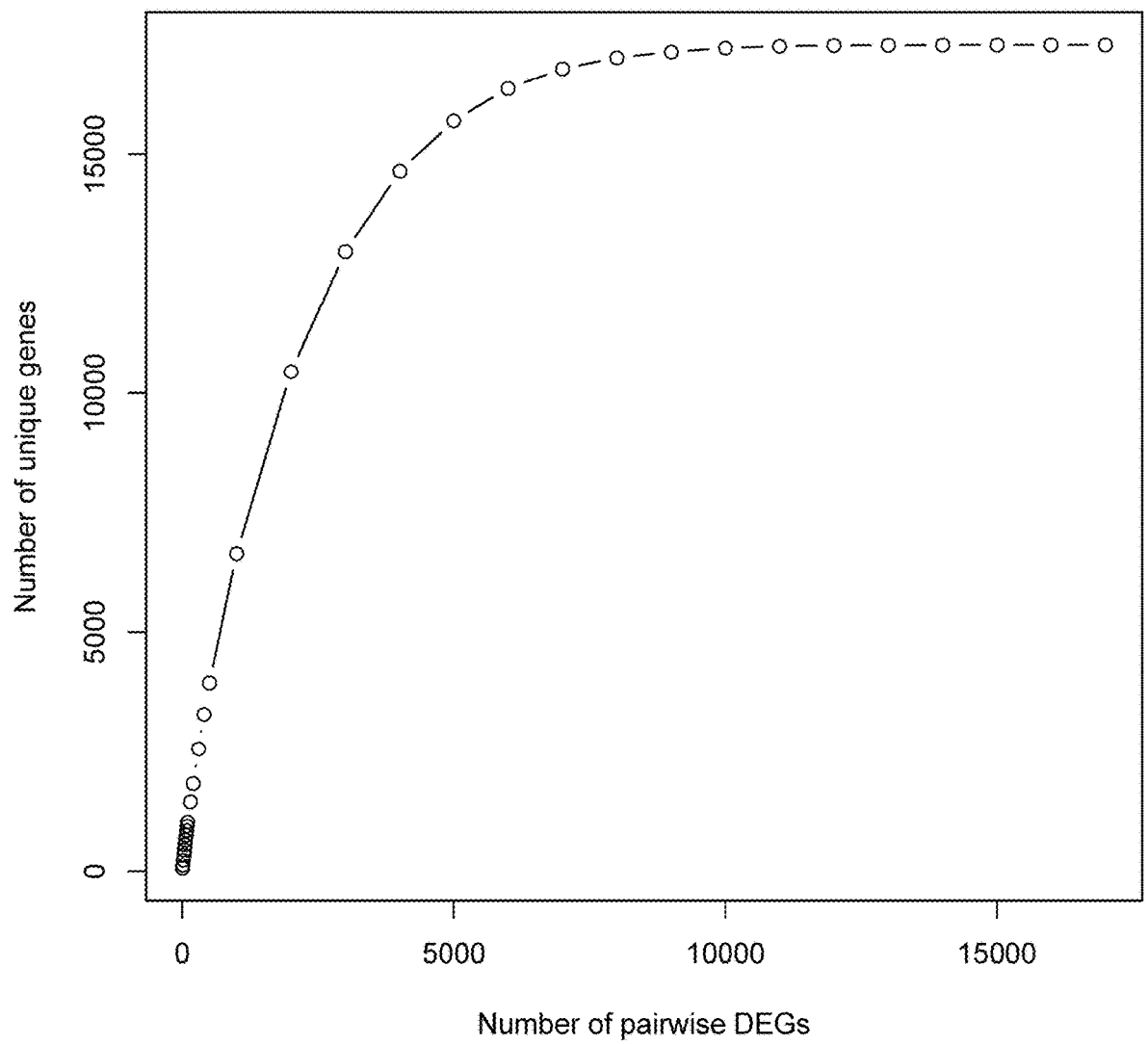
FIG. 6 illustrates the relationship between number of unique genes and number of pairwise DEGs in the TCGA dataset. When the number of pairwise DEGs is 50, there are 686 unique genes. When the number of pairwise DEGs reaches 7000, there are 16798 unique genes, about 97.1% of the 17288 genes eligible for pairwise comparisons in the TCGA dataset.

We observed that the within-type correlation coefficients initially decrease rapidly then stabilize for all cancer types in TCGA as the number of DEGs increases (FIG. 2A), because relatively few new genes are added at high numbers of DEGs (FIG. 6). When the number of pairwise DEGs reaches 7000, there are 16798 unique genes, about 97.1% of the 17288 genes eligible for pairwise comparison in the TCGA dataset. The relatively high within-type coefficients (as opposed to between-type coefficients, see below) demonstrate cancer type specificity, which is largely in accordance with histopathology classification. Meanwhile, the within-type correlation coefficients at any given DEGs vary among cancer types, reflecting their different degree of homogeneity. For example, LIHC seems to be much more homogeneous than other types.

Figure 2B:
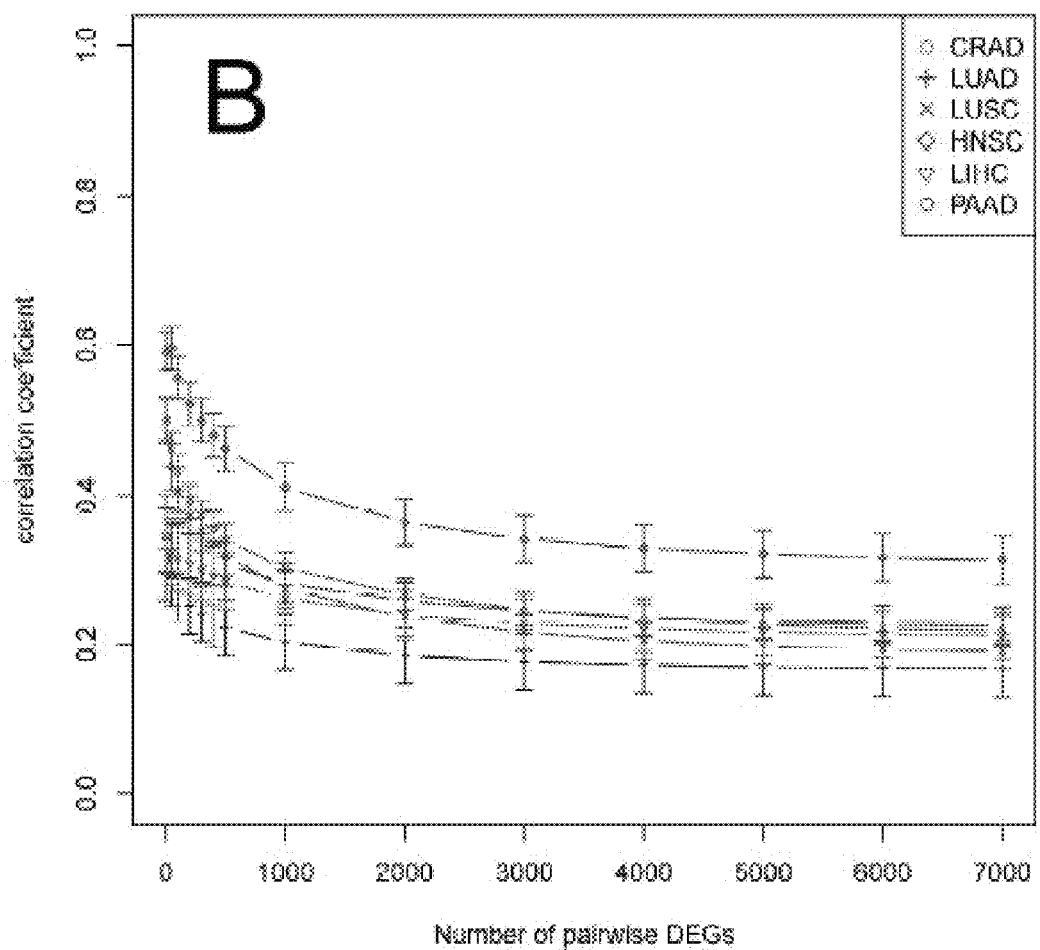
FIG. 2B illustrates the gene expression similarity within each cancer type at different numbers of pairwise DEGs in PDX dataset. For each cancer type in the dataset, Pearson correlation coefficients for all pairs of samples were calculated based on the normalized gene expression values. Values are the mean and SEM.
Figure 2C:
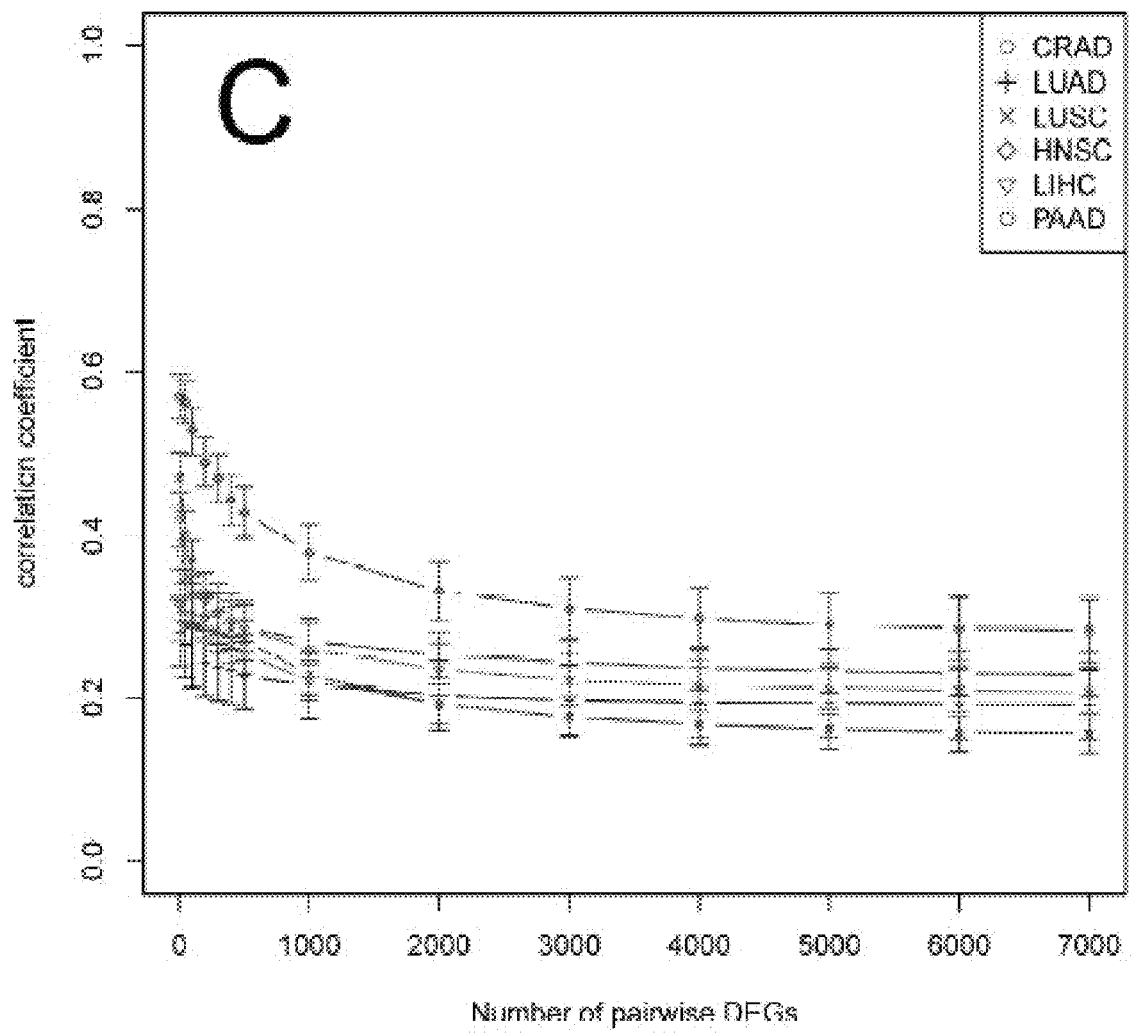
FIG. 2C illustrates the gene expression similarity within each cancer type at different numbers of pairwise DEGs in PDXU219 dataset. For each cancer type in the dataset, Pearson correlation coefficients for all pairs of samples were calculated based on the normalized gene expression values. Values are the mean and SEM.

Patient derived xenograft diseases are largely reflective of original patient diseases per histopathology, cell types, differentiation phenotypes (Tentler J J et al., "Patient-derived tumour xenografts as models for oncology drug development" Nat Rev Clin Oncol (2012) 9(6):338-50; Ding L et al., "Genome remodelling in a basal-like breast cancer metastasis and xenograft" Nature (2010) 464(7291):999-1005; Yang M et al., "Overcoming erlotinib resistance with tailored treatment regimen in patient-derived xenografts from naive Asian NSCLC patients". International journal of cancer (2013) 132(2):E74-84; Zhang L et al., "A subset of gastric cancers with EGFR amplification and overexpression respond to cetuximab therapy". Sci Rep (2013) 3:2992; Akashi Y et al., "Histological advantages of the tumor graft: a murine model involving transplantation of human pancreatic cancer tissue fragments" Pancreas (2013) 42(8):1275-82), and also per molecular pathology as reported in a number of isolated studies (Tentler J J et al., "Patient-derived tumour xenografts as models for oncology drug development" Nat Rev Clin Oncol (2012) 9(6):338-50; Ding L et al., "Genome remodelling in a basal-like breast cancer metastasis and xenograft" Nature (2010) 464(7291):999-1005). To systematically investigate such relevance, we subsequently performed the correlation coefficient calculation for PDX (RNA-seq) and PDXU219 datasets (Yang M et al., "Overcoming erlotinib resistance with tailored treatment regimen in patient-derived xenografts from naive Asian NSCLC patients". International journal of cancer (2013) 132(2):E74-84; Zhang L et al., "A subset of gastric cancers with EGFR amplification and overexpression respond to cetuximab therapy". Sci Rep (2013) 3:2992) using the same DEGs derived from above TCGA pairwise comparisons. We made several observations (FIG. 2B, 2C): 1) In both datasets, we also observed an initial rapid decline in correlation coefficients, parallel to TCGA, with the increase in DEGs for all cancer types. This parallelism suggests that the same DEGs can also describe the cancer type specificity in PDXs as seen in TCGA, and thus shows the similarity between TCGA and PDX. 2) The overall values of correlation coefficient in PDXs are lower than those of TCGA and may be attributed to the two factors: PDXs lost some tumor specificity (further discussed below), and TCGA-centric approach likely leads to lower values in PDXs, especially at low numbers of DEGs. 3) The within-type correlation coefficients at any given DEGs vary significantly among PDX cancer types as well, reflecting different degree of homogeneity, as seen in TCGA. In particular, they may vary in values not in concordance with those in TCGA. For example, HNSC, but not LIHC, has the highest within-type correlation in PDXs. This suggests that a same cancer type can have different homogeneity in PDXs than in human, and such difference may be reflective of how far away PDXs have drifted from human tumors. But it may also be attributed to small sample sizes of HNSC PDXs (10 in the PDXU219 dataset and 14 in the PDX dataset). 4) It is worth noting that PDXU219 and PDX (RNA-seq) are almost parallel to each other with similar correlation coefficient values, implying a near equivalence of the two expression profiling approaches (FIG. 3). Overall, our observations agree with anecdotal reports that PDXs have similar molecular profiles as the tumors from which they were derived (5,6).

Figure 2D:
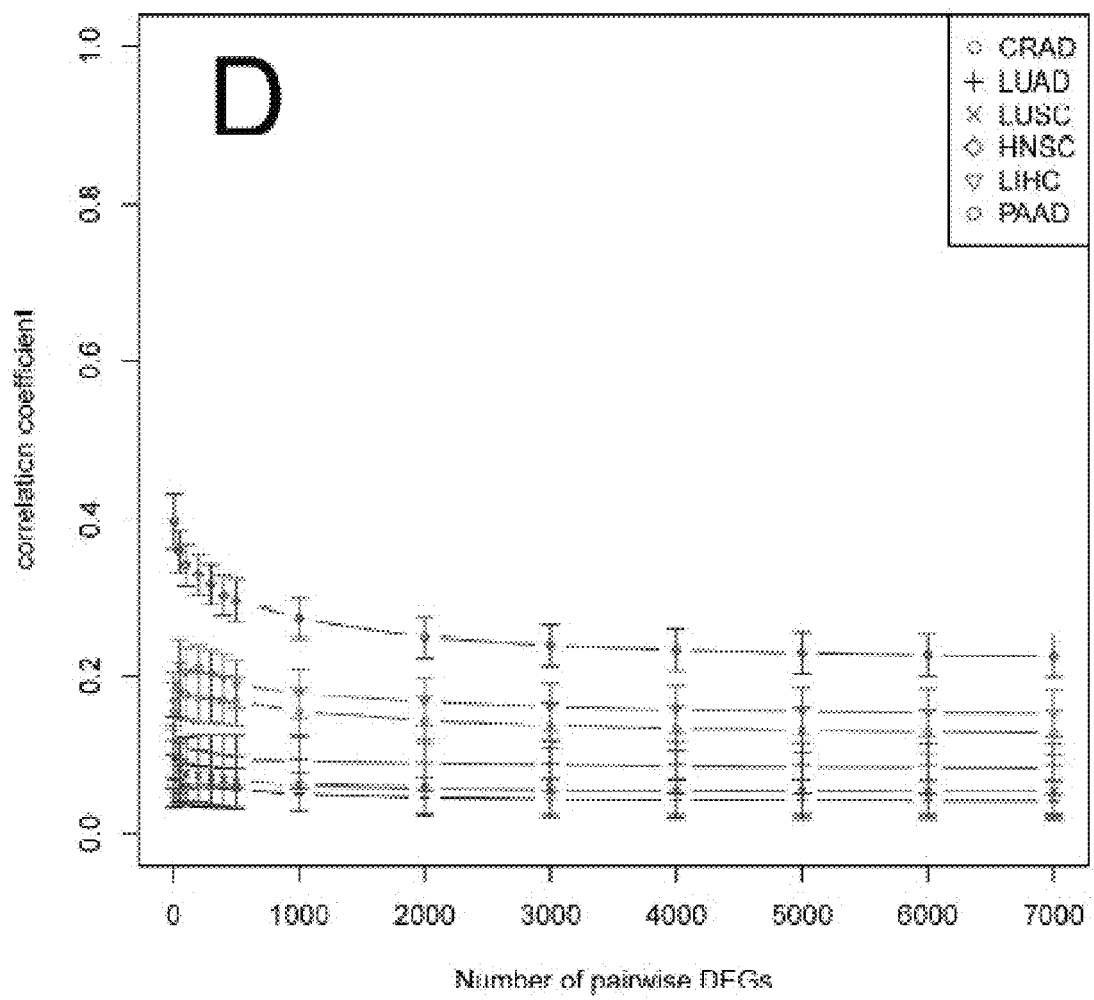
FIG. 2D illustrates the gene expression similarity within each cancer type at different numbers of pairwise DEGs in CCLE dataset. For each cancer type in the dataset, Pearson correlation coefficients for all pairs of samples were calculated based on the normalized gene expression values. Values are the mean and SEM.

Traditional cancer cell lines immortally grow in plastic flasks, usually clonally and with uniform morphology of undifferentiated phenotype. Many can grow in xenografts, but with compact and homogeneous morphology of little differentiation, which are all in sharp contrast to PDX. Therefore, they have been considered less relevant to human cancers, as compared to PDXs (5). Similarly, we also performed the within-type correlation coefficient calculation for the CCLE dataset. Interestingly, we barely observed any parallel decline of coefficients with the increase of DEGs for all cancer types except HNSC, suggesting the selected DEGs from TCGA have little relevance in CCLE (FIG. 2D). Furthermore, the within-type correlation coefficients are significantly lower in CCLE than in TCGA, PDX and PDXU219 (FIG. 3). It is unlikely that such decrease can be attributed to the TCGA-centric approach. The poor cancer type specificity observed in CCLE is consistent with the notion that cell lines deviate quite away from human cancers, both histopathologically and molecular pathologically. However, the within-type correlation coefficients, although low in general, do vary by types. For instance, HNSC cell lines show relatively higher coefficients (FIG. 2D). In summary, at any number of DEGs, the within-type correlation coefficients are highest in the TCGA dataset, lowest in the CCLE dataset, and intermediate yet close in the PDX and PDXU219 datasets.

Figure 3A:
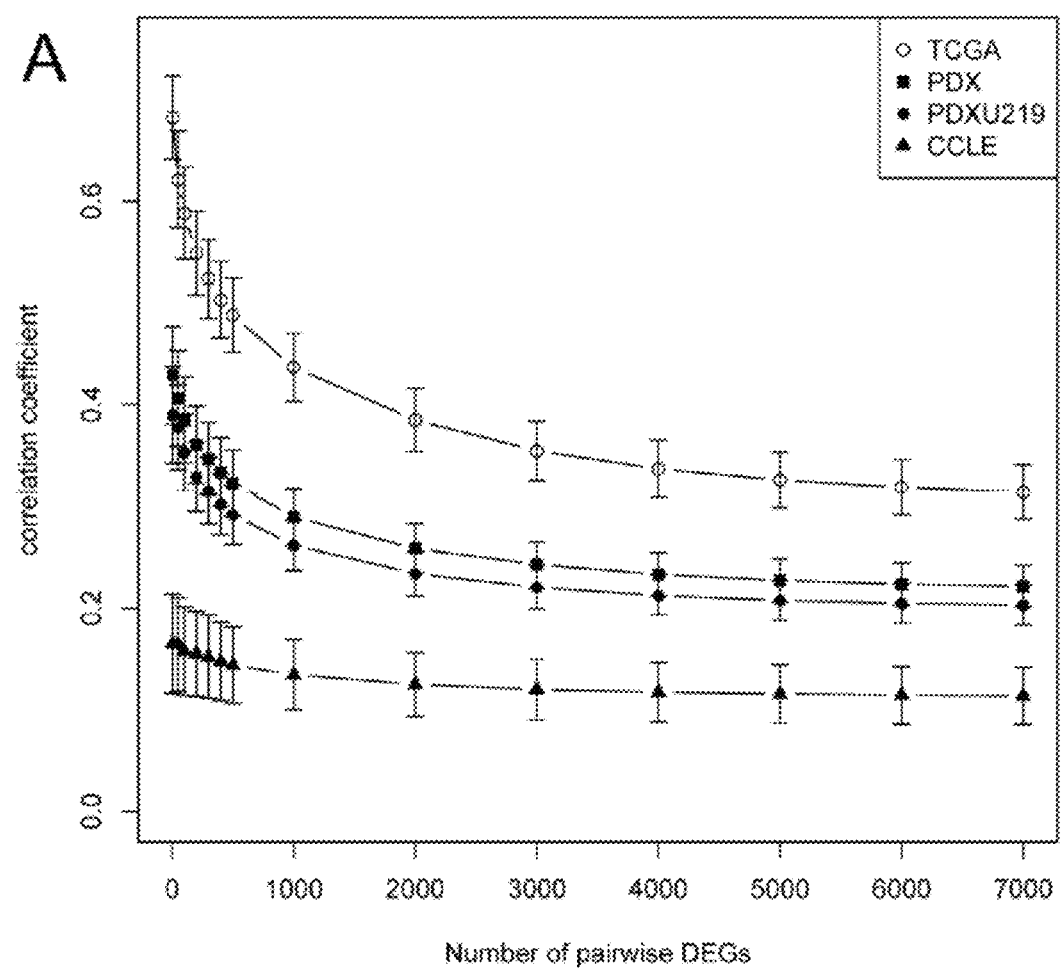
FIG. 3A illustrates the average within-type gene expression similarity at different numbers of pairwise DEGs in 4 datasets. Pearson correlation coefficients for all pairs of samples within the same cancer type in a dataset were calculated. Normalized gene expression values were used in calculations. Values are the mean and SEM.
Figure 3B:
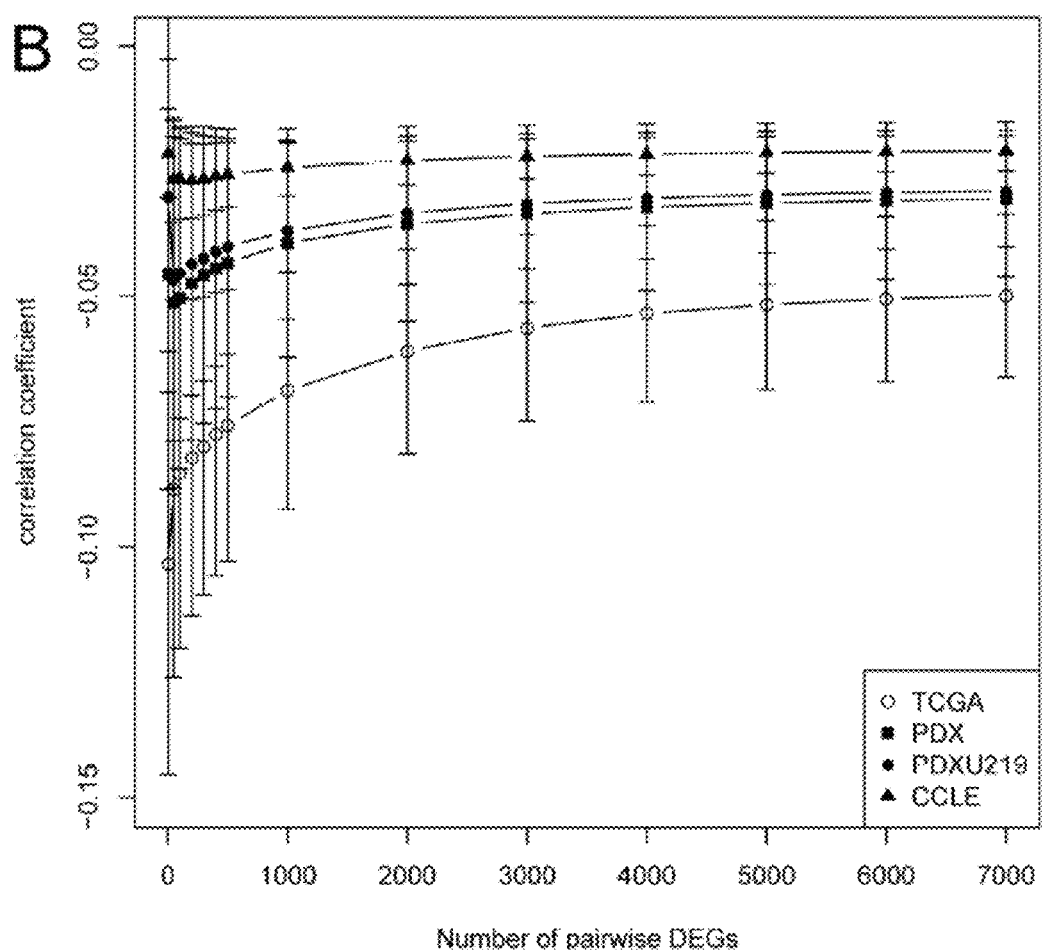
FIG. 3B illustrates the average between-type gene expression similarity at different numbers of pairwise DEGs in 4 datasets. Pearson correlation coefficients for all pairs of samples belonging to different cancer types in a dataset were calculated. Normalized gene expression values were used in calculations. Values are the mean and SEM.

Next, we performed the between-type correlation coefficient calculation using the same DEGs. We found that the coefficients are all negative and close to zero, reflecting that generally little similarity exists between different cancer types in all 4 datasets. Analogous to the within-type correlation, TCGA has the largest absolute values of correlation coefficient which exhibit an initial decline, PDX and PDXU219 have the intermediate values with parallel decline, while in CCLE, the values are smallest and flat (FIGS. 3A and 3B). In conclusion, patient tumors have the most pronounced cancer type specific gene expression profiles, and in general, have high correlation among the same histological cancer types. Patient derived xenografts (subcutaneously engrafted tumors) still maintain reasonable specificity, although not to the extent of human tumors, and are markedly better than cancer cell lines. With all the above analyses, we established a good degree of equivalence between two diagnosis methods, one based on histological morphology and tumor origin, and the other on transcriptome expression.

Example 2

This example illustrates the expression similarity between different cancer types and dissimilarity within same types.

The methods and materials are described in EXAMPLE 1.

Besides the within-type correlation and low between-type correlation in general as demonstrated in EXAMPLE 1, we also made some other interesting observations from patient tumors and PDXs (FIG. 1A-1D). First, colon adenocarcinoma (COAD) and rectum adenocarcinoma (READ) are virtually indistinguishable, suggesting that they could be essentially the same disease. Second, lung adenocarcinoma (LUAD) and lung squamous cell carcinoma (LUSC) have quite distinctive expression profiles even though both belong to non-small-cell lung carcinoma (NSCLC), consistent with fact that they have distinct morphology and pathogenesis. Third, HNSC is highly similar to LUSC by expression profiles, in accordance with the reported results in patient samples (Hoadley K A et al., "Multiplatform analysis of 12 cancer types reveals molecular classification within and across tissues of origin" Cell (2014) 158(4):929-44). It would be interesting to investigate the shared pathogenesis between these two squamous cell carcinomas.

Such observations again demonstrate the close relevance of PDX to human tumors. In contrast, in the CCLE dataset, LUAD and LUSC are not separable from each other. In fact, they have the lowest within-type correlation coefficients, being 0.067 and 0.080 when the number of pairwise DEGs is 50. Our pathology examination of lung cell line derived xenografts did not show morphological correlation within LUAD cell lines (e.g. A459, NCI-H1975, LU0682, LU6912, data not shown) and within LUSC cell lines (LU0357, data not shown). In the CCLE dataset, we did not observe high similarity between HNSC and LUSC, their between-type correlation coefficient is only 0.052 when the number of pairwise DEGs is 50, while at which the within-type correlation coefficient for HNSC is 0.36.

Example 3

This example illustrates the molecular pathology signature derived from TCGA for cancer classification.

The materials and methods are described in EXAMPLE 1.

Figure 4A:
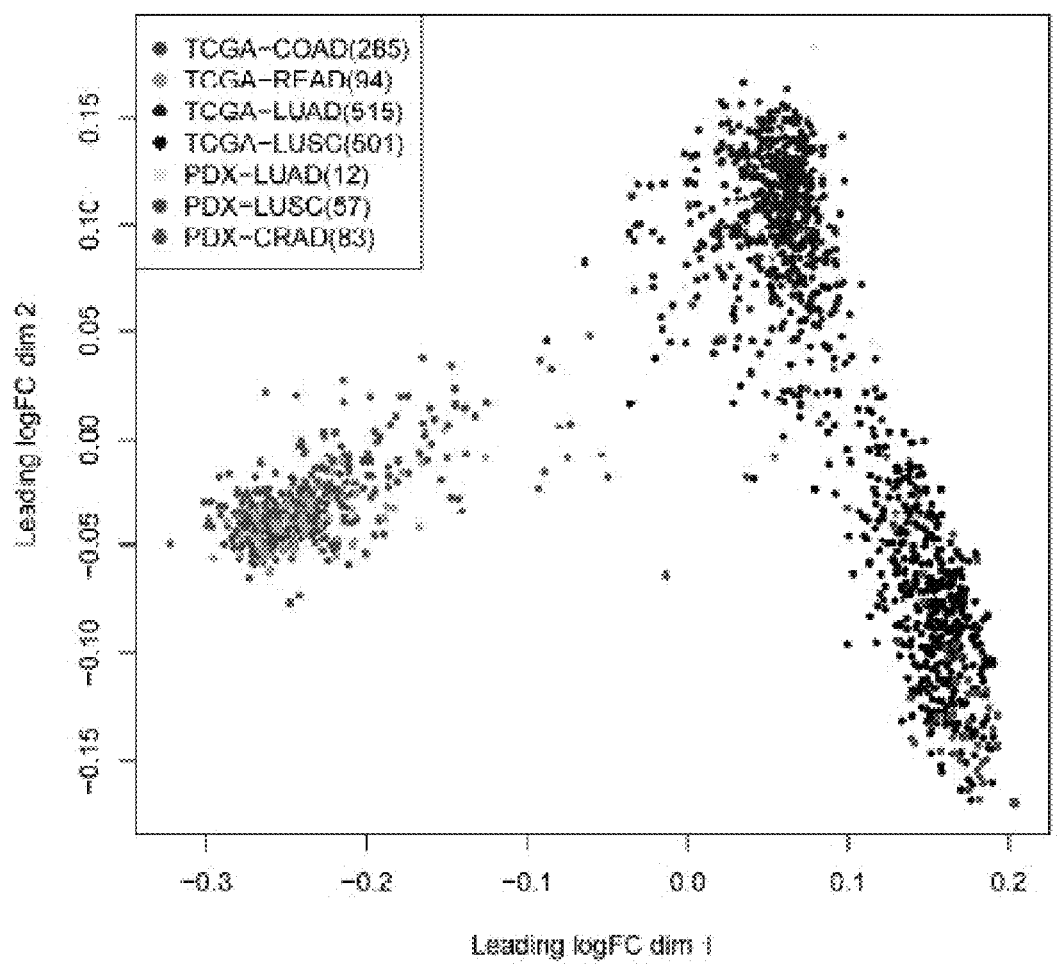
FIG. 4A illustrates multidimensional scaling (MDS) plots of colorectal cancer and lung cancer samples in TCGA and PDX. In the PDX dataset, 4 misclassified samples are labeled. Numbers in parenthesis are sample sizes. The MDS plots use 188 genes when the number of pairwise DEGs is 50. LogFC stands for log-fold-change. The first two leading logFCs were used at the two axes.
Figure 4B:
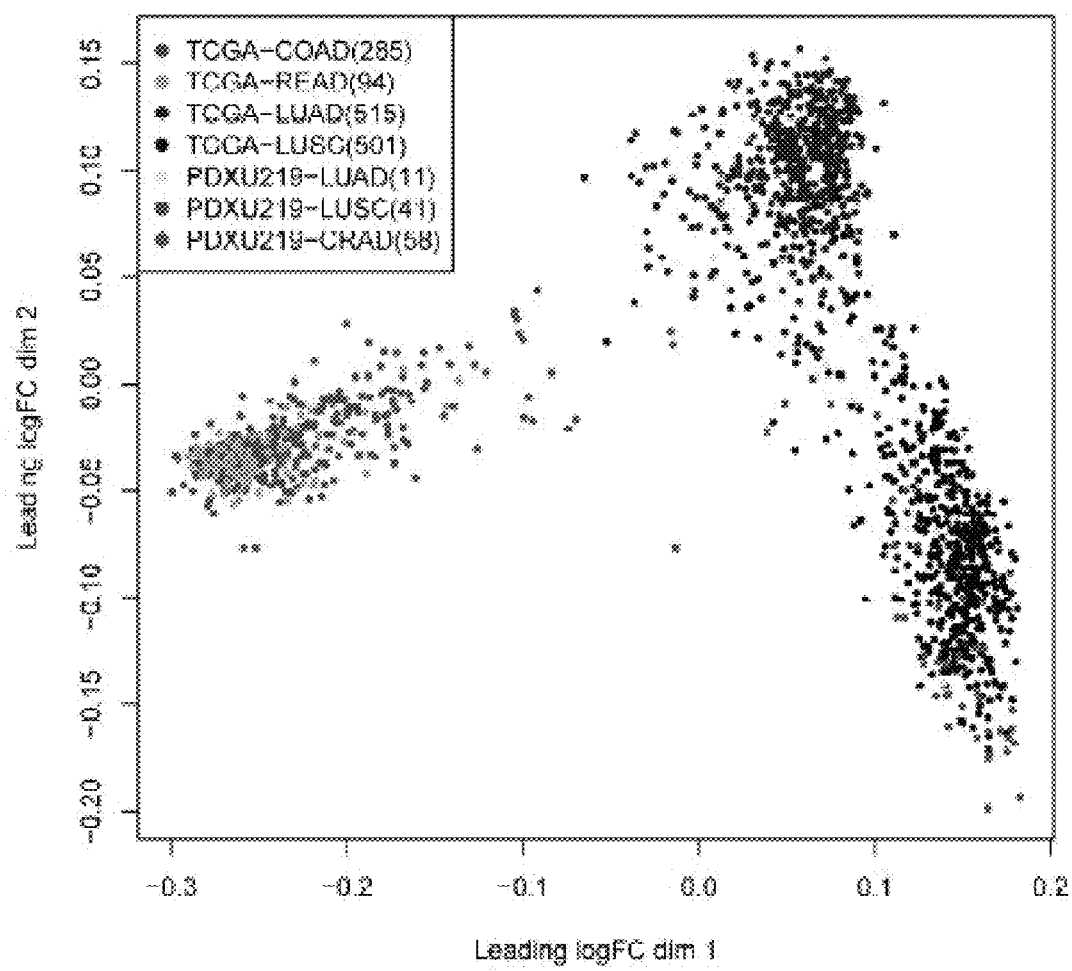
FIG. 4B illustrates multidimensional scaling (MDS) plots of colorectal cancer and lung cancer samples in TCGA and PDXU219. In the PDX dataset, 4 misclassified samples are labeled. Numbers in parenthesis are sample sizes. The MDS plots use 188 genes when the number of pairwise DEGs is 50. LogFC stands for log-fold-change. The first two leading logFCs were used at the two axes.
Figure 4C:
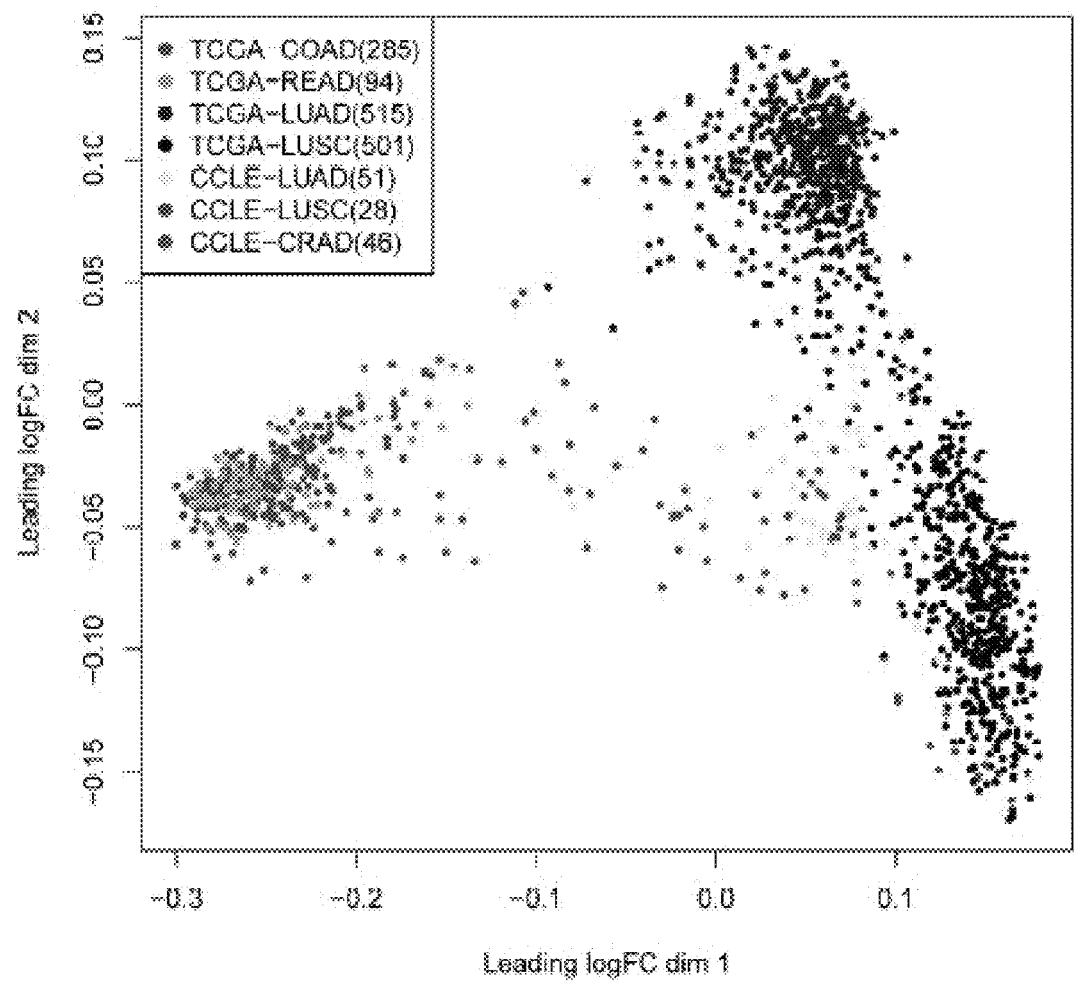
FIG. 4C illustrates multidimensional scaling (MDS) plots of colorectal cancer and lung cancer samples in TCGA and CCLE. In the PDX dataset, 4 misclassified samples are labeled. Numbers in parenthesis are sample sizes. The MDS plots use 188 genes when the number of pairwise DEGs is 50. LogFC stands for log-fold-change. The first two leading logFCs were used at the two axes.

By using the DEGs derived from the pairwise comparisons between TCGA cancer types, we can classify and diagnose malignant diseases of unknown cancer type for both human tumors and PDXs, but unlikely for cell lines. Results from this molecular pathology approach are in good agreement with traditional histopathology, thus forming the basis of a new molecular diagnosis. As an example, we used 188 signature genes from the pairwise comparisons of 4 TCGA cancers (LUAD, LUSC, COAD, and READ) by setting pairwise DEGs to 50. By design and as expected, these signature genes distinguish colorectal cancers from lung cancers in TCGA (FIG. 4A). When applied to both PDX and PDXU219 datasets, we observed that the colorectal PDXs and lung PDXs are clustered with corresponding TCGA cancer samples (FIGS. 4A and 4B). However, in the CCLE dataset, the 3 cancers (CRAD, LUAD, and LUSC) do not show good separation, and they seem to form a widespread cluster by themselves between the TCGA lung cancer and colorectal cancer samples (FIG. 4C). Because both PDXU219 and CCLE were profiled by Affymetrix microarrays, it is unlikely that the dislocation of CCLE samples is a technical artifact, but rather reflective of their transcriptome expression drift from both human and PDX tumors.

Figure 4D:
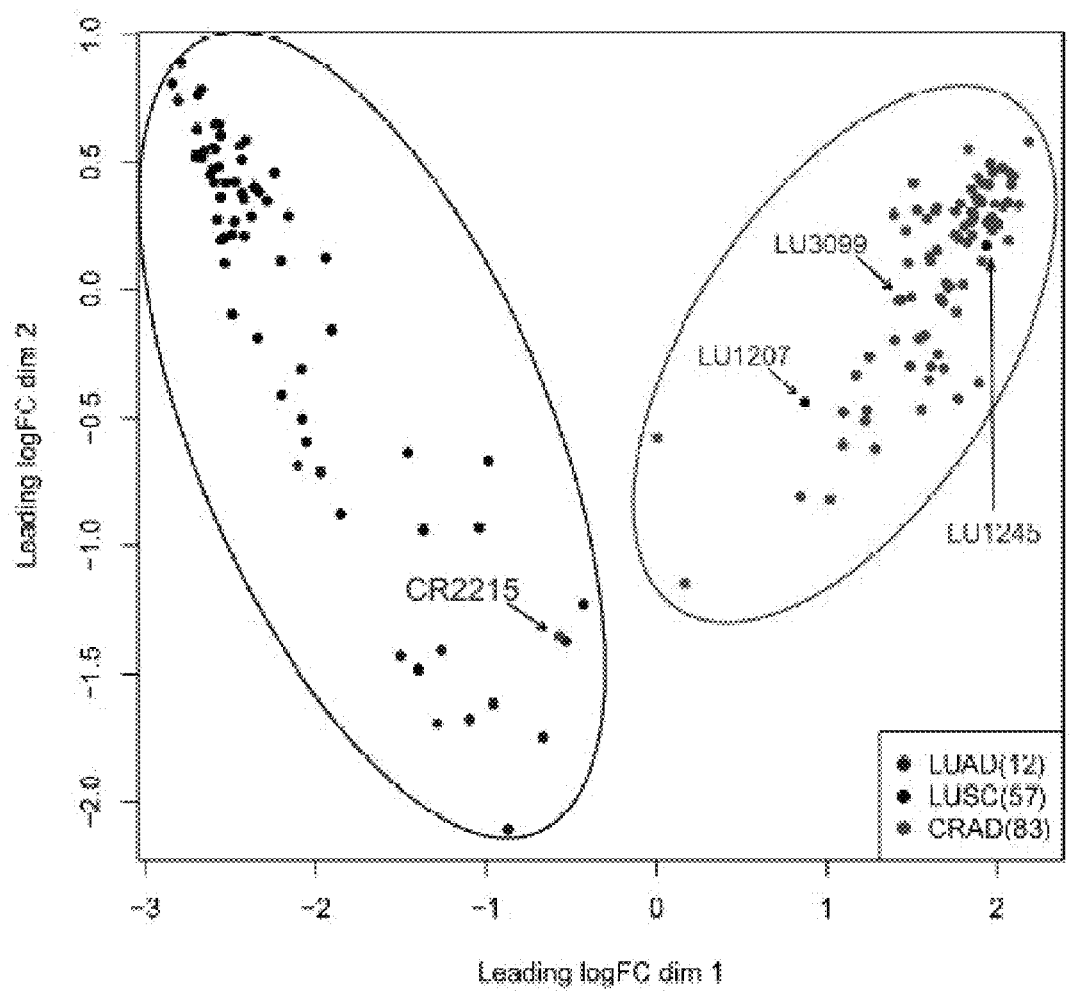
FIG. 4D illustrates multidimensional scaling (MDS) plots of colorectal cancer and lung cancer samples in PDX. In the PDX dataset, 4 misclassified samples are labeled. Numbers in parenthesis are sample sizes. The MDS plots use 188 genes when the number of pairwise DEGs is 50. LogFC stands for log-fold-change. The first two leading logFCs were used at the two axes.

To demonstrate the classification power of our method, we applied the signature DEGs to the PDX dataset and plot the samples by datasets. Again, we observed a clear separation of cancer types (FIG. 4D). We also saw 4 outliers, a colorectal PDX model (CR2215) in the lung cancer group and 3 lung cancer PDX models (LU1207, LU1245, LU3099) in the colorectal cancer group. We performed immunochemistry (IHC) analysis using tissue specific biomarkers (Table 2-3) to confirm their identity. The IHC results demonstrated that the 3 misclassified lung cancer models are indeed colorectal adenocarcinoma (CRAD). The only misclassified CRAD is in fact pancreatic adenocarcinoma (PAAD). Our current interpretation is that the original hospital diagnosis was wrong. Although LU1245, LU3099, and LU1207 were derived from tumors taken from lung and with adenocarcinoma morphology, they were actually the metastasis from primary CRAD. Prior histopathology was not able to identify them correctly since they are all adenocarcinoma with similar morphology.

Our DEG-based method can be used to build machine learning classifiers to diagnose tumors. To illustrate this, we randomly partitioned the 2463 TCGA patient samples into a train dataset and a validation dataset with an 80:20 split ratio. A support vector machine (SVM) based on the 686

DEGs was trained in the train dataset with 5-fold cross-validations, and then tested in the validation dataset. The partition and subsequent processes were repeated 10 times. In both cross validations and test dataset evaluation, the SVM consistently achieved ~98% accuracy if COAD and ROAD samples were treated as the same disease.

TABLE 1

Cell lines used in the analysis

| Cell Line | Cancer_Type | Subtype2 | Classification |
|---|---|---|---|
| CALU3_LUNG | lung | adenocarcinoma | LUAD |
| CORL105_LUNG | lung | adenocarcinoma | LUAD |
| DFCI024_LUNG | lung | adenocarcinoma | LUAD |
| DV90_LUNG | lung | adenocarcinoma | LUAD |
| HCC1833_LUNG | lung | adenocarcinoma | LUAD |
| HCC2108_LUNG | lung | adenocarcinoma | LUAD |
| HCC2279_LUNG | lung | adenocarcinoma | LUAD |
| HCC364_LUNG | lung | adenocarcinoma | LUAD |
| HCC4006_LUNG | lung | adenocarcinoma | LUAD |
| HCC44_LUNG | lung | adenocarcinoma | LUAD |
| HCC78_LUNG | lung | adenocarcinoma | LUAD |
| HCC827GR5_LUNG | lung | adenocarcinoma | LUAD |
| HCC827_LUNG | lung | adenocarcinoma | LUAD |
| HLC1_LUNG | lung | adenocarcinoma | LUAD |
| HS229T_LUNG | lung | adenocarcinoma | LUAD |
| HS618T_LUNG | lung | adenocarcinoma | LUAD |
| LXF289_LUNG | lung | adenocarcinoma | LUAD |
| MORCPR_LUNG | lung | adenocarcinoma | LUAD |
| NCIH1355_LUNG | lung | adenocarcinoma | LUAD |
| NCIH1373_LUNG | lung | adenocarcinoma | LUAD |
| NCIH1395_LUNG | lung | adenocarcinoma | LUAD |
| NCIH1437_LUNG | lung | adenocarcinoma | LUAD |
| NCIH1563_LUNG | lung | adenocarcinoma | LUAD |
| NCIH1573_LUNG | lung | adenocarcinoma | LUAD |
| NCIH1623_LUNG | lung | adenocarcinoma | LUAD |
| NCIH1648_LUNG | lung | adenocarcinoma | LUAD |
| NCIH1651_LUNG | lung | adenocarcinoma | LUAD |
| NCIH1693_LUNG | lung | adenocarcinoma | LUAD |
| NCIH1703_LUNG | lung | adenocarcinoma | LUAD |
| NCIH1734_LUNG | lung | adenocarcinoma | LUAD |
| NCIH1755_LUNG | lung | adenocarcinoma | LUAD |
| NCIH1792_LUNG | lung | adenocarcinoma | LUAD |
| NCIH2009_LUNG | lung | adenocarcinoma | LUAD |
| NCIH2023_LUNG | lung | adenocarcinoma | LUAD |
| NCIH2073_LUNG | lung | adenocarcinoma | LUAD |
| NCIH2085_LUNG | lung | adenocarcinoma | LUAD |
| NCIH2087_LUNG | lung | adenocarcinoma | LUAD |
| NCIH2122_LUNG | lung | adenocarcinoma | LUAD |
| NCIH2126_LUNG | lung | adenocarcinoma | LUAD |
| NCIH2228_LUNG | lung | adenocarcinoma | LUAD |
| NCIH2291_LUNG | lung | adenocarcinoma | LUAD |
| NCIH2342_LUNG | lung | adenocarcinoma | LUAD |
| NCIH2347_LUNG | lung | adenocarcinoma | LUAD |
| NCIH2405_LUNG | lung | adenocarcinoma | LUAD |
| NCIH322_LUNG | lung | adenocarcinoma | LUAD |
| NCIH3255_LUNG | lung | adenocarcinoma | LUAD |
| NCIH441_LUNG | lung | adenocarcinoma | LUAD |
| NCIH854_LUNG | lung | adenocarcinoma | LUAD |
| RERFLCAD1_LUNG | lung | adenocarcinoma | LUAD |
| RERFLCAD2_LUNG | lung | adenocarcinoma | LUAD |
| SKLU1_LUNG | lung | adenocarcinoma | LUAD |
| VMRCLCD_LUNG | lung | adenocarcinoma | LUAD |
| CALU1_LUNG | lung | squamous_cell_carcinoma | LUSC |
| EBC1_LUNG | lung | squamous_cell_carcinoma | LUSC |
| EPLC272H_LUNG | lung | squamous_cell_carcinoma | LUSC |
| HARA_LUNG | lung | squamous_cell_carcinoma | LUSC |
| HCC1588_LUNG | lung | squamous_cell_carcinoma | LUSC |
| HCC15_LUNG | lung | squamous_cell_carcinoma | LUSC |
| HCC1897_LUNG | lung | squamous_cell_carcinoma | LUSC |
| HCC2814_LUNG | lung | squamous_cell_carcinoma | LUSC |
| HCC95_LUNG | lung | squamous_cell_carcinoma | LUSC |
| HLFA_LUNG | lung | squamous_cell_carcinoma | LUSC |
| KNS62_LUNG | lung | squamous_cell_carcinoma | LUSC |
| LC1F_LUNG | lung | squamous_cell_carcinoma | LUSC |
| LC1SQSF_LUNG | lung | squamous_cell_carcinoma | LUSC |
| LK2_LUNG | lung | squamous_cell_carcinoma | LUSC |
| LOUNH91_LUNG | lung | squamous_cell_carcinoma | LUSC |
| LUDLU1_LUNG | lung | squamous_cell_carcinoma | LUSC |
| NCIH1385_LUNG | lung | squamous_cell_carcinoma | LUSC |
| NCIH1869_LUNG | lung | squamous_cell_carcinoma | LUSC |
| NCIH2170_LUNG | lung | squamous_cell_carcinoma | LUSC |
| NCIH226_LUNG | lung | squamous_cell_carcinoma | LUSC |
| NCIH520_LUNG | lung | squamous_cell_carcinoma | LUSC |
| RERFLCAI_LUNG | lung | squamous_cell_carcinoma | LUSC |
| RERFLCSQ1_LUNG | lung | squamous_cell_carcinoma | LUSC |
| SKMES1_LUNG | lung | squamous_cell_carcinoma | LUSC |
| SQ1_LUNG | lung | squamous_cell_carcinoma | LUSC |
| SW1573_LUNG | lung | squamous_cell_carcinoma | LUSC |
| SW900_LUNG | lung | squamous_cell_carcinoma | LUSC |
| VMRCLCP_LUNG | lung | squamous_cell_carcinoma | LUSC |
| C2BBE1_LARGE_INTESTINE | large_intestine | adenocarcinoma | CRAD |
| CCK81_LARGE_INTESTINE | large_intestine | adenocarcinoma | CRAD |
| CL11_LARGE_INTESTINE | large_intestine | adenocarcinoma | CRAD |
| CL34_LARGE_INTESTINE | large_intestine | adenocarcinoma | CRAD |
| COLO201_LARGE_INTESTINE | large_intestine | adenocarcinoma | CRAD |
| COLO205_LARGE_INTESTINE | large_intestine | adenocarcinoma | CRAD |
| COLO320_LARGE_INTESTINE | large_intestine | adenocarcinoma | CRAD |
| COLO678_LARGE_INTESTINE | large_intestine | adenocarcinoma | CRAD |
| DLD1_LARGE_INTESTINE | large_intestine | adenocarcinoma | CRAD |
| GP2D_LARGE_INTESTINE | large_intestine | adenocarcinoma | CRAD |
| HCC56_LARGE_INTESTINE | large_intestine | adenocarcinoma | CRAD |
| HCT15_LARGE_INTESTINE | large_intestine | adenocarcinoma | CRAD |
| HCT8_LARGE_INTESTINE | large_intestine | adenocarcinoma | CRAD |
| HRT18_LARGE_INTESTINE | large_intestine | adenocarcinoma | CRAD |
| HS255T_LARGE_INTESTINE | large_intestine | adenocarcinoma | CRAD |
| HS698T_LARGE_INTESTINE | large_intestine | adenocarcinoma | CRAD |

TABLE 1-continued

Cell lines used in the analysis

| Cell Line | Cancer_Type | Subtype2 | Classification |
|---|---|---|---|
| HT29_LARGE_INTESTINE | large_intestine | adenocarcinoma | CRAD |
| HT55_LARGE_INTESTINE | large_intestine | adenocarcinoma | CRAD |
| KM12_LARGE_INTESTINE | large_intestine | adenocarcinoma | CRAD |
| LOVO_LARGE_INTESTINE | large_intestine | adenocarcinoma | CRAD |
| LS1034_LARGE_INTESTINE | large_intestine | adenocarcinoma | CRAD |
| LS123_LARGE_INTESTINE | large_intestine | adenocarcinoma | CRAD |
| LS180_LARGE_INTESTINE | large_intestine | adenocarcinoma | CRAD |
| LS411N_LARGE_INTESTINE | large_intestine | adenocarcinoma | CRAD |
| LS513_LARGE_INTESTINE | large_intestine | adenocarcinoma | CRAD |
| MDST8_LARGE_INTESTINE | large_intestine | adenocarcinoma | CRAD |
| NCIH508_LARGE_INTESTINE | large_intestine | adenocarcinoma | CRAD |
| NCIH716_LARGE_INTESTINE | large_intestine | adenocarcinoma | CRAD |
| NCIH747_LARGE_INTESTINE | large_intestine | adenocarcinoma | CRAD |
| OUMS23_LARGE_INTESTINE | large_intestine | adenocarcinoma | CRAD |
| RCM1_LARGE_INTESTINE | large_intestine | adenocarcinoma | CRAD |
| RKO_LARGE_INTESTINE | large_intestine | adenocarcinoma | CRAD |
| SKCO1_LARGE_INTESTINE | large_intestine | adenocarcinoma | CRAD |
| SNUC1_LARGE_INTESTINE | large_intestine | adenocarcinoma | CRAD |
| SNUC2A_LARGE_INTESTINE | large_intestine | adenocarcinoma | CRAD |
| SNUC4_LARGE_INTESTINE | large_intestine | adenocarcinoma | CRAD |
| SNUC5_LARGE_INTESTINE | large_intestine | adenocarcinoma | CRAD |
| SW1116_LARGE_INTESTINE | large_intestine | adenocarcinoma | CRAD |
| SW1417_LARGE_INTESTINE | large_intestine | adenocarcinoma | CRAD |
| SW1463_LARGE_INTESTINE | large_intestine | adenocarcinoma | CRAD |
| SW403_LARGE_INTESTINE | large_intestine | adenocarcinoma | CRAD |
| SW480_LARGE_INTESTINE | large_intestine | adenocarcinoma | CRAD |
| SW48_LARGE_INTESTINE | large_intestine | adenocarcinoma | CRAD |
| SW620_LARGE_INTESTINE | large_intestine | adenocarcinoma | CRAD |
| SW837_LARGE_INTESTINE | large_intestine | adenocarcinoma | CRAD |
| SW948_LARGE_INTESTINE | large_intestine | adenocarcinoma | CRAD |
| T84_LARGE_INTESTINE | large_intestine | adenocarcinoma | CRAD |
| ALEXANDERCELLS_LIVER | liver | hepatocellular_carcinoma | LIHC |
| C3A_LIVER | liver | hepatocellular_carcinoma | LIHC |
| HEP3B217_LIVER | liver | hepatocellular_carcinoma | LIHC |
| HEPG2_LIVER | liver | hepatocellular_carcinoma | LIHC |
| HLE_LIVER | liver | hepatocellular_carcinoma | LIHC |
| HLF_LIVER | liver | hepatocellular_carcinoma | LIHC |
| HUH1_LIVER | liver | hepatocellular_carcinoma | LIHC |
| HUH7_LIVER | liver | hepatocellular_carcinoma | LIHC |
| JHH1_LIVER | liver | hepatocellular_carcinoma | LIHC |
| JHH2_LIVER | liver | hepatocellular_carcinoma | LIHC |
| JHH4_LIVER | liver | hepatocellular_carcinoma | LIHC |
| JHH5_LIVER | liver | hepatocellular_carcinoma | LIHC |
| JHH6_LIVER | liver | hepatocellular_carcinoma | LIHC |
| JHH7_LIVER | liver | hepatocellular_carcinoma | LIHC |
| L17_LIVER | liver | hepatocellular_carcinoma | LIHC |
| PLCPRF5_LIVER | liver | hepatocellular_carcinoma | LIHC |
| SNU182_LIVER | liver | hepatocellular_carcinoma | LIHC |
| SNU387_LIVER | liver | hepatocellular_carcinoma | LIHC |
| SNU398_LIVER | liver | hepatocellular_carcinoma | LIHC |
| SNU423_LIVER | liver | hepatocellular_carcinoma | LIHC |
| SNU449_LIVER | liver | hepatocellular_carcinoma | LIHC |
| SNU475_LIVER | liver | hepatocellular_carcinoma | LIHC |
| SNU761_LIVER | liver | hepatocellular_carcinoma | LIHC |
| SNU878_LIVER | liver | hepatocellular_carcinoma | LIHC |
| SNU886_LIVER | liver | hepatocellular_carcinoma | LIHC |
| ASPC1_PANCREAS | pancreas | ductal_carcinoma | PAAD |
| BXPC3_PANCREAS | pancreas | ductal carcinoma | PAAD |
| CAPAN1_PANCREAS | pancreas | ductal carcinoma | PAAD |
| CAPAN2_PANCREAS | pancreas | ductal carcinoma | PAAD |
| CFPAC1_PANCREAS | pancreas | ductal carcinoma | PAAD |
| HPAC_PANCREAS | pancreas | ductal carcinoma | PAAD |
| HPAFII_PANCREAS | pancreas | ductal carcinoma | PAAD |
| HS766T_PANCREAS | pancreas | ductal carcinoma | PAAD |
| KCIMOH1_PANCREAS | pancreas | ductal carcinoma | PAAD |
| KLM1_PANCREAS | pancreas | ductal carcinoma | PAAD |
| KP1NL_PANCREAS | pancreas | ductal carcinoma | PAAD |
| KP1N_PANCREAS | pancreas | ductal carcinoma | PAAD |
| KP3_PANCREAS | pancreas | ductal carcinoma | PAAD |
| KP4_PANCREAS | pancreas | ductal carcinoma | PAAD |
| MIAPACA2_PANCREAS | pancreas | ductal carcinoma | PAAD |
| PANC0327_PANCREAS | pancreas | ductal carcinoma | PAAD |
| PANC0813_PANCREAS | pancreas | ductal carcinoma | PAAD |
| PANC1005_PANCREAS | pancreas | ductal carcinoma | PAAD |
| PANC1_PANCREAS | pancreas | ductal carcinoma | PAAD |

TABLE 1-continued

Cell lines used in the analysis

| Cell Line | Cancer_Type | Subtype2 | Classification |
|---|---|---|---|
| PATU8902_PANCREAS | pancreas | ductal carcinoma | PAAD |
| PATU8988S_PANCREAS | pancreas | ductal carcinoma | PAAD |
| PATU8988T_PANCREAS | pancreas | ductal carcinoma | PAAD |
| PL45_PANCREAS | pancreas | ductal carcinoma | PAAD |
| PSN1_PANCREAS | pancreas | ductal carcinoma | PAAD |
| SU8686_PANCREAS | pancreas | ductal carcinoma | PAAD |
| SUIT2_PANCREAS | pancreas | ductal carcinoma | PAAD |
| SW1990_PANCREAS | pancreas | ductal carcinoma | PAAD |
| T3M4_PANCREAS | pancreas | ductal carcinoma | PAAD |
| BHY_UPPER_AERODIGESTIVE_TRACT | upper_aerodigestive_tract | squamous_cell_carcinoma | HNSC |
| BICR16_UPPER_AERODIGESTIVE_TRACT | upper_aerodigestive_tract | squamous_cell_carcinoma | HNSC |
| BICR18_UPPER_AERODIGESTIVE_TRACT | upper_aerodigestive_tract | squamous_cell_carcinoma | HNSC |
| BICR22_UPPER_AERODIGESTIVE_TRACT | upper_aerodigestive_tract | squamous_cell_carcinoma | HNSC |
| BICR31_UPPER_AERODIGESTIVE_TRACT | upper_aerodigestive_tract | squamous_cell_carcinoma | HNSC |
| BICR56_UPPER_AERODIGESTIVE_TRACT | upper_aerodigestive_tract | squamous_cell_carcinoma | HNSC |
| BICR6_UPPER_AERODIGESTIVE_TRACT | upper_aerodigestive_tract | squamous_cell_carcinoma | HNSC |
| CAL27_UPPER_AERODIGESTIVE_TRACT | upper_aerodigestive_tract | squamous_cell_carcinoma | HNSC |
| CAL33_UPPER_AERODIGESTIVE_TRACT | upper_aerodigestive_tract | squamous_cell_carcinoma | HNSC |
| FADU_UPPER_AERODIGESTIVE_TRACT | upper_aerodigestive_tract | squamous_cell_carcinoma | HNSC |
| HN_UPPER_AERODIGESTIVE_TRACT | upper_aerodigestive_tract | squamous_cell_carcinoma | HNSC |
| HSC2_UPPER_AERODIGESTIVE_TRACT | upper_aerodigestive_tract | squamous_cell_carcinoma | HNSC |
| HSC3_UPPER_AERODIGESTIVE_TRACT | upper_aerodigestive_tract | squamous_cell_carcinoma | HNSC |
| HSC4_UPPER_AERODIGESTIVE_TRACT | upper_aerodigestive_tract | squamous_cell_carcinoma | HNSC |
| PECAPJ15_UPPER_AERODIGESTIVE_TRACT | upper_aerodigestive_tract | squamous_cell_carcinoma | HNSC |
| PECAPJ34CLONEC12_UPPER_AERODIGESTIVE_TRACT | upper_aerodigestive_tract | squamous_cell_carcinoma | HNSC |
| PECAPJ41CLONED2_UPPER_AERODIGESTIVE_TRACT | upper_aerodigestive_tract | squamous_cell_carcinoma | HNSC |
| PECAPJ49_UPPER_AERODIGESTIVE_TRACT | upper_aerodigestive_tract | squamous_cell_carcinoma | HNSC |
| SCC15_UPPER_AERODIGESTIVE_TRACT | upper_aerodigestive_tract | squamous_cell_carcinoma | HNSC |
| SCC25_UPPER_AERODIGESTIVE_TRACT | upper_aerodigestive_tract | squamous_cell_carcinoma | HNSC |
| SCC4_UPPER_AERODIGESTIVE_TRACT | upper_aerodigestive_tract | squamous_cell_carcinoma | HNSC |
| SCC9_UPPER_AERODIGESTIVE_TRACT | upper_aerodigestive_tract | squamous_cell_carcinoma | HNSC |
| SNU1066_UPPER_AERODIGESTIVE_TRACT | upper_aerodigestive_tract | squamous_cell_carcinoma | HNSC |
| SNU1076_UPPER_AERODIGESTIVE_TRACT | upper_aerodigestive_tract | squamous_cell_carcinoma | HNSC |
| SNU1214_UPPER_AERODIGESTIVE_TRACT | upper_aerodigestive_tract | squamous_cell_carcinoma | HNSC |
| SNU46_UPPER_AERODIGESTIVE_TRACT | upper_aerodigestive_tract | squamous_cell_carcinoma | HNSC |
| SNU899_UPPER_AERODIGESTIVE_TRACT | upper_aerodigestive_tract | squamous_cell_carcinoma | HNSC |
| YD10B_UPPER_AERODIGESTIVE_TRACT | upper_aerodigestive_tract | squamous_cell_carcinoma | HNSC |
| YD38_UPPER_AERODIGESTIVE_TRACT | upper_aerodigestive_tract | squamous_cell_carcinoma | HNSC |
| YD8_UPPER_AERODIGESTIVE_TRACT | upper_aerodigestive_tract | squamous_cell_carcinoma | HNSC |

TABLE 2

IHC biomarkers for lung origin and colon origins.

| | Diseases | |
|---|---|---|
| Maker | Colorectal adenocarcinoma | Lung adenocarcinoma |
| CK7 | Rare | + |
| CK20 | + | R |
| CDX2 | + | − |
| TTF1 | − | + |

TABLE 3

IHC analysis of the outlier models

| Original ID | Certified type | Corrected ID | Confirmed markers by IHC |
|---|---|---|---|
| LU1245 | CR | CR1245 | TTF1(−), CDX2(3+), CK7(−), CK20(3+) |
| LU3099 | CR | CR3099 | CK(−), TTF1(−), CK20(3+) |

REFERENCES

1. Hoadley K A, Yau C, Wolf D M, Cherniack A D, Tamborero D, Ng S, et al. Multiplatform analysis of 12 cancer types reveals molecular classification within and across tissues of origin. Cell 2014; 158(4):929-44.
2. Comprehensive molecular characterization of gastric adenocarcinoma. Nature 2014; 513(7517):202-9.

3. Comprehensive genomic characterization defines human glioblastoma genes and core pathways. Nature 2008; 455(7216):1061-8.
4. Ge L, Shao G R, Wang H J, Song S L, Xin G, Wu M, et al. Integrated analysis of gene expression profile and genetic variations associated with ovarian cancer. Eur Rev Med Pharmacol Sci 2015; 19(14):2703-10.
5. Tentler J J, Tan A C, Weekes C D, Jimeno A, Leong S, Pitts T M, et al. Patient-derived tumour xenografts as models for oncology drug development. Nat Rev Clin Oncol 2012; 9(6):338-50.
6. Ding L, Ellis M J, Li S, Larson D E, Chen K, Wallis J W, et al. Genome remodelling in a basal-like breast cancer metastasis and xenograft. Nature 2010; 464(7291):999-1005.
7 Yang M, Shan B, Li Q, Song X, Cai J, Deng J, et al. Overcoming erlotinib resistance with tailored treatment regimen in patient-derived xenografts from naive Asian NSCLC patients. International journal of cancer Journal international du cancer 2013; 132 (2):E74-84.
8. Zhang L, Yang J, Cai J, Song X, Deng J, Huang X, et al. A subset of gastric cancers with EGFR amplification and overexpression respond to cetuximab therapy. Sci Rep 2013; 3:2992.
9. Walter A O, Sjin R T, Haringsma H J, Ohashi K, Sun J, Lee K, et al. Discovery of a mutant-selective covalent inhibitor of EGFR that overcomes T790M-mediated resistance in NSCLC. Cancer discovery 2013; 3(12): 1404-15.
10. Jiang J, Wang D D, Yang M, Chen D, Pang L, Guo S, et al. Comprehensive characterization of chemotherapeutic efficacy on metastases in the established gastric neuroendocrine cancer patient derived xenograft model. Oncotarget 2015; 6(17):15639-51.
11. Bladt F, Friese-Hamim M, Ihling C, Wilm C, Blaukat A. The c-Met Inhibitor MSC2156119J Effectively Inhibits Tumor Growth in Liver Cancer Models. Cancers (Basel) 2014; 6(3):1736-52.
12. Chen D, Huang X, Cai J, Guo S, Qian W, Wery J P, et al. A set of defined oncogenic mutation alleles seems to better predict the response to cetuximab in CRC patient-derived xenograft than KRAS 12/13 mutations. Oncotarget 2015; 6(38):40815-21.
13. Robinson M D, Smyth G K. Small-sample estimation of negative binomial dispersion, with applications to SAGE data. Biostatistics 2008; 9(2):321-32.
14. Barretina J, Caponigro G, Stransky N, Venkatesan K, Margolin A A, Kim S, et al. The Cancer Cell Line Encyclopedia enables predictive modelling of anticancer drug sensitivity. Nature 2012; 483(7391):603-7.
15. Akashi Y, Oda T, Ohara Y, Miyamoto R, Hashimoto S, Enomoto T, et al. Histological advantages of the tumor graft: a murine model involving transplantation of human pancreatic cancer tissue fragments. Pancreas 2013; 42(8): 1275-82.
16. Daniel V C, Marchionni L, Hierman J S, Rhodes J T, Devereux W L, Rudin C M, et al. A primary xenograft model of small-cell lung cancer reveals irreversible changes in gene expression imposed by culture in vitro. Cancer research 2009; 69(8):3364-73.
17. Johnson J I, Decker S, Zaharevitz D, Rubinstein L V, Venditti J M, Schepartz S, et al. Relationships between drug activity in NCI preclinical in vitro and in vivo models and early clinical trials. British journal of cancer 2001; 84(10):1424-31.
18. Voskoglou-Nomikos T, Pater J L, Seymour L. Clinical predictive value of the in vitro cell line, human xenograft, and mouse allograft preclinical cancer models. Clinical cancer research: an official journal of the American Association for Cancer Research 2003; 9(11):4227-39.
19. Drost J, van Jaarsveld R H, Ponsioen B, Zimberlin C, van Boxtel R, Buijs A, et al. Sequential cancer mutations in cultured human intestinal stem cells. Nature 2015; 521(7550):43-7.
20. Chua C W, Shibata M, Lei M, Toivanen R, Barlow L J, Bergren S K, et al. Single luminal epithelial progenitors can generate prostate organoids in culture. Nature cell biology 2014; 16(10):951-61, 1-4.

SEQUENCE LISTING (3407294 sequences)

SEQ ID NO: 1 - protein, 4 aa, Mycobacterium avium
AGPL

SEQ ID NO: 2 - protein, 5 aa, Mycobacterium avium
DMRNP

SEQ ID NO: 3 - protein, 5 aa, Mycobacterium avium
DLRNP

SEQ ID NO: 4 - protein, 4 aa, Mycobacterium avium
PATG

SEQ ID NO: 5 - protein, 4 aa, Mycobacterium avium
LRPE

SEQ ID NO: 6 - protein, 4 aa, Mycobacterium avium
TGRL

SEQ ID NO: 7 - protein, 5 aa, Mycobacterium avium
AARAG

SEQ ID NO: 8 - protein, 7 aa, Mycobacterium avium
AGPTGVE

SEQ ID NO: 9 - protein, 4 aa, Mycobacterium avium
DLRN

SEQ ID NO: 10 - protein, 4 aa, Mycobacterium avium
GAGT

SEQ ID NO: 11 - protein, 6 aa, Mycobacterium avium
GGGTAG

SEQ ID NO: 12 - protein, 10 aa, Mycobacterium avium
GGSGAGKTTL

SEQ ID NO: 13 - protein, 5 aa, Mycobacterium avium
GPGGA

SEQ ID NO: 14 - protein, 11 aa, Mycobacterium avium
KLSGGQRKRAS

SEQ ID NO: 15 - protein, 4 aa, Mycobacterium avium
LATT

SEQ ID NO: 16 - protein, 6 aa, Mycobacterium avium
LNEGRG

SEQ ID NO: 17 - protein, 16 aa, Mycobacterium avium
NDAGGVATYAQAGQNY

SEQ ID NO: 18 - protein, 6 aa, Mycobacterium avium
PARTPV

SEQ ID NO: 19 - protein, 5 aa, Mycobacterium avium
PDGKA

SEQ ID NO: 20 - protein, 8 aa, Mycobacterium avium
PTSGLDPA

SEQ ID NO: 21 - protein, 6 aa, Mycobacterium avium
QSNGTY

SEQ ID NO: 22 - protein, 4 aa, Mycobacterium avium
RPGT

SEQ ID NO: 23 - protein, 6 aa, Mycobacterium avium
RPRPAS

SEQ ID NO: 24 - protein, 4 aa, Mycobacterium avium
RSDR

SEQ ID NO: 25 - protein, 4 aa, Mycobacterium avium
RTTA

SEQ ID NO: 26 - protein, 4 aa, Mycobacterium avium
SDRF

SEQ ID NO: 27 - protein, 6 aa, Mycobacterium avium
SPDGKA

SEQ ID NO: 28 - protein, 5 aa, Mycobacterium avium
TAENP

SEQ ID NO: 29 - protein, 4 aa, Mycobacterium avium
TGGV

SEQ ID NO: 30 - protein, 4 aa, Mycobacterium avium
TSKL

SEQ ID NO: 31 - protein, 8 aa, Mycobacterium avium
AAGPGEKA

SEQ ID NO: 32 - protein, 4 aa, Mycobacterium avium
AGGV

SEQ ID NO: 33 - protein, 7 aa, Mycobacterium avium
ALASANA

SEQ ID NO: 34 - protein, 4 aa, Mycobacterium avium
DELA

SEQ ID NO: 35 - protein, 4 aa, Mycobacterium avium
ESLP

SEQ ID NO: 36 - protein, 6 aa, Mycobacterium avium
HADTRV

SEQ ID NO: 37 - protein, 4 aa, Mycobacterium avium
LPET

SEQ ID NO: 38 - protein, 4 aa, Mycobacterium avium
NPGA

SEQ ID NO: 39 - protein, 7 aa, Mycobacterium avium
PGKRAPT

SEQ ID NO: 40 - protein, 5 aa, Mycobacterium avium
PGLGG

SEQ ID NO: 41 - protein, 7 aa, Mycobacterium avium
PTSGLDP

SEQ ID NO: 42 - protein, 4 aa, Mycobacterium avium
RRRR

SEQ ID NO: 43 - protein, 4 aa, Mycobacterium avium
SAAG

SEQ ID NO: 44 - protein, 4 aa, Mycobacterium avium
TQPA

SEQ ID NO: 45 - protein, 5 aa, Mycobacterium avium
ADQNS

SEQ ID NO: 46 - protein, 4 aa, Mycobacterium avium
APAA

SEQ ID NO: 47 - protein, 6 aa, Mycobacterium avium
ATGEFE

SEQ ID NO: 48 - protein, 9 aa, Mycobacterium avium
DASKNDDSF

SEQ ID NO: 49 - protein, 4 aa, Mycobacterium avium
DLPP

SEQ ID NO: 50 - protein, 10 aa, Mycobacterium avium
EGDPATPEGI

SEQ ID NO: 51 - protein, 4 aa, Mycobacterium avium
ERIA

SEQ ID NO: 52 - protein, 5 aa, Mycobacterium avium
GDTIG

SEQ ID NO: 53 - protein, 4 aa, Mycobacterium avium
GDVD

SEQ ID NO: 54 - protein, 5 aa, Mycobacterium avium
GDVGG

SEQ ID NO: 55 - protein, 5 aa, Mycobacterium avium
GGPAD

SEQ ID NO: 56 - protein, 4 aa, Mycobacterium avium
GGSR

SEQ ID NO: 57 - protein, 7 aa, Mycobacterium avium
GGTGKVV

SEQ ID NO: 58 - protein, 8 aa, Mycobacterium avium
GNGSGKST

SEQ ID NO: 59 - protein, 10 aa, Mycobacterium avium
GPSGSGKSTL

SEQ ID NO: 60 - protein, 5 aa, Mycobacterium avium
GSAPP

SEQ ID NO: 61 - protein, 7 aa, Mycobacterium avium
KRGIDPE

SEQ ID NO: 62 - protein, 4 aa, Mycobacterium avium
NSPD

SEQ ID NO: 63 - protein, 5 aa, Mycobacterium avium
NVPAR

SEQ ID NO: 64 - protein, 4 aa, Mycobacterium avium
PAPV

SEQ ID NO: 65 - protein, 4 aa, Mycobacterium avium
PEDP

SEQ ID NO: 66 - protein, 5 aa, Mycobacterium avium
QIAQT

SEQ ID NO: 67 - protein, 10 aa, Mycobacterium avium
REAEAERERR

SEQ ID NO: 68 - protein, 4 aa, Mycobacterium avium
RPRD

SEQ ID NO: 69 - protein, 9 aa, Mycobacterium avium
SAGPGPGPL

SEQ ID NO: 70 - protein, 4 aa, Mycobacterium avium
TMST

SEQ ID NO: 71 - protein, 11 aa, Mycobacterium avium
VGATSLAGAAS

SEQ ID NO: 72 - protein, 6 aa, Mycobacterium avium
YGPRPA

SEQ ID NO: 73 - protein, 5 aa, Mycobacterium avium
AAAAG

SEQ ID NO: 74 - protein, 10 aa, Mycobacterium avium
AAAAGARAGQ

SEQ ID NO: 75 - protein, 14 aa, Mycobacterium avium
AAAAPNHPEGTAQG

SEQ ID NO: 76 - protein, 9 aa, Mycobacterium avium
AAAAQTRRN

SEQ ID NO: 77 - protein, 9 aa, Mycobacterium avium
AAADAAHRA

SEQ ID NO: 78 - protein, 7 aa, Mycobacterium avium
AAAGEAS

SEQ ID NO: 79 - protein, 9 aa, Mycobacterium avium
AAAPADQRA

SEQ ID NO: 80 - protein, 8 aa, Mycobacterium avium
AAAPDGDV

SEQ ID NO: 81 - protein, 9 aa, Mycobacterium avium
AAAPERHKG

SEQ ID NO: 82 - protein, 7 aa, Mycobacterium avium
AAAPGRL

SEQ ID NO: 83 - protein, 13 aa, Mycobacterium avium
AAAPPGGVGSPQA

SEQ ID NO: 84 - protein, 6 aa, Mycobacterium avium
AAAPRL

SEQ ID NO: 85 - protein, 11 aa, Mycobacterium avium
AAAQALGPGAL

SEQ ID NO: 86 - protein, 8 aa, Mycobacterium avium
AAAQERDR

SEQ ID NO: 87 - protein, 4 aa, Mycobacterium avium
AAAS

SEQ ID NO: 88 - protein, 32 aa, Mycobacterium avium
AAASVGDDRIQKQATGRVNPESWTHGSSEQRQ

SEQ ID NO: 89 - protein, 5 aa, Mycobacterium avium
AAATV

SEQ ID NO: 90 - protein, 7 aa, Mycobacterium avium
AAAVGEK

SEQ ID NO: 91 - protein, 8 aa, Mycobacterium avium
AADARDDL

SEQ ID NO: 92 - protein, 7 aa, Mycobacterium avium
AADERRR

SEQ ID NO: 93 - protein, 8 aa, Mycobacterium avium
AADNGPGA

SEQ ID NO: 94 - protein, 6 aa, Mycobacterium avium
AADPRM

SEQ ID NO: 95 - protein, 9 aa, Mycobacterium avium
AADPRPNAS

SEQ ID NO: 96 - protein, 13 aa, Mycobacterium avium
AADPSKGTAATDI

SEQ ID NO: 97 - protein, 4 aa, Mycobacterium avium
AAEH

SEQ ID NO: 98 - protein, 9 aa, Mycobacterium avium
AAEPDGLPL

SEQ ID NO: 99 - protein, 7 aa, Mycobacterium avium
AAEREVQ

SEQ ID NO: 100 - protein, 15 aa, Mycobacterium avium
AAERRVAGGIDPGAR

SEQ ID NO: 101 - protein, 9 aa, Mycobacterium avium
AAESALGQA

SEQ ID NO: 102 - protein, 6 aa, Mycobacterium avium
AAESGF

SEQ ID NO: 103 - protein, 5 aa, Mycobacterium avium
AAETL

SEQ ID NO: 104 - protein, 4 aa, Mycobacterium avium
AAGA

SEQ ID NO: 105 - protein, 6 aa, Mycobacterium avium
AAGAEA

SEQ ID NO: 106 - protein, 6 aa, Mycobacterium avium
AAGAGG

SEQ ID NO: 107 - protein, 12 aa, Mycobacterium avium
AAGAQSADAKGA

SEQ ID NO: 108 - protein, 4 aa, Mycobacterium avium
AAGD

SEQ ID NO: 109 - protein, 8 aa, Mycobacterium avium
AAGDNTAA

SEQ ID NO: 110 - protein, 10 aa, Mycobacterium avium
AAGEDRESAY

SEQ ID NO: 111 - protein, 9 aa, Mycobacterium avium
AAGGDPEAM

SEQ ID NO: 112 - protein, 6 aa, Mycobacterium avium
AAGGNI

SEQ ID NO: 113 - protein, 9 aa, Mycobacterium avium
AAGPSGPIT

SEQ ID NO: 114 - protein, 6 aa, Mycobacterium avium
AAGRLQ

SEQ ID NO: 115 - protein, 4 aa, Mycobacterium avium
AAGS

SEQ ID NO: 116 - protein, 12 aa, Mycobacterium avium
AAGSPDAYTPGA

SEQ ID NO: 117 - protein, 9 aa, Mycobacterium avium
AAGTDYADL

SEQ ID NO: 118 - protein, 5 aa, Mycobacterium avium
AAGVG

SEQ ID NO: 119 - protein, 9 aa, Mycobacterium avium
AAHASEQRA

SEQ ID NO: 120 - protein, 7 aa, Mycobacterium avium
AAHGKPN

SEQ ID NO: 121 - protein, 4 aa, Mycobacterium avium
AAHP

SEQ ID NO: 122 - protein, 15 aa, Mycobacterium avium
AAIPTGNNNDPCFAN

SEQ ID NO: 123 - protein, 10 aa, Mycobacterium avium
AAKEAGKQFA

SEQ ID NO: 124 - protein, 14 aa, Mycobacterium avium
AAKQAVKNTPLGDS

SEQ ID NO: 125 - protein, 8 aa, Mycobacterium avium
AALDPDAL

SEQ ID NO: 126 - protein, 6 aa, Mycobacterium avium
AALQDD

SEQ ID NO: 127 - protein, 7 aa, Mycobacterium avium
AALSARA

SEQ ID NO: 128 - protein, 6 aa, Mycobacterium avium
AALSDG

SEQ ID NO: 129 - protein, 8 aa, Mycobacterium avium
AALSGTPA

SEQ ID NO: 130 - protein, 7 aa, Mycobacterium avium
AANATRI

SEQ ID NO: 131 - protein, 13 aa, Mycobacterium avium
AANGDGSTASQHY

SEQ ID NO: 132 - protein, 20 aa, Mycobacterium avium
AANGDSEDGAPSRGAAEVGG

SEQ ID NO: 133 - protein, 11 aa, Mycobacterium avium
AANIASGALGG

SEQ ID NO: 134 - protein, 10 aa, Mycobacterium avium
AANNNGSAFA

SEQ ID NO: 135 - protein, 10 aa, Mycobacterium avium
AANPSTGSFA

SEQ ID NO: 136 - protein, 7 aa, Mycobacterium avium
AANPTTC

SEQ ID NO: 137 - protein, 27 aa, Mycobacterium avium
AAPAAPAVPADAVTAGGSGLDPNISPA

SEQ ID NO: 138 - protein, 5 aa, Mycobacterium avium
AAPGA

SEQ ID NO: 139 - protein, 17 aa, Mycobacterium avium
AAPGRTANELARDAGAA

SEQ ID NO: 140 - protein, 11 aa, Mycobacterium avium
AAPGSGPTVGA

SEQ ID NO: 141 - protein, 7 aa, Mycobacterium avium
AAPGTTT

SEQ ID NO: 142 - protein, 8 aa, Mycobacterium avium
AAPGVDPR

SEQ ID NO: 143 - protein, 8 aa, Mycobacterium avium
AAPLASDT

SEQ ID NO: 144 - protein, 4 aa, Mycobacterium avium
AAPR

SEQ ID NO: 145 - protein, 6 aa, Mycobacterium avium
AAPSTA

SEQ ID NO: 146 - protein, 11 aa, Mycobacterium avium
AAQAGEESRSY

SEQ ID NO: 147 - protein, 8 aa, Mycobacterium avium
AAQEAAKQ

SEQ ID NO: 148 - protein, 6 aa, Mycobacterium avium
AAQGGA

SEQ ID NO: 149 - protein, 7 aa, Mycobacterium avium
AAQNDNL

SEQ ID NO: 150 - protein, 5 aa, Mycobacterium avium
AAQRG

SEQ ID NO: 151 - protein, 16 aa, Mycobacterium avium
AAQRGETGTVTDTGYL

SEQ ID NO: 152 - protein, 7 aa, Mycobacterium avium
AAQSPAI

SEQ ID NO: 153 - protein, 18 aa, Mycobacterium avium
AARAQAQAARKAAARERR

SEQ ID NO: 154 - protein, 8 aa, Mycobacterium avium
AARARARA

SEQ ID NO: 155 - protein, 13 aa, Mycobacterium avium
AARDLAPRPRTGH

SEQ ID NO: 156 - protein, 11 aa, Mycobacterium avium
AARDSRAPELD

SEQ ID NO: 157 - protein, 11 aa, Mycobacterium avium
AARGAKPPHGS

SEQ ID NO: 158 - protein, 13 aa, Mycobacterium avium
AARGAPDQPIERA

SEQ ID NO: 159 - protein, 7 aa, Mycobacterium avium
AARGNAR

SEQ ID NO: 160 - protein, 10 aa, Mycobacterium avium
AARGPATGEP

SEQ ID NO: 161 - protein, 10 aa, Mycobacterium avium
AARHPSPNAG

SEQ ID NO: 162 - protein, 11 aa, Mycobacterium avium
AARNANDNSVA

SEQ ID NO: 163 - protein, 6 aa, Mycobacterium avium
AARQGR

SEQ ID NO: 164 - protein, 17 aa, Mycobacterium avium
AARSTDTVGGFTDAGAT

SEQ ID NO: 165 - protein, 9 aa, Mycobacterium avium
AARTDGANA

SEQ ID NO: 166 - protein, 7 aa, Mycobacterium avium
AARTGGP

SEQ ID NO: 167 - protein, 9 aa, Mycobacterium avium
AASDPGLTQ

SEQ ID NO: 168 - protein, 6 aa, Mycobacterium avium
AASELG

SEQ ID NO: 169 - protein, 9 aa, Mycobacterium avium
AASNTQSEL

SEQ ID NO: 170 - protein, 9 aa, Mycobacterium avium
AASPRAGHS

SEQ ID NO: 171 - protein, 9 aa, Mycobacterium avium
AASPTAMGS

SEQ ID NO: 172 - protein, 24 aa, Mycobacterium avium
AASRPRTQRDGVPAAAPAELQSVS

SEQ ID NO: 173 - protein, 6 aa, Mycobacterium avium
AASSFR

SEQ ID NO: 174 - protein, 7 aa, Mycobacterium avium
AASSIAA

SEQ ID NO: 175 - protein, 7 aa, Mycobacterium avium
AASSPHT

SEQ ID NO: 176 - protein, 13 aa, Mycobacterium avium
AASSPTPAGLNDT

SEQ ID NO: 177 - protein, 7 aa, Mycobacterium avium
AASSSAV

SEQ ID NO: 178 - protein, 11 aa, Mycobacterium avium
AASTHDETQSF

SEQ ID NO: 179 - protein, 5 aa, Mycobacterium avium
AATAG

SEQ ID NO: 180 - protein, 6 aa, Mycobacterium avium
AATALQ

SEQ ID NO: 181 - protein, 10 aa, Mycobacterium avium
AATASPIGDA

SEQ ID NO: 182 - protein, 6 aa, Mycobacterium avium
AATDHR

SEQ ID NO: 183 - protein, 4 aa, Mycobacterium avium
AATG

SEQ ID NO: 184 - protein, 13 aa, Mycobacterium avium
AATGLDTAPGSSG

SEQ ID NO: 185 - protein, 13 aa, Mycobacterium avium
AATLAGEARARPR

SEQ ID NO: 186 - protein, 10 aa, Mycobacterium avium
AATNNRRGPL

SEQ ID NO: 187 - protein, 13 aa, Mycobacterium avium
AATPAQQPTPPPV

SEQ ID NO: 188 - protein, 8 aa, Mycobacterium avium
AATPRARG

SEQ ID NO: 189 - protein, 4 aa, Mycobacterium avium
AATS

SEQ ID NO: 190 - protein, 4 aa, Mycobacterium avium
AATT

SEQ ID NO: 191 - protein, 10 aa, Mycobacterium avium
AATTTPAGVG

SEQ ID NO: 192 - protein, 6 aa, Mycobacterium avium
AATVAE

SEQ ID NO: 193 - protein, 11 aa, Mycobacterium avium
AATYKDIAEGA

SEQ ID NO: 194 - protein, 9 aa, Mycobacterium avium
AAVAGSGAA

SEQ ID NO: 195 - protein, 6 aa, Mycobacterium avium
AAVGTP

SEQ ID NO: 196 - protein, 15 aa, Mycobacterium avium
AAVKATAAEIAGRGG

SEQ ID NO: 197 - protein, 4 aa, Mycobacterium avium
ACER

SEQ ID NO: 198 - protein, 5 aa, Mycobacterium avium
ACTAA

SEQ ID NO: 199 - protein, 9 aa, Mycobacterium avium
ADAGRGPGA

SEQ ID NO: 200 - protein, 4 aa, Mycobacterium avium
ADAM

SEQ ID NO: 201 - protein, 6 aa, Mycobacterium avium
ADANQP

SEQ ID NO: 202 - protein, 10 aa, Mycobacterium avium
ADAPAGRRRG

SEQ ID NO: 203 - protein, 7 aa, Mycobacterium avium
ADAPSPF

SEQ ID NO: 204 - protein, 6 aa, Mycobacterium avium
ADARGR

SEQ ID NO: 205 - protein, 8 aa, Mycobacterium avium
ADDAEGQR

SEQ ID NO: 206 - protein, 7 aa, Mycobacterium avium
ADDPTKV

SEQ ID NO: 207 - protein, 9 aa, Mycobacterium avium
ADDQSVDGL

SEQ ID NO: 208 - protein, 22 aa, Mycobacterium avium
ADEPAVPDAEQQHGDEASDNRL

SEQ ID NO: 209 - protein, 5 aa, Mycobacterium avium
ADEPT

SEQ ID NO: 210 - protein, 9 aa, Mycobacterium avium
ADEPTARRA

SEQ ID NO: 211 - protein, 8 aa, Mycobacterium avium
ADESNSAL

SEQ ID NO: 212 - protein, 4 aa, Mycobacterium avium
ADGA

SEQ ID NO: 213 - protein, 91 aa, Mycobacterium avium
ADGAGDPPEKKPPAKAAKKTAKAPAKKAPAKKAPAKKAPAKKAPAKKAPAKNTPTGGGQRADTNGDLTAAAKDAAAQAKSTVEAADNPVAP

SEQ ID NO: 214 - protein, 4 aa, Mycobacterium avium
ADGL

SEQ ID NO: 215 - protein, 7 aa, Mycobacterium avium
ADGQPFT

SEQ ID NO: 216 - protein, 6 aa, Mycobacterium avium
ADGTRH

SEQ ID NO: 217 - protein, 7 aa, Mycobacterium avium
ADGVEDA

SEQ ID NO: 218 - protein, 7 aa, Mycobacterium avium
ADHPSPT

SEQ ID NO: 219 - protein, 9 aa, Mycobacterium avium
ADLSGAGAA

SEQ ID NO: 220 - protein, 10 aa, Mycobacterium avium
ADLSGAGTAF

SEQ ID NO: 221 - protein, 7 aa, Mycobacterium avium
ADNDQTV

SEQ ID NO: 222 - protein, 6 aa, Mycobacterium avium
ADNLKD

SEQ ID NO: 223 - protein, 15 aa, Mycobacterium avium
ADNLSGKGKQVNETL

SEQ ID NO: 224 - protein, 8 aa, Mycobacterium avium
ADPDRTTW

SEQ ID NO: 225 - protein, 12 aa, Mycobacterium avium
ADPGPNDPATKA

SEQ ID NO: 226 - protein, 7 aa, Mycobacterium avium
ADPGSAL

SEQ ID NO: 227 - protein, 5 aa, Mycobacterium avium
ADPGV

SEQ ID NO: 228 - protein, 9 aa, Mycobacterium avium
ADPHDIDDG

SEQ ID NO: 229 - protein, 25 aa, Mycobacterium avium
ADPPDQGAAHGRHELPGKQPRPAIG

SEQ ID NO: 230 - protein, 9 aa, Mycobacterium avium
ADPPDSFPT

SEQ ID NO: 231 - protein, 16 aa, Mycobacterium avium
ADPPGPAAPPAAAPRS

SEQ ID NO: 232 - protein, 7 aa, Mycobacterium avium
ADPQSGL

SEQ ID NO: 233 - protein, 9 aa, Mycobacterium avium
ADQAPDAAI

SEQ ID NO: 234 - protein, 12 aa, Mycobacterium avium
ADQATDSKFTAP

SEQ ID NO: 235 - protein, 6 aa, Mycobacterium avium
ADRDSG

SEQ ID NO: 236 - protein, 6 aa, Mycobacterium avium
ADRRGR

SEQ ID NO: 237 - protein, 8 aa, Mycobacterium avium
ADRVGGAR

SEQ ID NO: 238 - protein, 11 aa, Mycobacterium avium
ADSGEDRTVGS

SEQ ID NO: 239 - protein, 10 aa, Mycobacterium avium
ADSGNSVTQT

SEQ ID NO: 240 - protein, 18 aa, Mycobacterium avium
ADSVDKDLAAARDRLTGE

SEQ ID NO: 241 - protein, 6 aa, Mycobacterium avium
ADTADG

SEQ ID NO: 242 - protein, 14 aa, Mycobacterium avium
ADTAIEVGGPDSSE

SEQ ID NO: 243 - protein, 5 aa, Mycobacterium avium
ADTGP

SEQ ID NO: 244 - protein, 9 aa, Mycobacterium avium
ADTPANVGY

SEQ ID NO: 245 - protein, 8 aa, Mycobacterium avium
ADTTGREA

SEQ ID NO: 246 - protein, 6 aa, Mycobacterium avium
ADVTGG

SEQ ID NO: 247 - protein, 6 aa, Mycobacterium avium
ADYVPT

SEQ ID NO: 248 - protein, 10 aa, Mycobacterium avium
AEAEAAEAEA

SEQ ID NO: 249 - protein, 4 aa, Mycobacterium avium
AEAG

SEQ ID NO: 250 - protein, 8 aa, Mycobacterium avium
AEAPRDAT

SEQ ID NO: 251 - protein, 16 aa, Mycobacterium avium
AEAVRTGRLDERRRRR

SEQ ID NO: 252 - protein, 8 aa, Mycobacterium avium
AEDETTGV

SEQ ID NO: 253 - protein, 9 aa, Mycobacterium avium
AEDKIEANI

SEQ ID NO: 254 - protein, 5 aa, Mycobacterium avium
AEDLN

SEQ ID NO: 255 - protein, 7 aa, Mycobacterium avium
AEEASRR

SEQ ID NO: 256 - protein, 9 aa, Mycobacterium avium
AEEASRTEA

SEQ ID NO: 257 - protein, 4 aa, Mycobacterium avium
AEEF

SEQ ID NO: 258 - protein, 13 aa, Mycobacterium avium
AEESKASSKATVE

SEQ ID NO: 259 - protein, 7 aa, Mycobacterium avium
AEGARQV

SEQ ID NO: 260 - protein, 10 aa, Mycobacterium avium
AEGGTDHRGR

SEQ ID NO: 261 - protein, 9 aa, Mycobacterium avium
AEGKPASRA

SEQ ID NO: 262 - protein, 7 aa, Mycobacterium avium
AEGPAGL

SEQ ID NO: 263 - protein, 8 aa, Mycobacterium avium
AEGSGAAL

SEQ ID NO: 264 - protein, 4 aa, Mycobacterium avium
AEHK

SEQ ID NO: 265 - protein, 7 aa, Mycobacterium avium
AEIGSGI

SEQ ID NO: 266 - protein, 6 aa, Mycobacterium avium
AELGAQ

SEQ ID NO: 267 - protein, 13 aa, Mycobacterium avium
AELGGADPAEREP

SEQ ID NO: 268 - protein, 6 aa, Mycobacterium avium
AELGGQ

SEQ ID NO: 269 - protein, 6 aa, Mycobacterium avium
AELNQR

SEQ ID NO: 270 - protein, 8 aa, Mycobacterium avium
AELPEPQL

SEQ ID NO: 271 - protein, 8 aa, Mycobacterium avium
AEPAEPDY

SEQ ID NO: 272 - protein, 16 aa, Mycobacterium avium
AEPASRASQRSTEVDV

SEQ ID NO: 273 - protein, 7 aa, Mycobacterium avium
AEPATGT

SEQ ID NO: 274 - protein, 7 aa, Mycobacterium avium
AEPDANA

SEQ ID NO: 275 - protein, 6 aa, Mycobacterium avium
AEPGST

SEQ ID NO: 276 - protein, 6 aa, Mycobacterium avium
AEPLGT

SEQ ID NO: 277 - protein, 8 aa, Mycobacterium avium
AEPPPVRQ

SEQ ID NO: 278 - protein, 5 aa, Mycobacterium avium
AEPVG

SEQ ID NO: 279 - protein, 8 aa, Mycobacterium avium
AEQAADQD

SEQ ID NO: 280 - protein, 7 aa, Mycobacterium avium
AEQGRAA

SEQ ID NO: 281 - protein, 10 aa, Mycobacterium avium
AEQSDPDGGA

SEQ ID NO: 282 - protein, 10 aa, Mycobacterium avium
AERANPRRLA

SEQ ID NO: 283 - protein, 13 aa, Mycobacterium avium
AERERPKLGGEER

SEQ ID NO: 284 - protein, 6 aa, Mycobacterium avium
AERETN

SEQ ID NO: 285 - protein, 8 aa, Mycobacterium avium
AERRRGHR

SEQ ID NO: 286 - protein, 8 aa, Mycobacterium avium
AERSGRRV

SEQ ID NO: 287 - protein, 9 aa, Mycobacterium avium
AERVAGETA

SEQ ID NO: 288 - protein, 9 aa, Mycobacterium avium
AERVARTDD

SEQ ID NO: 289 - protein, 6 aa, Mycobacterium avium
AERVED

SEQ ID NO: 290 - protein, 9 aa, Mycobacterium avium
AESDPAATE

SEQ ID NO: 291 - protein, 12 aa, Mycobacterium avium
AESGDDSREVIG

SEQ ID NO: 292 - protein, 9 aa, Mycobacterium avium
AESMRSRPD

SEQ ID NO: 293 - protein, 17 aa, Mycobacterium avium
AESRDPRRAVQKATRSV

SEQ ID NO: 294 - protein, 11 aa, Mycobacterium avium
AESVEQRSEQR

SEQ ID NO: 295 - protein, 5 aa, Mycobacterium avium
AEVGV

SEQ ID NO: 296 - protein, 8 aa, Mycobacterium avium
AFADPESE

SEQ ID NO: 297 - protein, 9 aa, Mycobacterium avium
AFGAPPARW

SEQ ID NO: 298 - protein, 12 aa, Mycobacterium avium
AFSSTKNQYSGD

SEQ ID NO: 299 - protein, 6 aa, Mycobacterium avium
AGAAGA

SEQ ID NO: 300 - protein, 6 aa, Mycobacterium avium
AGAARP

SEQ ID NO: 301 - protein, 11 aa, Mycobacterium avium
AGADPQADAQR

SEQ ID NO: 302 - protein, 6 aa, Mycobacterium avium
AGANVS

SEQ ID NO: 303 - protein, 8 aa, Mycobacterium avium
AGAPEKAA

SEQ ID NO: 304 - protein, 6 aa, Mycobacterium avium
AGAQQV

SEQ ID NO: 305 - protein, 7 aa, Mycobacterium avium
AGARPVV

SEQ ID NO: 306 - protein, 4 aa, Mycobacterium avium
AGAS

SEQ ID NO: 307 - protein, 6 aa, Mycobacterium avium
AGASAA

SEQ ID NO: 308 - protein, 4 aa, Mycobacterium avium
AGAV

SEQ ID NO: 309 - protein, 10 aa, Mycobacterium avium
AGDDGPRSRA

SEQ ID NO: 310 - protein, 6 aa, Mycobacterium avium
AGDGSI

SEQ ID NO: 311 - protein, 11 aa, Mycobacterium avium
AGDKTAPLGPG

SEQ ID NO: 312 - protein, 9 aa, Mycobacterium avium
AGDLGYRSK

SEQ ID NO: 313 - protein, 7 aa, Mycobacterium avium
AGDPAPT

SEQ ID NO: 314 - protein, 10 aa, Mycobacterium avium
AGDPDGSRAR

SEQ ID NO: 315 - protein, 11 aa, Mycobacterium avium
AGDPGAGDDAY

SEQ ID NO: 316 - protein, 26 aa, Mycobacterium avium
AGDTSKKDCKQNPPHDPLQPNDPRNW

SEQ ID NO: 317 - protein, 4 aa, Mycobacterium avium
AGEA

SEQ ID NO: 318 - protein, 5 aa, Mycobacterium avium
AGEAT

SEQ ID NO: 319 - protein, 6 aa, Mycobacterium avium
AGERDR

SEQ ID NO: 320 - protein, 9 aa, Mycobacterium avium
AGGAEPIPA

SEQ ID NO: 321 - protein, 7 aa, Mycobacterium avium
AGGAGQP

SEQ ID NO: 322 - protein, 6 aa, Mycobacterium avium
AGGARP

SEQ ID NO: 323 - protein, 9 aa, Mycobacterium avium
AGGDAGTPY

SEQ ID NO: 324 - protein, 14 aa, Mycobacterium avium
AGGDANPDPHPENA

SEQ ID NO: 325 - protein, 8 aa, Mycobacterium avium
AGGDPRDA

SEQ ID NO: 326 - protein, 7 aa, Mycobacterium avium
AGGEGTL

SEQ ID NO: 327 - protein, 9 aa, Mycobacterium avium
AGGGPVGVG

SEQ ID NO: 328 - protein, 12 aa, Mycobacterium avium
AGGHPTPLPNPG

SEQ ID NO: 329 - protein, 6 aa, Mycobacterium avium
AGGNDI

SEQ ID NO: 330 - protein, 4 aa, Mycobacterium avium
AGGP

SEQ ID NO: 331 - protein, 8 aa, Mycobacterium avium
AGGPEGVG

SEQ ID NO: 332 - protein, 5 aa, Mycobacterium avium
AGGPY

SEQ ID NO: 333 - protein, 17 aa, Mycobacterium avium
AGGQDDSASSANRGPDS

SEQ ID NO: 334 - protein, 10 aa, Mycobacterium avium
AGGQPGAGVV

SEQ ID NO: 335 - protein, 9 aa, Mycobacterium avium
AGGSGKTTA

SEQ ID NO: 336 - protein, 6 aa, Mycobacterium avium
AGGSGL

SEQ ID NO: 337 - protein, 5 aa, Mycobacterium avium
AGGSI

SEQ ID NO: 338 - protein, 6 aa, Mycobacterium avium
AGGTAA

SEQ ID NO: 339 - protein, 8 aa, Mycobacterium avium
AGGTSTAA

SEQ ID NO: 340 - protein, 5 aa, Mycobacterium avium
AGGTT

SEQ ID NO: 341 - protein, 5 aa, Mycobacterium avium
AGHPS

SEQ ID NO: 342 - protein, 6 aa, Mycobacterium avium
AGHRAN

SEQ ID NO: 343 - protein, 6 aa, Mycobacterium avium
AGHRAQ

SEQ ID NO: 344 - protein, 5 aa, Mycobacterium avium
AGHRD

SEQ ID NO: 345 - protein, 23 aa, Mycobacterium avium
AGIAGNRPSGPPANPVTITSVRI

SEQ ID NO: 346 - protein, 4 aa, Mycobacterium avium
AGIT

SEQ ID NO: 347 - protein, 7 aa, Mycobacterium avium
AGKDSFP

SEQ ID NO: 348 - protein, 6 aa, Mycobacterium avium
AGKGTH

SEQ ID NO: 349 - protein, 6 aa, Mycobacterium avium
AGLQPD

SEQ ID NO: 350 - protein, 4 aa, Mycobacterium avium
AGLR

SEQ ID NO: 351 - protein, 4 aa, Mycobacterium avium
AGLS

SEQ ID NO: 352 - protein, 6 aa, Mycobacterium avium
AGLSES

SEQ ID NO: 353 - protein, 11 aa, Mycobacterium avium
AGLSESDIDDI

SEQ ID NO: 354 - protein, 9 aa, Mycobacterium avium
AGLSPADLD

SEQ ID NO: 355 - protein, 8 aa, Mycobacterium avium
AGLSRGKL

SEQ ID NO: 356 - protein, 12 aa, Mycobacterium avium
AGNDGEAGCNNN

SEQ ID NO: 357 - protein, 9 aa, Mycobacterium avium
AGNPLGGPI

SEQ ID NO: 358 - protein, 9 aa, Mycobacterium avium
AGNTVDGTS

SEQ ID NO: 359 - protein, 15 aa, Mycobacterium avium
AGPAGHGSSSRPCSM

SEQ ID NO: 360 - protein, 4 aa, Mycobacterium avium
AGPD

SEQ ID NO: 361 - protein, 5 aa, Mycobacterium avium
AGPER

SEQ ID NO: 362 - protein, 14 aa, Mycobacterium avium
AGPHAGDRSPTRTV

SEQ ID NO: 363 - protein, 14 aa, Mycobacterium avium
AGPKDLERNAATVG

SEQ ID NO: 364 - protein, 13 aa, Mycobacterium avium
AGPLGADPRARTQ

SEQ ID NO: 365 - protein, 7 aa, Mycobacterium avium
AGPNPGH

SEQ ID NO: 366 - protein, 4 aa, Mycobacterium avium
AGPQ

SEQ ID NO: 367 - protein, 8 aa, Mycobacterium avium
AGPSRFNK

SEQ ID NO: 368 - protein, 6 aa, Mycobacterium avium
AGPTRR

SEQ ID NO: 369 - protein, 6 aa, Mycobacterium avium
AGPTSD

SEQ ID NO: 370 - protein, 5 aa, Mycobacterium avium
AGPVP

SEQ ID NO: 371 - protein, 7 aa, Mycobacterium avium
AGQATAG

SEQ ID NO: 372 - protein, 11 aa, Mycobacterium avium
AGQAVSGQQGR

SEQ ID NO: 373 - protein, 7 aa, Mycobacterium avium
AGQGALT

SEQ ID NO: 374 - protein, 8 aa, Mycobacterium avium
AGQSPGLL

SEQ ID NO: 375 - protein, 6 aa, Mycobacterium avium
AGQSYF

SEQ ID NO: 376 - protein, 6 aa, Mycobacterium avium
AGQTVV

SEQ ID NO: 377 - protein, 8 aa, Mycobacterium avium
AGQVGDSP

SEQ ID NO: 378 - protein, 16 aa, Mycobacterium avium
AGRAGEDGEEGFTDAT

SEQ ID NO: 379 - protein, 8 aa, Mycobacterium avium
AGRAPVGT

SEQ ID NO: 380 - protein, 14 aa, Mycobacterium avium
AGRDKPGEGSATGQ

SEQ ID NO: 381 - protein, 6 aa, Mycobacterium avium
AGRDQA

SEQ ID NO: 382 - protein, 11 aa, Mycobacterium avium
AGREPPPGLSA

SEQ ID NO: 383 - protein, 9 aa, Mycobacterium avium
AGRGRDDRS

SEQ ID NO: 384 - protein, 4 aa, Mycobacterium avium
AGRL

SEQ ID NO: 385 - protein, 6 aa, Mycobacterium avium
AGRRAA

SEQ ID NO: 386 - protein, 5 aa, Mycobacterium avium
AGRRG

SEQ ID NO: 387 - protein, 21 aa, Mycobacterium avium
AGSADDLAQARAQSVQAARED

SEQ ID NO: 388 - protein, 11 aa, Mycobacterium avium
AGSADSGPAKL

SEQ ID NO: 389 - protein, 5 aa, Mycobacterium avium
AGSAG

SEQ ID NO: 390 - protein, 14 aa, Mycobacterium avium
AGSATSSNGAAGST

SEQ ID NO: 391 - protein, 7 aa, Mycobacterium avium
AGSGATT

SEQ ID NO: 392 - protein, 33 aa, Mycobacterium avium
AGSGGLDSFTPQASAVPDSDAEREAERAGAAQT

SEQ ID NO: 393 - protein, 10 aa, Mycobacterium avium
AGSNSQKELP

SEQ ID NO: 394 - protein, 8 aa, Mycobacterium avium
AGSPASRA

SEQ ID NO: 395 - protein, 6 aa, Mycobacterium avium
AGSPTS

SEQ ID NO: 396 - protein, 7 aa, Mycobacterium avium
AGSQNQT

SEQ ID NO: 397 - protein, 4 aa, Mycobacterium avium
AGSR

SEQ ID NO: 398 - protein, 7 aa, Mycobacterium avium
AGSRAPV

SEQ ID NO: 399 - protein, 10 aa, Mycobacterium avium
AGSSCDRPGT

SEQ ID NO: 400 - protein, 4 aa, Mycobacterium avium
AGST

SEQ ID NO: 401 - protein, 5 aa, Mycobacterium avium
AGSTA

SEQ ID NO: 402 - protein, 5 aa, Mycobacterium avium
AGSWQ

SEQ ID NO: 403 - protein, 4 aa, Mycobacterium avium
AGTD

SEQ ID NO: 404 - protein, 11 aa, Mycobacterium avium
AGTDDGSPGVQ

SEQ ID NO: 405 - protein, 18 aa, Mycobacterium avium
AGTGGPAEVQEEVREQSQ

SEQ ID NO: 406 - protein, 4 aa, Mycobacterium avium
AGTR

SEQ ID NO: 407 - protein, 5 aa, Mycobacterium avium
AGTVG

SEQ ID NO: 408 - protein, 6 aa, Mycobacterium avium
AGVAKG

SEQ ID NO: 409 - protein, 6 aa, Mycobacterium avium
AGVGEY

SEQ ID NO: 410 - protein, 6 aa, Mycobacterium avium
AGYSRY

SEQ ID NO: 411 - protein, 8 aa, Mycobacterium avium
AHEITDKP

SEQ ID NO: 412 - protein, 6 aa, Mycobacterium avium
AHGGPV

SEQ ID NO: 413 - protein, 69 aa, Mycobacterium avium
AHGYPGQQPYPGQQPYPGQPGGPAQSGPPQARPPYPPYPPYPPPGQPAPEGGSPDRQDDDVSRSNPPAH

SEQ ID NO: 414 - protein, 7 aa, Mycobacterium avium
AHHPPAG

SEQ ID NO: 415 - protein, 11 aa, Mycobacterium avium
AHNPPAGVDNK

SEQ ID NO: 416 - protein, 15 aa, Mycobacterium avium
AHPAPSAGTKRVQGG

SEQ ID NO: 417 - protein, 5 aa, Mycobacterium avium
AHPAQ

SEQ ID NO: 418 - protein, 6 aa, Mycobacterium avium
AHPDAG

SEQ ID NO: 419 - protein, 7 aa, Mycobacterium avium
AHPFENP

SEQ ID NO: 420 - protein, 15 aa, Mycobacterium avium
AHPPGPSPAPRPGEG

SEQ ID NO: 421 - protein, 4 aa, Mycobacterium avium
AHQP

SEQ ID NO: 422 - protein, 8 aa, Mycobacterium avium
AHRDNDTN

SEQ ID NO: 423 - protein, 4 aa, Mycobacterium avium
AHRS

SEQ ID NO: 424 - protein, 4 aa, Mycobacterium avium
AIAG

SEQ ID NO: 425 - protein, 8 aa, Mycobacterium avium
AIDAPDDS

SEQ ID NO: 426 - protein, 8 aa, Mycobacterium avium
AIDSSNPA

SEQ ID NO: 427 - protein, 6 aa, Mycobacterium avium
AIGPGT

SEQ ID NO: 428 - protein, 7 aa, Mycobacterium avium
AIGPSQA

SEQ ID NO: 429 - protein, 12 aa, Mycobacterium avium
AINAQSSPDEVQ

SEQ ID NO: 430 - protein, 6 aa, Mycobacterium avium
AIPPNA

SEQ ID NO: 431 - protein, 6 aa, Mycobacterium avium
AITGEN

SEQ ID NO: 432 - protein, 9 aa, Mycobacterium avium
AKAASNRTA

SEQ ID NO: 433 - protein, 9 aa, Mycobacterium avium
AKAHTRSGE

SEQ ID NO: 434 - protein, 8 aa, Mycobacterium avium
AKAYTGRG

SEQ ID NO: 435 - protein, 7 aa, Mycobacterium avium
AKDEGVP

SEQ ID NO: 436 - protein, 9 aa, Mycobacterium avium
AKDGVTAGR

SEQ ID NO: 437 - protein, 9 aa, Mycobacterium avium
AKDPERRYQ

SEQ ID NO: 438 - protein, 7 aa, Mycobacterium avium
AKGETVE

SEQ ID NO: 439 - protein, 10 aa, Mycobacterium avium
AKGGRQLSPA

SEQ ID NO: 440 - protein, 7 aa, Mycobacterium avium
AKGLTRR

SEQ ID NO: 441 - protein, 11 aa, Mycobacterium avium
AKIDGATPAQA

SEQ ID NO: 442 - protein, 6 aa, Mycobacterium avium
AKLADT

SEQ ID NO: 443 - protein, 7 aa, Mycobacterium avium
AKLTPDY

SEQ ID NO: 444 - protein, 9 aa, Mycobacterium avium
AKNAKVSTV

SEQ ID NO: 445 - protein, 33 aa, Mycobacterium avium
AKNAPRPGGDDTAGPPPGADLGRRTDPTPRGRY

SEQ ID NO: 446 - protein, 11 aa, Mycobacterium avium
AKNDNSSSYQL

SEQ ID NO: 447 - protein, 15 aa, Mycobacterium avium
AKPKTPKDTGPQLDS

SEQ ID NO: 448 - protein, 7 aa, Mycobacterium avium
AKPRSSD

SEQ ID NO: 449 - protein, 9 aa, Mycobacterium avium
AKPVGGDAL

SEQ ID NO: 450 - protein, 5 aa, Mycobacterium avium
AKQNN

SEQ ID NO: 451 - protein, 4 aa, Mycobacterium avium
AKQT

SEQ ID NO: 452 - protein, 7 aa, Mycobacterium avium
AKREKEK

SEQ ID NO: 453 - protein, 4 aa, Mycobacterium avium
AKRG

SEQ ID NO: 454 - protein, 13 aa, Mycobacterium avium
AKRPEDRYRTAGE

SEQ ID NO: 455 - protein, 14 aa, Mycobacterium avium
AKRRRRDPGLRPAR

SEQ ID NO: 456 - protein, 8 aa, Mycobacterium avium
AKSARSKI

SEQ ID NO: 457 - protein, 8 aa, Mycobacterium avium
AKSEVPRH

SEQ ID NO: 458 - protein, 5 aa, Mycobacterium avium
AKSGL

SEQ ID NO: 459 - protein, 6 aa, Mycobacterium avium
AKSNEQ

SEQ ID NO: 460 - protein, 5 aa, Mycobacterium avium
AKTAD

SEQ ID NO: 461 - protein, 8 aa, Mycobacterium avium
AKTGEDYS

SEQ ID NO: 462 - protein, 10 aa, Mycobacterium avium
AKTGSRGTPV

SEQ ID NO: 463 - protein, 7 aa, Mycobacterium avium
AKTTDEL

SEQ ID NO: 464 - protein, 6 aa, Mycobacterium avium
AKTTPV

SEQ ID NO: 465 - protein, 9 aa, Mycobacterium avium
AKWSPPGGH

SEQ ID NO: 466 - protein, 7 aa, Mycobacterium avium
AKYPTGP

SEQ ID NO: 467 - protein, 9 aa, Mycobacterium avium
ALADRDPAG

SEQ ID NO: 468 - protein, 9 aa, Mycobacterium avium
ALANPAAAA

SEQ ID NO: 469 - protein, 13 aa, Mycobacterium avium
ALASTPDNRFESD

SEQ ID NO: 470 - protein, 6 aa, Mycobacterium avium
ALDPDG

SEQ ID NO: 471 - protein, 4 aa, Mycobacterium avium
ALGA

SEQ ID NO: 472 - protein, 13 aa, Mycobacterium avium
ALGEQVDPGTSLS

SEQ ID NO: 473 - protein, 5 aa, Mycobacterium avium
ALGGG

SEQ ID NO: 474 - protein, 7 aa, Mycobacterium avium
ALGPDDT

SEQ ID NO: 475 - protein, 7 aa, Mycobacterium avium
ALPADKV

SEQ ID NO: 476 - protein, 6 aa, Mycobacterium avium
ALPAGW

SEQ ID NO: 477 - protein, 5 aa, Mycobacterium avium
ALPAS

SEQ ID NO: 478 - protein, 9 aa, Mycobacterium avium
ALPGGADEA

SEQ ID NO: 479 - protein, 17 aa, Mycobacterium avium
ALPGPFSPSSASATVRG

SEQ ID NO: 480 - protein, 9 aa, Mycobacterium avium
ALPGSPPFG

SEQ ID NO: 481 - protein, 9 aa, Mycobacterium avium
ALPSPGVNY

SEQ ID NO: 482 - protein, 8 aa, Mycobacterium avium
ALQPAASE

SEQ ID NO: 483 - protein, 10 aa, Mycobacterium avium
ALQSDSREEL

SEQ ID NO: 484 - protein, 7 aa, Mycobacterium avium
ALRQGTE

SEQ ID NO: 485 - protein, 9 aa, Mycobacterium avium
ALTDPATGQ

SEQ ID NO: 486 - protein, 5 aa, Mycobacterium avium
ALTRY

SEQ ID NO: 487 - protein, 11 aa, Mycobacterium avium
ALTTSEQRKAA

SEQ ID NO: 488 - protein, 6 aa, Mycobacterium avium
AMGQPT

SEQ ID NO: 489 - protein, 8 aa, Mycobacterium avium
AMGSATNW

SEQ ID NO: 490 - protein, 19 aa, Mycobacterium avium
AMPEPSPETPTTSTHRSPS

SEQ ID NO: 491 - protein, 4 aa, Mycobacterium avium
AMRD

SEQ ID NO: 492 - protein, 17 aa, Mycobacterium avium
ANAADDSSKTTGETAAI

SEQ ID NO: 493 - protein, 11 aa, Mycobacterium avium
ANDPNQNGGYP

SEQ ID NO: 494 - protein, 11 aa, Mycobacterium avium
ANEHDGVGGTG

SEQ ID NO: 495 - protein, 16 aa, Mycobacterium avium
ANGGGPTTVRNPDGSL

SEQ ID NO: 496 - protein, 7 aa, Mycobacterium avium
ANGKANM

SEQ ID NO: 497 - protein, 8 aa, Mycobacterium avium
ANGKPVGS

SEQ ID NO: 498 - protein, 5 aa, Mycobacterium avium
ANGSV

SEQ ID NO: 499 - protein, 12 aa, Mycobacterium avium
ANLTAASAQAGR

SEQ ID NO: 500 - protein, 7 aa, Mycobacterium avium
ANNARGE

SEQ ID NO: 501 - protein, 8 aa, Mycobacterium avium
ANNRGEYD

SEQ ID NO: 502 - protein, 6 aa, Mycobacterium avium
ANPSYA

SEQ ID NO: 503 - protein, 11 aa, Mycobacterium avium
ANREVGPGKEA

SEQ ID NO: 504 - protein, 8 aa, Mycobacterium avium
ANRPPRKL

SEQ ID NO: 505 - protein, 9 aa, Mycobacterium avium
ANRQKTPNE

SEQ ID NO: 506 - protein, 9 aa, Mycobacterium avium
ANSGGPTLA

SEQ ID NO: 507 - protein, 7 aa, Mycobacterium avium
ANSSDDG

SEQ ID NO: 508 - protein, 12 aa, Mycobacterium avium
ANSYGSTAPRVV

SEQ ID NO: 509 - protein, 12 aa, Mycobacterium avium
ANVNAGAKTRAS

SEQ ID NO: 510 - protein, 9 aa, Mycobacterium avium
APAAGRGAL

SEQ ID NO: 511 - protein, 5 aa, Mycobacterium avium
APAGA

SEQ ID NO: 512 - protein, 7 aa, Mycobacterium avium
APAGAGA

SEQ ID NO: 513 - protein, 17 aa, Mycobacterium avium
APAHPDRPGPQGFTETE

SEQ ID NO: 514 - protein, 22 aa, Mycobacterium avium
APARDTVDAARTRTVTDRAGHA

SEQ ID NO: 515 - protein, 5 aa, Mycobacterium avium
APAVP

SEQ ID NO: 516 - protein, 10 aa, Mycobacterium avium
APDEAGRRPL

SEQ ID NO: 517 - protein, 6 aa, Mycobacterium avium
APDHKR

SEQ ID NO: 518 - protein, 5 aa, Mycobacterium avium
APDKR

SEQ ID NO: 519 - protein, 6 aa, Mycobacterium avium
APDLSN

SEQ ID NO: 520 - protein, 4 aa, Mycobacterium avium
APDR

SEQ ID NO: 521 - protein, 5 aa, Mycobacterium avium
APEEP

SEQ ID NO: 522 - protein, 5 aa, Mycobacterium avium
APENL

SEQ ID NO: 523 - protein, 16 aa, Mycobacterium avium
APEQLTGSPIDGRADQ

SEQ ID NO: 524 - protein, 13 aa, Mycobacterium avium
APEQSAPSGVPHA

SEQ ID NO: 525 - protein, 12 aa, Mycobacterium avium
APESPAISGVTG

SEQ ID NO: 526 - protein, 9 aa, Mycobacterium avium
APETKGRQL

SEQ ID NO: 527 - protein, 17 aa, Mycobacterium avium
APGASSAPTPPAGQPSA

SEQ ID NO: 528 - protein, 5 aa, Mycobacterium avium
APGEA

SEQ ID NO: 529 - protein, 6 aa, Mycobacterium avium
APGEAV

SEQ ID NO: 530 - protein, 8 aa, Mycobacterium avium
APGFDAKE

SEQ ID NO: 531 - protein, 14 aa, Mycobacterium avium
APGGSNSDPARRVG

SEQ ID NO: 532 - protein, 7 aa, Mycobacterium avium
APGQPAG

SEQ ID NO: 533 - protein, 6 aa, Mycobacterium avium
APGSKI

SEQ ID NO: 534 - protein, 5 aa, Mycobacterium avium
APGTD

SEQ ID NO: 535 - protein, 8 aa, Mycobacterium avium
APIAGGPV

SEQ ID NO: 536 - protein, 20 aa, Mycobacterium avium
APIPPTSEPEPPTATTGPAA

SEQ ID NO: 537 - protein, 4 aa, Mycobacterium avium
APLF

SEQ ID NO: 538 - protein, 12 aa, Mycobacterium avium
APLYSPASNAQL

SEQ ID NO: 539 - protein, 10 aa, Mycobacterium avium
APPAGAQPPL

SEQ ID NO: 540 - protein, 6 aa, Mycobacterium avium
APPALA

SEQ ID NO: 541 - protein, 6 aa, Mycobacterium avium
APPAYR

SEQ ID NO: 542 - protein, 5 aa, Mycobacterium avium
APPEA

SEQ ID NO: 543 - protein, 6 aa, Mycobacterium avium
APPHPS

SEQ ID NO: 544 - protein, 12 aa, Mycobacterium avium
APPPATATQARR

SEQ ID NO: 545 - protein, 6 aa, Mycobacterium avium
APPRGL

SEQ ID NO: 546 - protein, 7 aa, Mycobacterium avium
APPSPGR

SEQ ID NO: 547 - protein, 6 aa, Mycobacterium avium
APPSSV

SEQ ID NO: 548 - protein, 27 aa, Mycobacterium avium
APQPSPVTAPADPDGEETADAAPQGIS

SEQ ID NO: 549 - protein, 12 aa, Mycobacterium avium
APRPQVKHGSSV

SEQ ID NO: 550 - protein, 5 aa, Mycobacterium avium
APRPR

SEQ ID NO: 551 - protein, 31 aa, Mycobacterium avium
APSGHAAPPTTAQPAPAQTGRIGGDSSNLAT

SEQ ID NO: 552 - protein, 6 aa, Mycobacterium avium
APSGLA

SEQ ID NO: 553 - protein, 5 aa, Mycobacterium avium
APSNE

SEQ ID NO: 554 - protein, 8 aa, Mycobacterium avium
APSRNGSD

SEQ ID NO: 555 - protein, 6 aa, Mycobacterium avium
APSTTD

SEQ ID NO: 556 - protein, 6 aa, Mycobacterium avium
APTPKL

SEQ ID NO: 557 - protein, 5 aa, Mycobacterium avium
APVDA

SEQ ID NO: 558 - protein, 8 aa, Mycobacterium avium
APVDPAQQ

SEQ ID NO: 559 - protein, 8 aa, Mycobacterium avium
APVGPGTV

SEQ ID NO: 560 - protein, 4 aa, Mycobacterium avium
APWG

SEQ ID NO: 561 - protein, 10 aa, Mycobacterium avium
AQAAERRNSA

SEQ ID NO: 562 - protein, 6 aa, Mycobacterium avium
AQAAGG

SEQ ID NO: 563 - protein, 8 aa, Mycobacterium avium
AQAAHGEQ

SEQ ID NO: 564 - protein, 14 aa, Mycobacterium avium
AQADTALTQTGATM

SEQ ID NO: 565 - protein, 7 aa, Mycobacterium avium
AQAEHPG

SEQ ID NO: 566 - protein, 11 aa, Mycobacterium avium
AQAGQAAQRTA

SEQ ID NO: 567 - protein, 9 aa, Mycobacterium avium
AQARDRQDR

SEQ ID NO: 568 - protein, 7 aa, Mycobacterium avium
AQATDVD

SEQ ID NO: 569 - protein, 4 aa, Mycobacterium avium
AQAV

SEQ ID NO: 570 - protein, 9 aa, Mycobacterium avium
AQDGRTAAG

SEQ ID NO: 571 - protein, 9 aa, Mycobacterium avium
AQDPGTGAI

SEQ ID NO: 572 - protein, 11 aa, Mycobacterium avium
AQDTRQGVGAG

SEQ ID NO: 573 - protein, 18 aa, Mycobacterium avium
AQGAPDEGYYPDERRYPD

SEQ ID NO: 574 - protein, 5 aa, Mycobacterium avium
AQGDG

SEQ ID NO: 575 - protein, 10 aa, Mycobacterium avium
AQGTTPSYES

SEQ ID NO: 576 - protein, 4 aa, Mycobacterium avium
AQHG

SEQ ID NO: 577 - protein, 4 aa, Mycobacterium avium
AQHT

SEQ ID NO: 578 - protein, 10 aa, Mycobacterium avium
AQKGQNGDVG

SEQ ID NO: 579 - protein, 16 aa, Mycobacterium avium
AQKSVYRKAEGQTGAA

SEQ ID NO: 580 - protein, 12 aa, Mycobacterium avium
AQLKGELEREAR

SEQ ID NO: 581 - protein, 10 aa, Mycobacterium avium
AQLSPSARFA

SEQ ID NO: 582 - protein, 13 aa, Mycobacterium avium
AQLTGRDTLRRNT

SEQ ID NO: 583 - protein, 14 aa, Mycobacterium avium
AQNATASGLDPTAR

SEQ ID NO: 584 - protein, 5 aa, Mycobacterium avium
AQPGV

SEQ ID NO: 585 - protein, 11 aa, Mycobacterium avium
AQPTAANDPLY

SEQ ID NO: 586 - protein, 7 aa, Mycobacterium avium
AQPVRKP

SEQ ID NO: 587 - protein, 9 aa, Mycobacterium avium
AQQARADET

SEQ ID NO: 588 - protein, 15 aa, Mycobacterium avium
AQQPGQTLPVGSPEK

SEQ ID NO: 589 - protein, 5 aa, Mycobacterium avium
AQQSY

SEQ ID NO: 590 - protein, 12 aa, Mycobacterium avium
AQRNAATAAVGS

SEQ ID NO: 591 - protein, 4 aa, Mycobacterium avium
AQRR

SEQ ID NO: 592 - protein, 7 aa, Mycobacterium avium
AQRSGIE

SEQ ID NO: 593 - protein, 5 aa, Mycobacterium avium
AQSNE

SEQ ID NO: 594 - protein, 4 aa, Mycobacterium avium
AQSR

SEQ ID NO: 595 - protein, 8 aa, Mycobacterium avium
AQSSAPGW

SEQ ID NO: 596 - protein, 8 aa, Mycobacterium avium
AQTASGGT

SEQ ID NO: 597 - protein, 25 aa, Mycobacterium avium
AQTRANTDTATALGQAYDAAKNDDS

SEQ ID NO: 598 - protein, 7 aa, Mycobacterium avium
AQTTGRA

SEQ ID NO: 599 - protein, 8 aa, Mycobacterium avium
AQYATAAA

SEQ ID NO: 600 - protein, 12 aa, Mycobacterium avium
ARAAAARDREMP

SEQ ID NO: 601 - protein, 13 aa, Mycobacterium avium
ARAAGLPLPAGAG

SEQ ID NO: 602 - protein, 9 aa, Mycobacterium avium
ARAAKAEGV

SEQ ID NO: 603 - protein, 19 aa, Mycobacterium avium
ARAASRDAAPQQLTPVTAI

SEQ ID NO: 604 - protein, 7 aa, Mycobacterium avium
ARADPLA

SEQ ID NO: 605 - protein, 5 aa, Mycobacterium avium
ARAEG

SEQ ID NO: 606 - protein, 5 aa, Mycobacterium avium
ARAGA

SEQ ID NO: 607 - protein, 9 aa, Mycobacterium avium
ARAKGGTPG

SEQ ID NO: 608 - protein, 5 aa, Mycobacterium avium
ARALK

SEQ ID NO: 609 - protein, 14 aa, Mycobacterium avium
ARAQAQRGIAGSME

SEQ ID NO: 610 - protein, 18 aa, Mycobacterium avium
ARASARPQEGQGHAHATD

SEQ ID NO: 611 - protein, 5 aa, Mycobacterium avium
ARASD

SEQ ID NO: 612 - protein, 11 aa, Mycobacterium avium
ARAVGESREDA

SEQ ID NO: 613 - protein, 9 aa, Mycobacterium avium
ARDDGAGEL

SEQ ID NO: 614 - protein, 6 aa, Mycobacterium avium
ARDKAR

SEQ ID NO: 615 - protein, 4 aa, Mycobacterium avium
ARDP

SEQ ID NO: 616 - protein, 11 aa, Mycobacterium avium
ARDPDKALESA

SEQ ID NO: 617 - protein, 13 aa, Mycobacterium avium
ARDRLPDQLIARS

SEQ ID NO: 618 - protein, 6 aa, Mycobacterium avium
ARDSLA

SEQ ID NO: 619 - protein, 16 aa, Mycobacterium avium
AREAGRTRADRERPRQ

SEQ ID NO: 620 - protein, 8 aa, Mycobacterium avium
AREESPRT

SEQ ID NO: 621 - protein, 7 aa, Mycobacterium avium
ARENGTV

SEQ ID NO: 622 - protein, 5 aa, Mycobacterium avium
AREPR

SEQ ID NO: 623 - protein, 10 aa, Mycobacterium avium
ARERGGGTRF

SEQ ID NO: 624 - protein, 14 aa, Mycobacterium avium
ARERRAAAHVSTGQ

SEQ ID NO: 625 - protein, 11 aa, Mycobacterium avium
ARGEASNPRTA

SEQ ID NO: 626 - protein, 8 aa, Mycobacterium avium
ARGQDMPP

SEQ ID NO: 627 - protein, 7 aa, Mycobacterium avium
ARGTAGQ

SEQ ID NO: 628 - protein, 6 aa, Mycobacterium avium
ARGVSR

SEQ ID NO: 629 - protein, 11 aa, Mycobacterium avium
ARHEGQDRETA

SEQ ID NO: 630 - protein, 7 aa, Mycobacterium avium
ARHEPEA

SEQ ID NO: 631 - protein, 13 aa, Mycobacterium avium
ARKAYEKGDYGAA

SEQ ID NO: 632 - protein, 6 aa, Mycobacterium avium
ARKGYP

SEQ ID NO: 633 - protein, 8 aa, Mycobacterium avium
ARKPGGWK

SEQ ID NO: 634 - protein, 8 aa, Mycobacterium avium
ARLGGAPQ

SEQ ID NO: 635 - protein, 8 aa, Mycobacterium avium
ARPADPEL

SEQ ID NO: 636 - protein, 8 aa, Mycobacterium avium
ARPAGGPL

SEQ ID NO: 637 - protein, 10 aa, Mycobacterium avium
ARPDPRLGET

SEQ ID NO: 638 - protein, 4 aa, Mycobacterium avium
ARPG

SEQ ID NO: 639 - protein, 7 aa, Mycobacterium avium
ARPGSTL

SEQ ID NO: 640 - protein, 5 aa, Mycobacterium avium
ARPGT

SEQ ID NO: 641 - protein, 8 aa, Mycobacterium avium
ARPPLTGT

SEQ ID NO: 642 - protein, 5 aa, Mycobacterium avium
ARPRT

SEQ ID NO: 643 - protein, 12 aa, Mycobacterium avium
ARQLPHTDPDGR

SEQ ID NO: 644 - protein, 7 aa, Mycobacterium avium
ARQNTGP

SEQ ID NO: 645 - protein, 8 aa, Mycobacterium avium
ARQPEAQG

SEQ ID NO: 646 - protein, 12 aa, Mycobacterium avium
ARQQSGDANPFP

SEQ ID NO: 647 - protein, 15 aa, Mycobacterium avium
ARRDQTAAATRTGGL

SEQ ID NO: 648 - protein, 6 aa, Mycobacterium avium
ARRDTV

SEQ ID NO: 649 - protein, 22 aa, Mycobacterium avium
ARREAKRRAAGRPVNQPKPVAR

SEQ ID NO: 650 - protein, 18 aa, Mycobacterium avium
ARRGARGAQTGLENFLEH

SEQ ID NO: 651 - protein, 13 aa, Mycobacterium avium
ARRQGAPEPGEPA

SEQ ID NO: 652 - protein, 8 aa, Mycobacterium avium
ARRRAPEV

SEQ ID NO: 653 - protein, 5 aa, Mycobacterium avium
ARRRP

SEQ ID NO: 654 - protein, 8 aa, Mycobacterium avium
ARSASESA

SEQ ID NO: 655 - protein, 7 aa, Mycobacterium avium
ARSATRD

SEQ ID NO: 656 - protein, 7 aa, Mycobacterium avium
ARSEQTW

SEQ ID NO: 657 - protein, 10 aa, Mycobacterium avium
ARSGLSGAQV

SEQ ID NO: 658 - protein, 8 aa, Mycobacterium avium
ARSQNALG

SEQ ID NO: 659 - protein, 15 aa, Mycobacterium avium
ARSRGRDTSEDERRQ

SEQ ID NO: 660 - protein, 17 aa, Mycobacterium avium
ARSSEQYRGSPGPGPQL

SEQ ID NO: 661 - protein, 10 aa, Mycobacterium avium
ARSVAPGVRS

SEQ ID NO: 662 - protein, 6 aa, Mycobacterium avium
ARTAAN

SEQ ID NO: 663 - protein, 6 aa, Mycobacterium avium
ARTAAS

SEQ ID NO: 664 - protein, 16 aa, Mycobacterium avium
ARTNNRQGNPVGSSYL

SEQ ID NO: 665 - protein, 14 aa, Mycobacterium avium
ARTPDGSAPSREAL

SEQ ID NO: 666 - protein, 5 aa, Mycobacterium avium
ARTTV

SEQ ID NO: 667 - protein, 5 aa, Mycobacterium avium
ARVDR

SEQ ID NO: 668 - protein, 7 aa, Mycobacterium avium
ARYGGDP

SEQ ID NO: 669 - protein, 11 aa, Mycobacterium avium
ARYTDPNTRSF

SEQ ID NO: 670 - protein, 11 aa, Mycobacterium avium
ASAAPTPGGVG

SEQ ID NO: 671 - protein, 15 aa, Mycobacterium avium
ASADSAGAAAQQEVA

SEQ ID NO: 672 - protein, 12 aa, Mycobacterium avium
ASAGAGINPIPT

SEQ ID NO: 673 - protein, 10 aa, Mycobacterium avium
ASAHPGPPAQ

SEQ ID NO: 674 - protein, 4 aa, Mycobacterium avium
ASAI

SEQ ID NO: 675 - protein, 8 aa, Mycobacterium avium
ASAIGPGA

SEQ ID NO: 676 - protein, 12 aa, Mycobacterium avium
ASANASNMATCA

SEQ ID NO: 677 - protein, 26 aa, Mycobacterium avium
ASANNEMSPDTAPPKTPLRSGGPESL

SEQ ID NO: 678 - protein, 6 aa, Mycobacterium avium
ASASTV

SEQ ID NO: 679 - protein, 4 aa, Mycobacterium avium
ASAT

SEQ ID NO: 680 - protein, 6 aa, Mycobacterium avium
ASATNS

SEQ ID NO: 681 - protein, 12 aa, Mycobacterium avium
ASATQSQPPLPV

SEQ ID NO: 682 - protein, 8 aa, Mycobacterium avium
ASDAGPYL

SEQ ID NO: 683 - protein, 18 aa, Mycobacterium avium
ASDGADTTDDRAGGGRTA

SEQ ID NO: 684 - protein, 11 aa, Mycobacterium avium
ASDQSQNESGY

SEQ ID NO: 685 - protein, 6 aa, Mycobacterium avium
ASEKAA

SEQ ID NO: 686 - protein, 7 aa, Mycobacterium avium
ASEQERA

SEQ ID NO: 687 - protein, 13 aa, Mycobacterium avium
ASETAGVDGAPEI

SEQ ID NO: 688 - protein, 7 aa, Mycobacterium avium
ASETERM

SEQ ID NO: 689 - protein, 10 aa, Mycobacterium avium
ASGALKPKTA

SEQ ID NO: 690 - protein, 9 aa, Mycobacterium avium
ASGGPEGVG

SEQ ID NO: 691 - protein, 13 aa, Mycobacterium avium
ASGRGGQAGDVAG

SEQ ID NO: 692 - protein, 9 aa, Mycobacterium avium
ASGRSLPTR

SEQ ID NO: 693 - protein, 11 aa, Mycobacterium avium
ASGRYGADPAV

SEQ ID NO: 694 - protein, 7 aa, Mycobacterium avium
ASGSTYP

SEQ ID NO: 695 - protein, 12 aa, Mycobacterium avium
ASHENAAPNFGT

SEQ ID NO: 696 - protein, 5 aa, Mycobacterium avium
ASIEG

SEQ ID NO: 697 - protein, 7 aa, Mycobacterium avium
ASIGNRS

SEQ ID NO: 698 - protein, 15 aa, Mycobacterium avium
ASLAAANARLGAPRT

SEQ ID NO: 699 - protein, 8 aa, Mycobacterium avium
ASPATTEP

SEQ ID NO: 700 - protein, 5 aa, Mycobacterium avium
ASPAW

SEQ ID NO: 701 - protein, 10 aa, Mycobacterium avium
ASPDPELASN

SEQ ID NO: 702 - protein, 13 aa, Mycobacterium avium
ASPGASDAASSYP

SEQ ID NO: 703 - protein, 8 aa, Mycobacterium avium
ASPPGPRI

SEQ ID NO: 704 - protein, 13 aa, Mycobacterium avium
ASPSVSGRYPNLG

SEQ ID NO: 705 - protein, 6 aa, Mycobacterium avium
ASQDPL

SEQ ID NO: 706 - protein, 7 aa, Mycobacterium avium
ASQPPGL

SEQ ID NO: 707 - protein, 10 aa, Mycobacterium avium
ASRDPEARRQ

SEQ ID NO: 708 - protein, 8 aa, Mycobacterium avium
ASRGDGPV

SEQ ID NO: 709 - protein, 9 aa, Mycobacterium avium
ASRGGTNPY

SEQ ID NO: 710 - protein, 7 aa, Mycobacterium avium
ASRGKWD

SEQ ID NO: 711 - protein, 5 aa, Mycobacterium avium
ASRPE

SEQ ID NO: 712 - protein, 5 aa, Mycobacterium avium
ASRWT

SEQ ID NO: 713 - protein, 7 aa, Mycobacterium avium
ASSAGVA

SEQ ID NO: 714 - protein, 9 aa, Mycobacterium avium
ASSDPATYG

SEQ ID NO: 715 - protein, 5 aa, Mycobacterium avium
ASSRM

SEQ ID NO: 716 - protein, 5 aa, Mycobacterium avium
ASSSA

SEQ ID NO: 717 - protein, 17 aa, Mycobacterium avium
ASSSDPAANPEGQDAAA

SEQ ID NO: 718 - protein, 11 aa, Mycobacterium avium
ASTAAASGPAI

SEQ ID NO: 719 - protein, 5 aa, Mycobacterium avium
ASTAS

SEQ ID NO: 720 - protein, 5 aa, Mycobacterium avium
ASTDT

SEQ ID NO: 721 - protein, 5 aa, Mycobacterium avium
ASTEM

SEQ ID NO: 722 - protein, 16 aa, Mycobacterium avium
ASTTAAGPVSQNAYGA

SEQ ID NO: 723 - protein, 9 aa, Mycobacterium avium
ASTTGDITG

SEQ ID NO: 724 - protein, 7 aa, Mycobacterium avium
ASTTNTV

SEQ ID NO: 725 - protein, 4 aa, Mycobacterium avium
ASTV

SEQ ID NO: 726 - protein, 15 aa, Mycobacterium avium
ASVPPGAPVTQGTGA

SEQ ID NO: 727 - protein, 4 aa, Mycobacterium avium
ASWG

SEQ ID NO: 728 - protein, 11 aa, Mycobacterium avium
ATAAPPPQHPR

SEQ ID NO: 729 - protein, 8 aa, Mycobacterium avium
ATADDTEA

SEQ ID NO: 730 - protein, 12 aa, Mycobacterium avium
ATADGADKSGLT

SEQ ID NO: 731 - protein, 25 aa, Mycobacterium avium
ATAEREAESPTETIPSAGDDPKTEV

SEQ ID NO: 732 - protein, 8 aa, Mycobacterium avium
ATAGAKPD

SEQ ID NO: 733 - protein, 6 aa, Mycobacterium avium
ATAHGT

SEQ ID NO: 734 - protein, 14 aa, Mycobacterium avium
ATARQVAARTTGTE

SEQ ID NO: 735 - protein, 18 aa, Mycobacterium avium
ATASTDPRDRPVAPPAPA

SEQ ID NO: 736 - protein, 7 aa, Mycobacterium avium
ATATRNL

SEQ ID NO: 737 - protein, 5 aa, Mycobacterium avium
ATAVS

SEQ ID NO: 738 - protein, 5 aa, Mycobacterium avium
ATAYT

SEQ ID NO: 739 - protein, 7 aa, Mycobacterium avium
ATDAGAT

SEQ ID NO: 740 - protein, 4 aa, Mycobacterium avium
ATDL

SEQ ID NO: 741 - protein, 9 aa, Mycobacterium avium
ATDPTTPGA

SEQ ID NO: 742 - protein, 6 aa, Mycobacterium avium
ATEPLG

SEQ ID NO: 743 - protein, 6 aa, Mycobacterium avium
ATERAV

SEQ ID NO: 744 - protein, 5 aa, Mycobacterium avium
ATGAI

SEQ ID NO: 745 - protein, 4 aa, Mycobacterium avium
ATGG

SEQ ID NO: 746 - protein, 6 aa, Mycobacterium avium
ATGGAG

SEQ ID NO: 747 - protein, 5 aa, Mycobacterium avium
ATGKV

SEQ ID NO: 748 - protein, 5 aa, Mycobacterium avium
ATGPA

SEQ ID NO: 749 - protein, 7 aa, Mycobacterium avium
ATGPAAP

SEQ ID NO: 750 - protein, 10 aa, Mycobacterium avium
ATGPADRHDK

SEQ ID NO: 751 - protein, 8 aa, Mycobacterium avium
ATGPHGRE

SEQ ID NO: 752 - protein, 9 aa, Mycobacterium avium
ATGPPPPAL

SEQ ID NO: 753 - protein, 7 aa, Mycobacterium avium
ATGPRSV

SEQ ID NO: 754 - protein, 9 aa, Mycobacterium avium
ATGQAPPVR

SEQ ID NO: 755 - protein, 7 aa, Mycobacterium avium
ATGSTTL

SEQ ID NO: 756 - protein, 6 aa, Mycobacterium avium
ATKMTP

SEQ ID NO: 757 - protein, 12 aa, Mycobacterium avium
ATLDAESRRAAS

SEQ ID NO: 758 - protein, 10 aa, Mycobacterium avium
ATNADGPGRM

SEQ ID NO: 759 - protein, 17 aa, Mycobacterium avium
ATPADLRDAPETVGKPV

SEQ ID NO: 760 - protein, 6 aa, Mycobacterium avium
ATPATY

SEQ ID NO: 761 - protein, 11 aa, Mycobacterium avium
ATPEDPASARF

SEQ ID NO: 762 - protein, 5 aa, Mycobacterium avium
ATPEE

SEQ ID NO: 763 - protein, 16 aa, Mycobacterium avium
ATPEEVAPQEVSSEVS

SEQ ID NO: 764 - protein, 9 aa, Mycobacterium avium
ATPGGVPHP

SEQ ID NO: 765 - protein, 7 aa, Mycobacterium avium
ATPGKTQ

SEQ ID NO: 766 - protein, 10 aa, Mycobacterium avium
ATPGNAYPIT

SEQ ID NO: 767 - protein, 7 aa, Mycobacterium avium
ATPGNRA

SEQ ID NO: 768 - protein, 6 aa, Mycobacterium avium
ATPPKW

SEQ ID NO: 769 - protein, 5 aa, Mycobacterium avium
ATPPS

SEQ ID NO: 770 - protein, 8 aa, Mycobacterium avium
ATPQGTQV

SEQ ID NO: 771 - protein, 6 aa, Mycobacterium avium
ATPRPV

SEQ ID NO: 772 - protein, 6 aa, Mycobacterium avium
ATPSER

SEQ ID NO: 773 - protein, 9 aa, Mycobacterium avium
ATPVAAPRN

SEQ ID NO: 774 - protein, 11 aa, Mycobacterium avium
ATPVRSGRGGA

SEQ ID NO: 775 - protein, 14 aa, Mycobacterium avium
ATQAPDTNAMTASE

SEQ ID NO: 776 - protein, 6 aa, Mycobacterium avium
ATQDTN

SEQ ID NO: 777 - protein, 5 aa, Mycobacterium avium
ATRAR

SEQ ID NO: 778 - protein, 14 aa, Mycobacterium avium
ATRATRQAQPVGNV

SEQ ID NO: 779 - protein, 13 aa, Mycobacterium avium
ATRDRAEAQLHQP

SEQ ID NO: 780 - protein, 5 aa, Mycobacterium avium
ATRDS

SEQ ID NO: 781 - protein, 10 aa, Mycobacterium avium
ATRPQADGPY

SEQ ID NO: 782 - protein, 13 aa, Mycobacterium avium
ATRSGLWNPAPLR

SEQ ID NO: 783 - protein, 7 aa, Mycobacterium avium
ATRTELA

SEQ ID NO: 784 - protein, 6 aa, Mycobacterium avium
ATRYTA

SEQ ID NO: 785 - protein, 7 aa, Mycobacterium avium
ATSDEDV

SEQ ID NO: 786 - protein, 10 aa, Mycobacterium avium
ATSDTSPTRV

SEQ ID NO: 787 - protein, 17 aa, Mycobacterium avium
ATSKRVDEETTASTQIP

SEQ ID NO: 788 - protein, 6 aa, Mycobacterium avium
ATSNRL

SEQ ID NO: 789 - protein, 4 aa, Mycobacterium avium
ATSR

SEQ ID NO: 790 - protein, 9 aa, Mycobacterium avium
ATSSDDGYN

SEQ ID NO: 791 - protein, 7 aa, Mycobacterium avium
ATSTTIN

SEQ ID NO: 792 - protein, 8 aa, Mycobacterium avium
ATTAAAHG

SEQ ID NO: 793 - protein, 7 aa, Mycobacterium avium
ATVDAYD

SEQ ID NO: 794 - protein, 12 aa, Mycobacterium avium
ATYDDTIAQTNN

SEQ ID NO: 795 - protein, 8 aa, Mycobacterium avium
ATYPNASA

SEQ ID NO: 796 - protein, 5 aa, Mycobacterium avium
AVADR

SEQ ID NO: 797 - protein, 17 aa, Mycobacterium avium
AVAGPEWNKQRNEGARA

SEQ ID NO: 798 - protein, 7 aa, Mycobacterium avium
AVDAEPD

SEQ ID NO: 799 - protein, 4 aa, Mycobacterium avium
AVEE

SEQ ID NO: 800 - protein, 8 aa, Mycobacterium avium
AVGDDVEP

SEQ ID NO: 801 - protein, 4 aa, Mycobacterium avium
AVHR

SEQ ID NO: 802 - protein, 17 aa, Mycobacterium avium
AVKTSSERADVDPDIGD

SEQ ID NO: 803 - protein, 10 aa, Mycobacterium avium
AVNNGTLPYG

SEQ ID NO: 804 - protein, 21 aa, Mycobacterium avium
AVNQDGASNGLATPNGPSQQR

SEQ ID NO: 805 - protein, 8 aa, Mycobacterium avium
AVPDDPDE

SEQ ID NO: 806 - protein, 21 aa, Mycobacterium avium
AVPGTADDAAAEGTKVGVEEG

SEQ ID NO: 807 - protein, 14 aa, Mycobacterium avium
AVPPVPSSGPPALA

SEQ ID NO: 808 - protein, 5 aa, Mycobacterium avium
AVPTR

SEQ ID NO: 809 - protein, 8 aa, Mycobacterium avium
AVRAGNAA

SEQ ID NO: 810 - protein, 10 aa, Mycobacterium avium
AVSAATTRSD

SEQ ID NO: 811 - protein, 24 aa, Mycobacterium avium
AVSPARPDKPSITVSTNPRAGTLG

SEQ ID NO: 812 - protein, 5 aa, Mycobacterium avium
AVTDN

SEQ ID NO: 813 - protein, 8 aa, Mycobacterium avium
AVTGDQPN

SEQ ID NO: 814 - protein, 5 aa, Mycobacterium avium
AVTGG

SEQ ID NO: 815 - protein, 7 aa, Mycobacterium avium
AVTGGAT

SEQ ID NO: 816 - protein, 8 aa, Mycobacterium avium
AVTGGLGP

SEQ ID NO: 817 - protein, 6 aa, Mycobacterium avium
AVTGKG

SEQ ID NO: 818 - protein, 13 aa, Mycobacterium avium
AWDEAPKQRRAAR

SEQ ID NO: 819 - protein, 12 aa, Mycobacterium avium
AWTTGNKRGQAH

SEQ ID NO: 820 - protein, 9 aa, Mycobacterium avium
AYADAAPDL

SEQ ID NO: 821 - protein, 13 aa, Mycobacterium avium
AYAGAADGTGFSE

SEQ ID NO: 822 - protein, 13 aa, Mycobacterium avium
AYDDKAKKTTKAV

SEQ ID NO: 823 - protein, 8 aa, Mycobacterium avium
AYDPTNNE

SEQ ID NO: 824 - protein, 5 aa, Mycobacterium avium
AYEAL

SEQ ID NO: 825 - protein, 9 aa, Mycobacterium avium
AYGARGAGS

SEQ ID NO: 826 - protein, 5 aa, Mycobacterium avium
AYGKP

SEQ ID NO: 827 - protein, 4 aa, Mycobacterium avium
AYGP

SEQ ID NO: 828 - protein, 9 aa, Mycobacterium avium
AYNGSTIGR

SEQ ID NO: 829 - protein, 15 aa, Mycobacterium avium
AYPDKRALKASTDRL

SEQ ID NO: 830 - protein, 9 aa, Mycobacterium avium
AYPSGGGDY

SEQ ID NO: 831 - protein, 5 aa, Mycobacterium avium
AYRRP

SEQ ID NO: 832 - protein, 8 aa, Mycobacterium avium
AYSDSYND

SEQ ID NO: 833 - protein, 9 aa, Mycobacterium avium
AYSGETTQG

SEQ ID NO: 834 - protein, 7 aa, Mycobacterium avium
AYTTGKY

SEQ ID NO: 835 - protein, 6 aa, Mycobacterium avium
CAPPGV

SEQ ID NO: 836 - protein, 29 aa, Mycobacterium avium
CAPTRSAAIDGDGVAAEQAATLGNGGHYA

SEQ ID NO: 837 - protein, 5 aa, Mycobacterium avium
CEQQG

SEQ ID NO: 838 - protein, 4 aa, Mycobacterium avium
CGGS

SEQ ID NO: 839 - protein, 14 aa, Mycobacterium avium
CGPPGQIGPAMGTT

SEQ ID NO: 840 - protein, 6 aa, Mycobacterium avium
CGPPQR

SEQ ID NO: 841 - protein, 11 aa, Mycobacterium avium
CGTTRDGYADY

SEQ ID NO: 842 - protein, 9 aa, Mycobacterium avium
CKTGADANK

SEQ ID NO: 843 - protein, 14 aa, Mycobacterium avium
CNHGQNPTVKKGAT

SEQ ID NO: 844 - protein, 5 aa, Mycobacterium avium
CPPSH

SEQ ID NO: 845 - protein, 29 aa, Mycobacterium avium
CPPSTTPSTPAPEQPQPGPGPTPTSPPPA

SEQ ID NO: 846 - protein, 6 aa, Mycobacterium avium
CPRYGQ

SEQ ID NO: 847 - protein, 6 aa, Mycobacterium avium
CPTGGV

SEQ ID NO: 848 - protein, 29 aa, Mycobacterium avium
CQYPPSPEPAAKQVKPPRTGKVPTDPAQV

SEQ ID NO: 849 - protein, 4 aa, Mycobacterium avium
CTPA

SEQ ID NO: 850 - protein, 5 aa, Mycobacterium avium
DAAAA

SEQ ID NO: 851 - protein, 10 aa, Mycobacterium avium
DAADATALEQ

SEQ ID NO: 852 - protein, 7 aa, Mycobacterium avium
DAAELDE

SEQ ID NO: 853 - protein, 5 aa, Mycobacterium avium
DAAPA

SEQ ID NO: 854 - protein, 7 aa, Mycobacterium avium
DAASQRG

SEQ ID NO: 855 - protein, 5 aa, Mycobacterium avium
DAATH

SEQ ID NO: 856 - protein, 4 aa, Mycobacterium avium
DADA

SEQ ID NO: 857 - protein, 9 aa, Mycobacterium avium
DADGHAPGL

SEQ ID NO: 858 - protein, 14 aa, Mycobacterium avium
DAEDTEPQGDSAPV

SEQ ID NO: 859 - protein, 5 aa, Mycobacterium avium
DAEPA

SEQ ID NO: 860 - protein, 18 aa, Mycobacterium avium
DAERTAAQEGLKQSSLSD

SEQ ID NO: 861 - protein, 5 aa, Mycobacterium avium
DAGAA

SEQ ID NO: 862 - protein, 7 aa, Mycobacterium avium
DAGAQSV

SEQ ID NO: 863 - protein, 16 aa, Mycobacterium avium
DAGRMTGYDLKYPDGG

SEQ ID NO: 864 - protein, 8 aa, Mycobacterium avium
DAGVDGSV

SEQ ID NO: 865 - protein, 13 aa, Mycobacterium avium
DAIANPDPDRRGD

SEQ ID NO: 866 - protein, 13 aa, Mycobacterium avium
DAIEGASEKERAR

SEQ ID NO: 867 - protein, 10 aa, Mycobacterium avium
DAKRSPAKTV

SEQ ID NO: 868 - protein, 9 aa, Mycobacterium avium
DALSRSDGI

SEQ ID NO: 869 - protein, 7 aa, Mycobacterium avium
DAMGPEG

SEQ ID NO: 870 - protein, 18 aa, Mycobacterium avium
DAPAGARAERVDDRRGQL

SEQ ID NO: 871 - protein, 6 aa, Mycobacterium avium
DAPARL

SEQ ID NO: 872 - protein, 12 aa, Mycobacterium avium
DAPARNGPTRPV

SEQ ID NO: 873 - protein, 8 aa, Mycobacterium avium
DAPGKPGL

SEQ ID NO: 874 - protein, 8 aa, Mycobacterium avium
DAPQEEGA

SEQ ID NO: 875 - protein, 10 aa, Mycobacterium avium
DAPSTAPDSL

SEQ ID NO: 876 - protein, 15 aa, Mycobacterium avium
DAPTKLSAPGINGST

SEQ ID NO: 877 - protein, 11 aa, Mycobacterium avium
DAQAKQSRDQR

SEQ ID NO: 878 - protein, 10 aa, Mycobacterium avium
DAQAMDPKRT

SEQ ID NO: 879 - protein, 16 aa, Mycobacterium avium
DAQGGAAFADPSRPHG

SEQ ID NO: 880 - protein, 7 aa, Mycobacterium avium
DAQVSGR

SEQ ID NO: 881 - protein, 6 aa, Mycobacterium avium
DARRGQ

SEQ ID NO: 882 - protein, 8 aa, Mycobacterium avium
DARTDSRV

SEQ ID NO: 883 - protein, 5 aa, Mycobacterium avium
DARTS

SEQ ID NO: 884 - protein, 14 aa, Mycobacterium avium
DASGAALDKSMSGP

SEQ ID NO: 885 - protein, 7 aa, Mycobacterium avium
DASPDLR

SEQ ID NO: 886 - protein, 8 aa, Mycobacterium avium
DASRNDDS

SEQ ID NO: 887 - protein, 9 aa, Mycobacterium avium
DASSPATLN

SEQ ID NO: 888 - protein, 6 aa, Mycobacterium avium
DATTDR

SEQ ID NO: 889 - protein, 6 aa, Mycobacterium avium
DATTQV

SEQ ID NO: 890 - protein, 7 aa, Mycobacterium avium
DAVRRTS

SEQ ID NO: 891 - protein, 5 aa, Mycobacterium avium
DAYND

SEQ ID NO: 892 - protein, 10 aa, Mycobacterium avium
DCTGPGPAAL

SEQ ID NO: 893 - protein, 16 aa, Mycobacterium avium
DDADLTSADRRTYTKK

SEQ ID NO: 894 - protein, 6 aa, Mycobacterium avium
DDAETR

SEQ ID NO: 895 - protein, 8 aa, Mycobacterium avium
DDDEPGGD

SEQ ID NO: 896 - protein, 9 aa, Mycobacterium avium
DDDPAVSIR

SEQ ID NO: 897 - protein, 6 aa, Mycobacterium avium
DDDTIT

SEQ ID NO: 898 - protein, 4 aa, Mycobacterium avium
DDGL

SEQ ID NO: 899 - protein, 21 aa, Mycobacterium avium
DDGPPPPAPGAPVEFKGQEPA

SEQ ID NO: 900 - protein, 5 aa, Mycobacterium avium
DDLAD

SEQ ID NO: 901 - protein, 5 aa, Mycobacterium avium
DDLGG

SEQ ID NO: 902 - protein, 8 aa, Mycobacterium avium
DDLPDERR

SEQ ID NO: 903 - protein, 18 aa, Mycobacterium avium
DDLPEESRASGFGRSEST

SEQ ID NO: 904 - protein, 12 aa, Mycobacterium avium
DDNGSGVPEDER

SEQ ID NO: 905 - protein, 6 aa, Mycobacterium avium
DDPAAA

SEQ ID NO: 906 - protein, 10 aa, Mycobacterium avium
DDPAPGVSPE

SEQ ID NO: 907 - protein, 8 aa, Mycobacterium avium
DDPRAATA

SEQ ID NO: 908 - protein, 7 aa, Mycobacterium avium
DDQGATS

SEQ ID NO: 909 - protein, 8 aa, Mycobacterium avium
DDRGCGQV

SEQ ID NO: 910 - protein, 7 aa, Mycobacterium avium
DDRKQTA

SEQ ID NO: 911 - protein, 11 aa, Mycobacterium avium
DDTGKSVAEKL

SEQ ID NO: 912 - protein, 4 aa, Mycobacterium avium
DDTK

SEQ ID NO: 913 - protein, 7 aa, Mycobacterium avium
DDTPTMP

SEQ ID NO: 914 - protein, 7 aa, Mycobacterium avium
DDVDPSL

SEQ ID NO: 915 - protein, 9 aa, Mycobacterium avium
DDVNPHDPF

SEQ ID NO: 916 - protein, 7 aa, Mycobacterium avium
DDYKAAG

SEQ ID NO: 917 - protein, 20 aa, Mycobacterium avium
DEADQPEHRRGSFGKPAPGF

SEQ ID NO: 918 - protein, 11 aa, Mycobacterium avium
DEAKHQLDTGR

SEQ ID NO: 919 - protein, 6 aa, Mycobacterium avium
DEATRQ

SEQ ID NO: 920 - protein, 5 aa, Mycobacterium avium
DEDLA

SEQ ID NO: 921 - protein, 5 aa, Mycobacterium avium
DEDTV

SEQ ID NO: 922 - protein, 6 aa, Mycobacterium avium
DEEGEL

SEQ ID NO: 923 - protein, 7 aa, Mycobacterium avium
DEHPNTN

SEQ ID NO: 924 - protein, 4 aa, Mycobacterium avium
DEIG

SEQ ID NO: 925 - protein, 6 aa, Mycobacterium avium
DEKSLA

SEQ ID NO: 926 - protein, 4 aa, Mycobacterium avium
DELD

SEQ ID NO: 927 - protein, 24 aa, Mycobacterium avium
DELDAAETAARQHDSDGDGETRPD

SEQ ID NO: 928 - protein, 4 aa, Mycobacterium avium
DELR

SEQ ID NO: 929 - protein, 6 aa, Mycobacterium avium
DELTPG

SEQ ID NO: 930 - protein, 4 aa, Mycobacterium avium
DEMG

SEQ ID NO: 931 - protein, 5 aa, Mycobacterium avium
DEMGD

SEQ ID NO: 932 - protein, 16 aa, Mycobacterium avium
DEPSPDHPVDERDDAY

SEQ ID NO: 933 - protein, 9 aa, Mycobacterium avium
DEPTPEQPA

SEQ ID NO: 934 - protein, 8 aa, Mycobacterium avium
DEPTPQVD

SEQ ID NO: 935 - protein, 7 aa, Mycobacterium avium
DEREGNS

SEQ ID NO: 936 - protein, 8 aa, Mycobacterium avium
DERGRIPT

SEQ ID NO: 937 - protein, 7 aa, Mycobacterium avium
DERPAQV

SEQ ID NO: 938 - protein, 7 aa, Mycobacterium avium
DERPGAV

SEQ ID NO: 939 - protein, 12 aa, Mycobacterium avium
DESHADPPSTRE

SEQ ID NO: 940 - protein, 7 aa, Mycobacterium avium
DETCGPV

SEQ ID NO: 941 - protein, 6 aa, Mycobacterium avium
DETTQA

SEQ ID NO: 942 - protein, 14 aa, Mycobacterium avium
DEYDQAETAPIEDL

SEQ ID NO: 943 - protein, 7 aa, Mycobacterium avium
DFGPTDD

SEQ ID NO: 944 - protein, 4 aa, Mycobacterium avium
DGAG

SEQ ID NO: 945 - protein, 7 aa, Mycobacterium avium
DGAGPFD

SEQ ID NO: 946 - protein, 6 aa, Mycobacterium avium
DGAPAV

SEQ ID NO: 947 - protein, 17 aa, Mycobacterium avium
DGAPGPSIRNGARIPED

SEQ ID NO: 948 - protein, 5 aa, Mycobacterium avium
DGAPK

SEQ ID NO: 949 - protein, 19 aa, Mycobacterium avium
DGARREAQAYRGDNPRPLG

SEQ ID NO: 950 - protein, 7 aa, Mycobacterium avium
DGARSDT

SEQ ID NO: 951 - protein, 6 aa, Mycobacterium avium
DGATGE

SEQ ID NO: 952 - protein, 7 aa, Mycobacterium avium
DGATSGI

SEQ ID NO: 953 - protein, 5 aa, Mycobacterium avium
DGDED

SEQ ID NO: 954 - protein, 12 aa, Mycobacterium avium
DGDRRGVGSAAR

SEQ ID NO: 955 - protein, 4 aa, Mycobacterium avium
DGEV

SEQ ID NO: 956 - protein, 5 aa, Mycobacterium avium
DGFSG

SEQ ID NO: 957 - protein, 12 aa, Mycobacterium avium
DGGAASPEHSHT

SEQ ID NO: 958 - protein, 7 aa, Mycobacterium avium
DGGKRAR

SEQ ID NO: 959 - protein, 5 aa, Mycobacterium avium
DGGSL

SEQ ID NO: 960 - protein, 6 aa, Mycobacterium avium
DGHETG

SEQ ID NO: 961 - protein, 7 aa, Mycobacterium avium
DGIKQSV

SEQ ID NO: 962 - protein, 6 aa, Mycobacterium avium
DGLNGE

SEQ ID NO: 963 - protein, 9 aa, Mycobacterium avium
DGLPQKSDV

SEQ ID NO: 964 - protein, 9 aa, Mycobacterium avium
DGNGPSGSH

SEQ ID NO: 965 - protein, 5 aa, Mycobacterium avium
DGPDN

SEQ ID NO: 966 - protein, 7 aa, Mycobacterium avium
DGPGPFD

SEQ ID NO: 967 - protein, 23 aa, Mycobacterium avium
DGPGSPKRLPAGGQIPVSRTAPA

SEQ ID NO: 968 - protein, 8 aa, Mycobacterium avium
DGPGTPEV

SEQ ID NO: 969 - protein, 6 aa, Mycobacterium avium
DGPPTL

SEQ ID NO: 970 - protein, 7 aa, Mycobacterium avium
DGQDADH

SEQ ID NO: 971 - protein, 4 aa, Mycobacterium avium
DGQI

SEQ ID NO: 972 - protein, 12 aa, Mycobacterium avium
DGQRTEQAAADE

SEQ ID NO: 973 - protein, 5 aa, Mycobacterium avium
DGQTI

SEQ ID NO: 974 - protein, 18 aa, Mycobacterium avium
DGQVKSNSDVTLPPMEEG

SEQ ID NO: 975 - protein, 11 aa, Mycobacterium avium
DGRADAENAHG

SEQ ID NO: 976 - protein, 4 aa, Mycobacterium avium
DGRE

SEQ ID NO: 977 - protein, 5 aa, Mycobacterium avium
DGRPV

SEQ ID NO: 978 - protein, 10 aa, Mycobacterium avium
DGRSPSVADP

SEQ ID NO: 979 - protein, 26 aa, Mycobacterium avium
DGSAPDVSGLRPERTDAEEARSRLPE

SEQ ID NO: 980 - protein, 5 aa, Mycobacterium avium
DGSHG

SEQ ID NO: 981 - protein, 6 aa, Mycobacterium avium
DGSLDA

SEQ ID NO: 982 - protein, 6 aa, Mycobacterium avium
DGSPGL

SEQ ID NO: 983 - protein, 5 aa, Mycobacterium avium
DGSPL

SEQ ID NO: 984 - protein, 7 aa, Mycobacterium avium
DGSQPAY

SEQ ID NO: 985 - protein, 4 aa, Mycobacterium avium
DGSS

SEQ ID NO: 986 - protein, 7 aa, Mycobacterium avium
DGSTGEF

SEQ ID NO: 987 - protein, 5 aa, Mycobacterium avium
DGTAI

SEQ ID NO: 988 - protein, 6 aa, Mycobacterium avium
DGTFTY

SEQ ID NO: 989 - protein, 9 aa, Mycobacterium avium
DGTGPVPEL

SEQ ID NO: 990 - protein, 5 aa, Mycobacterium avium
DGTKY

SEQ ID NO: 991 - protein, 8 aa, Mycobacterium avium
DGTPLGPD

SEQ ID NO: 992 - protein, 6 aa, Mycobacterium avium
DGTPRH

SEQ ID NO: 993 - protein, 5 aa, Mycobacterium avium
DGTQE

SEQ ID NO: 994 - protein, 15 aa, Mycobacterium avium
DGTRVNMGNPDGPAL

SEQ ID NO: 995 - protein, 4 aa, Mycobacterium avium
DGVG

SEQ ID NO: 996 - protein, 6 aa, Mycobacterium avium
DGVSTG

SEQ ID NO: 997 - protein, 4 aa, Mycobacterium avium
DHAN

SEQ ID NO: 998 - protein, 8 aa, Mycobacterium avium
DHDNTTGV

SEQ ID NO: 999 - protein, 5 aa, Mycobacterium avium
DHDQM

SEQ ID NO: 1000 - protein, 12 aa, Mycobacterium avium
DHGDQLAGGTAH

SEQ ID NO: 1001 - protein, 10 aa, Mycobacterium avium
DHHANPTRRY

SEQ ID NO: 1002 - protein, 9 aa, Mycobacterium avium
DHPARSETF

SEQ ID NO: 1003 - protein, 6 aa, Mycobacterium avium
DHQVSD

SEQ ID NO: 1004 - protein, 6 aa, Mycobacterium avium
DHRERR

SEQ ID NO: 1005 - protein, 5 aa, Mycobacterium avium
DHRPK

SEQ ID NO: 1006 - protein, 19 aa, Mycobacterium avium
DIAPAPAPQPAKRTRRTPL

SEQ ID NO: 1007 - protein, 5 aa, Mycobacterium avium
DIPDE

SEQ ID NO: 1008 - protein, 10 aa, Mycobacterium avium
DIPTDARSGK

SEQ ID NO: 1009 - protein, 9 aa, Mycobacterium avium
DISGAGAAL

SEQ ID NO: 1010 - protein, 11 aa, Mycobacterium avium
DKAKGSMAGPV

SEQ ID NO: 1011 - protein, 9 aa, Mycobacterium avium
DKDGNPLPQ

SEQ ID NO: 1012 - protein, 7 aa, Mycobacterium avium
DKDIADA

SEQ ID NO: 1013 - protein, 13 aa, Mycobacterium avium
DKGAGAPNEPDEA

SEQ ID NO: 1014 - protein, 6 aa, Mycobacterium avium
DKGRAV

SEQ ID NO: 1015 - protein, 7 aa, Mycobacterium avium
DKKPDLS

SEQ ID NO: 1016 - protein, 5 aa, Mycobacterium avium
DKPGI

SEQ ID NO: 1017 - protein, 8 aa, Mycobacterium avium
DKPGPAAV

SEQ ID NO: 1018 - protein, 8 aa, Mycobacterium avium
DKPLGAEA

SEQ ID NO: 1019 - protein, 8 aa, Mycobacterium avium
DKPLGDDA

SEQ ID NO: 1020 - protein, 9 aa, Mycobacterium avium
DKPTAGSGA

SEQ ID NO: 1021 - protein, 11 aa, Mycobacterium avium
DKQYSSSGGAV

SEQ ID NO: 1022 - protein, 8 aa, Mycobacterium avium
DKRAAPKL

SEQ ID NO: 1023 - protein, 7 aa, Mycobacterium avium
DKSASQA

SEQ ID NO: 1024 - protein, 11 aa, Mycobacterium avium
DKSRSDGSGHG

SEQ ID NO: 1025 - protein, 5 aa, Mycobacterium avium
DLARR

SEQ ID NO: 1026 - protein, 8 aa, Mycobacterium avium
DLDPTLAR

SEQ ID NO: 1027 - protein, 7 aa, Mycobacterium avium
DLDPTSV

SEQ ID NO: 1028 - protein, 10 aa, Mycobacterium avium
DLGSGNTGHK

SEQ ID NO: 1029 - protein, 12 aa, Mycobacterium avium
DLGSRTMREETD

SEQ ID NO: 1030 - protein, 8 aa, Mycobacterium avium
DLKPGIHT

SEQ ID NO: 1031 - protein, 4 aa, Mycobacterium avium
DLQP

SEQ ID NO: 1032 - protein, 5 aa, Mycobacterium avium
DLRDP

SEQ ID NO: 1033 - protein, 6 aa, Mycobacterium avium
DLRPGR

SEQ ID NO: 1034 - protein, 5 aa, Mycobacterium avium
DLRPS

SEQ ID NO: 1035 - protein, 7 aa, Mycobacterium avium
DLRTPQA

SEQ ID NO: 1036 - protein, 8 aa, Mycobacterium avium
DLSGAGAA

SEQ ID NO: 1037 - protein, 13 aa, Mycobacterium avium
DLSNTTHETTRLT

SEQ ID NO: 1038 - protein, 10 aa, Mycobacterium avium
DLTDTAKATR

SEQ ID NO: 1039 - protein, 12 aa, Mycobacterium avium
DLTPNTGTREQT

SEQ ID NO: 1040 - protein, 4 aa, Mycobacterium avium
DMRN

SEQ ID NO: 1041 - protein, 5 aa, Mycobacterium avium
DMTGA

SEQ ID NO: 1042 - protein, 6 aa, Mycobacterium avium
DNIDES

SEQ ID NO: 1043 - protein, 7 aa, Mycobacterium avium
DNPAQPY

SEQ ID NO: 1044 - protein, 6 aa, Mycobacterium avium
DNPDFQ

SEQ ID NO: 1045 - protein, 7 aa, Mycobacterium avium
DNRDAAR

SEQ ID NO: 1046 - protein, 4 aa, Mycobacterium avium
DNSD

SEQ ID NO: 1047 - protein, 6 aa, Mycobacterium avium
DNSERA

SEQ ID NO: 1048 - protein, 9 aa, Mycobacterium avium
DNSSSAPAQ

SEQ ID NO: 1049 - protein, 14 aa, Mycobacterium avium
DNSTDEPASHGGGQ

SEQ ID NO: 1050 - protein, 10 aa, Mycobacterium avium
DNTAETTATG

SEQ ID NO: 1051 - protein, 9 aa, Mycobacterium avium
DNTGSPDAW

SEQ ID NO: 1052 - protein, 9 aa, Mycobacterium avium
DNVPQSPAI

SEQ ID NO: 1053 - protein, 9 aa, Mycobacterium avium
DPAGPASRW

SEQ ID NO: 1054 - protein, 23 aa, Mycobacterium avium
DPAREAEESGDSEESGDSQRADK

SEQ ID NO: 1055 - protein, 4 aa, Mycobacterium avium
DPAS

SEQ ID NO: 1056 - protein, 9 aa, Mycobacterium avium
DPASGKQRA

SEQ ID NO: 1057 - protein, 7 aa, Mycobacterium avium
DPATPYS

SEQ ID NO: 1058 - protein, 14 aa, Mycobacterium avium
DPATQLSGTPPGYY

SEQ ID NO: 1059 - protein, 16 aa, Mycobacterium avium
DPAVAPETPSAARHSR

SEQ ID NO: 1060 - protein, 4 aa, Mycobacterium avium
DPDA

SEQ ID NO: 1061 - protein, 7 aa, Mycobacterium avium
DPDDPTP

SEQ ID NO: 1062 - protein, 6 aa, Mycobacterium avium
DPDEGF

SEQ ID NO: 1063 - protein, 8 aa, Mycobacterium avium
DPDEQPVA

SEQ ID NO: 1064 - protein, 9 aa, Mycobacterium avium
DPDGSKTEF

SEQ ID NO: 1065 - protein, 21 aa, Mycobacterium avium
DPDPCDYPDDQGPDADAPADW

SEQ ID NO: 1066 - protein, 7 aa, Mycobacterium avium
DPDTGAA

SEQ ID NO: 1067 - protein, 13 aa, Mycobacterium avium
DPDTGAPVGAGTA

SEQ ID NO: 1068 - protein, 10 aa, Mycobacterium avium
DPEADQQRAE

SEQ ID NO: 1069 - protein, 5 aa, Mycobacterium avium
DPEAE

SEQ ID NO: 1070 - protein, 8 aa, Mycobacterium avium
DPEDMKAR

SEQ ID NO: 1071 - protein, 6 aa, Mycobacterium avium
DPEPPR

SEQ ID NO: 1072 - protein, 4 aa, Mycobacterium avium
DPER

SEQ ID NO: 1073 - protein, 14 aa, Mycobacterium avium
DPGARPPLQNPDGL

SEQ ID NO: 1074 - protein, 6 aa, Mycobacterium avium
DPGHAV

SEQ ID NO: 1075 - protein, 8 aa, Mycobacterium avium
DPGTGEVD

SEQ ID NO: 1076 - protein, 24 aa, Mycobacterium avium
DPGYAAAAAKRGAVDETRNRRPRV

SEQ ID NO: 1077 - protein, 12 aa, Mycobacterium avium
DPHAKPAEPTIG

SEQ ID NO: 1078 - protein, 11 aa, Mycobacterium avium
DPKPGAFTEKD

SEQ ID NO: 1079 - protein, 18 aa, Mycobacterium avium
DPLPATPRRDLADFVEWV

SEQ ID NO: 1080 - protein, 53 aa, Mycobacterium avium
DPLPEENDQNAQNLSASGSTTGAPKAPTTRKSPTPTPEPQREQVTTTSPSGVT

SEQ ID NO: 1081 - protein, 6 aa, Mycobacterium avium
DPLSSL

SEQ ID NO: 1082 - protein, 12 aa, Mycobacterium avium
DPNPTASSYQPP

SEQ ID NO: 1083 - protein, 15 aa, Mycobacterium avium
DPPAGSYPTAAERRQ

SEQ ID NO: 1084 - protein, 8 aa, Mycobacterium avium
DPPKLNES

SEQ ID NO: 1085 - protein, 9 aa, Mycobacterium avium
DPPSEDAAL

SEQ ID NO: 1086 - protein, 5 aa, Mycobacterium avium
DPPTL

SEQ ID NO: 1087 - protein, 6 aa, Mycobacterium avium
DPPWPE

SEQ ID NO: 1088 - protein, 4 aa, Mycobacterium avium
DPQG

SEQ ID NO: 1089 - protein, 5 aa, Mycobacterium avium
DPQSA

SEQ ID NO: 1090 - protein, 5 aa, Mycobacterium avium
DPQTW

SEQ ID NO: 1091 - protein, 11 aa, Mycobacterium avium
DPRRQDAAGNA

SEQ ID NO: 1092 - protein, 27 aa, Mycobacterium avium
DPSESQMGHSSLESRDAARRTLNRPGF

SEQ ID NO: 1093 - protein, 13 aa, Mycobacterium avium
DPSRVRRSGGTGL

SEQ ID NO: 1094 - protein, 4 aa, Mycobacterium avium
DPTG

SEQ ID NO: 1095 - protein, 9 aa, Mycobacterium avium
DPTPRPIPP

SEQ ID NO: 1096 - protein, 8 aa, Mycobacterium avium
DPTSRSTH

SEQ ID NO: 1097 - protein, 6 aa, Mycobacterium avium
DPYRYP

SEQ ID NO: 1098 - protein, 22 aa, Mycobacterium avium
DPYTLSSDRGAEPDVGPQPDLP

SEQ ID NO: 1099 - protein, 6 aa, Mycobacterium avium
DQAETL

SEQ ID NO: 1100 - protein, 10 aa, Mycobacterium avium
DQGATAAGDD

SEQ ID NO: 1101 - protein, 4 aa, Mycobacterium avium
DQGG

SEQ ID NO: 1102 - protein, 14 aa, Mycobacterium avium
DQGRTGAVKVAFDQ

SEQ ID NO: 1103 - protein, 6 aa, Mycobacterium avium
DQITDK

SEQ ID NO: 1104 - protein, 7 aa, Mycobacterium avium
DQPGKPL

SEQ ID NO: 1105 - protein, 7 aa, Mycobacterium avium
DQQEAAT

SEQ ID NO: 1106 - protein, 6 aa, Mycobacterium avium
DQQGRD

SEQ ID NO: 1107 - protein, 15 aa, Mycobacterium avium
DQRWDRRERGETEVQ

SEQ ID NO: 1108 - protein, 9 aa, Mycobacterium avium
DQSSSGAPR

SEQ ID NO: 1109 - protein, 13 aa, Mycobacterium avium
DQTAEQSGDDADE

SEQ ID NO: 1110 - protein, 5 aa, Mycobacterium avium
DQTAS

SEQ ID NO: 1111 - protein, 20 aa, Mycobacterium avium
DQTDNSEQATLANAAAEGVA

SEQ ID NO: 1112 - protein, 4 aa, Mycobacterium avium
DQTH

SEQ ID NO: 1113 - protein, 6 aa, Mycobacterium avium
DQTPSN

SEQ ID NO: 1114 - protein, 5 aa, Mycobacterium avium
DQYNQ

SEQ ID NO: 1115 - protein, 6 aa, Mycobacterium avium
DRAADP

SEQ ID NO: 1116 - protein, 9 aa, Mycobacterium avium
DRAFERAGR

SEQ ID NO: 1117 - protein, 12 aa, Mycobacterium avium
DRAGQRPWSENT

SEQ ID NO: 1118 - protein, 6 aa, Mycobacterium avium
DRAGSA

SEQ ID NO: 1119 - protein, 6 aa, Mycobacterium avium
DRALPD

SEQ ID NO: 1120 - protein, 6 aa, Mycobacterium avium
DRARNG

SEQ ID NO: 1121 - protein, 6 aa, Mycobacterium avium
DRASAY

SEQ ID NO: 1122 - protein, 9 aa, Mycobacterium avium
DRDADGDTV

SEQ ID NO: 1123 - protein, 8 aa, Mycobacterium avium
DRDAEARA

SEQ ID NO: 1124 - protein, 5 aa, Mycobacterium avium
DRDAL

SEQ ID NO: 1125 - protein, 15 aa, Mycobacterium avium
DRESELRPPVRSGFG

SEQ ID NO: 1126 - protein, 4 aa, Mycobacterium avium
DRFG

SEQ ID NO: 1127 - protein, 6 aa, Mycobacterium avium
DRGNSR

SEQ ID NO: 1128 - protein, 12 aa, Mycobacterium avium
DRGPGMNEQDAS

SEQ ID NO: 1129 - protein, 6 aa, Mycobacterium avium
DRGTAS

SEQ ID NO: 1130 - protein, 14 aa, Mycobacterium avium
DRIGSASLNTDQNI

SEQ ID NO: 1131 - protein, 13 aa, Mycobacterium avium
DRIPAPVGLTRRP

SEQ ID NO: 1132 - protein, 23 aa, Mycobacterium avium
DRKREDERKAIDGEAHRRGNVPV

SEQ ID NO: 1133 - protein, 16 aa, Mycobacterium avium
DRNSSDIRDPGGQYGD

SEQ ID NO: 1134 - protein, 9 aa, Mycobacterium avium
DRPAPAGGR

SEQ ID NO: 1135 - protein, 10 aa, Mycobacterium avium
DRPDGRAPRW

SEQ ID NO: 1136 - protein, 9 aa, Mycobacterium avium
DRPDPSDDR

SEQ ID NO: 1137 - protein, 4 aa, Mycobacterium avium
DRPE

SEQ ID NO: 1138 - protein, 9 aa, Mycobacterium avium
DRPGGLQSN

SEQ ID NO: 1139 - protein, 6 aa, Mycobacterium avium
DRPGIV

SEQ ID NO: 1140 - protein, 7 aa, Mycobacterium avium
DRQGPGK

SEQ ID NO: 1141 - protein, 15 aa, Mycobacterium avium
DRRIGPGTPLAAPPV

SEQ ID NO: 1142 - protein, 4 aa, Mycobacterium avium
DRRN

SEQ ID NO: 1143 - protein, 6 aa, Mycobacterium avium
DRRRGG

SEQ ID NO: 1144 - protein, 6 aa, Mycobacterium avium
DRRRPD

SEQ ID NO: 1145 - protein, 9 aa, Mycobacterium avium
DRSAPSEAL

SEQ ID NO: 1146 - protein, 5 aa, Mycobacterium avium
DRSGV

SEQ ID NO: 1147 - protein, 7 aa, Mycobacterium avium
DRSPPRW

SEQ ID NO: 1148 - protein, 15 aa, Mycobacterium avium
DRSPRLTAPRDQPPP

SEQ ID NO: 1149 - protein, 10 aa, Mycobacterium avium
DRSTLEHAES

SEQ ID NO: 1150 - protein, 8 aa, Mycobacterium avium
DRTATGEG

SEQ ID NO: 1151 - protein, 7 aa, Mycobacterium avium
DRVGGSR

SEQ ID NO: 1152 - protein, 4 aa, Mycobacterium avium
DRVS

SEQ ID NO: 1153 - protein, 7 aa, Mycobacterium avium
DRYGGGT

SEQ ID NO: 1154 - protein, 7 aa, Mycobacterium avium
DSAANGS

SEQ ID NO: 1155 - protein, 4 aa, Mycobacterium avium
DSAH

SEQ ID NO: 1156 - protein, 7 aa, Mycobacterium avium
DSAHRDQ

SEQ ID NO: 1157 - protein, 30 aa, Mycobacterium avium
DSANRLAPRPISRPPVDPASRREFGRPAGL

SEQ ID NO: 1158 - protein, 6 aa, Mycobacterium avium
DSDPTK

SEQ ID NO: 1159 - protein, 12 aa, Mycobacterium avium
DSELGADRLTES

SEQ ID NO: 1160 - protein, 10 aa, Mycobacterium avium
DSFSSSPTWR

SEQ ID NO: 1161 - protein, 15 aa, Mycobacterium avium
DSGLARPAPSSANAH

SEQ ID NO: 1162 - protein, 10 aa, Mycobacterium avium
DSGPNAGAAT

SEQ ID NO: 1163 - protein, 5 aa, Mycobacterium avium
DSGRD

SEQ ID NO: 1164 - protein, 8 aa, Mycobacterium avium
DSKPGTEW

SEQ ID NO: 1165 - protein, 5 aa, Mycobacterium avium
DSKPL

SEQ ID NO: 1166 - protein, 8 aa, Mycobacterium avium
DSKPPAGV

SEQ ID NO: 1167 - protein, 9 aa, Mycobacterium avium
DSLGDAAQS

SEQ ID NO: 1168 - protein, 14 aa, Mycobacterium avium
DSLQPAPKTATGEG

SEQ ID NO: 1169 - protein, 8 aa, Mycobacterium avium
DSNRDEIQ

SEQ ID NO: 1170 - protein, 5 aa, Mycobacterium avium
DSPAL

SEQ ID NO: 1171 - protein, 7 aa, Mycobacterium avium
DSPDGGS

SEQ ID NO: 1172 - protein, 7 aa, Mycobacterium avium
DSPQPAI

SEQ ID NO: 1173 - protein, 13 aa, Mycobacterium avium
DSPRVESGASRLQ

SEQ ID NO: 1174 - protein, 11 aa, Mycobacterium avium
DSRNTSDVAKQ

SEQ ID NO: 1175 - protein, 11 aa, Mycobacterium avium
DSSAKDPSAMG

SEQ ID NO: 1176 - protein, 8 aa, Mycobacterium avium
DSSDIDPL

SEQ ID NO: 1177 - protein, 12 aa, Mycobacterium avium
DSSEPVLQYATA

SEQ ID NO: 1178 - protein, 5 aa, Mycobacterium avium
DSSGE

SEQ ID NO: 1179 - protein, 28 aa, Mycobacterium avium
DSTAPATEPAPSAAPPKAAAPKPPAPRI

SEQ ID NO: 1180 - protein, 10 aa, Mycobacterium avium
DSTPAPPGVK

SEQ ID NO: 1181 - protein, 17 aa, Mycobacterium avium
DSTRAADSGALVGGADA

SEQ ID NO: 1182 - protein, 4 aa, Mycobacterium avium
DSTV

SEQ ID NO: 1183 - protein, 9 aa, Mycobacterium avium
DTARASARP

SEQ ID NO: 1184 - protein, 4 aa, Mycobacterium avium
DTAT

SEQ ID NO: 1185 - protein, 5 aa, Mycobacterium avium
DTATR

SEQ ID NO: 1186 - protein, 5 aa, Mycobacterium avium
DTDKH

SEQ ID NO: 1187 - protein, 6 aa, Mycobacterium avium
DTDNNR

SEQ ID NO: 1188 - protein, 9 aa, Mycobacterium avium
DTDPARAAA

SEQ ID NO: 1189 - protein, 21 aa, Mycobacterium avium
DTEGHPLSQGNQGQASTSVAG

SEQ ID NO: 1190 - protein, 6 aa, Mycobacterium avium
DTGGES

SEQ ID NO: 1191 - protein, 4 aa, Mycobacterium avium
DTKL

SEQ ID NO: 1192 - protein, 5 aa, Mycobacterium avium
DTNAI

SEQ ID NO: 1193 - protein, 17 aa, Mycobacterium avium
DTNAPNAFATGRNPRNA

SEQ ID NO: 1194 - protein, 6 aa, Mycobacterium avium
DTPAEE

SEQ ID NO: 1195 - protein, 12 aa, Mycobacterium avium
DTPANSVRGSRN

SEQ ID NO: 1196 - protein, 14 aa, Mycobacterium avium
DTPETQAKSATPVP

SEQ ID NO: 1197 - protein, 5 aa, Mycobacterium avium
DTPVP

SEQ ID NO: 1198 - protein, 6 aa, Mycobacterium avium
DTPVST

SEQ ID NO: 1199 - protein, 4 aa, Mycobacterium avium
DTRA

SEQ ID NO: 1200 - protein, 6 aa, Mycobacterium avium
DTRDYY

SEQ ID NO: 1201 - protein, 10 aa, Mycobacterium avium
DTRGYKPVDT

SEQ ID NO: 1202 - protein, 19 aa, Mycobacterium avium
DTRNGLEEQRVGDKVEAEQ

SEQ ID NO: 1203 - protein, 17 aa, Mycobacterium avium
DTRPEDYEGAEISDGAG

SEQ ID NO: 1204 - protein, 11 aa, Mycobacterium avium
DTRYSSSPTPL

SEQ ID NO: 1205 - protein, 7 aa, Mycobacterium avium
DTSGPGA

SEQ ID NO: 1206 - protein, 17 aa, Mycobacterium avium
DVAQQQSAQQVTDQPVG

SEQ ID NO: 1207 - protein, 16 aa, Mycobacterium avium
DVDTRRTALPGTAPDQ

SEQ ID NO: 1208 - protein, 12 aa, Mycobacterium avium
DVEPTEHGAEAT

SEQ ID NO: 1209 - protein, 8 aa, Mycobacterium avium
DVETTSRQ

SEQ ID NO: 1210 - protein, 10 aa, Mycobacterium avium
DVGGTPHDIP

SEQ ID NO: 1211 - protein, 24 aa, Mycobacterium avium
DVGHAGHGGHGTSEFTVGGGASGT

SEQ ID NO: 1212 - protein, 12 aa, Mycobacterium avium
DVGTSGGGSGDD

SEQ ID NO: 1213 - protein, 8 aa, Mycobacterium avium
DVPDEQPA

SEQ ID NO: 1214 - protein, 5 aa, Mycobacterium avium
DVPPL

SEQ ID NO: 1215 - protein, 9 aa, Mycobacterium avium
DVPPPSAAI

SEQ ID NO: 1216 - protein, 5 aa, Mycobacterium avium
DVQGY

SEQ ID NO: 1217 - protein, 6 aa, Mycobacterium avium
DVRSAE

SEQ ID NO: 1218 - protein, 5 aa, Mycobacterium avium
DVTGG

SEQ ID NO: 1219 - protein, 15 aa, Mycobacterium avium
DVTNPAARNEASSPI

SEQ ID NO: 1220 - protein, 13 aa, Mycobacterium avium
DWSTSAAEDHATA

SEQ ID NO: 1221 - protein, 7 aa, Mycobacterium avium
DYADRSS

SEQ ID NO: 1222 - protein, 6 aa, Mycobacterium avium
DYDEDD

SEQ ID NO: 1223 - protein, 9 aa, Mycobacterium avium
DYPPGSEGR

SEQ ID NO: 1224 - protein, 9 aa, Mycobacterium avium
DYPVPGADP

SEQ ID NO: 1225 - protein, 7 aa, Mycobacterium avium
DYSGRSA

SEQ ID NO: 1226 - protein, 6 aa, Mycobacterium avium
EAAAGL

SEQ ID NO: 1227 - protein, 12 aa, Mycobacterium avium
EAAANPGNQTAA

SEQ ID NO: 1228 - protein, 9 aa, Mycobacterium avium
EAAGEAERG

SEQ ID NO: 1229 - protein, 9 aa, Mycobacterium avium
EAANNPSQF

SEQ ID NO: 1230 - protein, 9 aa, Mycobacterium avium
EAATRAGGL

SEQ ID NO: 1231 - protein, 10 aa, Mycobacterium avium
EAEAARVRRD

SEQ ID NO: 1232 - protein, 7 aa, Mycobacterium avium
EAEDTRK

SEQ ID NO: 1233 - protein, 4 aa, Mycobacterium avium
EAEG

SEQ ID NO: 1234 - protein, 10 aa, Mycobacterium avium
EAEPELEGMG

SEQ ID NO: 1235 - protein, 6 aa, Mycobacterium avium
EAGPAT

SEQ ID NO: 1236 - protein, 7 aa, Mycobacterium avium
EAGPKRV

SEQ ID NO: 1237 - protein, 7 aa, Mycobacterium avium
EAGPRRL

SEQ ID NO: 1238 - protein, 7 aa, Mycobacterium avium
EAKNDDS

SEQ ID NO: 1239 - protein, 10 aa, Mycobacterium avium
EAPAEGTPYR

SEQ ID NO: 1240 - protein, 11 aa, Mycobacterium avium
EAQHDRAPIQT

SEQ ID NO: 1241 - protein, 7 aa, Mycobacterium avium
EAQNAAA

SEQ ID NO: 1242 - protein, 7 aa, Mycobacterium avium
EAQTDAL

SEQ ID NO: 1243 - protein, 8 aa, Mycobacterium avium
EARGGERG

SEQ ID NO: 1244 - protein, 7 aa, Mycobacterium avium
EARNGVD

SEQ ID NO: 1245 - protein, 11 aa, Mycobacterium avium
EARRGGVAPAQ

SEQ ID NO: 1246 - protein, 9 aa, Mycobacterium avium
EASGGAAGQ

SEQ ID NO: 1247 - protein, 8 aa, Mycobacterium avium
EASPPPGL

SEQ ID NO: 1248 - protein, 12 aa, Mycobacterium avium
EASSFPLSDYVI

SEQ ID NO: 1249 - protein, 4 aa, Mycobacterium avium
EASW

SEQ ID NO: 1250 - protein, 7 aa, Mycobacterium avium
EATPEDK

SEQ ID NO: 1251 - protein, 11 aa, Mycobacterium avium
EAVSETDFDPG

SEQ ID NO: 1252 - protein, 5 aa, Mycobacterium avium
EDADR

SEQ ID NO: 1253 - protein, 9 aa, Mycobacterium avium
EDAGPGGAQ

SEQ ID NO: 1254 - protein, 10 aa, Mycobacterium avium
EDARAKAEQE

SEQ ID NO: 1255 - protein, 6 aa, Mycobacterium avium
EDDGGN

SEQ ID NO: 1256 - protein, 8 aa, Mycobacterium avium
EDGGGGSI

SEQ ID NO: 1257 - protein, 7 aa, Mycobacterium avium
EDGRTSV

SEQ ID NO: 1258 - protein, 7 aa, Mycobacterium avium
EDLDAGG

SEQ ID NO: 1259 - protein, 93 aa, Mycobacterium avium
EDLDEQTAASGGSDVAGAADAASREPRRTGPKGRPTPKRSEARRNARKGPVAPAPMTASEARARRKTLAGPKLSREERRADKAANRARMSERR

SEQ ID NO: 1260 - protein, 8 aa, Mycobacterium avium
EDNLTDED

SEQ ID NO: 1261 - protein, 14 aa, Mycobacterium avium
EDNTTYDLSGQAGP

SEQ ID NO: 1262 - protein, 5 aa, Mycobacterium avium
EDPGN

SEQ ID NO: 1263 - protein, 6 aa, Mycobacterium avium
EDPPRL

SEQ ID NO: 1264 - protein, 14 aa, Mycobacterium avium
EDPVPPSQRHEGIS

SEQ ID NO: 1265 - protein, 9 aa, Mycobacterium avium
EDPVPRRYP

SEQ ID NO: 1266 - protein, 5 aa, Mycobacterium avium
EDQPW

SEQ ID NO: 1267 - protein, 8 aa, Mycobacterium avium
EDRRDADV

SEQ ID NO: 1268 - protein, 15 aa, Mycobacterium avium
EEAPEPDPDELPATG

SEQ ID NO: 1269 - protein, 16 aa, Mycobacterium avium
EEDRRRAAQTKADTEY

SEQ ID NO: 1270 - protein, 5 aa, Mycobacterium avium
EEEAE

SEQ ID NO: 1271 - protein, 9 aa, Mycobacterium avium
EEESPAVER

SEQ ID NO: 1272 - protein, 9 aa, Mycobacterium avium
EEFPAPKTH

SEQ ID NO: 1273 - protein, 12 aa, Mycobacterium avium
EEGTRKISSGDY

SEQ ID NO: 1274 - protein, 5 aa, Mycobacterium avium
EEHTR

SEQ ID NO: 1275 - protein, 7 aa, Mycobacterium avium
EELTDQN

SEQ ID NO: 1276 - protein, 8 aa, Mycobacterium avium
EENTRDFQ

SEQ ID NO: 1277 - protein, 9 aa, Mycobacterium avium
EEPTPQQRD

SEQ ID NO: 1278 - protein, 15 aa, Mycobacterium avium
EEQRRRVAAQQQSTT

SEQ ID NO: 1279 - protein, 11 aa, Mycobacterium avium
EETKHPQRDVP

SEQ ID NO: 1280 - protein, 5 aa, Mycobacterium avium
EFTDT

SEQ ID NO: 1281 - protein, 8 aa, Mycobacterium avium
EGADLDED

SEQ ID NO: 1282 - protein, 7 aa, Mycobacterium avium
EGDADNA

SEQ ID NO: 1283 - protein, 9 aa, Mycobacterium avium
EGDDCPDST

SEQ ID NO: 1284 - protein, 9 aa, Mycobacterium avium
EGDPASPEG

SEQ ID NO: 1285 - protein, 9 aa, Mycobacterium avium
EGEAAEGED

SEQ ID NO: 1286 - protein, 9 aa, Mycobacterium avium
EGESSSKAT

SEQ ID NO: 1287 - protein, 5 aa, Mycobacterium avium
EGGGF

SEQ ID NO: 1288 - protein, 8 aa, Mycobacterium avium
EGNPEGPT

SEQ ID NO: 1289 - protein, 9 aa, Mycobacterium avium
EGPGIPHGA

SEQ ID NO: 1290 - protein, 6 aa, Mycobacterium avium
EGQKRA

SEQ ID NO: 1291 - protein, 5 aa, Mycobacterium avium
EGSLG

SEQ ID NO: 1292 - protein, 7 aa, Mycobacterium avium
EGSPTRV

SEQ ID NO: 1293 - protein, 7 aa, Mycobacterium avium
EGTDASR

SEQ ID NO: 1294 - protein, 15 aa, Mycobacterium avium
EGTRVDTTEVGPFKK

SEQ ID NO: 1295 - protein, 13 aa, Mycobacterium avium
EGVDGSRPFCTGG

SEQ ID NO: 1296 - protein, 6 aa, Mycobacterium avium
EGVPGV

SEQ ID NO: 1297 - protein, 4 aa, Mycobacterium avium
EHAS

SEQ ID NO: 1298 - protein, 4 aa, Mycobacterium avium
EHGE

SEQ ID NO: 1299 - protein, 6 aa, Mycobacterium avium
EHPARS

SEQ ID NO: 1300 - protein, 8 aa, Mycobacterium avium
EIESQGRE

SEQ ID NO: 1301 - protein, 5 aa, Mycobacterium avium
EIPAG

SEQ ID NO: 1302 - protein, 11 aa, Mycobacterium avium
EIPRSPKDQDT

SEQ ID NO: 1303 - protein, 7 aa, Mycobacterium avium
EIREGRT

SEQ ID NO: 1304 - protein, 8 aa, Mycobacterium avium
EKDGAERR

SEQ ID NO: 1305 - protein, 9 aa, Mycobacterium avium
EKGLGPADE

SEQ ID NO: 1306 - protein, 11 aa, Mycobacterium avium
EKHENGPAATS

SEQ ID NO: 1307 - protein, 7 aa, Mycobacterium avium
EKKRTAR

SEQ ID NO: 1308 - protein, 8 aa, Mycobacterium avium
EKPTMTNG

SEQ ID NO: 1309 - protein, 9 aa, Mycobacterium avium
ELAGGDPDT

SEQ ID NO: 1310 - protein, 11 aa, Mycobacterium avium
ELDEKSELSDR

SEQ ID NO: 1311 - protein, 9 aa, Mycobacterium avium
ELDGSGHDR

SEQ ID NO: 1312 - protein, 6 aa, Mycobacterium avium
ELDTGN

SEQ ID NO: 1313 - protein, 8 aa, Mycobacterium avium
ELGTPQSY

SEQ ID NO: 1314 - protein, 9 aa, Mycobacterium avium
ELPAAPAYE

SEQ ID NO: 1315 - protein, 10 aa, Mycobacterium avium
ELPASGGLYP

SEQ ID NO: 1316 - protein, 50 aa, Mycobacterium avium
ELPDLSGPVPRGPHRKPAAERGAETTGGQGGGRPVSGESREGRDNRDRVQ

SEQ ID NO: 1317 - protein, 7 aa, Mycobacterium avium
ELPGSPR

SEQ ID NO: 1318 - protein, 10 aa, Mycobacterium avium
ELRDDPAAEL

SEQ ID NO: 1319 - protein, 5 aa, Mycobacterium avium
ELRRD

SEQ ID NO: 1320 - protein, 10 aa, Mycobacterium avium
ELSGAQQAAP

SEQ ID NO: 1321 - protein, 14 aa, Mycobacterium avium
ELSTPAAAEAAQPV

SEQ ID NO: 1322 - protein, 12 aa, Mycobacterium avium
ELTDPVEQRRRL

SEQ ID NO: 1323 - protein, 7 aa, Mycobacterium avium
EMDPQST

SEQ ID NO: 1324 - protein, 10 aa, Mycobacterium avium
EMTPDDAQSV

SEQ ID NO: 1325 - protein, 7 aa, Mycobacterium avium
ENARHAG

SEQ ID NO: 1326 - protein, 7 aa, Mycobacterium avium
ENDGTVS

SEQ ID NO: 1327 - protein, 6 aa, Mycobacterium avium
ENDSGG

SEQ ID NO: 1328 - protein, 9 aa, Mycobacterium avium
ENKAPPGVK

SEQ ID NO: 1329 - protein, 7 aa, Mycobacterium avium
ENLETRP

SEQ ID NO: 1330 - protein, 11 aa, Mycobacterium avium
ENNPLSGWDGA

SEQ ID NO: 1331 - protein, 4 aa, Mycobacterium avium
ENSF

SEQ ID NO: 1332 - protein, 8 aa, Mycobacterium avium
ENSHPQQA

SEQ ID NO: 1333 - protein, 22 aa, Mycobacterium avium
EPAATPSSTDSNRGYASAGRHF

SEQ ID NO: 1334 - protein, 14 aa, Mycobacterium avium
EPAEELRSARSPQE

SEQ ID NO: 1335 - protein, 12 aa, Mycobacterium avium
EPCAGNAYRARG

SEQ ID NO: 1336 - protein, 9 aa, Mycobacterium avium
EPCESTPTP

SEQ ID NO: 1337 - protein, 4 aa, Mycobacterium avium
EPDH

SEQ ID NO: 1338 - protein, 5 aa, Mycobacterium avium
EPDSN

SEQ ID NO: 1339 - protein, 9 aa, Mycobacterium avium
EPGAPRLPE

SEQ ID NO: 1340 - protein, 6 aa, Mycobacterium avium
EPGRRQ

SEQ ID NO: 1341 - protein, 10 aa, Mycobacterium avium
EPLETPQTRA

SEQ ID NO: 1342 - protein, 4 aa, Mycobacterium avium
EPLP

SEQ ID NO: 1343 - protein, 11 aa, Mycobacterium avium
EPNGPARLPGN

SEQ ID NO: 1344 - protein, 20 aa, Mycobacterium avium
EPNHPRHEHSPYPRPGPGPR

SEQ ID NO: 1345 - protein, 6 aa, Mycobacterium avium
EPNSAI

SEQ ID NO: 1346 - protein, 7 aa, Mycobacterium avium
EPPKPVR

SEQ ID NO: 1347 - protein, 5 aa, Mycobacterium avium
EPPRV

SEQ ID NO: 1348 - protein, 9 aa, Mycobacterium avium
EPPYKGGPV

SEQ ID NO: 1349 - protein, 5 aa, Mycobacterium avium
EPQQR

SEQ ID NO: 1350 - protein, 7 aa, Mycobacterium avium
EPRGPLP

SEQ ID NO: 1351 - protein, 9 aa, Mycobacterium avium
EPRPSRTAR

SEQ ID NO: 1352 - protein, 8 aa, Mycobacterium avium
EPSAEEDL

SEQ ID NO: 1353 - protein, 9 aa, Mycobacterium avium
EPTASRQPV

SEQ ID NO: 1354 - protein, 17 aa, Mycobacterium avium
EPTETSVSGPRATAGQR

SEQ ID NO: 1355 - protein, 4 aa, Mycobacterium avium
EQAT

SEQ ID NO: 1356 - protein, 6 aa, Mycobacterium avium
EQDKKH

SEQ ID NO: 1357 - protein, 7 aa, Mycobacterium avium
EQFPPSR

SEQ ID NO: 1358 - protein, 9 aa, Mycobacterium avium
EQKETVPDS

SEQ ID NO: 1359 - protein, 5 aa, Mycobacterium avium
EQPKA

SEQ ID NO: 1360 - protein, 5 aa, Mycobacterium avium
EQQIA

SEQ ID NO: 1361 - protein, 11 aa, Mycobacterium avium
EQRKAKLADPA

SEQ ID NO: 1362 - protein, 9 aa, Mycobacterium avium
EQRPAETGW

SEQ ID NO: 1363 - protein, 5 aa, Mycobacterium avium
EQRPL

SEQ ID NO: 1364 - protein, 7 aa, Mycobacterium avium
EQRREND

SEQ ID NO: 1365 - protein, 8 aa, Mycobacterium avium
EQSAEVTA

SEQ ID NO: 1366 - protein, 12 aa, Mycobacterium avium
EQSDGTETDRAG

SEQ ID NO: 1367 - protein, 9 aa, Mycobacterium avium
ERANPVGAG

SEQ ID NO: 1368 - protein, 6 aa, Mycobacterium avium
ERARRR

SEQ ID NO: 1369 - protein, 11 aa, Mycobacterium avium
ERASEDRAAGR

SEQ ID NO: 1370 - protein, 9 aa, Mycobacterium avium
ERASGTAPA

SEQ ID NO: 1371 - protein, 6 aa, Mycobacterium avium
ERDQNA

SEQ ID NO: 1372 - protein, 9 aa, Mycobacterium avium
ERENKVDEV

SEQ ID NO: 1373 - protein, 6 aa, Mycobacterium avium
EREPIP

SEQ ID NO: 1374 - protein, 4 aa, Mycobacterium avium
ERGR

SEQ ID NO: 1375 - protein, 5 aa, Mycobacterium avium
ERGRY

SEQ ID NO: 1376 - protein, 14 aa, Mycobacterium avium
ERGSSNAPAKLPED

SEQ ID NO: 1377 - protein, 5 aa, Mycobacterium avium
ERIRS

SEQ ID NO: 1378 - protein, 11 aa, Mycobacterium avium
ERKPTPTDERN

SEQ ID NO: 1379 - protein, 14 aa, Mycobacterium avium
ERLRPPPGYKDTTV

SEQ ID NO: 1380 - protein, 12 aa, Mycobacterium avium
ERPGPATAAPRL

SEQ ID NO: 1381 - protein, 12 aa, Mycobacterium avium
ERPSASPLKPGA

SEQ ID NO: 1382 - protein, 29 aa, Mycobacterium avium
ERQQRDLGGDEAHEDADEDADEAGADEDD

SEQ ID NO: 1383 - protein, 12 aa, Mycobacterium avium
ERRKTQRELSQE

SEQ ID NO: 1384 - protein, 4 aa, Mycobacterium avium
ERRR

SEQ ID NO: 1385 - protein, 5 aa, Mycobacterium avium
ERSQQ

SEQ ID NO: 1386 - protein, 6 aa, Mycobacterium avium
ERSRQG

SEQ ID NO: 1387 - protein, 7 aa, Mycobacterium avium
ERTEPSF

SEQ ID NO: 1388 - protein, 7 aa, Mycobacterium avium
ERTGAKI

SEQ ID NO: 1389 - protein, 5 aa, Mycobacterium avium
ERYAR

SEQ ID NO: 1390 - protein, 7 aa, Mycobacterium avium
ESAARPD

SEQ ID NO: 1391 - protein, 11 aa, Mycobacterium avium
ESADGVTVDED

SEQ ID NO: 1392 - protein, 10 aa, Mycobacterium avium
ESAEGYRPTS

SEQ ID NO: 1393 - protein, 8 aa, Mycobacterium avium
ESAGGLTV

SEQ ID NO: 1394 - protein, 12 aa, Mycobacterium avium
ESDANPSTEVGQ

SEQ ID NO: 1395 - protein, 14 aa, Mycobacterium avium
ESDGDGTTPESQEK

SEQ ID NO: 1396 - protein, 4 aa, Mycobacterium avium
ESEA

SEQ ID NO: 1397 - protein, 6 aa, Mycobacterium avium
ESEASR

SEQ ID NO: 1398 - protein, 5 aa, Mycobacterium avium
ESEFG

SEQ ID NO: 1399 - protein, 22 aa, Mycobacterium avium
ESERGRASYTTEGTTGLPAGGE

SEQ ID NO: 1400 - protein, 8 aa, Mycobacterium avium
ESESEGLL

SEQ ID NO: 1401 - protein, 5 aa, Mycobacterium avium
ESFAP

SEQ ID NO: 1402 - protein, 7 aa, Mycobacterium avium
ESGEGLA

SEQ ID NO: 1403 - protein, 11 aa, Mycobacterium avium
ESKSDQEGMQG

SEQ ID NO: 1404 - protein, 6 aa, Mycobacterium avium
ESLDDT

SEQ ID NO: 1405 - protein, 7 aa, Mycobacterium avium
ESLPNGQ

SEQ ID NO: 1406 - protein, 4 aa, Mycobacterium avium
ESPG

SEQ ID NO: 1407 - protein, 12 aa, Mycobacterium avium
ESRERAASKDRE

SEQ ID NO: 1408 - protein, 7 aa, Mycobacterium avium
ESRERQA

SEQ ID NO: 1409 - protein, 12 aa, Mycobacterium avium
ESRGRGNISASD

SEQ ID NO: 1410 - protein, 23 aa, Mycobacterium avium
ESSAYQSANDSPHTPGGQGRQQI

SEQ ID NO: 1411 - protein, 11 aa, Mycobacterium avium
ESSPGPGQPKF

SEQ ID NO: 1412 - protein, 7 aa, Mycobacterium avium
ESSPTHI

SEQ ID NO: 1413 - protein, 5 aa, Mycobacterium avium
ESSRG

SEQ ID NO: 1414 - protein, 10 aa, Mycobacterium avium
ESTALNERIG

SEQ ID NO: 1415 - protein, 7 aa, Mycobacterium avium
ESTRADW

SEQ ID NO: 1416 - protein, 7 aa, Mycobacterium avium
ESVQSTL

SEQ ID NO: 1417 - protein, 13 aa, Mycobacterium avium
ETDARVKPSARGL

SEQ ID NO: 1418 - protein, 10 aa, Mycobacterium avium
ETDSTGAQQI

SEQ ID NO: 1419 - protein, 7 aa, Mycobacterium avium
ETEHART

SEQ ID NO: 1420 - protein, 5 aa, Mycobacterium avium
ETGLT

SEQ ID NO: 1421 - protein, 23 aa, Mycobacterium avium
ETGTTVSSTPLPRPPSPSAAVSH

SEQ ID NO: 1422 - protein, 8 aa, Mycobacterium avium
ETLGSSDE

SEQ ID NO: 1423 - protein, 6 aa, Mycobacterium avium
ETLPKE

SEQ ID NO: 1424 - protein, 11 aa, Mycobacterium avium
ETLTNDQTTKL

SEQ ID NO: 1425 - protein, 8 aa, Mycobacterium avium
ETMPDGGQ

SEQ ID NO: 1426 - protein, 8 aa, Mycobacterium avium
ETNRAPFD

SEQ ID NO: 1427 - protein, 4 aa, Mycobacterium avium
ETPA

SEQ ID NO: 1428 - protein, 11 aa, Mycobacterium avium
ETPADAGADGL

SEQ ID NO: 1429 - protein, 5 aa, Mycobacterium avium
ETPMQ

SEQ ID NO: 1430 - protein, 5 aa, Mycobacterium avium
ETRGQ

SEQ ID NO: 1431 - protein, 8 aa, Mycobacterium avium
ETRTATEL

SEQ ID NO: 1432 - protein, 4 aa, Mycobacterium avium
ETSA

SEQ ID NO: 1433 - protein, 6 aa, Mycobacterium avium
ETSHGS

SEQ ID NO: 1434 - protein, 11 aa, Mycobacterium avium
EVADTAPSPVG

SEQ ID NO: 1435 - protein, 4 aa, Mycobacterium avium
EVED

SEQ ID NO: 1436 - protein, 13 aa, Mycobacterium avium
EVEQSEIGGSPRH

SEQ ID NO: 1437 - protein, 21 aa, Mycobacterium avium
EVPGTTEIPNPTQRPPQPDRP

SEQ ID NO: 1438 - protein, 4 aa, Mycobacterium avium
EVRR

SEQ ID NO: 1439 - protein, 7 aa, Mycobacterium avium
EVSEREG

SEQ ID NO: 1440 - protein, 4 aa, Mycobacterium avium
EVTA

SEQ ID NO: 1441 - protein, 6 aa, Mycobacterium avium
EVTSLP

SEQ ID NO: 1442 - protein, 4 aa, Mycobacterium avium
EVVP

SEQ ID NO: 1443 - protein, 8 aa, Mycobacterium avium
EYAPTDRR

SEQ ID NO: 1444 - protein, 9 aa, Mycobacterium avium
EYAQDIPSA

SEQ ID NO: 1445 - protein, 5 aa, Mycobacterium avium
EYEEK

SEQ ID NO: 1446 - protein, 17 aa, Mycobacterium avium
EYPTDQYPPNDPKAQQP

SEQ ID NO: 1447 - protein, 25 aa, Mycobacterium avium
FAPSPSAETVVGPSPARAGAPSSGL

SEQ ID NO: 1448 - protein, 9 aa, Mycobacterium avium
FATGPNAPT

SEQ ID NO: 1449 - protein, 6 aa, Mycobacterium avium
FDASKN

SEQ ID NO: 1450 - protein, 9 aa, Mycobacterium avium
FDASKNDDS

SEQ ID NO: 1451 - protein, 8 aa, Mycobacterium avium
FDNDDVKT

SEQ ID NO: 1452 - protein, 4 aa, Mycobacterium avium
FDNH

SEQ ID NO: 1453 - protein, 36 aa, Mycobacterium avium
FDPEKAARATATSAATGSTEPAPPTPAGPKKPDGVT

SEQ ID NO: 1454 - protein, 4 aa, Mycobacterium avium
FDPR

SEQ ID NO: 1455 - protein, 7 aa, Mycobacterium avium
FDRSRSD

SEQ ID NO: 1456 - protein, 7 aa, Mycobacterium avium
FDTSPGM

SEQ ID NO: 1457 - protein, 4 aa, Mycobacterium avium
FEGP

SEQ ID NO: 1458 - protein, 10 aa, Mycobacterium avium
FERGEGSMSK

SEQ ID NO: 1459 - protein, 6 aa, Mycobacterium avium
FERPTA

SEQ ID NO: 1460 - protein, 13 aa, Mycobacterium avium
FETAGGPRAPDYY

SEQ ID NO: 1461 - protein, 10 aa, Mycobacterium avium
FGEGDYDGTE

SEQ ID NO: 1462 - protein, 4 aa, Mycobacterium avium
FGGD

SEQ ID NO: 1463 - protein, 13 aa, Mycobacterium avium
FGGEPGPVPNDGF

SEQ ID NO: 1464 - protein, 26 aa, Mycobacterium avium
FGGGGVAPGGGDGGDKHVKSTSAADA

SEQ ID NO: 1465 - protein, 8 aa, Mycobacterium avium
FGGQQEAG

SEQ ID NO: 1466 - protein, 8 aa, Mycobacterium avium
FGKDSRAQ

SEQ ID NO: 1467 - protein, 7 aa, Mycobacterium avium
FGKGSGV

SEQ ID NO: 1468 - protein, 8 aa, Mycobacterium avium
FGKPSGYL

SEQ ID NO: 1469 - protein, 7 aa, Mycobacterium avium
FGPAPEG

SEQ ID NO: 1470 - protein, 4 aa, Mycobacterium avium
FGPR

SEQ ID NO: 1471 - protein, 4 aa, Mycobacterium avium
FGPT

SEQ ID NO: 1472 - protein, 6 aa, Mycobacterium avium
FGQSGQ

SEQ ID NO: 1473 - protein, 4 aa, Mycobacterium avium
FGSI

SEQ ID NO: 1474 - protein, 9 aa, Mycobacterium avium
FGSSGGPFA

SEQ ID NO: 1475 - protein, 18 aa, Mycobacterium avium
FGTGPLPDDPAPRERGVT

SEQ ID NO: 1476 - protein, 8 aa, Mycobacterium avium
FKESDSDS

SEQ ID NO: 1477 - protein, 7 aa, Mycobacterium avium
FKETNTG

SEQ ID NO: 1478 - protein, 17 aa, Mycobacterium avium
FKPDGVGDDLQSDPVVT

SEQ ID NO: 1479 - protein, 14 aa, Mycobacterium avium
FKPESDDVRDSPAL

SEQ ID NO: 1480 - protein, 8 aa, Mycobacterium avium
FKTGGAPY

SEQ ID NO: 1481 - protein, 5 aa, Mycobacterium avium
FNDSQ

SEQ ID NO: 1482 - protein, 5 aa, Mycobacterium avium
FNSDN

SEQ ID NO: 1483 - protein, 4 aa, Mycobacterium avium
FPGK

SEQ ID NO: 1484 - protein, 5 aa, Mycobacterium avium
FPGLG

SEQ ID NO: 1485 - protein, 8 aa, Mycobacterium avium
FPKGPARN

SEQ ID NO: 1486 - protein, 11 aa, Mycobacterium avium
FPPQPPRSRTW

SEQ ID NO: 1487 - protein, 11 aa, Mycobacterium avium
FPRGSARNAAT

SEQ ID NO: 1488 - protein, 6 aa, Mycobacterium avium
FPSNQR

SEQ ID NO: 1489 - protein, 5 aa, Mycobacterium avium
FPSSN

SEQ ID NO: 1490 - protein, 10 aa, Mycobacterium avium
FQQQDQASTA

SEQ ID NO: 1491 - protein, 18 aa, Mycobacterium avium
FRPSGVGQPQPAGPATGW

SEQ ID NO: 1492 - protein, 9 aa, Mycobacterium avium
FSADGSAAL

SEQ ID NO: 1493 - protein, 6 aa, Mycobacterium avium
FSAPDK

SEQ ID NO: 1494 - protein, 9 aa, Mycobacterium avium
FSETDPPDR

SEQ ID NO: 1495 - protein, 8 aa, Mycobacterium avium
FSGNPEFS

SEQ ID NO: 1496 - protein, 6 aa, Mycobacterium avium
FSGPQI

SEQ ID NO: 1497 - protein, 12 aa, Mycobacterium avium
FSGRGPQLGQSL

SEQ ID NO: 1498 - protein, 8 aa, Mycobacterium avium
FSGRSSAR

SEQ ID NO: 1499 - protein, 8 aa, Mycobacterium avium
FSKKGTRS

SEQ ID NO: 1500 - protein, 9 aa, Mycobacterium avium
FSPNGVPEH

SEQ ID NO: 1501 - protein, 30 aa, Mycobacterium avium
FSPPQPRYSPSVDPAYADQTPYAPTYGPTM

SEQ ID NO: 1502 - protein, 8 aa, Mycobacterium avium
FSPSGEAS

SEQ ID NO: 1503 - protein, 7 aa, Mycobacterium avium
FSPTDTA

SEQ ID NO: 1504 - protein, 13 aa, Mycobacterium avium
FSTSNNDAAQFDP

SEQ ID NO: 1505 - protein, 9 aa, Mycobacterium avium
FTAGDSRTV

SEQ ID NO: 1506 - protein, 5 aa, Mycobacterium avium
FTDAG

SEQ ID NO: 1507 - protein, 10 aa, Mycobacterium avium
FTGDRSDELT

SEQ ID NO: 1508 - protein, 23 aa, Mycobacterium avium
FTGKGGALSSGKYAPDLEPANEQ

SEQ ID NO: 1509 - protein, 9 aa, Mycobacterium avium
FTGTTDHRA

SEQ ID NO: 1510 - protein, 8 aa, Mycobacterium avium
FTPAQATA

SEQ ID NO: 1511 - protein, 5 aa, Mycobacterium avium
FTPKT

SEQ ID NO: 1512 - protein, 7 aa, Mycobacterium avium
FTPSAPN

SEQ ID NO: 1513 - protein, 6 aa, Mycobacterium avium
FYGGGS

SEQ ID NO: 1514 - protein, 8 aa, Mycobacterium avium
GAAAATQV

SEQ ID NO: 1515 - protein, 6 aa, Mycobacterium avium
GAAATV

SEQ ID NO: 1516 - protein, 6 aa, Mycobacterium avium
GAAEAG

SEQ ID NO: 1517 - protein, 7 aa, Mycobacterium avium
GAAGAAP

SEQ ID NO: 1518 - protein, 16 aa, Mycobacterium avium
GAAGGALAALASRRQS

SEQ ID NO: 1519 - protein, 16 aa, Mycobacterium avium
GAAGTLPAEKKPQVGG

SEQ ID NO: 1520 - protein, 15 aa, Mycobacterium avium
GAAKDAQKKGDFAGY

SEQ ID NO: 1521 - protein, 7 aa, Mycobacterium avium
GAAPDKR

SEQ ID NO: 1522 - protein, 9 aa, Mycobacterium avium
GAAPTTGYT

SEQ ID NO: 1523 - protein, 21 aa, Mycobacterium avium
GAARPARPTPKRAHAANDESV

SEQ ID NO: 1524 - protein, 9 aa, Mycobacterium avium
GAARTAGAD

SEQ ID NO: 1525 - protein, 8 aa, Mycobacterium avium
GAARVTEG

SEQ ID NO: 1526 - protein, 17 aa, Mycobacterium avium
GAAVADPASPKSPPGAI

SEQ ID NO: 1527 - protein, 6 aa, Mycobacterium avium
GADEPT

SEQ ID NO: 1528 - protein, 10 aa, Mycobacterium avium
GADGSPVAVS

SEQ ID NO: 1529 - protein, 15 aa, Mycobacterium avium
GADPASPPDPPPQVT

SEQ ID NO: 1530 - protein, 9 aa, Mycobacterium avium
GADPDEANR

SEQ ID NO: 1531 - protein, 37 aa, Mycobacterium avium
GADPDEANRRFKERNQQSSQPPTPQSPADLGEPPQTD

SEQ ID NO: 1532 - protein, 5 aa, Mycobacterium avium
GADVS

SEQ ID NO: 1533 - protein, 18 aa, Mycobacterium avium
GAEANSPVMDNNGGGPLG

SEQ ID NO: 1534 - protein, 6 aa, Mycobacterium avium
GAEAVS

SEQ ID NO: 1535 - protein, 9 aa, Mycobacterium avium
GAGSGRSRA

SEQ ID NO: 1536 - protein, 10 aa, Mycobacterium avium
GAGSPEAKTL

SEQ ID NO: 1537 - protein, 6 aa, Mycobacterium avium
GAGSTA

SEQ ID NO: 1538 - protein, 9 aa, Mycobacterium avium
GAGSTRQHD

SEQ ID NO: 1539 - protein, 4 aa, Mycobacterium avium
GAGV

SEQ ID NO: 1540 - protein, 7 aa, Mycobacterium avium
GAIQGAK

SEQ ID NO: 1541 - protein, 11 aa, Mycobacterium avium
GAKEIADQHGK

SEQ ID NO: 1542 - protein, 8 aa, Mycobacterium avium
GAKPNGEL

SEQ ID NO: 1543 - protein, 8 aa, Mycobacterium avium
GAKPVQPK

SEQ ID NO: 1544 - protein, 4 aa, Mycobacterium avium
GALD

SEQ ID NO: 1545 - protein, 4 aa, Mycobacterium avium
GALG

SEQ ID NO: 1546 - protein, 17 aa, Mycobacterium avium
GALGGKTGYTDDAGQTF

SEQ ID NO: 1547 - protein, 27 aa, Mycobacterium avium
GALPPTAPTDARAAEAAVTAGGGESFG

SEQ ID NO: 1548 - protein, 6 aa, Mycobacterium avium
GALPSP

SEQ ID NO: 1549 - protein, 8 aa, Mycobacterium avium
GANNTGSV

SEQ ID NO: 1550 - protein, 8 aa, Mycobacterium avium
GAPEGSWR

SEQ ID NO: 1551 - protein, 8 aa, Mycobacterium avium
GAPEQQRV

SEQ ID NO: 1552 - protein, 4 aa, Mycobacterium avium
GAPF

SEQ ID NO: 1553 - protein, 6 aa, Mycobacterium avium
GAPFPD

SEQ ID NO: 1554 - protein, 7 aa, Mycobacterium avium
GAPGRAA

SEQ ID NO: 1555 - protein, 5 aa, Mycobacterium avium
GAPGS

SEQ ID NO: 1556 - protein, 7 aa, Mycobacterium avium
GAPLPKK

SEQ ID NO: 1557 - protein, 7 aa, Mycobacterium avium
GAPNRPV

SEQ ID NO: 1558 - protein, 6 aa, Mycobacterium avium
GAPTPI

SEQ ID NO: 1559 - protein, 7 aa, Mycobacterium avium
GAPTSPT

SEQ ID NO: 1560 - protein, 10 aa, Mycobacterium avium
GAQSAQEDSH

SEQ ID NO: 1561 - protein, 9 aa, Mycobacterium avium
GARDANDYE

SEQ ID NO: 1562 - protein, 9 aa, Mycobacterium avium
GARPGGFGD

SEQ ID NO: 1563 - protein, 5 aa, Mycobacterium avium
GARPT

SEQ ID NO: 1564 - protein, 6 aa, Mycobacterium avium
GASAAT

SEQ ID NO: 1565 - protein, 5 aa, Mycobacterium avium
GASEA

SEQ ID NO: 1566 - protein, 7 aa, Mycobacterium avium
GASGSYP

SEQ ID NO: 1567 - protein, 13 aa, Mycobacterium avium
GASLGREGAPRQF

SEQ ID NO: 1568 - protein, 12 aa, Mycobacterium avium
GASTQGARTYRE

SEQ ID NO: 1569 - protein, 26 aa, Mycobacterium avium
GATEITETSSGASELTDSDAAAAGLP

SEQ ID NO: 1570 - protein, 7 aa, Mycobacterium avium
GATGPGV

SEQ ID NO: 1571 - protein, 10 aa, Mycobacterium avium
GATKSLPPGA

SEQ ID NO: 1572 - protein, 7 aa, Mycobacterium avium
GATQTAP

SEQ ID NO: 1573 - protein, 6 aa, Mycobacterium avium
GDAGHQ

SEQ ID NO: 1574 - protein, 7 aa, Mycobacterium avium
GDATASL

SEQ ID NO: 1575 - protein, 6 aa, Mycobacterium avium
GDATKA

SEQ ID NO: 1576 - protein, 9 aa, Mycobacterium avium
GDCPDDELT

SEQ ID NO: 1577 - protein, 12 aa, Mycobacterium avium
GDDGPGIPPAQR

SEQ ID NO: 1578 - protein, 7 aa, Mycobacterium avium
GDEPASP

SEQ ID NO: 1579 - protein, 9 aa, Mycobacterium avium
GDGANDAAA

SEQ ID NO: 1580 - protein, 5 aa, Mycobacterium avium
GDGLA

SEQ ID NO: 1581 - protein, 17 aa, Mycobacterium avium
GDGPQVTAVKPGQAQTI

SEQ ID NO: 1582 - protein, 16 aa, Mycobacterium avium
GDGPRAATTAGPVDQV

SEQ ID NO: 1583 - protein, 4 aa, Mycobacterium avium
GDGV

SEQ ID NO: 1584 - protein, 7 aa, Mycobacterium avium
GDIAPPT

SEQ ID NO: 1585 - protein, 6 aa, Mycobacterium avium
GDIAPT

SEQ ID NO: 1586 - protein, 8 aa, Mycobacterium avium
GDLDEDAW

SEQ ID NO: 1587 - protein, 11 aa, Mycobacterium avium
GDLSGAGAGLA

SEQ ID NO: 1588 - protein, 5 aa, Mycobacterium avium
GDNAV

SEQ ID NO: 1589 - protein, 9 aa, Mycobacterium avium
GDPASGTVP

SEQ ID NO: 1590 - protein, 7 aa, Mycobacterium avium
GDPASVE

SEQ ID NO: 1591 - protein, 9 aa, Mycobacterium avium
GDPATSEAL

SEQ ID NO: 1592 - protein, 10 aa, Mycobacterium avium
GDPEEPTPTA

SEQ ID NO: 1593 - protein, 7 aa, Mycobacterium avium
GDPIGDE

SEQ ID NO: 1594 - protein, 13 aa, Mycobacterium avium
GDPKGEGTGGPGY

SEQ ID NO: 1595 - protein, 5 aa, Mycobacterium avium
GDPLS

SEQ ID NO: 1596 - protein, 9 aa, Mycobacterium avium
GDPMSPEGI

SEQ ID NO: 1597 - protein, 7 aa, Mycobacterium avium
GDPMTQE

SEQ ID NO: 1598 - protein, 12 aa, Mycobacterium avium
GDPPKKRSAANN

SEQ ID NO: 1599 - protein, 12 aa, Mycobacterium avium
GDPQEGTPRGSL

SEQ ID NO: 1600 - protein, 7 aa, Mycobacterium avium
GDPRPVV

SEQ ID NO: 1601 - protein, 11 aa, Mycobacterium avium
GDPTGGQQRAP

SEQ ID NO: 1602 - protein, 10 aa, Mycobacterium avium
GDPTTPGGPL

SEQ ID NO: 1603 - protein, 15 aa, Mycobacterium avium
GDQIKDASASQNQRG

SEQ ID NO: 1604 - protein, 7 aa, Mycobacterium avium
GDQLDER

SEQ ID NO: 1605 - protein, 9 aa, Mycobacterium avium
GDQRTQPFT

SEQ ID NO: 1606 - protein, 8 aa, Mycobacterium avium
GDRDKARM

SEQ ID NO: 1607 - protein, 4 aa, Mycobacterium avium
GDRE

SEQ ID NO: 1608 - protein, 5 aa, Mycobacterium avium
GDRGA

SEQ ID NO: 1609 - protein, 13 aa, Mycobacterium avium
GDRGPNVGPKDQS

SEQ ID NO: 1610 - protein, 8 aa, Mycobacterium avium
GDRLDPTL

SEQ ID NO: 1611 - protein, 8 aa, Mycobacterium avium
GDRPLTPA

SEQ ID NO: 1612 - protein, 11 aa, Mycobacterium avium
GDSPETASLAP

SEQ ID NO: 1613 - protein, 4 aa, Mycobacterium avium
GDSR

SEQ ID NO: 1614 - protein, 12 aa, Mycobacterium avium
GDTGLDTGRPQS

SEQ ID NO: 1615 - protein, 6 aa, Mycobacterium avium
GDTPAR

SEQ ID NO: 1616 - protein, 5 aa, Mycobacterium avium
GDTPL

SEQ ID NO: 1617 - protein, 8 aa, Mycobacterium avium
GDVPPGVT

SEQ ID NO: 1618 - protein, 6 aa, Mycobacterium avium
GDVRGQ

SEQ ID NO: 1619 - protein, 6 aa, Mycobacterium avium
GDWSGA

SEQ ID NO: 1620 - protein, 14 aa, Mycobacterium avium
GDYGPLGPLGGQHP

SEQ ID NO: 1621 - protein, 4 aa, Mycobacterium avium
GDYR

SEQ ID NO: 1622 - protein, 14 aa, Mycobacterium avium
GEAHSAPMTPLDAP

SEQ ID NO: 1623 - protein, 8 aa, Mycobacterium avium
GEAPGWDD

SEQ ID NO: 1624 - protein, 12 aa, Mycobacterium avium
GEDIAKTGNPVV

SEQ ID NO: 1625 - protein, 8 aa, Mycobacterium avium
GEDLGRGG

SEQ ID NO: 1626 - protein, 7 aa, Mycobacterium avium
GEDVSDL

SEQ ID NO: 1627 - protein, 4 aa, Mycobacterium avium
GEFT

SEQ ID NO: 1628 - protein, 6 aa, Mycobacterium avium
GEGISA

SEQ ID NO: 1629 - protein, 10 aa, Mycobacterium avium
GEGQDLQSED

SEQ ID NO: 1630 - protein, 7 aa, Mycobacterium avium
GEHGGLS

SEQ ID NO: 1631 - protein, 6 aa, Mycobacterium avium
GEKDAD

SEQ ID NO: 1632 - protein, 6 aa, Mycobacterium avium
GELGAD

SEQ ID NO: 1633 - protein, 5 aa, Mycobacterium avium
GELGG

SEQ ID NO: 1634 - protein, 4 aa, Mycobacterium avium
GELT

SEQ ID NO: 1635 - protein, 7 aa, Mycobacterium avium
GELTGAQ

SEQ ID NO: 1636 - protein, 12 aa, Mycobacterium avium
GENDMDHPKRTS

SEQ ID NO: 1637 - protein, 4 aa, Mycobacterium avium
GENF

SEQ ID NO: 1638 - protein, 7 aa, Mycobacterium avium
GENSTKY

SEQ ID NO: 1639 - protein, 4 aa, Mycobacterium avium
GENT

SEQ ID NO: 1640 - protein, 14 aa, Mycobacterium avium
GEPDDGVDQPRVPT

SEQ ID NO: 1641 - protein, 7 aa, Mycobacterium avium
GEPEPLR

SEQ ID NO: 1642 - protein, 4 aa, Mycobacterium avium
GEPH

SEQ ID NO: 1643 - protein, 10 aa, Mycobacterium avium
GEPPFTGDSP

SEQ ID NO: 1644 - protein, 8 aa, Mycobacterium avium
GEPQNMPT

SEQ ID NO: 1645 - protein, 14 aa, Mycobacterium avium
GERAGMANSGPHGL

SEQ ID NO: 1646 - protein, 7 aa, Mycobacterium avium
GERPGQA

SEQ ID NO: 1647 - protein, 8 aa, Mycobacterium avium
GERRRRER

SEQ ID NO: 1648 - protein, 14 aa, Mycobacterium avium
GETCNGDSARRSGN

SEQ ID NO: 1649 - protein, 11 aa, Mycobacterium avium
GETGSRTTLSA

SEQ ID NO: 1650 - protein, 10 aa, Mycobacterium avium
GETLGDTARR

SEQ ID NO: 1651 - protein, 6 aa, Mycobacterium avium
GEVPAT

SEQ ID NO: 1652 - protein, 7 aa, Mycobacterium avium
GFAPDGR

SEQ ID NO: 1653 - protein, 7 aa, Mycobacterium avium
GFAPVGP

SEQ ID NO: 1654 - protein, 8 aa, Mycobacterium avium
GFNGSGYD

SEQ ID NO: 1655 - protein, 4 aa, Mycobacterium avium
GFNQ

SEQ ID NO: 1656 - protein, 6 aa, Mycobacterium avium
GGAATN

SEQ ID NO: 1657 - protein, 8 aa, Mycobacterium avium
GGADIQPG

SEQ ID NO: 1658 - protein, 8 aa, Mycobacterium avium
GGAFNNDT

SEQ ID NO: 1659 - protein, 7 aa, Mycobacterium avium
GGAGPER

SEQ ID NO: 1660 - protein, 5 aa, Mycobacterium avium
GGAHG

SEQ ID NO: 1661 - protein, 4 aa, Mycobacterium avium
GGAN

SEQ ID NO: 1662 - protein, 4 aa, Mycobacterium avium
GGAP

SEQ ID NO: 1663 - protein, 6 aa, Mycobacterium avium
GGAPLR

SEQ ID NO: 1664 - protein, 11 aa, Mycobacterium avium
GGAQAISAGQR

SEQ ID NO: 1665 - protein, 6 aa, Mycobacterium avium
GGATAR

SEQ ID NO: 1666 - protein, 8 aa, Mycobacterium avium
GGDPNEQI

SEQ ID NO: 1667 - protein, 4 aa, Mycobacterium avium
GGDQ

SEQ ID NO: 1668 - protein, 4 aa, Mycobacterium avium
GGDT

SEQ ID NO: 1669 - protein, 13 aa, Mycobacterium avium
GGDYVSTGDGIQD

SEQ ID NO: 1670 - protein, 8 aa, Mycobacterium avium
GGEEWAGT

SEQ ID NO: 1671 - protein, 5 aa, Mycobacterium avium
GGESL

SEQ ID NO: 1672 - protein, 4 aa, Mycobacterium avium
GGGA

SEQ ID NO: 1673 - protein, 8 aa, Mycobacterium avium
GGGARDVQ

SEQ ID NO: 1674 - protein, 9 aa, Mycobacterium avium
GGGDKPPPA

SEQ ID NO: 1675 - protein, 10 aa, Mycobacterium avium
GGGEGPPPAR

SEQ ID NO: 1676 - protein, 5 aa, Mycobacterium avium
GGGLA

SEQ ID NO: 1677 - protein, 9 aa, Mycobacterium avium
GGGLANESA

SEQ ID NO: 1678 - protein, 12 aa, Mycobacterium avium
GGGLTGAKTVSL

SEQ ID NO: 1679 - protein, 11 aa, Mycobacterium avium
GGGQRDPQTPM

SEQ ID NO: 1680 - protein, 7 aa, Mycobacterium avium
GGGTPLG

SEQ ID NO: 1681 - protein, 12 aa, Mycobacterium avium
GGHRSEGGRRGV

SEQ ID NO: 1682 - protein, 19 aa, Mycobacterium avium
GGKTAFLGPPGQIGPAMGT

SEQ ID NO: 1683 - protein, 8 aa, Mycobacterium avium
GGLAGEPE

SEQ ID NO: 1684 - protein, 8 aa, Mycobacterium avium
GGLATGNP

SEQ ID NO: 1685 - protein, 36 aa, Mycobacterium avium
GGLDPEQVDELDDASSLTRAERRAVRRQDRENWQTP

SEQ ID NO: 1686 - protein, 4 aa, Mycobacterium avium
GGNG

SEQ ID NO: 1687 - protein, 6 aa, Mycobacterium avium
GGPAFG

SEQ ID NO: 1688 - protein, 6 aa, Mycobacterium avium
GGPGFC

SEQ ID NO: 1689 - protein, 6 aa, Mycobacterium avium
GGPGVA

SEQ ID NO: 1690 - protein, 8 aa, Mycobacterium avium
GGPRKHPY

SEQ ID NO: 1691 - protein, 9 aa, Mycobacterium avium
GGPTGATTA

SEQ ID NO: 1692 - protein, 5 aa, Mycobacterium avium
GGQEK

SEQ ID NO: 1693 - protein, 11 aa, Mycobacterium avium
GGQQQMSRPKL

SEQ ID NO: 1694 - protein, 5 aa, Mycobacterium avium
GGQTI

SEQ ID NO: 1695 - protein, 16 aa, Mycobacterium avium
GGRGNRRVIDGDDEPD

SEQ ID NO: 1696 - protein, 8 aa, Mycobacterium avium
GGRRADAR

SEQ ID NO: 1697 - protein, 6 aa, Mycobacterium avium
GGSAGG

SEQ ID NO: 1698 - protein, 8 aa, Mycobacterium avium
GGSAGGHL

SEQ ID NO: 1699 - protein, 10 aa, Mycobacterium avium
GGSEAVEATA

SEQ ID NO: 1700 - protein, 10 aa, Mycobacterium avium
GGSGAGKSTL

SEQ ID NO: 1701 - protein, 9 aa, Mycobacterium avium
GGSGGARDS

SEQ ID NO: 1702 - protein, 12 aa, Mycobacterium avium
GGSGSNDKDIKQ

SEQ ID NO: 1703 - protein, 7 aa, Mycobacterium avium
GGSGTSI

SEQ ID NO: 1704 - protein, 4 aa, Mycobacterium avium
GGSI

SEQ ID NO: 1705 - protein, 9 aa, Mycobacterium avium
GGSKPYGYT

SEQ ID NO: 1706 - protein, 8 aa, Mycobacterium avium
GGSPAKLL

SEQ ID NO: 1707 - protein, 9 aa, Mycobacterium avium
GGSPGASTA

SEQ ID NO: 1708 - protein, 13 aa, Mycobacterium avium
GGSPLQVSGPAAG

SEQ ID NO: 1709 - protein, 9 aa, Mycobacterium avium
GGSTGSSDV

SEQ ID NO: 1710 - protein, 5 aa, Mycobacterium avium
GGSTV

SEQ ID NO: 1711 - protein, 4 aa, Mycobacterium avium
GGSV

SEQ ID NO: 1712 - protein, 7 aa, Mycobacterium avium
GGTGSVV

SEQ ID NO: 1713 - protein, 6 aa, Mycobacterium avium
GGTPGL

SEQ ID NO: 1714 - protein, 4 aa, Mycobacterium avium
GGTR

SEQ ID NO: 1715 - protein, 6 aa, Mycobacterium avium
GGTSAL

SEQ ID NO: 1716 - protein, 9 aa, Mycobacterium avium
GGTSSIGPG

SEQ ID NO: 1717 - protein, 5 aa, Mycobacterium avium
GGTST

SEQ ID NO: 1718 - protein, 4 aa, Mycobacterium avium
GGTT

SEQ ID NO: 1719 - protein, 16 aa, Mycobacterium avium
GGTTVSMPAAGTHGTV

SEQ ID NO: 1720 - protein, 12 aa, Mycobacterium avium
GGTVGVTTAPGQ

SEQ ID NO: 1721 - protein, 5 aa, Mycobacterium avium
GGTVT

SEQ ID NO: 1722 - protein, 8 aa, Mycobacterium avium
GGVSGGTV

SEQ ID NO: 1723 - protein, 21 aa, Mycobacterium avium
GGWDSGAGWDSGGSDSGGDIG

SEQ ID NO: 1724 - protein, 5 aa, Mycobacterium avium
GHAHP

SEQ ID NO: 1725 - protein, 11 aa, Mycobacterium avium
GHEIGGATTEL

SEQ ID NO: 1726 - protein, 5 aa, Mycobacterium avium
GHEPE

SEQ ID NO: 1727 - protein, 21 aa, Mycobacterium avium
GHERPTRLASPAGAADRPAGT

SEQ ID NO: 1728 - protein, 5 aa, Mycobacterium avium
GHGKL

SEQ ID NO: 1729 - protein, 5 aa, Mycobacterium avium
GHGQV

SEQ ID NO: 1730 - protein, 6 aa, Mycobacterium avium
GHGTGT

SEQ ID NO: 1731 - protein, 8 aa, Mycobacterium avium
GHPDEGPH

SEQ ID NO: 1732 - protein, 4 aa, Mycobacterium avium
GHQA

SEQ ID NO: 1733 - protein, 12 aa, Mycobacterium avium
GHSSAGGSHDLA

SEQ ID NO: 1734 - protein, 9 aa, Mycobacterium avium
GIAAPESYS

SEQ ID NO: 1735 - protein, 4 aa, Mycobacterium avium
GIEG

SEQ ID NO: 1736 - protein, 8 aa, Mycobacterium avium
GINDAPAL

SEQ ID NO: 1737 - protein, 6 aa, Mycobacterium avium
GIPGVS

SEQ ID NO: 1738 - protein, 11 aa, Mycobacterium avium
GISDDGEEAPA

SEQ ID NO: 1739 - protein, 5 aa, Mycobacterium avium
GISGT

SEQ ID NO: 1740 - protein, 5 aa, Mycobacterium avium
GITET

SEQ ID NO: 1741 - protein, 6 aa, Mycobacterium avium
GITPQA

SEQ ID NO: 1742 - protein, 6 aa, Mycobacterium avium
GKAAAV

SEQ ID NO: 1743 - protein, 7 aa, Mycobacterium avium
GKAPKNY

SEQ ID NO: 1744 - protein, 10 aa, Mycobacterium avium
GKARQAGQRE

SEQ ID NO: 1745 - protein, 15 aa, Mycobacterium avium
GKEGNPAQLPPGSTI

SEQ ID NO: 1746 - protein, 15 aa, Mycobacterium avium
GKEQQRTKAALESAR

SEQ ID NO: 1747 - protein, 6 aa, Mycobacterium avium
GKEVPA

SEQ ID NO: 1748 - protein, 7 aa, Mycobacterium avium
GKGGVGV

SEQ ID NO: 1749 - protein, 6 aa, Mycobacterium avium
GKIAGN

SEQ ID NO: 1750 - protein, 7 aa, Mycobacterium avium
GKPLREP

SEQ ID NO: 1751 - protein, 6 aa, Mycobacterium avium
GKPVPA

SEQ ID NO: 1752 - protein, 8 aa, Mycobacterium avium
GKRGPWTP

SEQ ID NO: 1753 - protein, 12 aa, Mycobacterium avium
GKRRGRERRKRP

SEQ ID NO: 1754 - protein, 7 aa, Mycobacterium avium
GKSKSTA

SEQ ID NO: 1755 - protein, 4 aa, Mycobacterium avium
GKTL

SEQ ID NO: 1756 - protein, 7 aa, Mycobacterium avium
GKTVDAG

SEQ ID NO: 1757 - protein, 12 aa, Mycobacterium avium
GLAGKGKQFNTT

SEQ ID NO: 1758 - protein, 10 aa, Mycobacterium avium
GLAGPTMPAR

SEQ ID NO: 1759 - protein, 11 aa, Mycobacterium avium
GLAGRGNPGKT

SEQ ID NO: 1760 - protein, 6 aa, Mycobacterium avium
GLANTA

SEQ ID NO: 1761 - protein, 9 aa, Mycobacterium avium
GLASSSVGA

SEQ ID NO: 1762 - protein, 17 aa, Mycobacterium avium
GLDPKRARKTARTSAHR

SEQ ID NO: 1763 - protein, 8 aa, Mycobacterium avium
GLEQTSRV

SEQ ID NO: 1764 - protein, 10 aa, Mycobacterium avium
GLGAASSSCS

SEQ ID NO: 1765 - protein, 5 aa, Mycobacterium avium
GLGGA

SEQ ID NO: 1766 - protein, 9 aa, Mycobacterium avium
GLGGGNYAA

SEQ ID NO: 1767 - protein, 9 aa, Mycobacterium avium
GLGMNDADR

SEQ ID NO: 1768 - protein, 6 aa, Mycobacterium avium
GLPGRA

SEQ ID NO: 1769 - protein, 7 aa, Mycobacterium avium
GLPPGTY

SEQ ID NO: 1770 - protein, 6 aa, Mycobacterium avium
GLPRGG

SEQ ID NO: 1771 - protein, 8 aa, Mycobacterium avium
GLPRSTRR

SEQ ID NO: 1772 - protein, 10 aa, Mycobacterium avium
GLPRTKTPVE

SEQ ID NO: 1773 - protein, 9 aa, Mycobacterium avium
GLQTNPNAL

SEQ ID NO: 1774 - protein, 6 aa, Mycobacterium avium
GLRPRY

SEQ ID NO: 1775 - protein, 6 aa, Mycobacterium avium
GLRSGS

SEQ ID NO: 1776 - protein, 9 aa, Mycobacterium avium
GLSGGERQR

SEQ ID NO: 1777 - protein, 4 aa, Mycobacterium avium
GLTA

SEQ ID NO: 1778 - protein, 11 aa, Mycobacterium avium
GLTAATARTVA

SEQ ID NO: 1779 - protein, 9 aa, Mycobacterium avium
GLTDPEARV

SEQ ID NO: 1780 - protein, 5 aa, Mycobacterium avium
GLTEQ

SEQ ID NO: 1781 - protein, 8 aa, Mycobacterium avium
GLTPSGVK

SEQ ID NO: 1782 - protein, 8 aa, Mycobacterium avium
GMTSTGDM

SEQ ID NO: 1783 - protein, 7 aa, Mycobacterium avium
GNAGNTE

SEQ ID NO: 1784 - protein, 7 aa, Mycobacterium avium
GNAPFPD

SEQ ID NO: 1785 - protein, 9 aa, Mycobacterium avium
GNAPSNVAA

SEQ ID NO: 1786 - protein, 5 aa, Mycobacterium avium
GNDAA

SEQ ID NO: 1787 - protein, 6 aa, Mycobacterium avium
GNDLGD

SEQ ID NO: 1788 - protein, 9 aa, Mycobacterium avium
GNDRDGENP

SEQ ID NO: 1789 - protein, 4 aa, Mycobacterium avium
GNGA

SEQ ID NO: 1790 - protein, 8 aa, Mycobacterium avium
GNGNTDGT

SEQ ID NO: 1791 - protein, 7 aa, Mycobacterium avium
GNPHGPR

SEQ ID NO: 1792 - protein, 7 aa, Mycobacterium avium
GNPKQGY

SEQ ID NO: 1793 - protein, 4 aa, Mycobacterium avium
GNPV

SEQ ID NO: 1794 - protein, 12 aa, Mycobacterium avium
GNQGDALANESV

SEQ ID NO: 1795 - protein, 13 aa, Mycobacterium avium
GNQGTTLANESVD

SEQ ID NO: 1796 - protein, 11 aa, Mycobacterium avium
GNQGTTLGQES

SEQ ID NO: 1797 - protein, 7 aa, Mycobacterium avium
GNRETPA

SEQ ID NO: 1798 - protein, 11 aa, Mycobacterium avium
GNRTSDQPRPL

SEQ ID NO: 1799 - protein, 6 aa, Mycobacterium avium
GNTRDA

SEQ ID NO: 1800 - protein, 20 aa, Mycobacterium avium
GNTSSPLDFTSDPGAKPDGV

SEQ ID NO: 1801 - protein, 7 aa, Mycobacterium avium
GNVASGA

SEQ ID NO: 1802 - protein, 4 aa, Mycobacterium avium
GPAA

SEQ ID NO: 1803 - protein, 13 aa, Mycobacterium avium
GPAAAAAAGLPDN

SEQ ID NO: 1804 - protein, 9 aa, Mycobacterium avium
GPAAGQSPV

SEQ ID NO: 1805 - protein, 5 aa, Mycobacterium avium
GPADV

SEQ ID NO: 1806 - protein, 5 aa, Mycobacterium avium
GPAMG

SEQ ID NO: 1807 - protein, 4 aa, Mycobacterium avium
GPAP

SEQ ID NO: 1808 - protein, 7 aa, Mycobacterium avium
GPARADR

SEQ ID NO: 1809 - protein, 6 aa, Mycobacterium avium
GPATGG

SEQ ID NO: 1810 - protein, 4 aa, Mycobacterium avium
GPAV

SEQ ID NO: 1811 - protein, 4 aa, Mycobacterium avium
GPDA

SEQ ID NO: 1812 - protein, 11 aa, Mycobacterium avium
GPDGQNPPDEV

SEQ ID NO: 1813 - protein, 6 aa, Mycobacterium avium
GPDGSV

SEQ ID NO: 1814 - protein, 5 aa, Mycobacterium avium
GPDIY

SEQ ID NO: 1815 - protein, 5 aa, Mycobacterium avium
GPDKV

SEQ ID NO: 1816 - protein, 5 aa, Mycobacterium avium
GPDLG

SEQ ID NO: 1817 - protein, 13 aa, Mycobacterium avium
GPDVDGSGGPGYE

SEQ ID NO: 1818 - protein, 4 aa, Mycobacterium avium
GPDY

SEQ ID NO: 1819 - protein, 6 aa, Mycobacterium avium
GPGARG

SEQ ID NO: 1820 - protein, 4 aa, Mycobacterium avium
GPGD

SEQ ID NO: 1821 - protein, 7 aa, Mycobacterium avium
GPGGAGF

SEQ ID NO: 1822 - protein, 10 aa, Mycobacterium avium
GPGHYRSTQP

SEQ ID NO: 1823 - protein, 5 aa, Mycobacterium avium
GPGPL

SEQ ID NO: 1824 - protein, 8 aa, Mycobacterium avium
GPGRGGLA

SEQ ID NO: 1825 - protein, 9 aa, Mycobacterium avium
GPGRTQGGW

SEQ ID NO: 1826 - protein, 11 aa, Mycobacterium avium
GPHGHPSASGW

SEQ ID NO: 1827 - protein, 7 aa, Mycobacterium avium
GPHPATY

SEQ ID NO: 1828 - protein, 12 aa, Mycobacterium avium
GPHTDQTLDGPG

SEQ ID NO: 1829 - protein, 7 aa, Mycobacterium avium
GPLAPPR

SEQ ID NO: 1830 - protein, 4 aa, Mycobacterium avium
GPLR

SEQ ID NO: 1831 - protein, 6 aa, Mycobacterium avium
GPLSDG

SEQ ID NO: 1832 - protein, 13 aa, Mycobacterium avium
GPNEDADGVIPDR

SEQ ID NO: 1833 - protein, 7 aa, Mycobacterium avium
GPNPDRF

SEQ ID NO: 1834 - protein, 8 aa, Mycobacterium avium
GPPGRRTD

SEQ ID NO: 1835 - protein, 8 aa, Mycobacterium avium
GPPGSTAT

SEQ ID NO: 1836 - protein, 8 aa, Mycobacterium avium
GPPGTGKT

SEQ ID NO: 1837 - protein, 5 aa, Mycobacterium avium
GPPIA

SEQ ID NO: 1838 - protein, 9 aa, Mycobacterium avium
GPPLSEPSI

SEQ ID NO: 1839 - protein, 8 aa, Mycobacterium avium
GPPPTTDH

SEQ ID NO: 1840 - protein, 5 aa, Mycobacterium avium
GPPPV

SEQ ID NO: 1841 - protein, 8 aa, Mycobacterium avium
GPQAGTAG

SEQ ID NO: 1842 - protein, 5 aa, Mycobacterium avium
GPQPA

SEQ ID NO: 1843 - protein, 20 aa, Mycobacterium avium
GPRAPGSSYGSRENGPPVNG

SEQ ID NO: 1844 - protein, 11 aa, Mycobacterium avium
GPRDERGNVTH

SEQ ID NO: 1845 - protein, 8 aa, Mycobacterium avium
GPRGQADL

SEQ ID NO: 1846 - protein, 4 aa, Mycobacterium avium
GPRP

SEQ ID NO: 1847 - protein, 4 aa, Mycobacterium avium
GPRV

SEQ ID NO: 1848 - protein, 10 aa, Mycobacterium avium
GPSGAGKSTF

SEQ ID NO: 1849 - protein, 10 aa, Mycobacterium avium
GPSGGPESAT

SEQ ID NO: 1850 - protein, 12 aa, Mycobacterium avium
GPTAEQPKGPFG

SEQ ID NO: 1851 - protein, 11 aa, Mycobacterium avium
GPTAGSMQGPL

SEQ ID NO: 1852 - protein, 20 aa, Mycobacterium avium
GPTDPAADAGWADRKPRKGF

SEQ ID NO: 1853 - protein, 8 aa, Mycobacterium avium
GPTDPYGV

SEQ ID NO: 1854 - protein, 9 aa, Mycobacterium avium
GPTGAGKTT

SEQ ID NO: 1855 - protein, 6 aa, Mycobacterium avium
GPTLSR

SEQ ID NO: 1856 - protein, 6 aa, Mycobacterium avium
GPTNDV

SEQ ID NO: 1857 - protein, 6 aa, Mycobacterium avium
GPTRAG

SEQ ID NO: 1858 - protein, 6 aa, Mycobacterium avium
GPVDEH

SEQ ID NO: 1859 - protein, 5 aa, Mycobacterium avium
GPVGD

SEQ ID NO: 1860 - protein, 12 aa, Mycobacterium avium
GPYRESKLREAY

SEQ ID NO: 1861 - protein, 12 aa, Mycobacterium avium
GPYRQSNLRGAY

SEQ ID NO: 1862 - protein, 8 aa, Mycobacterium avium
GQAASPEQ

SEQ ID NO: 1863 - protein, 8 aa, Mycobacterium avium
GQASSTHM

SEQ ID NO: 1864 - protein, 6 aa, Mycobacterium avium
GQASYQ

SEQ ID NO: 1865 - protein, 11 aa, Mycobacterium avium
GQCGDSGGPVY

SEQ ID NO: 1866 - protein, 8 aa, Mycobacterium avium
GQDQTQAA

SEQ ID NO: 1867 - protein, 5 aa, Mycobacterium avium
GQDSP

SEQ ID NO: 1868 - protein, 10 aa, Mycobacterium avium
GQDYSRETGN

SEQ ID NO: 1869 - protein, 6 aa, Mycobacterium avium
GQGGTI

SEQ ID NO: 1870 - protein, 6 aa, Mycobacterium avium
GQGGTL

SEQ ID NO: 1871 - protein, 9 aa, Mycobacterium avium
GQGRPASVA

SEQ ID NO: 1872 - protein, 20 aa, Mycobacterium avium
GQHDPAPSVPMGTPRTAEGR

SEQ ID NO: 1873 - protein, 8 aa, Mycobacterium avium
GQHPDGGL

SEQ ID NO: 1874 - protein, 8 aa, Mycobacterium avium
GQLAGTSF

SEQ ID NO: 1875 - protein, 26 aa, Mycobacterium avium
GQPHGRPDVQPPPPGAGACATTAVGH

SEQ ID NO: 1876 - protein, 14 aa, Mycobacterium avium
GQPPFEGADPGELR

SEQ ID NO: 1877 - protein, 10 aa, Mycobacterium avium
GQPSGQAASP

SEQ ID NO: 1878 - protein, 9 aa, Mycobacterium avium
GQRATIEGR

SEQ ID NO: 1879 - protein, 6 aa, Mycobacterium avium
GQRGAS

SEQ ID NO: 1880 - protein, 7 aa, Mycobacterium avium
GQSGGSN

SEQ ID NO: 1881 - protein, 5 aa, Mycobacterium avium
GQSKG

SEQ ID NO: 1882 - protein, 5 aa, Mycobacterium avium
GQSPV

SEQ ID NO: 1883 - protein, 11 aa, Mycobacterium avium
GQTIDNTTPPT

SEQ ID NO: 1884 - protein, 6 aa, Mycobacterium avium
GQTIGP

SEQ ID NO: 1885 - protein, 6 aa, Mycobacterium avium
GQTPGN

SEQ ID NO: 1886 - protein, 4 aa, Mycobacterium avium
GQVA

SEQ ID NO: 1887 - protein, 4 aa, Mycobacterium avium
GQVG

SEQ ID NO: 1888 - protein, 21 aa, Mycobacterium avium
GQVNGPKLANNAITTDPAVSQ

SEQ ID NO: 1889 - protein, 5 aa, Mycobacterium avium
GQVSA

SEQ ID NO: 1890 - protein, 12 aa, Mycobacterium avium
GQYKISKLDQVT

SEQ ID NO: 1891 - protein, 9 aa, Mycobacterium avium
GRADATEQQ

SEQ ID NO: 1892 - protein, 7 aa, Mycobacterium avium
GRAQPVG

SEQ ID NO: 1893 - protein, 6 aa, Mycobacterium avium
GRASQM

SEQ ID NO: 1894 - protein, 6 aa, Mycobacterium avium
GRATRL

SEQ ID NO: 1895 - protein, 9 aa, Mycobacterium avium
GRDALGGNG

SEQ ID NO: 1896 - protein, 7 aa, Mycobacterium avium
GRDDAKN

SEQ ID NO: 1897 - protein, 7 aa, Mycobacterium avium
GRDNQNR

SEQ ID NO: 1898 - protein, 7 aa, Mycobacterium avium
GRDPKTD

SEQ ID NO: 1899 - protein, 13 aa, Mycobacterium avium
GRERIEQARESGR

SEQ ID NO: 1900 - protein, 6 aa, Mycobacterium avium
GRFDPR

SEQ ID NO: 1901 - protein, 4 aa, Mycobacterium avium
GRFG

SEQ ID NO: 1902 - protein, 5 aa, Mycobacterium avium
GRGHG

SEQ ID NO: 1903 - protein, 15 aa, Mycobacterium avium
GRGLQDRLTATAVVR

SEQ ID NO: 1904 - protein, 6 aa, Mycobacterium avium
GRIPGT

SEQ ID NO: 1905 - protein, 13 aa, Mycobacterium avium
GRIPGTATGPSRR

SEQ ID NO: 1906 - protein, 15 aa, Mycobacterium avium
GRIPSDKPPIKTPGE

SEQ ID NO: 1907 - protein, 13 aa, Mycobacterium avium
GRITREEAHSHPQ

SEQ ID NO: 1908 - protein, 8 aa, Mycobacterium avium
GRKQDSPA

SEQ ID NO: 1909 - protein, 6 aa, Mycobacterium avium
GRKSRH

SEQ ID NO: 1910 - protein, 11 aa, Mycobacterium avium
GRNGAGKSTTL

SEQ ID NO: 1911 - protein, 8 aa, Mycobacterium avium
GRPADQRA

SEQ ID NO: 1912 - protein, 6 aa, Mycobacterium avium
GRPAEE

SEQ ID NO: 1913 - protein, 4 aa, Mycobacterium avium
GRPE

SEQ ID NO: 1914 - protein, 9 aa, Mycobacterium avium
GRPGPGGDI

SEQ ID NO: 1915 - protein, 8 aa, Mycobacterium avium
GRPTHERV

SEQ ID NO: 1916 - protein, 15 aa, Mycobacterium avium
GRRAGHQVTAPSVTP

SEQ ID NO: 1917 - protein, 22 aa, Mycobacterium avium
GRRDAGEPDRSDALAADPNSPV

SEQ ID NO: 1918 - protein, 6 aa, Mycobacterium avium
GRRKRD

SEQ ID NO: 1919 - protein, 21 aa, Mycobacterium avium
GRRQQGVGNDIGPNPPGQGAE

SEQ ID NO: 1920 - protein, 10 aa, Mycobacterium avium
GRRSRIDATN

SEQ ID NO: 1921 - protein, 7 aa, Mycobacterium avium
GRSADTV

SEQ ID NO: 1922 - protein, 12 aa, Mycobacterium avium
GRSETTHVSAPT

SEQ ID NO: 1923 - protein, 15 aa, Mycobacterium avium
GRSPGFEGRPDRQAV

SEQ ID NO: 1924 - protein, 18 aa, Mycobacterium avium
GRSQQGAQGAGGNGVRTE

SEQ ID NO: 1925 - protein, 13 aa, Mycobacterium avium
GRTAGPADAGRTL

SEQ ID NO: 1926 - protein, 9 aa, Mycobacterium avium
GRTAPTQLA

SEQ ID NO: 1927 - protein, 5 aa, Mycobacterium avium
GRTAT

SEQ ID NO: 1928 - protein, 9 aa, Mycobacterium avium
GRTDTMGRS

SEQ ID NO: 1929 - protein, 6 aa, Mycobacterium avium
GRTGGH

SEQ ID NO: 1930 - protein, 5 aa, Mycobacterium avium
GRTGR

SEQ ID NO: 1931 - protein, 10 aa, Mycobacterium avium
GRTSDALGRR

SEQ ID NO: 1932 - protein, 19 aa, Mycobacterium avium
GRTTAAGADPARGLGPGQI

SEQ ID NO: 1933 - protein, 5 aa, Mycobacterium avium
GRYAG

SEQ ID NO: 1934 - protein, 5 aa, Mycobacterium avium
GRYTG

SEQ ID NO: 1935 - protein, 8 aa, Mycobacterium avium
GSAAAGTG

SEQ ID NO: 1936 - protein, 8 aa, Mycobacterium avium
GSAGAAPA

SEQ ID NO: 1937 - protein, 36 aa, Mycobacterium avium
GSAGRDAEGAKKNYEARKNELQTRLGDTDVTDDVRA

SEQ ID NO: 1938 - protein, 8 aa, Mycobacterium avium
GSAPLTAQ

SEQ ID NO: 1939 - protein, 6 aa, Mycobacterium avium
GSDSFK

SEQ ID NO: 1940 - protein, 4 aa, Mycobacterium avium
GSEC

SEQ ID NO: 1941 - protein, 4 aa, Mycobacterium avium
GSEL

SEQ ID NO: 1942 - protein, 6 aa, Mycobacterium avium
GSFGGE

SEQ ID NO: 1943 - protein, 11 aa, Mycobacterium avium
GSFGGGTSGEV

SEQ ID NO: 1944 - protein, 18 aa, Mycobacterium avium
GSFTPRHASSSAQTPTPH

SEQ ID NO: 1945 - protein, 7 aa, Mycobacterium avium
GSGADAC

SEQ ID NO: 1946 - protein, 14 aa, Mycobacterium avium
GSGAGSADADGGDP

SEQ ID NO: 1947 - protein, 8 aa, Mycobacterium avium
GSGGSTGS

SEQ ID NO: 1948 - protein, 11 aa, Mycobacterium avium
GSGPEQATRPL

SEQ ID NO: 1949 - protein, 5 aa, Mycobacterium avium
GSGPL

SEQ ID NO: 1950 - protein, 9 aa, Mycobacterium avium
GSGQAPTAV

SEQ ID NO: 1951 - protein, 12 aa, Mycobacterium avium
GSGQSGADAEPV

SEQ ID NO: 1952 - protein, 10 aa, Mycobacterium avium
GSGSGPDATR

SEQ ID NO: 1953 - protein, 7 aa, Mycobacterium avium
GSGSVVT

SEQ ID NO: 1954 - protein, 6 aa, Mycobacterium avium
GSGVDA

SEQ ID NO: 1955 - protein, 8 aa, Mycobacterium avium
GSHAGARA

SEQ ID NO: 1956 - protein, 5 aa, Mycobacterium avium
GSHTG

SEQ ID NO: 1957 - protein, 9 aa, Mycobacterium avium
GSHVDGGKR

SEQ ID NO: 1958 - protein, 7 aa, Mycobacterium avium
GSITVGG

SEQ ID NO: 1959 - protein, 4 aa, Mycobacterium avium
GSKD

SEQ ID NO: 1960 - protein, 5 aa, Mycobacterium avium
GSKEE

SEQ ID NO: 1961 - protein, 6 aa, Mycobacterium avium
GSLNGT

SEQ ID NO: 1962 - protein, 6 aa, Mycobacterium avium
GSPEAA

SEQ ID NO: 1963 - protein, 8 aa, Mycobacterium avium
GSPFSTPT

SEQ ID NO: 1964 - protein, 12 aa, Mycobacterium avium
GSPGDPDARRRA

SEQ ID NO: 1965 - protein, 10 aa, Mycobacterium avium
GSPTDGGTPV

SEQ ID NO: 1966 - protein, 7 aa, Mycobacterium avium
GSQAPTA

SEQ ID NO: 1967 - protein, 5 aa, Mycobacterium avium
GSQDT

SEQ ID NO: 1968 - protein, 7 aa, Mycobacterium avium
GSQWPGM

SEQ ID NO: 1969 - protein, 7 aa, Mycobacterium avium
GSRDGTA

SEQ ID NO: 1970 - protein, 5 aa, Mycobacterium avium
GSRLD

SEQ ID NO: 1971 - protein, 9 aa, Mycobacterium avium
GSRLGYQES

SEQ ID NO: 1972 - protein, 8 aa, Mycobacterium avium
GSRQGVTR

SEQ ID NO: 1973 - protein, 8 aa, Mycobacterium avium
GSSGLGPI

SEQ ID NO: 1974 - protein, 8 aa, Mycobacterium avium
GSSGTPKG

SEQ ID NO: 1975 - protein, 10 aa, Mycobacterium avium
GSSKSSAWSN

SEQ ID NO: 1976 - protein, 7 aa, Mycobacterium avium
GSSPRPL

SEQ ID NO: 1977 - protein, 13 aa, Mycobacterium avium
GSSQFEEPTGSIA

SEQ ID NO: 1978 - protein, 14 aa, Mycobacterium avium
GSSSIKATDERRQT

SEQ ID NO: 1979 - protein, 9 aa, Mycobacterium avium
GSTAGATAI

SEQ ID NO: 1980 - protein, 5 aa, Mycobacterium avium
GSTAL

SEQ ID NO: 1981 - protein, 5 aa, Mycobacterium avium
GSTFA

SEQ ID NO: 1982 - protein, 7 aa, Mycobacterium avium
GSTGGVV

SEQ ID NO: 1983 - protein, 10 aa, Mycobacterium avium
GSTGSGKSSF

SEQ ID NO: 1984 - protein, 9 aa, Mycobacterium avium
GSTGSGKST

SEQ ID NO: 1985 - protein, 11 aa, Mycobacterium avium
GSVGRANPGAA

SEQ ID NO: 1986 - protein, 11 aa, Mycobacterium avium
GSVGVESTAGR

SEQ ID NO: 1987 - protein, 7 aa, Mycobacterium avium
GSVQGAR

SEQ ID NO: 1988 - protein, 5 aa, Mycobacterium avium
GSVRR

SEQ ID NO: 1989 - protein, 4 aa, Mycobacterium avium
GSYR

SEQ ID NO: 1990 - protein, 11 aa, Mycobacterium avium
GSYTPTPSNIA

SEQ ID NO: 1991 - protein, 13 aa, Mycobacterium avium
GSYTTGAQQQSRL

SEQ ID NO: 1992 - protein, 4 aa, Mycobacterium avium
GTAA

SEQ ID NO: 1993 - protein, 10 aa, Mycobacterium avium
GTAAAGHFTD

SEQ ID NO: 1994 - protein, 4 aa, Mycobacterium avium
GTAG

SEQ ID NO: 1995 - protein, 4 aa, Mycobacterium avium
GTAP

SEQ ID NO: 1996 - protein, 6 aa, Mycobacterium avium
GTASGG

SEQ ID NO: 1997 - protein, 17 aa, Mycobacterium avium
GTATRTGWWSPGPIRIK

SEQ ID NO: 1998 - protein, 4 aa, Mycobacterium avium
GTAW

SEQ ID NO: 1999 - protein, 15 aa, Mycobacterium avium
GTDPGANASVSAGDE

SEQ ID NO: 2000 - protein, 12 aa, Mycobacterium avium
GTDQEEAAATLG

SEQ ID NO: 2001 - protein, 18 aa, Mycobacterium avium
GTEDLTASVGATHPPGTP

SEQ ID NO: 2002 - protein, 4 aa, Mycobacterium avium
GTGG

SEQ ID NO: 2003 - protein, 5 aa, Mycobacterium avium
GTGGV

SEQ ID NO: 2004 - protein, 5 aa, Mycobacterium avium
GTGGW

SEQ ID NO: 2005 - protein, 9 aa, Mycobacterium avium
GTGKTTTVG

SEQ ID NO: 2006 - protein, 5 aa, Mycobacterium avium
GTGLA

SEQ ID NO: 2007 - protein, 4 aa, Mycobacterium avium
GTGM

SEQ ID NO: 2008 - protein, 7 aa, Mycobacterium avium
GTGMAGS

SEQ ID NO: 2009 - protein, 5 aa, Mycobacterium avium
GTGPA

SEQ ID NO: 2010 - protein, 6 aa, Mycobacterium avium
GTGTLT

SEQ ID NO: 2011 - protein, 4 aa, Mycobacterium avium
GTGV

SEQ ID NO: 2012 - protein, 4 aa, Mycobacterium avium
GTID

SEQ ID NO: 2013 - protein, 7 aa, Mycobacterium avium
GTITLGN

SEQ ID NO: 2014 - protein, 10 aa, Mycobacterium avium
GTKGGEIEMD

SEQ ID NO: 2015 - protein, 5 aa, Mycobacterium avium
GTLTV

SEQ ID NO: 2016 - protein, 11 aa, Mycobacterium avium
GTNPPANQTSA

SEQ ID NO: 2017 - protein, 11 aa, Mycobacterium avium
GTNPPKGQTVP

SEQ ID NO: 2018 - protein, 12 aa, Mycobacterium avium
GTPAHASSAADY

SEQ ID NO: 2019 - protein, 7 aa, Mycobacterium avium
GTPEPVR

SEQ ID NO: 2020 - protein, 5 aa, Mycobacterium avium
GTPGD

SEQ ID NO: 2021 - protein, 20 aa, Mycobacterium avium
GTPGIPRTPLPATSSPAVGA

SEQ ID NO: 2022 - protein, 7 aa, Mycobacterium avium
GTPGPFR

SEQ ID NO: 2023 - protein, 7 aa, Mycobacterium avium
GTPGSLT

SEQ ID NO: 2024 - protein, 28 aa, Mycobacterium avium
GTPLPPGAVPRGAPAGPRGENPPPGSVG

SEQ ID NO: 2025 - protein, 12 aa, Mycobacterium avium
GTPLRSRAAEAA

SEQ ID NO: 2026 - protein, 11 aa, Mycobacterium avium
GTPQKKGEYGA

SEQ ID NO: 2027 - protein, 10 aa, Mycobacterium avium
GTPRFPDERT

SEQ ID NO: 2028 - protein, 7 aa, Mycobacterium avium
GTPYGTV

SEQ ID NO: 2029 - protein, 7 aa, Mycobacterium avium
GTQADYS

SEQ ID NO: 2030 - protein, 4 aa, Mycobacterium avium
GTQL

SEQ ID NO: 2031 - protein, 5 aa, Mycobacterium avium
GTQPW

SEQ ID NO: 2032 - protein, 4 aa, Mycobacterium avium
GTRA

SEQ ID NO: 2033 - protein, 13 aa, Mycobacterium avium
GTRAGYHERNART

SEQ ID NO: 2034 - protein, 7 aa, Mycobacterium avium
GTRPSKG

SEQ ID NO: 2035 - protein, 9 aa, Mycobacterium avium
GTSGSGKSE

SEQ ID NO: 2036 - protein, 4 aa, Mycobacterium avium
GTSV

SEQ ID NO: 2037 - protein, 4 aa, Mycobacterium avium
GTTA

SEQ ID NO: 2038 - protein, 7 aa, Mycobacterium avium
GTTGLPK

SEQ ID NO: 2039 - protein, 9 aa, Mycobacterium avium
GTTGPVKTM

SEQ ID NO: 2040 - protein, 18 aa, Mycobacterium avium
GTTGTPKGANRSTPPTLA

SEQ ID NO: 2041 - protein, 19 aa, Mycobacterium avium
GTTNGKSQAGFSEITVQAA

SEQ ID NO: 2042 - protein, 6 aa, Mycobacterium avium
GTVPSA

SEQ ID NO: 2043 - protein, 4 aa, Mycobacterium avium
GVAG

SEQ ID NO: 2044 - protein, 9 aa, Mycobacterium avium
GVARRGQLR

SEQ ID NO: 2045 - protein, 8 aa, Mycobacterium avium
GVENEDTL

SEQ ID NO: 2046 - protein, 7 aa, Mycobacterium avium
GVKAGDG

SEQ ID NO: 2047 - protein, 7 aa, Mycobacterium avium
GVKTPGV

SEQ ID NO: 2048 - protein, 8 aa, Mycobacterium avium
GVNKPSMP

SEQ ID NO: 2049 - protein, 9 aa, Mycobacterium avium
GVPGGNAWN

SEQ ID NO: 2050 - protein, 12 aa, Mycobacterium avium
GVPKKRTEAGFR

SEQ ID NO: 2051 - protein, 7 aa, Mycobacterium avium
GVPVPSQ

SEQ ID NO: 2052 - protein, 9 aa, Mycobacterium avium
GVRSYDADG

SEQ ID NO: 2053 - protein, 6 aa, Mycobacterium avium
GVTGLR

SEQ ID NO: 2054 - protein, 9 aa, Mycobacterium avium
GWSSAGSDP

SEQ ID NO: 2055 - protein, 5 aa, Mycobacterium avium
GWTTG

SEQ ID NO: 2056 - protein, 4 aa, Mycobacterium avium
GYAA

SEQ ID NO: 2057 - protein, 8 aa, Mycobacterium avium
GYAGSDGD

SEQ ID NO: 2058 - protein, 17 aa, Mycobacterium avium
GYDAAEGQWGHDDADVA

SEQ ID NO: 2059 - protein, 6 aa, Mycobacterium avium
GYGPTV

SEQ ID NO: 2060 - protein, 11 aa, Mycobacterium avium
GYGRPGAGDDE

SEQ ID NO: 2061 - protein, 7 aa, Mycobacterium avium
GYKTDYD

SEQ ID NO: 2062 - protein, 6 aa, Mycobacterium avium
GYKTSY

SEQ ID NO: 2063 - protein, 13 aa, Mycobacterium avium
GYMPDEAGYTPPV

SEQ ID NO: 2064 - protein, 6 aa, Mycobacterium avium
GYNADG

SEQ ID NO: 2065 - protein, 6 aa, Mycobacterium avium
GYPDYT

SEQ ID NO: 2066 - protein, 9 aa, Mycobacterium avium
GYQTGKSDQ

SEQ ID NO: 2067 - protein, 6 aa, Mycobacterium avium
GYRSDR

SEQ ID NO: 2068 - protein, 12 aa, Mycobacterium avium
GYSQLTGSGVSN

SEQ ID NO: 2069 - protein, 5 aa, Mycobacterium avium
HAAPG

SEQ ID NO: 2070 - protein, 8 aa, Mycobacterium avium
HAASDAPL

SEQ ID NO: 2071 - protein, 7 aa, Mycobacterium avium
HAETAYA

SEQ ID NO: 2072 - protein, 6 aa, Mycobacterium avium
HAGPGA

SEQ ID NO: 2073 - protein, 5 aa, Mycobacterium avium
HAPLS

SEQ ID NO: 2074 - protein, 8 aa, Mycobacterium avium
HAPPGRRG

SEQ ID NO: 2075 - protein, 7 aa, Mycobacterium avium
HAPPYPT

SEQ ID NO: 2076 - protein, 9 aa, Mycobacterium avium
HAPQARSTA

SEQ ID NO: 2077 - protein, 7 aa, Mycobacterium avium
HATGDSI

SEQ ID NO: 2078 - protein, 6 aa, Mycobacterium avium
HAVPSA

SEQ ID NO: 2079 - protein, 12 aa, Mycobacterium avium
HCPPRSSLLTRR

SEQ ID NO: 2080 - protein, 7 aa, Mycobacterium avium
HDADNLT

SEQ ID NO: 2081 - protein, 22 aa, Mycobacterium avium
HDAEPAPPRAPSDDEVAPLSFA

SEQ ID NO: 2082 - protein, 6 aa, Mycobacterium avium
HDASER

SEQ ID NO: 2083 - protein, 15 aa, Mycobacterium avium
HDGAGPDAVEVSAEK

SEQ ID NO: 2084 - protein, 6 aa, Mycobacterium avium
HDGAGT

SEQ ID NO: 2085 - protein, 9 aa, Mycobacterium avium
HDGGETGRR

SEQ ID NO: 2086 - protein, 19 aa, Mycobacterium avium
HDGSGDVIKTPNRSDPNQT

SEQ ID NO: 2087 - protein, 11 aa, Mycobacterium avium
HDGSQPAGSQD

SEQ ID NO: 2088 - protein, 5 aa, Mycobacterium avium
HDPGQ

SEQ ID NO: 2089 - protein, 7 aa, Mycobacterium avium
HDQGGSS

SEQ ID NO: 2090 - protein, 7 aa, Mycobacterium avium
HDQTPLR

SEQ ID NO: 2091 - protein, 4 aa, Mycobacterium avium
HDRT

SEQ ID NO: 2092 - protein, 6 aa, Mycobacterium avium
HDSATS

SEQ ID NO: 2093 - protein, 7 aa, Mycobacterium avium
HDTGNAM

SEQ ID NO: 2094 - protein, 25 aa, Mycobacterium avium
HEGRSEVTSGPLADPVNGQPRSAAL

SEQ ID NO: 2095 - protein, 9 aa, Mycobacterium avium
HEKVEQPEK

SEQ ID NO: 2096 - protein, 5 aa, Mycobacterium avium
HEKYA

SEQ ID NO: 2097 - protein, 4 aa, Mycobacterium avium
HELR

SEQ ID NO: 2098 - protein, 5 aa, Mycobacterium avium
HELRS

SEQ ID NO: 2099 - protein, 4 aa, Mycobacterium avium
HEPR

SEQ ID NO: 2100 - protein, 5 aa, Mycobacterium avium
HEQRQ

SEQ ID NO: 2101 - protein, 6 aa, Mycobacterium avium
HGESPT

SEQ ID NO: 2102 - protein, 9 aa, Mycobacterium avium
HGPGIPPQE

SEQ ID NO: 2103 - protein, 5 aa, Mycobacterium avium
HGREG

SEQ ID NO: 2104 - protein, 9 aa, Mycobacterium avium
HGTNDAQKT

SEQ ID NO: 2105 - protein, 6 aa, Mycobacterium avium
HGVPQT

SEQ ID NO: 2106 - protein, 10 aa, Mycobacterium avium
HHDWPTAGTA

SEQ ID NO: 2107 - protein, 11 aa, Mycobacterium avium
HHSEAADQIAS

SEQ ID NO: 2108 - protein, 5 aa, Mycobacterium avium
HHSSE

SEQ ID NO: 2109 - protein, 11 aa, Mycobacterium avium
HIGDSRSPDFE

SEQ ID NO: 2110 - protein, 9 aa, Mycobacterium avium
HKRPNPIRS

SEQ ID NO: 2111 - protein, 8 aa, Mycobacterium avium
HLPSKENG

SEQ ID NO: 2112 - protein, 13 aa, Mycobacterium avium
HLSPETQRALAPA

SEQ ID NO: 2113 - protein, 5 aa, Mycobacterium avium
HLTPS

SEQ ID NO: 2114 - protein, 12 aa, Mycobacterium avium
HMAPGDARRGIF

SEQ ID NO: 2115 - protein, 8 aa, Mycobacterium avium
HNGPRTDF

SEQ ID NO: 2116 - protein, 15 aa, Mycobacterium avium
HNGTISVNSSPGHTE

SEQ ID NO: 2117 - protein, 19 aa, Mycobacterium avium
HNNTSAAGGISDQTEPFSP

SEQ ID NO: 2118 - protein, 13 aa, Mycobacterium avium
HPAPAPTGPILIG

SEQ ID NO: 2119 - protein, 7 aa, Mycobacterium avium
HPDKTAP

SEQ ID NO: 2120 - protein, 6 aa, Mycobacterium avium
HPDLES

SEQ ID NO: 2121 - protein, 5 aa, Mycobacterium avium
HPDSE

SEQ ID NO: 2122 - protein, 24 aa, Mycobacterium avium
HPGARLPAPANTADTTPQSRLTPE

SEQ ID NO: 2123 - protein, 6 aa, Mycobacterium avium
HPGSGG

SEQ ID NO: 2124 - protein, 6 aa, Mycobacterium avium
HPNPPA

SEQ ID NO: 2125 - protein, 5 aa, Mycobacterium avium
HPPIE

SEQ ID NO: 2126 - protein, 5 aa, Mycobacterium avium
HPPTK

SEQ ID NO: 2127 - protein, 6 aa, Mycobacterium avium
HPTATV

SEQ ID NO: 2128 - protein, 9 aa, Mycobacterium avium
HPTPGCPQT

SEQ ID NO: 2129 - protein, 8 aa, Mycobacterium avium
HQAGPART

SEQ ID NO: 2130 - protein, 5 aa, Mycobacterium avium
HQANG

SEQ ID NO: 2131 - protein, 6 aa, Mycobacterium avium
HQPGFG

SEQ ID NO: 2132 - protein, 10 aa, Mycobacterium avium
HQQEAAEGST

SEQ ID NO: 2133 - protein, 6 aa, Mycobacterium avium
HRAAAD

SEQ ID NO: 2134 - protein, 7 aa, Mycobacterium avium
HRRGTPT

SEQ ID NO: 2135 - protein, 4 aa, Mycobacterium avium
HRTG

SEQ ID NO: 2136 - protein, 12 aa, Mycobacterium avium
HRTTRRRGAASK

SEQ ID NO: 2137 - protein, 12 aa, Mycobacterium avium
HSAGGSRKAGAV

SEQ ID NO: 2138 - protein, 7 aa, Mycobacterium avium
HSATDAS

SEQ ID NO: 2139 - protein, 6 aa, Mycobacterium avium
HSDGDL

SEQ ID NO: 2140 - protein, 6 aa, Mycobacterium avium
HSDTEV

SEQ ID NO: 2141 - protein, 12 aa, Mycobacterium avium
HSGTGSGGEPSV

SEQ ID NO: 2142 - protein, 11 aa, Mycobacterium avium
HSLRKGAASSV

SEQ ID NO: 2143 - protein, 12 aa, Mycobacterium avium
HSPGDRRGRYGA

SEQ ID NO: 2144 - protein, 4 aa, Mycobacterium avium
HSPP

SEQ ID NO: 2145 - protein, 7 aa, Mycobacterium avium
HSPRNTW

SEQ ID NO: 2146 - protein, 5 aa, Mycobacterium avium
HSQGE

SEQ ID NO: 2147 - protein, 7 aa, Mycobacterium avium
HSSGSLA

SEQ ID NO: 2148 - protein, 9 aa, Mycobacterium avium
HTAKASRDL

SEQ ID NO: 2149 - protein, 11 aa, Mycobacterium avium
HTEVKDSRRNR

SEQ ID NO: 2150 - protein, 5 aa, Mycobacterium avium
HTGAG

SEQ ID NO: 2151 - protein, 8 aa, Mycobacterium avium
HTGPRTDF

SEQ ID NO: 2152 - protein, 14 aa, Mycobacterium avium
HTNTPGSKNPKRWQ

SEQ ID NO: 2153 - protein, 7 aa, Mycobacterium avium
HTPYPGT

SEQ ID NO: 2154 - protein, 20 aa, Mycobacterium avium
HTREDGPPTHHAKRGTPSMG

SEQ ID NO: 2155 - protein, 7 aa, Mycobacterium avium
HVAGPDH

SEQ ID NO: 2156 - protein, 8 aa, Mycobacterium avium
HYQEEQAN

SEQ ID NO: 2157 - protein, 7 aa, Mycobacterium avium
IADQEKN

SEQ ID NO: 2158 - protein, 12 aa, Mycobacterium avium
IADSDDEPITGP

SEQ ID NO: 2159 - protein, 8 aa, Mycobacterium avium
IAGADRPV

SEQ ID NO: 2160 - protein, 13 aa, Mycobacterium avium
IAGAPTTSPATLS

SEQ ID NO: 2161 - protein, 14 aa, Mycobacterium avium
IAGPPRNSAQVGMP

SEQ ID NO: 2162 - protein, 6 aa, Mycobacterium avium
IAPRSS

SEQ ID NO: 2163 - protein, 7 aa, Mycobacterium avium
IAPTEGR

SEQ ID NO: 2164 - protein, 9 aa, Mycobacterium avium
IARGRVGSA

SEQ ID NO: 2165 - protein, 9 aa, Mycobacterium avium
IASGGTSTV

SEQ ID NO: 2166 - protein, 9 aa, Mycobacterium avium
IDAGTPPDV

SEQ ID NO: 2167 - protein, 7 aa, Mycobacterium avium
IDARQDV

SEQ ID NO: 2168 - protein, 9 aa, Mycobacterium avium
IDDPATKQD

SEQ ID NO: 2169 - protein, 11 aa, Mycobacterium avium
IDDSPSPSTAL

SEQ ID NO: 2170 - protein, 9 aa, Mycobacterium avium
IDESPPGDY

SEQ ID NO: 2171 - protein, 10 aa, Mycobacterium avium
IDFENPPDDA

SEQ ID NO: 2172 - protein, 6 aa, Mycobacterium avium
IDGAGE

SEQ ID NO: 2173 - protein, 5 aa, Mycobacterium avium
IDGGP

SEQ ID NO: 2174 - protein, 7 aa, Mycobacterium avium
IDPRPTD

SEQ ID NO: 2175 - protein, 8 aa, Mycobacterium avium
IDQGPAAG

SEQ ID NO: 2176 - protein, 10 aa, Mycobacterium avium
IDQSGPRLRT

SEQ ID NO: 2177 - protein, 14 aa, Mycobacterium avium
IDSPSGKARYERCT

SEQ ID NO: 2178 - protein, 10 aa, Mycobacterium avium
IDTPSTGTKV

SEQ ID NO: 2179 - protein, 8 aa, Mycobacterium avium
IGAGATAQ

SEQ ID NO: 2180 - protein, 9 aa, Mycobacterium avium
IGAGATAQL

SEQ ID NO: 2181 - protein, 9 aa, Mycobacterium avium
IGDRDSGAL

SEQ ID NO: 2182 - protein, 10 aa, Mycobacterium avium
IGDRPGGGTT

SEQ ID NO: 2183 - protein, 13 aa, Mycobacterium avium
IGETKTVGTGSCV

SEQ ID NO: 2184 - protein, 5 aa, Mycobacterium avium
IGGEY

SEQ ID NO: 2185 - protein, 6 aa, Mycobacterium avium
IGNGAR

SEQ ID NO: 2186 - protein, 6 aa, Mycobacterium avium
IGNGST

SEQ ID NO: 2187 - protein, 6 aa, Mycobacterium avium
IGPAEQ

SEQ ID NO: 2188 - protein, 6 aa, Mycobacterium avium
IGQNGL

SEQ ID NO: 2189 - protein, 7 aa, Mycobacterium avium
IGRANDN

SEQ ID NO: 2190 - protein, 4 aa, Mycobacterium avium
IGRK

SEQ ID NO: 2191 - protein, 5 aa, Mycobacterium avium
IGRQG

SEQ ID NO: 2192 - protein, 6 aa, Mycobacterium avium
IGSDPA

SEQ ID NO: 2193 - protein, 20 aa, Mycobacterium avium
IGSGYGGYSEDHKYFGRHQT

SEQ ID NO: 2194 - protein, 6 aa, Mycobacterium avium
IGTDVK

SEQ ID NO: 2195 - protein, 5 aa, Mycobacterium avium
IHKQT

SEQ ID NO: 2196 - protein, 5 aa, Mycobacterium avium
IHRQT

SEQ ID NO: 2197 - protein, 6 aa, Mycobacterium avium
IKGDAS

SEQ ID NO: 2198 - protein, 12 aa, Mycobacterium avium
IKGDQPGQTANG

SEQ ID NO: 2199 - protein, 8 aa, Mycobacterium avium
IKGTPLES

SEQ ID NO: 2200 - protein, 5 aa, Mycobacterium avium
INPRE

SEQ ID NO: 2201 - protein, 46 aa, Mycobacterium avium
INPTPNLTDPNPPLAPGITPSPPVPGSANPDNPSPGAPATPQPQQP

SEQ ID NO: 2202 - protein, 8 aa, Mycobacterium avium
IPAEGKTI

SEQ ID NO: 2203 - protein, 12 aa, Mycobacterium avium
IPAPSGAAIATT

SEQ ID NO: 2204 - protein, 20 aa, Mycobacterium avium
IPASDIPKLPDTPSPKPMPN

SEQ ID NO: 2205 - protein, 8 aa, Mycobacterium avium
IPDATKAA

SEQ ID NO: 2206 - protein, 6 aa, Mycobacterium avium
IPERTS

SEQ ID NO: 2207 - protein, 12 aa, Mycobacterium avium
IPGGAQDTVKRV

SEQ ID NO: 2208 - protein, 19 aa, Mycobacterium avium
IPGGRTQISGGDPPFTAAT

SEQ ID NO: 2209 - protein, 6 aa, Mycobacterium avium
IPGKSA

SEQ ID NO: 2210 - protein, 12 aa, Mycobacterium avium
IPGQNSGGPNNG

SEQ ID NO: 2211 - protein, 7 aa, Mycobacterium avium
IPGRGTV

SEQ ID NO: 2212 - protein, 6 aa, Mycobacterium avium
IPPGSG

SEQ ID NO: 2213 - protein, 15 aa, Mycobacterium avium
IPRNPTGKVLRKELP

SEQ ID NO: 2214 - protein, 5 aa, Mycobacterium avium
IPSGP

SEQ ID NO: 2215 - protein, 15 aa, Mycobacterium avium
IPTPYGGPQLPIEPP

SEQ ID NO: 2216 - protein, 27 aa, Mycobacterium avium
IPTVPEPAVKTGRGRKRGRAADNSDTI

SEQ ID NO: 2217 - protein, 8 aa, Mycobacterium avium
IQANQSVD

SEQ ID NO: 2218 - protein, 10 aa, Mycobacterium avium
IQGKSAGLRT

SEQ ID NO: 2219 - protein, 13 aa, Mycobacterium avium
IQPSETGKTFPDN

SEQ ID NO: 2220 - protein, 6 aa, Mycobacterium avium
IQSNNS

SEQ ID NO: 2221 - protein, 7 aa, Mycobacterium avium
IQSQSRN

SEQ ID NO: 2222 - protein, 17 aa, Mycobacterium avium
IRAQAQGLSRAVGARGQ

SEQ ID NO: 2223 - protein, 6 aa, Mycobacterium avium
IRPPHG

SEQ ID NO: 2224 - protein, 14 aa, Mycobacterium avium
IRQEQRDWTISRPA

SEQ ID NO: 2225 - protein, 7 aa, Mycobacterium avium
IRRPTRR

SEQ ID NO: 2226 - protein, 6 aa, Mycobacterium avium
IRSNNT

SEQ ID NO: 2227 - protein, 13 aa, Mycobacterium avium
IRTPRPPATRSRQ

SEQ ID NO: 2228 - protein, 4 aa, Mycobacterium avium
ISAG

SEQ ID NO: 2229 - protein, 11 aa, Mycobacterium avium
ISEQEKKITAY

SEQ ID NO: 2230 - protein, 7 aa, Mycobacterium avium
ISGASER

SEQ ID NO: 2231 - protein, 17 aa, Mycobacterium avium
ISGGVQAAPLPPEPQLA

SEQ ID NO: 2232 - protein, 5 aa, Mycobacterium avium
ISPDD

SEQ ID NO: 2233 - protein, 4 aa, Mycobacterium avium
ISPG

SEQ ID NO: 2234 - protein, 12 aa, Mycobacterium avium
ISPGNDPATFAR

SEQ ID NO: 2235 - protein, 6 aa, Mycobacterium avium
ISPSAL

SEQ ID NO: 2236 - protein, 5 aa, Mycobacterium avium
ISSET

SEQ ID NO: 2237 - protein, 6 aa, Mycobacterium avium
ITAAGA

SEQ ID NO: 2238 - protein, 6 aa, Mycobacterium avium
ITATAG

SEQ ID NO: 2239 - protein, 11 aa, Mycobacterium avium
ITATDTPGGGL

SEQ ID NO: 2240 - protein, 13 aa, Mycobacterium avium
ITGGGAKAVGNAV

SEQ ID NO: 2241 - protein, 10 aa, Mycobacterium avium
ITGPNDSTTV

SEQ ID NO: 2242 - protein, 11 aa, Mycobacterium avium
ITQPGSSNPKA

SEQ ID NO: 2243 - protein, 10 aa, Mycobacterium avium
ITRPEGTPIQ

SEQ ID NO: 2244 - protein, 10 aa, Mycobacterium avium
ITRPTGNVPE

SEQ ID NO: 2245 - protein, 7 aa, Mycobacterium avium
ITSGTRE

SEQ ID NO: 2246 - protein, 4 aa, Mycobacterium avium
ITST

SEQ ID NO: 2247 - protein, 11 aa, Mycobacterium avium
IVGPSGSGKST

SEQ ID NO: 2248 - protein, 18 aa, Mycobacterium avium
KAAAGGTPIDQSAIPRQS

SEQ ID NO: 2249 - protein, 5 aa, Mycobacterium avium
KAAIT

SEQ ID NO: 2250 - protein, 6 aa, Mycobacterium avium
KAAPGD

SEQ ID NO: 2251 - protein, 20 aa, Mycobacterium avium
KAAPVTRVDPANPPKPPTQV

SEQ ID NO: 2252 - protein, 16 aa, Mycobacterium avium
KADGKTCRFNPWPYPI

SEQ ID NO: 2253 - protein, 17 aa, Mycobacterium avium
KAEAAPPSAPFADPGNP

SEQ ID NO: 2254 - protein, 8 aa, Mycobacterium avium
KAEDRLDR

SEQ ID NO: 2255 - protein, 9 aa, Mycobacterium avium
KAGAQGPYS

SEQ ID NO: 2256 - protein, 25 aa, Mycobacterium avium
KAGNYGGTGDYRSGTATLSYPATLG

SEQ ID NO: 2257 - protein, 24 aa, Mycobacterium avium
KAGVAGGGEDGAPATEVTITSVLL

SEQ ID NO: 2258 - protein, 7 aa, Mycobacterium avium
KAKEDVQ

SEQ ID NO: 2259 - protein, 12 aa, Mycobacterium avium
KALRPSAPSSVG

SEQ ID NO: 2260 - protein, 5 aa, Mycobacterium avium
KARAA

SEQ ID NO: 2261 - protein, 10 aa, Mycobacterium avium
KDAAGTPGFG

SEQ ID NO: 2262 - protein, 8 aa, Mycobacterium avium
KDEGITDE

SEQ ID NO: 2263 - protein, 5 aa, Mycobacterium avium
KDGAK

SEQ ID NO: 2264 - protein, 8 aa, Mycobacterium avium
KDKLGDSA

SEQ ID NO: 2265 - protein, 12 aa, Mycobacterium avium
KDNGNSKGTIGA

SEQ ID NO: 2266 - protein, 6 aa, Mycobacterium avium
KDNKPL

SEQ ID NO: 2267 - protein, 24 aa, Mycobacterium avium
KDNSLPDHQSGQSLPPGSAFGQAP

SEQ ID NO: 2268 - protein, 9 aa, Mycobacterium avium
KDPHGRHRP

SEQ ID NO: 2269 - protein, 6 aa, Mycobacterium avium
KDPQFG

SEQ ID NO: 2270 - protein, 7 aa, Mycobacterium avium
KDPYGRP

SEQ ID NO: 2271 - protein, 11 aa, Mycobacterium avium
KDQAEPEYTEG

SEQ ID NO: 2272 - protein, 8 aa, Mycobacterium avium
KDQATASF

SEQ ID NO: 2273 - protein, 5 aa, Mycobacterium avium
KDRRP

SEQ ID NO: 2274 - protein, 11 aa, Mycobacterium avium
KDVAAAQALDA

SEQ ID NO: 2275 - protein, 6 aa, Mycobacterium avium
KEAIRD

SEQ ID NO: 2276 - protein, 11 aa, Mycobacterium avium
KEATKEGTLTP

SEQ ID NO: 2277 - protein, 5 aa, Mycobacterium avium
KEFKK

SEQ ID NO: 2278 - protein, 7 aa, Mycobacterium avium
KEFSPGQ

SEQ ID NO: 2279 - protein, 4 aa, Mycobacterium avium
KEGL

SEQ ID NO: 2280 - protein, 8 aa, Mycobacterium avium
KELEKDPV

SEQ ID NO: 2281 - protein, 12 aa, Mycobacterium avium
KENSNDVAAGRR

SEQ ID NO: 2282 - protein, 28 aa, Mycobacterium avium
KETMPTNPDNPKGAFTAARTAKDQGVPI

SEQ ID NO: 2283 - protein, 4 aa, Mycobacterium avium
KEVA

SEQ ID NO: 2284 - protein, 8 aa, Mycobacterium avium
KFETTEDG

SEQ ID NO: 2285 - protein, 8 aa, Mycobacterium avium
KGAPTAHP

SEQ ID NO: 2286 - protein, 8 aa, Mycobacterium avium
KGAPTQGA

SEQ ID NO: 2287 - protein, 7 aa, Mycobacterium avium
KGAPTRG

SEQ ID NO: 2288 - protein, 5 aa, Mycobacterium avium
KGATG

SEQ ID NO: 2289 - protein, 7 aa, Mycobacterium avium
KGCGEAG

SEQ ID NO: 2290 - protein, 14 aa, Mycobacterium avium
KGGENDAQKYASTL

SEQ ID NO: 2291 - protein, 6 aa, Mycobacterium avium
KGGGLS

SEQ ID NO: 2292 - protein, 8 aa, Mycobacterium avium
KGGPLPRG

SEQ ID NO: 2293 - protein, 8 aa, Mycobacterium avium
KGGSAVKP

SEQ ID NO: 2294 - protein, 7 aa, Mycobacterium avium
KGKLTAR

SEQ ID NO: 2295 - protein, 14 aa, Mycobacterium avium
KGKPIAPDADLDGL

SEQ ID NO: 2296 - protein, 12 aa, Mycobacterium avium
KGNGDTDNSDKV

SEQ ID NO: 2297 - protein, 12 aa, Mycobacterium avium
KGPDVDAGGAQS

SEQ ID NO: 2298 - protein, 10 aa, Mycobacterium avium
KGPETANEAS

SEQ ID NO: 2299 - protein, 21 aa, Mycobacterium avium
KGPHPGLGPADPLGPAPTQPQ

SEQ ID NO: 2300 - protein, 19 aa, Mycobacterium avium
KGPLPNAGKMRGVQRTVRR

SEQ ID NO: 2301 - protein, 7 aa, Mycobacterium avium
KGPPTRP

SEQ ID NO: 2302 - protein, 8 aa, Mycobacterium avium
KGQTANLA

SEQ ID NO: 2303 - protein, 5 aa, Mycobacterium avium
KGRRR

SEQ ID NO: 2304 - protein, 8 aa, Mycobacterium avium
KGSTDPQA

SEQ ID NO: 2305 - protein, 7 aa, Mycobacterium avium
KGTPLEG

SEQ ID NO: 2306 - protein, 6 aa, Mycobacterium avium
KGTPWE

SEQ ID NO: 2307 - protein, 8 aa, Mycobacterium avium
KHAPESKA

SEQ ID NO: 2308 - protein, 7 aa, Mycobacterium avium
KHGGATR

SEQ ID NO: 2309 - protein, 7 aa, Mycobacterium avium
KHGNAGK

SEQ ID NO: 2310 - protein, 5 aa, Mycobacterium avium
KHGPG

SEQ ID NO: 2311 - protein, 13 aa, Mycobacterium avium
KHGRPFRRRNPRP

SEQ ID NO: 2312 - protein, 6 aa, Mycobacterium avium
KHSDGD

SEQ ID NO: 2313 - protein, 6 aa, Mycobacterium avium
KHYQSS

SEQ ID NO: 2314 - protein, 8 aa, Mycobacterium avium
KIEPAGDK

SEQ ID NO: 2315 - protein, 8 aa, Mycobacterium avium
KIEPSGDK

SEQ ID NO: 2316 - protein, 7 aa, Mycobacterium avium
KINPRGG

SEQ ID NO: 2317 - protein, 6 aa, Mycobacterium avium
KIPQPV

SEQ ID NO: 2318 - protein, 7 aa, Mycobacterium avium
KIRATPT

SEQ ID NO: 2319 - protein, 8 aa, Mycobacterium avium
KKDQLGEG

SEQ ID NO: 2320 - protein, 5 aa, Mycobacterium avium
KKGLT

SEQ ID NO: 2321 - protein, 9 aa, Mycobacterium avium
KKKPIRPVA

SEQ ID NO: 2322 - protein, 13 aa, Mycobacterium avium
KKSVTEVAEELKA

SEQ ID NO: 2323 - protein, 8 aa, Mycobacterium avium
KKYGKDRQ

SEQ ID NO: 2324 - protein, 5 aa, Mycobacterium avium
KLAGG

SEQ ID NO: 2325 - protein, 7 aa, Mycobacterium avium
KLDAGQQ

SEQ ID NO: 2326 - protein, 10 aa, Mycobacterium avium
KLGSAGSPGI

SEQ ID NO: 2327 - protein, 8 aa, Mycobacterium avium
KLGSSGGV

SEQ ID NO: 2328 - protein, 11 aa, Mycobacterium avium
KLPKTPARTAA

SEQ ID NO: 2329 - protein, 5 aa, Mycobacterium avium
KLPRR

SEQ ID NO: 2330 - protein, 18 aa, Mycobacterium avium
KLSAGSAQRCPAQTGSPL

SEQ ID NO: 2331 - protein, 6 aa, Mycobacterium avium
KMPRGR

SEQ ID NO: 2332 - protein, 6 aa, Mycobacterium avium
KNDPNL

SEQ ID NO: 2333 - protein, 5 aa, Mycobacterium avium
KNDSL

SEQ ID NO: 2334 - protein, 5 aa, Mycobacterium avium
KNRGW

SEQ ID NO: 2335 - protein, 13 aa, Mycobacterium avium
KNVPKKATATLRQ

SEQ ID NO: 2336 - protein, 18 aa, Mycobacterium avium
KPAEAPTDLVAEQPHTAH

SEQ ID NO: 2337 - protein, 7 aa, Mycobacterium avium
KPAGSDA

SEQ ID NO: 2338 - protein, 17 aa, Mycobacterium avium
KPDNWADRTRSESGMGD

SEQ ID NO: 2339 - protein, 20 aa, Mycobacterium avium
KPDPPSGPQETPDGPQRERR

SEQ ID NO: 2340 - protein, 8 aa, Mycobacterium avium
KPEETRRT

SEQ ID NO: 2341 - protein, 7 aa, Mycobacterium avium
KPELGTP

SEQ ID NO: 2342 - protein, 4 aa, Mycobacterium avium
KPIR

SEQ ID NO: 2343 - protein, 7 aa, Mycobacterium avium
KPKEAAG

SEQ ID NO: 2344 - protein, 7 aa, Mycobacterium avium
KPLGEDA

SEQ ID NO: 2345 - protein, 12 aa, Mycobacterium avium
KPNAAQKESEYI

SEQ ID NO: 2346 - protein, 6 aa, Mycobacterium avium
KPPGLA

SEQ ID NO: 2347 - protein, 8 aa, Mycobacterium avium
KPPRGTPI

SEQ ID NO: 2348 - protein, 8 aa, Mycobacterium avium
KPQGRNAR

SEQ ID NO: 2349 - protein, 6 aa, Mycobacterium avium
KPSDVK

SEQ ID NO: 2350 - protein, 23 aa, Mycobacterium avium
KPSGPPTAVYSPQSGELVGPDGV

SEQ ID NO: 2351 - protein, 9 aa, Mycobacterium avium
KPSSPPPPR

SEQ ID NO: 2352 - protein, 4 aa, Mycobacterium avium
KPTP

SEQ ID NO: 2353 - protein, 9 aa, Mycobacterium avium
KPTSTVKDG

SEQ ID NO: 2354 - protein, 6 aa, Mycobacterium avium
KPVARP

SEQ ID NO: 2355 - protein, 6 aa, Mycobacterium avium
KQLEAT

SEQ ID NO: 2356 - protein, 7 aa, Mycobacterium avium
KQNRAAA

SEQ ID NO: 2357 - protein, 8 aa, Mycobacterium avium
KQRGKTTT

SEQ ID NO: 2358 - protein, 26 aa, Mycobacterium avium
KQSPLESTPEGGVGEELSGEKHAEAH

SEQ ID NO: 2359 - protein, 7 aa, Mycobacterium avium
KRARGSP

SEQ ID NO: 2360 - protein, 30 aa, Mycobacterium avium
KRGGPAAGHRSDPHWTRPEDSDADLDEEHD

SEQ ID NO: 2361 - protein, 4 aa, Mycobacterium avium
KRHQ

SEQ ID NO: 2362 - protein, 10 aa, Mycobacterium avium
KRKAKREAQA

SEQ ID NO: 2363 - protein, 17 aa, Mycobacterium avium
KRKLERQLERRAKQART

SEQ ID NO: 2364 - protein, 10 aa, Mycobacterium avium
KRMDGDPEQM

SEQ ID NO: 2365 - protein, 12 aa, Mycobacterium avium
KRPFAGDSLEEQ

SEQ ID NO: 2366 - protein, 4 aa, Mycobacterium avium
KRPR

SEQ ID NO: 2367 - protein, 6 aa, Mycobacterium avium
KRQTLA

SEQ ID NO: 2368 - protein, 5 aa, Mycobacterium avium
KRRAR

SEQ ID NO: 2369 - protein, 13 aa, Mycobacterium avium
KRREESLHPVGEE

SEQ ID NO: 2370 - protein, 8 aa, Mycobacterium avium
KRSREECF

SEQ ID NO: 2371 - protein, 6 aa, Mycobacterium avium
KRTLQT

SEQ ID NO: 2372 - protein, 13 aa, Mycobacterium avium
KRTREARRASQEA

SEQ ID NO: 2373 - protein, 7 aa, Mycobacterium avium
KRTRQDG

SEQ ID NO: 2374 - protein, 15 aa, Mycobacterium avium
KSAGRTSFGSARNAH

SEQ ID NO: 2375 - protein, 13 aa, Mycobacterium avium
KSLEGDGHGGGPI

SEQ ID NO: 2376 - protein, 8 aa, Mycobacterium avium
KSLTADGS

SEQ ID NO: 2377 - protein, 4 aa, Mycobacterium avium
KSNN

SEQ ID NO: 2378 - protein, 8 aa, Mycobacterium avium
KSPALRAD

SEQ ID NO: 2379 - protein, 6 aa, Mycobacterium avium
KSPDFA

SEQ ID NO: 2380 - protein, 14 aa, Mycobacterium avium
KSPPDSGEHGEGAE

SEQ ID NO: 2381 - protein, 13 aa, Mycobacterium avium
KSPTLAKPAYNGL

SEQ ID NO: 2382 - protein, 20 aa, Mycobacterium avium
KSTQDRPTSPPSTPAPPQTV

SEQ ID NO: 2383 - protein, 39 aa, Mycobacterium avium
KSVPAESAPARKAPAKTAAKSTAKKAPGRRAGAGDLRST

SEQ ID NO: 2384 - protein, 8 aa, Mycobacterium avium
KTAKTIGQ

SEQ ID NO: 2385 - protein, 8 aa, Mycobacterium avium
KTAPPLSQ

SEQ ID NO: 2386 - protein, 4 aa, Mycobacterium avium
KTGA

SEQ ID NO: 2387 - protein, 9 aa, Mycobacterium avium
KTGTLTESG

SEQ ID NO: 2388 - protein, 4 aa, Mycobacterium avium
KTHD

SEQ ID NO: 2389 - protein, 7 aa, Mycobacterium avium
KTKPSVA

SEQ ID NO: 2390 - protein, 6 aa, Mycobacterium avium
KTLSPS

SEQ ID NO: 2391 - protein, 5 aa, Mycobacterium avium
KTNPH

SEQ ID NO: 2392 - protein, 6 aa, Mycobacterium avium
KTPPTL

SEQ ID NO: 2393 - protein, 7 aa, Mycobacterium avium
KTTDADL

SEQ ID NO: 2394 - protein, 4 aa, Mycobacterium avium
KTYP

SEQ ID NO: 2395 - protein, 8 aa, Mycobacterium avium
KVAGAGTH

SEQ ID NO: 2396 - protein, 9 aa, Mycobacterium avium
KVPANAQAV

SEQ ID NO: 2397 - protein, 19 aa, Mycobacterium avium
KVRSGEITAPLGSQREYRP

SEQ ID NO: 2398 - protein, 8 aa, Mycobacterium avium
KVSKKAKE

SEQ ID NO: 2399 - protein, 5 aa, Mycobacterium avium
KWNNS

SEQ ID NO: 2400 - protein, 23 aa, Mycobacterium avium
KWTGPRAAESDPRVSQAEPAPAD

SEQ ID NO: 2401 - protein, 5 aa, Mycobacterium avium
KYPSG

SEQ ID NO: 2402 - protein, 18 aa, Mycobacterium avium
KYRNGEHVSPHPGTPPIQ

SEQ ID NO: 2403 - protein, 6 aa, Mycobacterium avium
LAADGR

SEQ ID NO: 2404 - protein, 9 aa, Mycobacterium avium
LAAGDPASW

SEQ ID NO: 2405 - protein, 6 aa, Mycobacterium avium
LAAPHD

SEQ ID NO: 2406 - protein, 17 aa, Mycobacterium avium
LAASGAPPGAVSSPGAL

SEQ ID NO: 2407 - protein, 8 aa, Mycobacterium avium
LAATRPPA

SEQ ID NO: 2408 - protein, 6 aa, Mycobacterium avium
LADAAG

SEQ ID NO: 2409 - protein, 20 aa, Mycobacterium avium
LADQSRSDAAHTAAAAAERA

SEQ ID NO: 2410 - protein, 14 aa, Mycobacterium avium
LADRDTGSLSGGEL

SEQ ID NO: 2411 - protein, 6 aa, Mycobacterium avium
LAEEAS

SEQ ID NO: 2412 - protein, 8 aa, Mycobacterium avium
LAEGHDRD

SEQ ID NO: 2413 - protein, 7 aa, Mycobacterium avium
LAEPETQ

SEQ ID NO: 2414 - protein, 14 aa, Mycobacterium avium
LAERDTGSLSGGEL

SEQ ID NO: 2415 - protein, 5 aa, Mycobacterium avium
LAGAG

SEQ ID NO: 2416 - protein, 10 aa, Mycobacterium avium
LAGGATPEAV

SEQ ID NO: 2417 - protein, 8 aa, Mycobacterium avium
LAGKGATA

SEQ ID NO: 2418 - protein, 4 aa, Mycobacterium avium
LAGR

SEQ ID NO: 2419 - protein, 12 aa, Mycobacterium avium
LAGRGPSALAGA

SEQ ID NO: 2420 - protein, 9 aa, Mycobacterium avium
LAGTPSTWV

SEQ ID NO: 2421 - protein, 12 aa, Mycobacterium avium
LAKDAAGDKWSQ

SEQ ID NO: 2422 - protein, 5 aa, Mycobacterium avium
LANGS

SEQ ID NO: 2423 - protein, 10 aa, Mycobacterium avium
LANPKGWTHN

SEQ ID NO: 2424 - protein, 4 aa, Mycobacterium avium
LANS

SEQ ID NO: 2425 - protein, 8 aa, Mycobacterium avium
LAPDEADR

SEQ ID NO: 2426 - protein, 12 aa, Mycobacterium avium
LAPEPVSGTSYA

SEQ ID NO: 2427 - protein, 6 aa, Mycobacterium avium
LAPNYG

SEQ ID NO: 2428 - protein, 22 aa, Mycobacterium avium
LAPPAAADRNQCAPAGPKSAAV

SEQ ID NO: 2429 - protein, 6 aa, Mycobacterium avium
LAQTGY

SEQ ID NO: 2430 - protein, 10 aa, Mycobacterium avium
LARDQRDPVP

SEQ ID NO: 2431 - protein, 5 aa, Mycobacterium avium
LAREG

SEQ ID NO: 2432 - protein, 17 aa, Mycobacterium avium
LARQGSTPDSAGTLPTH

SEQ ID NO: 2433 - protein, 12 aa, Mycobacterium avium
LARTDNSGWGDE

SEQ ID NO: 2434 - protein, 9 aa, Mycobacterium avium
LARTEDRDR

SEQ ID NO: 2435 - protein, 8 aa, Mycobacterium avium
LASAGHGA

SEQ ID NO: 2436 - protein, 9 aa, Mycobacterium avium
LASDRNERI

SEQ ID NO: 2437 - protein, 13 aa, Mycobacterium avium
LASSDVRTEADAK

SEQ ID NO: 2438 - protein, 17 aa, Mycobacterium avium
LASSESSAEKARGSEDR

SEQ ID NO: 2439 - protein, 8 aa, Mycobacterium avium
LASSYSQD

SEQ ID NO: 2440 - protein, 7 aa, Mycobacterium avium
LATGAAT

SEQ ID NO: 2441 - protein, 10 aa, Mycobacterium avium
LDADDQQDIT

SEQ ID NO: 2442 - protein, 16 aa, Mycobacterium avium
LDDGAGQLKAGSAELA

SEQ ID NO: 2443 - protein, 5 aa, Mycobacterium avium
LDDRQ

SEQ ID NO: 2444 - protein, 7 aa, Mycobacterium avium
LDDVASQ

SEQ ID NO: 2445 - protein, 15 aa, Mycobacterium avium
LDEAESHDAGGAAAS

SEQ ID NO: 2446 - protein, 17 aa, Mycobacterium avium
LDEAPAPSLSGPRAAAP

SEQ ID NO: 2447 - protein, 6 aa, Mycobacterium avium
LDEATE

SEQ ID NO: 2448 - protein, 11 aa, Mycobacterium avium
LDEGGDGPHGV

SEQ ID NO: 2449 - protein, 4 aa, Mycobacterium avium
LDET

SEQ ID NO: 2450 - protein, 4 aa, Mycobacterium avium
LDGD

SEQ ID NO: 2451 - protein, 11 aa, Mycobacterium avium
LDGSADGAPAI

SEQ ID NO: 2452 - protein, 11 aa, Mycobacterium avium
LDGSPNLPSGY

SEQ ID NO: 2453 - protein, 7 aa, Mycobacterium avium
LDGTAKG

SEQ ID NO: 2454 - protein, 6 aa, Mycobacterium avium
LDGVGP

SEQ ID NO: 2455 - protein, 5 aa, Mycobacterium avium
LDHPG

SEQ ID NO: 2456 - protein, 9 aa, Mycobacterium avium
LDNKALSAL

SEQ ID NO: 2457 - protein, 10 aa, Mycobacterium avium
LDPPDDGHAA

SEQ ID NO: 2458 - protein, 8 aa, Mycobacterium avium
LDTGRAGT

SEQ ID NO: 2459 - protein, 10 aa, Mycobacterium avium
LEAGPPPRRL

SEQ ID NO: 2460 - protein, 15 aa, Mycobacterium avium
LEDEDAEAAHPAPGR

SEQ ID NO: 2461 - protein, 44 aa, Mycobacterium avium
LEEPVSGAEAETEKLPTQRPDLRSESGPDEPTEAGPTEAKPPDR

SEQ ID NO: 2462 - protein, 5 aa, Mycobacterium avium
LEPET

SEQ ID NO: 2463 - protein, 8 aa, Mycobacterium avium
LEPGSTTA

SEQ ID NO: 2464 - protein, 7 aa, Mycobacterium avium
LEPPQNY

SEQ ID NO: 2465 - protein, 8 aa, Mycobacterium avium
LEPRRTQR

SEQ ID NO: 2466 - protein, 11 aa, Mycobacterium avium
LESATADSNEV

SEQ ID NO: 2467 - protein, 5 aa, Mycobacterium avium
LETAT

SEQ ID NO: 2468 - protein, 9 aa, Mycobacterium avium
LETATDTVD

SEQ ID NO: 2469 - protein, 6 aa, Mycobacterium avium
LGAEPR

SEQ ID NO: 2470 - protein, 8 aa, Mycobacterium avium
LGAGLSES

SEQ ID NO: 2471 - protein, 7 aa, Mycobacterium avium
LGAGSPV

SEQ ID NO: 2472 - protein, 9 aa, Mycobacterium avium
LGDCGSPSV

SEQ ID NO: 2473 - protein, 9 aa, Mycobacterium avium
LGDDTVSPE

SEQ ID NO: 2474 - protein, 7 aa, Mycobacterium avium
LGDPADG

SEQ ID NO: 2475 - protein, 9 aa, Mycobacterium avium
LGDSDKVRV

SEQ ID NO: 2476 - protein, 6 aa, Mycobacterium avium
LGEERQ

SEQ ID NO: 2477 - protein, 29 aa, Mycobacterium avium
LGEGESLRGQHHRPDPDDDPTGYGRHSSG

SEQ ID NO: 2478 - protein, 9 aa, Mycobacterium avium
LGEGPDDLA

SEQ ID NO: 2479 - protein, 6 aa, Mycobacterium avium
LGEREA

SEQ ID NO: 2480 - protein, 23 aa, Mycobacterium avium
LGGQDTRVATPSGLDAPGMSTSA

SEQ ID NO: 2481 - protein, 16 aa, Mycobacterium avium
LGGTAQTIPGGPVASQ

SEQ ID NO: 2482 - protein, 4 aa, Mycobacterium avium
LGHR

SEQ ID NO: 2483 - protein, 9 aa, Mycobacterium avium
LGKRAADRL

SEQ ID NO: 2484 - protein, 14 aa, Mycobacterium avium
LGPGIGGRAGDAGT

SEQ ID NO: 2485 - protein, 4 aa, Mycobacterium avium
LGPV

SEQ ID NO: 2486 - protein, 4 aa, Mycobacterium avium
LGQG

SEQ ID NO: 2487 - protein, 8 aa, Mycobacterium avium
LGQPANEY

SEQ ID NO: 2488 - protein, 15 aa, Mycobacterium avium
LGRREPDVYGDTTHD

SEQ ID NO: 2489 - protein, 10 aa, Mycobacterium avium
LGSARNTVTN

SEQ ID NO: 2490 - protein, 5 aa, Mycobacterium avium
LGSPA

SEQ ID NO: 2491 - protein, 8 aa, Mycobacterium avium
LGSRAGAA

SEQ ID NO: 2492 - protein, 12 aa, Mycobacterium avium
LGSSEEDSTPAF

SEQ ID NO: 2493 - protein, 7 aa, Mycobacterium avium
LGTDPES

SEQ ID NO: 2494 - protein, 7 aa, Mycobacterium avium
LGTTEAE

SEQ ID NO: 2495 - protein, 10 aa, Mycobacterium avium
LGTTPNGTLN

SEQ ID NO: 2496 - protein, 8 aa, Mycobacterium avium
LGTTPSGT

SEQ ID NO: 2497 - protein, 6 aa, Mycobacterium avium
LGVQDG

SEQ ID NO: 2498 - protein, 5 aa, Mycobacterium avium
LGVSG

SEQ ID NO: 2499 - protein, 4 aa, Mycobacterium avium
LKPE

SEQ ID NO: 2500 - protein, 7 aa, Mycobacterium avium
LKPGQSV

SEQ ID NO: 2501 - protein, 8 aa, Mycobacterium avium
LKPGRALP

SEQ ID NO: 2502 - protein, 13 aa, Mycobacterium avium
LKPRDGGDFGTTE

SEQ ID NO: 2503 - protein, 14 aa, Mycobacterium avium
LKPRPAPAAPVAEE

SEQ ID NO: 2504 - protein, 6 aa, Mycobacterium avium
LKPTEA

SEQ ID NO: 2505 - protein, 7 aa, Mycobacterium avium
LKRERDA

SEQ ID NO: 2506 - protein, 7 aa, Mycobacterium avium
LKSGDEL

SEQ ID NO: 2507 - protein, 4 aa, Mycobacterium avium
LKTA

SEQ ID NO: 2508 - protein, 5 aa, Mycobacterium avium
LLGPS

SEQ ID NO: 2509 - protein, 9 aa, Mycobacterium avium
LNAETGNLS

SEQ ID NO: 2510 - protein, 9 aa, Mycobacterium avium
LNDTEGHVA

SEQ ID NO: 2511 - protein, 5 aa, Mycobacterium avium
LNGGG

SEQ ID NO: 2512 - protein, 9 aa, Mycobacterium avium
LNRTDESDT

SEQ ID NO: 2513 - protein, 9 aa, Mycobacterium avium
LNTPAAPSF

SEQ ID NO: 2514 - protein, 6 aa, Mycobacterium avium
LNTRQT

SEQ ID NO: 2515 - protein, 7 aa, Mycobacterium avium
LNTSDRT

SEQ ID NO: 2516 - protein, 21 aa, Mycobacterium avium
LPAAPSDRAGAPPTATADNQA

SEQ ID NO: 2517 - protein, 12 aa, Mycobacterium avium
LPADEWDEDTRA

SEQ ID NO: 2518 - protein, 5 aa, Mycobacterium avium
LPADG

SEQ ID NO: 2519 - protein, 5 aa, Mycobacterium avium
LPAGS

SEQ ID NO: 2520 - protein, 17 aa, Mycobacterium avium
LPAGTLPDGGPFTEAGD

SEQ ID NO: 2521 - protein, 4 aa, Mycobacterium avium
LPAH

SEQ ID NO: 2522 - protein, 19 aa, Mycobacterium avium
LPASASPGAGSMPSRANPR

SEQ ID NO: 2523 - protein, 23 aa, Mycobacterium avium
LPDDAVSGDDMRVSGQKVATRSG

SEQ ID NO: 2524 - protein, 23 aa, Mycobacterium avium
LPDGADSVVGEAGSALSGGERQR

SEQ ID NO: 2525 - protein, 9 aa, Mycobacterium avium
LPDPDDPDH

SEQ ID NO: 2526 - protein, 15 aa, Mycobacterium avium
LPEPGGLRDAASRAR

SEQ ID NO: 2527 - protein, 6 aa, Mycobacterium avium
LPEREP

SEQ ID NO: 2528 - protein, 9 aa, Mycobacterium avium
LPGAPTTVD

SEQ ID NO: 2529 - protein, 4 aa, Mycobacterium avium
LPGK

SEQ ID NO: 2530 - protein, 16 aa, Mycobacterium avium
LPGRRGGTPRFGTDTA

SEQ ID NO: 2531 - protein, 8 aa, Mycobacterium avium
LPGSAPKS

SEQ ID NO: 2532 - protein, 8 aa, Mycobacterium avium
LPLPASGG

SEQ ID NO: 2533 - protein, 5 aa, Mycobacterium avium
LPPAA

SEQ ID NO: 2534 - protein, 7 aa, Mycobacterium avium
LPPDPRV

SEQ ID NO: 2535 - protein, 12 aa, Mycobacterium avium
LPPDTGKADRAR

SEQ ID NO: 2536 - protein, 12 aa, Mycobacterium avium
LPPDTSKEERAR

SEQ ID NO: 2537 - protein, 12 aa, Mycobacterium avium
LPPDTSKSDRAQ

SEQ ID NO: 2538 - protein, 12 aa, Mycobacterium avium
LPPDTTKEDRAQ

SEQ ID NO: 2539 - protein, 11 aa, Mycobacterium avium
LPPGGMDAGKN

SEQ ID NO: 2540 - protein, 4 aa, Mycobacterium avium
LPPI

SEQ ID NO: 2541 - protein, 7 aa, Mycobacterium avium
LPPPPLP

SEQ ID NO: 2542 - protein, 6 aa, Mycobacterium avium
LPPRPE

SEQ ID NO: 2543 - protein, 8 aa, Mycobacterium avium
LPPRPRTH

SEQ ID NO: 2544 - protein, 8 aa, Mycobacterium avium
LPQRRPDA

SEQ ID NO: 2545 - protein, 14 aa, Mycobacterium avium
LPQSRPTRSGRRTL

SEQ ID NO: 2546 - protein, 7 aa, Mycobacterium avium
LPRDGKA

SEQ ID NO: 2547 - protein, 7 aa, Mycobacterium avium
LPRPPTL

SEQ ID NO: 2548 - protein, 5 aa, Mycobacterium avium
LPRRG

SEQ ID NO: 2549 - protein, 12 aa, Mycobacterium avium
LPRSASAHQVGD

SEQ ID NO: 2550 - protein, 8 aa, Mycobacterium avium
LPSPPGQR

SEQ ID NO: 2551 - protein, 6 aa, Mycobacterium avium
LPVPTA

SEQ ID NO: 2552 - protein, 18 aa, Mycobacterium avium
LQASGNNDQAAIQSAQSR

SEQ ID NO: 2553 - protein, 4 aa, Mycobacterium avium
LQEP

SEQ ID NO: 2554 - protein, 15 aa, Mycobacterium avium
LQESDGSWRPWWCGK

SEQ ID NO: 2555 - protein, 7 aa, Mycobacterium avium
LQGDQAS

SEQ ID NO: 2556 - protein, 9 aa, Mycobacterium avium
LRADSDTDA

SEQ ID NO: 2557 - protein, 6 aa, Mycobacterium avium
LRAESA

SEQ ID NO: 2558 - protein, 17 aa, Mycobacterium avium
LRDGAQQVATGNAELAG

SEQ ID NO: 2559 - protein, 8 aa, Mycobacterium avium
LRETNRER

SEQ ID NO: 2560 - protein, 4 aa, Mycobacterium avium
LRGD

SEQ ID NO: 2561 - protein, 12 aa, Mycobacterium avium
LRGPAGAATAGA

SEQ ID NO: 2562 - protein, 5 aa, Mycobacterium avium
LRGTG

SEQ ID NO: 2563 - protein, 13 aa, Mycobacterium avium
LRPGDRVHTTSGL

SEQ ID NO: 2564 - protein, 6 aa, Mycobacterium avium
LRPGEE

SEQ ID NO: 2565 - protein, 5 aa, Mycobacterium avium
LRPGS

SEQ ID NO: 2566 - protein, 8 aa, Mycobacterium avium
LRQQGAGR

SEQ ID NO: 2567 - protein, 4 aa, Mycobacterium avium
LRRP

SEQ ID NO: 2568 - protein, 12 aa, Mycobacterium avium
LRSGDGGDREPH

SEQ ID NO: 2569 - protein, 10 aa, Mycobacterium avium
LRSGRAGTDA

SEQ ID NO: 2570 - protein, 6 aa, Mycobacterium avium
LRTGSR

SEQ ID NO: 2571 - protein, 10 aa, Mycobacterium avium
LRTPGSPLAS

SEQ ID NO: 2572 - protein, 7 aa, Mycobacterium avium
LRTSANE

SEQ ID NO: 2573 - protein, 5 aa, Mycobacterium avium
LRTSR

SEQ ID NO: 2574 - protein, 10 aa, Mycobacterium avium
LSAADTGPIN

SEQ ID NO: 2575 - protein, 6 aa, Mycobacterium avium
LSARDR

SEQ ID NO: 2576 - protein, 4 aa, Mycobacterium avium
LSAS

SEQ ID NO: 2577 - protein, 5 aa, Mycobacterium avium
LSDAA

SEQ ID NO: 2578 - protein, 6 aa, Mycobacterium avium
LSDAGR

SEQ ID NO: 2579 - protein, 10 aa, Mycobacterium avium
LSDDRNTIGS

SEQ ID NO: 2580 - protein, 8 aa, Mycobacterium avium
LSDEPAPA

SEQ ID NO: 2581 - protein, 10 aa, Mycobacterium avium
LSDEQNSTVS

SEQ ID NO: 2582 - protein, 6 aa, Mycobacterium avium
LSDGNN

SEQ ID NO: 2583 - protein, 8 aa, Mycobacterium avium
LSDPRTGQ

SEQ ID NO: 2584 - protein, 7 aa, Mycobacterium avium
LSDPSDP

SEQ ID NO: 2585 - protein, 7 aa, Mycobacterium avium
LSGAPPN

SEQ ID NO: 2586 - protein, 18 aa, Mycobacterium avium
LSGGGFQDPTSESARATE

SEQ ID NO: 2587 - protein, 5 aa, Mycobacterium avium
LSGGQ

SEQ ID NO: 2588 - protein, 10 aa, Mycobacterium avium
LSGGQRKRAS

SEQ ID NO: 2589 - protein, 17 aa, Mycobacterium avium
LSGGSGPQGAPPQPSTV

SEQ ID NO: 2590 - protein, 7 aa, Mycobacterium avium
LSGPDMR

SEQ ID NO: 2591 - protein, 5 aa, Mycobacterium avium
LSLPN

SEQ ID NO: 2592 - protein, 13 aa, Mycobacterium avium
LSLSTSPKVPADL

SEQ ID NO: 2593 - protein, 9 aa, Mycobacterium avium
LSNTSPPSL

SEQ ID NO: 2594 - protein, 6 aa, Mycobacterium avium
LSPAGE

SEQ ID NO: 2595 - protein, 16 aa, Mycobacterium avium
LSPEQARGDAVDARSD

SEQ ID NO: 2596 - protein, 6 aa, Mycobacterium avium
LSPGGP

SEQ ID NO: 2597 - protein, 4 aa, Mycobacterium avium
LSPR

SEQ ID NO: 2598 - protein, 7 aa, Mycobacterium avium
LSPRDDG

SEQ ID NO: 2599 - protein, 5 aa, Mycobacterium avium
LSPTR

SEQ ID NO: 2600 - protein, 9 aa, Mycobacterium avium
LSQGGGDAT

SEQ ID NO: 2601 - protein, 9 aa, Mycobacterium avium
LSRPPGGHQ

SEQ ID NO: 2602 - protein, 12 aa, Mycobacterium avium
LSSDGGAATREQ

SEQ ID NO: 2603 - protein, 4 aa, Mycobacterium avium
LSTA

SEQ ID NO: 2604 - protein, 4 aa, Mycobacterium avium
LSTE

SEQ ID NO: 2605 - protein, 7 aa, Mycobacterium avium
LSTEPAH

SEQ ID NO: 2606 - protein, 6 aa, Mycobacterium avium
LSTSAQ

SEQ ID NO: 2607 - protein, 10 aa, Mycobacterium avium
LSTTLPGGPV

SEQ ID NO: 2608 - protein, 10 aa, Mycobacterium avium
LSVTTPEEPE

SEQ ID NO: 2609 - protein, 6 aa, Mycobacterium avium
LSYSDA

SEQ ID NO: 2610 - protein, 13 aa, Mycobacterium avium
LTAAGSQSHDQKA

SEQ ID NO: 2611 - protein, 13 aa, Mycobacterium avium
LTAPEEPDTALAR

SEQ ID NO: 2612 - protein, 8 aa, Mycobacterium avium
LTAPQSAE

SEQ ID NO: 2613 - protein, 6 aa, Mycobacterium avium
LTAPSA

SEQ ID NO: 2614 - protein, 6 aa, Mycobacterium avium
LTDAQN

SEQ ID NO: 2615 - protein, 21 aa, Mycobacterium avium
LTDGNTDVSAESLKANASLHD

SEQ ID NO: 2616 - protein, 6 aa, Mycobacterium avium
LTDPRY

SEQ ID NO: 2617 - protein, 11 aa, Mycobacterium avium
LTGERSLRPDR

SEQ ID NO: 2618 - protein, 12 aa, Mycobacterium avium
LTGPPQPALPGA

SEQ ID NO: 2619 - protein, 4 aa, Mycobacterium avium
LTGS

SEQ ID NO: 2620 - protein, 4 aa, Mycobacterium avium
LTGV

SEQ ID NO: 2621 - protein, 8 aa, Mycobacterium avium
LTHSSQEA

SEQ ID NO: 2622 - protein, 4 aa, Mycobacterium avium
LTNA

SEQ ID NO: 2623 - protein, 5 aa, Mycobacterium avium
LTPAT

SEQ ID NO: 2624 - protein, 13 aa, Mycobacterium avium
LTPDSPAGPAVPA

SEQ ID NO: 2625 - protein, 7 aa, Mycobacterium avium
LTPGGTA

SEQ ID NO: 2626 - protein, 7 aa, Mycobacterium avium
LTPPGTF

SEQ ID NO: 2627 - protein, 9 aa, Mycobacterium avium
LTPSATAVG

SEQ ID NO: 2628 - protein, 8 aa, Mycobacterium avium
LTPSGALT

SEQ ID NO: 2629 - protein, 6 aa, Mycobacterium avium
LTQITK

SEQ ID NO: 2630 - protein, 11 aa, Mycobacterium avium
LTQSKDQPELA

SEQ ID NO: 2631 - protein, 11 aa, Mycobacterium avium
LTRDGTPTGSL

SEQ ID NO: 2632 - protein, 20 aa, Mycobacterium avium
LTRGGSMSQPDEHTTPTVEP

SEQ ID NO: 2633 - protein, 5 aa, Mycobacterium avium
LTRRS

SEQ ID NO: 2634 - protein, 10 aa, Mycobacterium avium
LTSLTDPEAD

SEQ ID NO: 2635 - protein, 39 aa, Mycobacterium avium
LTTGLEGADDHSPPPDAGPPFGGPGDRYQSDDPTLKASA

SEQ ID NO: 2636 - protein, 6 aa, Mycobacterium avium
LTTPTA

SEQ ID NO: 2637 - protein, 4 aa, Mycobacterium avium
LTTR

SEQ ID NO: 2638 - protein, 25 aa, Mycobacterium avium
LVDPEDDLTPVGYPGDFNPSTGTTT

SEQ ID NO: 2639 - protein, 4 aa, Mycobacterium avium
LVGT

SEQ ID NO: 2640 - protein, 5 aa, Mycobacterium avium
LYPGD

SEQ ID NO: 2641 - protein, 5 aa, Mycobacterium avium
MAADP

SEQ ID NO: 2642 - protein, 6 aa, Mycobacterium avium
MADGEK

SEQ ID NO: 2643 - protein, 8 aa, Mycobacterium avium
MAGQNEDD

SEQ ID NO: 2644 - protein, 10 aa, Mycobacterium avium
MASPSTGQAT

SEQ ID NO: 2645 - protein, 4 aa, Mycobacterium avium
MATS

SEQ ID NO: 2646 - protein, 10 aa, Mycobacterium avium
MDGKSNAEAL

SEQ ID NO: 2647 - protein, 7 aa, Mycobacterium avium
MDPPNDL

SEQ ID NO: 2648 - protein, 7 aa, Mycobacterium avium
MEGPTPV

SEQ ID NO: 2649 - protein, 6 aa, Mycobacterium avium
MEPGSG

SEQ ID NO: 2650 - protein, 9 aa, Mycobacterium avium
MGAAPNEPG

SEQ ID NO: 2651 - protein, 9 aa, Mycobacterium avium
MGGHAAGEV

SEQ ID NO: 2652 - protein, 5 aa, Mycobacterium avium
MGRTA

SEQ ID NO: 2653 - protein, 8 aa, Mycobacterium avium
MGTAQPSG

SEQ ID NO: 2654 - protein, 24 aa, Mycobacterium avium
MGTPLTGDESRKSWPSTYKVRDKR

SEQ ID NO: 2655 - protein, 8 aa, Mycobacterium avium
MPDEQRKE

SEQ ID NO: 2656 - protein, 8 aa, Mycobacterium avium
MPEPERTE

SEQ ID NO: 2657 - protein, 11 aa, Mycobacterium avium
MPGQEGGKSRL

SEQ ID NO: 2658 - protein, 12 aa, Mycobacterium avium
MPPSAPSAVAAA

SEQ ID NO: 2659 - protein, 7 aa, Mycobacterium avium
MPPTGGL

SEQ ID NO: 2660 - protein, 9 aa, Mycobacterium avium
MPTTETPDQ

SEQ ID NO: 2661 - protein, 7 aa, Mycobacterium avium
MQGQPGV

SEQ ID NO: 2662 - protein, 13 aa, Mycobacterium avium
MRNGADDPDGASG

SEQ ID NO: 2663 - protein, 4 aa, Mycobacterium avium
MRRS

SEQ ID NO: 2664 - protein, 4 aa, Mycobacterium avium
MSRP

SEQ ID NO: 2665 - protein, 4 aa, Mycobacterium avium
MSTS

SEQ ID NO: 2666 - protein, 10 aa, Mycobacterium avium
MTAPARPPVR

SEQ ID NO: 2667 - protein, 4 aa, Mycobacterium avium
MTGG

SEQ ID NO: 2668 - protein, 6 aa, Mycobacterium avium
MTGNGD

SEQ ID NO: 2669 - protein, 18 aa, Mycobacterium avium
NAADDSAKTTAVTSQITD

SEQ ID NO: 2670 - protein, 8 aa, Mycobacterium avium
NAAGPALT

SEQ ID NO: 2671 - protein, 5 aa, Mycobacterium avium
NADET

SEQ ID NO: 2672 - protein, 4 aa, Mycobacterium avium
NADK

SEQ ID NO: 2673 - protein, 13 aa, Mycobacterium avium
NAEDDLGKHHSQP

SEQ ID NO: 2674 - protein, 4 aa, Mycobacterium avium
NAET

SEQ ID NO: 2675 - protein, 15 aa, Mycobacterium avium
NAGPGNTKPVTVEPS

SEQ ID NO: 2676 - protein, 5 aa, Mycobacterium avium
NAIGG

SEQ ID NO: 2677 - protein, 7 aa, Mycobacterium avium
NAKAALS

SEQ ID NO: 2678 - protein, 8 aa, Mycobacterium avium
NAKTNEIC

SEQ ID NO: 2679 - protein, 4 aa, Mycobacterium avium
NANG

SEQ ID NO: 2680 - protein, 5 aa, Mycobacterium avium
NAQNQ

SEQ ID NO: 2681 - protein, 5 aa, Mycobacterium avium
NAQTL

SEQ ID NO: 2682 - protein, 5 aa, Mycobacterium avium
NATFN

SEQ ID NO: 2683 - protein, 6 aa, Mycobacterium avium
NATGLT

SEQ ID NO: 2684 - protein, 8 aa, Mycobacterium avium
NATPGKDE

SEQ ID NO: 2685 - protein, 5 aa, Mycobacterium avium
NCGAS

SEQ ID NO: 2686 - protein, 17 aa, Mycobacterium avium
NCSAADTGLLANTEVPR

SEQ ID NO: 2687 - protein, 17 aa, Mycobacterium avium
NDDADADTAEIPVPRPT

SEQ ID NO: 2688 - protein, 7 aa, Mycobacterium avium
NDDQGGY

SEQ ID NO: 2689 - protein, 8 aa, Mycobacterium avium
NDDRTGAA

SEQ ID NO: 2690 - protein, 30 aa, Mycobacterium avium
NDEEKTGSNQAGTEGGTTPAPGINGSSAQL

SEQ ID NO: 2691 - protein, 9 aa, Mycobacterium avium
NDGATPGEV

SEQ ID NO: 2692 - protein, 10 aa, Mycobacterium avium
NDGEIGSGPG

SEQ ID NO: 2693 - protein, 8 aa, Mycobacterium avium
NDKDRLDA

SEQ ID NO: 2694 - protein, 6 aa, Mycobacterium avium
NDPDRA

SEQ ID NO: 2695 - protein, 5 aa, Mycobacterium avium
NDRPT

SEQ ID NO: 2696 - protein, 8 aa, Mycobacterium avium
NDSNTAAT

SEQ ID NO: 2697 - protein, 8 aa, Mycobacterium avium
NDTPPPGL

SEQ ID NO: 2698 - protein, 4 aa, Mycobacterium avium
NDWP

SEQ ID NO: 2699 - protein, 8 aa, Mycobacterium avium
NEAASADR

SEQ ID NO: 2700 - protein, 7 aa, Mycobacterium avium
NEARAGL

SEQ ID NO: 2701 - protein, 22 aa, Mycobacterium avium
NEDRRGVQGPPSNAPTRPPEVP

SEQ ID NO: 2702 - protein, 9 aa, Mycobacterium avium
NESKLAPTL

SEQ ID NO: 2703 - protein, 4 aa, Mycobacterium avium
NESN

SEQ ID NO: 2704 - protein, 6 aa, Mycobacterium avium
NESPCT

SEQ ID NO: 2705 - protein, 8 aa, Mycobacterium avium
NFSGGQRQ

SEQ ID NO: 2706 - protein, 9 aa, Mycobacterium avium
NGAPATEPI

SEQ ID NO: 2707 - protein, 9 aa, Mycobacterium avium
NGDNATVGQ

SEQ ID NO: 2708 - protein, 15 aa, Mycobacterium avium
NGDNVKSAQIDDREQ

SEQ ID NO: 2709 - protein, 7 aa, Mycobacterium avium
NGEDEVP

SEQ ID NO: 2710 - protein, 13 aa, Mycobacterium avium
NGEDYDPSTPDAL

SEQ ID NO: 2711 - protein, 10 aa, Mycobacterium avium
NGEEARSLDS

SEQ ID NO: 2712 - protein, 10 aa, Mycobacterium avium
NGEKPEAPKV

SEQ ID NO: 2713 - protein, 4 aa, Mycobacterium avium
NGFG

SEQ ID NO: 2714 - protein, 4 aa, Mycobacterium avium
NGFR

SEQ ID NO: 2715 - protein, 7 aa, Mycobacterium avium
NGGANSR

SEQ ID NO: 2716 - protein, 5 aa, Mycobacterium avium
NGGAV

SEQ ID NO: 2717 - protein, 5 aa, Mycobacterium avium
NGGEV

SEQ ID NO: 2718 - protein, 9 aa, Mycobacterium avium
NGGRLSPQR

SEQ ID NO: 2719 - protein, 8 aa, Mycobacterium avium
NGGSSLTG

SEQ ID NO: 2720 - protein, 4 aa, Mycobacterium avium
NGGT

SEQ ID NO: 2721 - protein, 7 aa, Mycobacterium avium
NGIPADV

SEQ ID NO: 2722 - protein, 10 aa, Mycobacterium avium
NGKPPTSTEY

SEQ ID NO: 2723 - protein, 9 aa, Mycobacterium avium
NGLTPASAD

SEQ ID NO: 2724 - protein, 13 aa, Mycobacterium avium
NGNAGAAAGDESV

SEQ ID NO: 2725 - protein, 7 aa, Mycobacterium avium
NGNITDD

SEQ ID NO: 2726 - protein, 8 aa, Mycobacterium avium
NGPGIPAE

SEQ ID NO: 2727 - protein, 17 aa, Mycobacterium avium
NGPVFNQGERVEANTST

SEQ ID NO: 2728 - protein, 5 aa, Mycobacterium avium
NGQTL

SEQ ID NO: 2729 - protein, 10 aa, Mycobacterium avium
NGRDPGPLAN

SEQ ID NO: 2730 - protein, 8 aa, Mycobacterium avium
NGTQSATT

SEQ ID NO: 2731 - protein, 8 aa, Mycobacterium avium
NGTSGPLR

SEQ ID NO: 2732 - protein, 7 aa, Mycobacterium avium
NGTSTAN

SEQ ID NO: 2733 - protein, 5 aa, Mycobacterium avium
NHDGR

SEQ ID NO: 2734 - protein, 10 aa, Mycobacterium avium
NHGAGLSSTT

SEQ ID NO: 2735 - protein, 5 aa, Mycobacterium avium
NHTGL

SEQ ID NO: 2736 - protein, 8 aa, Mycobacterium avium
NIGTAREL

SEQ ID NO: 2737 - protein, 7 aa, Mycobacterium avium
NKAQAGV

SEQ ID NO: 2738 - protein, 8 aa, Mycobacterium avium
NKSAGPIG

SEQ ID NO: 2739 - protein, 10 aa, Mycobacterium avium
NLARPKDPWD

SEQ ID NO: 2740 - protein, 5 aa, Mycobacterium avium
NLGET

SEQ ID NO: 2741 - protein, 8 aa, Mycobacterium avium
NLGKDERH

SEQ ID NO: 2742 - protein, 8 aa, Mycobacterium avium
NLNAGKVD

SEQ ID NO: 2743 - protein, 8 aa, Mycobacterium avium
NLPGKSQT

SEQ ID NO: 2744 - protein, 6 aa, Mycobacterium avium
NLTAQR

SEQ ID NO: 2745 - protein, 8 aa, Mycobacterium avium
NLTGDGNA

SEQ ID NO: 2746 - protein, 13 aa, Mycobacterium avium
NMGHTSAAAGAGG

SEQ ID NO: 2747 - protein, 5 aa, Mycobacterium avium
NNLPF

SEQ ID NO: 2748 - protein, 5 aa, Mycobacterium avium
NNNVE

SEQ ID NO: 2749 - protein, 12 aa, Mycobacterium avium
NNPDGVAVDPAG

SEQ ID NO: 2750 - protein, 16 aa, Mycobacterium avium
NNPGVPDTQALNTSGV

SEQ ID NO: 2751 - protein, 8 aa, Mycobacterium avium
NNPTSSPY

SEQ ID NO: 2752 - protein, 7 aa, Mycobacterium avium
NNRPLGD

SEQ ID NO: 2753 - protein, 8 aa, Mycobacterium avium
NNRPVGPR

SEQ ID NO: 2754 - protein, 5 aa, Mycobacterium avium
NNSPV

SEQ ID NO: 2755 - protein, 4 aa, Mycobacterium avium
NNTL

SEQ ID NO: 2756 - protein, 6 aa, Mycobacterium avium
NNTPEG

SEQ ID NO: 2757 - protein, 11 aa, Mycobacterium avium
NNTSGSSGELV

SEQ ID NO: 2758 - protein, 4 aa, Mycobacterium avium
NNTY

SEQ ID NO: 2759 - protein, 4 aa, Mycobacterium avium
NPDA

SEQ ID NO: 2760 - protein, 5 aa, Mycobacterium avium
NPDAP

SEQ ID NO: 2761 - protein, 9 aa, Mycobacterium avium
NPDERADEM

SEQ ID NO: 2762 - protein, 8 aa, Mycobacterium avium
NPEPDGKQ

SEQ ID NO: 2763 - protein, 6 aa, Mycobacterium avium
NPEQHA

SEQ ID NO: 2764 - protein, 5 aa, Mycobacterium avium
NPEQR

SEQ ID NO: 2765 - protein, 5 aa, Mycobacterium avium
NPESR

SEQ ID NO: 2766 - protein, 14 aa, Mycobacterium avium
NPEVQSALGTPSDI

SEQ ID NO: 2767 - protein, 10 aa, Mycobacterium avium
NPGESPRERH

SEQ ID NO: 2768 - protein, 6 aa, Mycobacterium avium
NPKATL

SEQ ID NO: 2769 - protein, 6 aa, Mycobacterium avium
NPNRNI

SEQ ID NO: 2770 - protein, 8 aa, Mycobacterium avium
NPNRSLPE

SEQ ID NO: 2771 - protein, 19 aa, Mycobacterium avium
NPPAGAGVNRDGIITLKFG

SEQ ID NO: 2772 - protein, 12 aa, Mycobacterium avium
NPPGPDAPRDAP

SEQ ID NO: 2773 - protein, 9 aa, Mycobacterium avium
NPPNDTPLR

SEQ ID NO: 2774 - protein, 16 aa, Mycobacterium avium
NPPPQLQNPTADELNS

SEQ ID NO: 2775 - protein, 6 aa, Mycobacterium avium
NPPSPR

SEQ ID NO: 2776 - protein, 16 aa, Mycobacterium avium
NPPTVAEYESATDGYA

SEQ ID NO: 2777 - protein, 6 aa, Mycobacterium avium
NPPVSA

SEQ ID NO: 2778 - protein, 11 aa, Mycobacterium avium
NPQTGHAGAPL

SEQ ID NO: 2779 - protein, 11 aa, Mycobacterium avium
NPRPTNPEGKM

SEQ ID NO: 2780 - protein, 10 aa, Mycobacterium avium
NPSPGTPRQP

SEQ ID NO: 2781 - protein, 4 aa, Mycobacterium avium
NPSW

SEQ ID NO: 2782 - protein, 7 aa, Mycobacterium avium
NPTGDQA

SEQ ID NO: 2783 - protein, 4 aa, Mycobacterium avium
NPTI

SEQ ID NO: 2784 - protein, 7 aa, Mycobacterium avium
NPVGYGN

SEQ ID NO: 2785 - protein, 13 aa, Mycobacterium avium
NQGEALANESVES

SEQ ID NO: 2786 - protein, 5 aa, Mycobacterium avium
NQKSD

SEQ ID NO: 2787 - protein, 8 aa, Mycobacterium avium
NQKYQQDQ

SEQ ID NO: 2788 - protein, 5 aa, Mycobacterium avium
NQLQS

SEQ ID NO: 2789 - protein, 6 aa, Mycobacterium avium
NQNRID

SEQ ID NO: 2790 - protein, 6 aa, Mycobacterium avium
NQPPPC

SEQ ID NO: 2791 - protein, 8 aa, Mycobacterium avium
NQRPNRAT

SEQ ID NO: 2792 - protein, 4 aa, Mycobacterium avium
NQTD

SEQ ID NO: 2793 - protein, 5 aa, Mycobacterium avium
NQTWP

SEQ ID NO: 2794 - protein, 4 aa, Mycobacterium avium
NRAG

SEQ ID NO: 2795 - protein, 8 aa, Mycobacterium avium
NRASTLAA

SEQ ID NO: 2796 - protein, 11 aa, Mycobacterium avium
NRDNISKALPG

SEQ ID NO: 2797 - protein, 8 aa, Mycobacterium avium
NRGGRERH

SEQ ID NO: 2798 - protein, 13 aa, Mycobacterium avium
NRKHRKDIENREQ

SEQ ID NO: 2799 - protein, 17 aa, Mycobacterium avium
NRKRPEPFAGSPSANYL

SEQ ID NO: 2800 - protein, 8 aa, Mycobacterium avium
NRNPQDGD

SEQ ID NO: 2801 - protein, 5 aa, Mycobacterium avium
NRPDI

SEQ ID NO: 2802 - protein, 24 aa, Mycobacterium avium
NRPPPPARTEAPAELGAPAQTSKR

SEQ ID NO: 2803 - protein, 8 aa, Mycobacterium avium
NRQENRDR

SEQ ID NO: 2804 - protein, 13 aa, Mycobacterium avium
NRQLSDEYAAAAR

SEQ ID NO: 2805 - protein, 4 aa, Mycobacterium avium
NRRR

SEQ ID NO: 2806 - protein, 5 aa, Mycobacterium avium
NRSPN

SEQ ID NO: 2807 - protein, 11 aa, Mycobacterium avium
NRTHSADSRAH

SEQ ID NO: 2808 - protein, 10 aa, Mycobacterium avium
NSADGITATA

SEQ ID NO: 2809 - protein, 6 aa, Mycobacterium avium
NSDAAG

SEQ ID NO: 2810 - protein, 6 aa, Mycobacterium avium
NSDGSM

SEQ ID NO: 2811 - protein, 6 aa, Mycobacterium avium
NSESPC

SEQ ID NO: 2812 - protein, 4 aa, Mycobacterium avium
NSGA

SEQ ID NO: 2813 - protein, 6 aa, Mycobacterium avium
NSGTLQ

SEQ ID NO: 2814 - protein, 9 aa, Mycobacterium avium
NSPGMGDDA

SEQ ID NO: 2815 - protein, 4 aa, Mycobacterium avium
NSRE

SEQ ID NO: 2816 - protein, 7 aa, Mycobacterium avium
NSRIPGD

SEQ ID NO: 2817 - protein, 7 aa, Mycobacterium avium
NSWGETL

SEQ ID NO: 2818 - protein, 15 aa, Mycobacterium avium
NTAPPRPSATAPEVP

SEQ ID NO: 2819 - protein, 6 aa, Mycobacterium avium
NTAQAA

SEQ ID NO: 2820 - protein, 12 aa, Mycobacterium avium
NTGTSAAKEAGN

SEQ ID NO: 2821 - protein, 6 aa, Mycobacterium avium
NTNPPQ

SEQ ID NO: 2822 - protein, 4 aa, Mycobacterium avium
NTPA

SEQ ID NO: 2823 - protein, 14 aa, Mycobacterium avium
NTPADWTRAGNAVK

SEQ ID NO: 2824 - protein, 20 aa, Mycobacterium avium
NTPPAVDSSEVPTAGDPPMP

SEQ ID NO: 2825 - protein, 5 aa, Mycobacterium avium
NTQNQ

SEQ ID NO: 2826 - protein, 8 aa, Mycobacterium avium
NTRTAIRA

SEQ ID NO: 2827 - protein, 5 aa, Mycobacterium avium
NTSAD

SEQ ID NO: 2828 - protein, 6 aa, Mycobacterium avium
NTSDDG

SEQ ID NO: 2829 - protein, 12 aa, Mycobacterium avium
NTTSTSPLTKNV

SEQ ID NO: 2830 - protein, 6 aa, Mycobacterium avium
NVGGAA

SEQ ID NO: 2831 - protein, 6 aa, Mycobacterium avium
NVPDGH

SEQ ID NO: 2832 - protein, 15 aa, Mycobacterium avium
NVTRTGGRQPGPGRA

SEQ ID NO: 2833 - protein, 5 aa, Mycobacterium avium
NWTGP

SEQ ID NO: 2834 - protein, 8 aa, Mycobacterium avium
NYHAGQTN

SEQ ID NO: 2835 - protein, 20 aa, Mycobacterium avium
NYQPPKDLAPPPGTVIGPDG

SEQ ID NO: 2836 - protein, 4 aa, Mycobacterium avium
PAAA

SEQ ID NO: 2837 - protein, 6 aa, Mycobacterium avium
PAAANT

SEQ ID NO: 2838 - protein, 13 aa, Mycobacterium avium
PAAATTSATKTSG

SEQ ID NO: 2839 - protein, 25 aa, Mycobacterium avium
PAAGADMPEIEGPDDDDVEGIRTPK

SEQ ID NO: 2840 - protein, 6 aa, Mycobacterium avium
PAAGET

SEQ ID NO: 2841 - protein, 12 aa, Mycobacterium avium
PAAGRGDPPGPR

SEQ ID NO: 2842 - protein, 4 aa, Mycobacterium avium
PAAI

SEQ ID NO: 2843 - protein, 10 aa, Mycobacterium avium
PAANGVATAR

SEQ ID NO: 2844 - protein, 10 aa, Mycobacterium avium
PAAPQTTRAA

SEQ ID NO: 2845 - protein, 12 aa, Mycobacterium avium
PAAQTGGTAATA

SEQ ID NO: 2846 - protein, 4 aa, Mycobacterium avium
PAAR

SEQ ID NO: 2847 - protein, 11 aa, Mycobacterium avium
PAASSASQDYT

SEQ ID NO: 2848 - protein, 6 aa, Mycobacterium avium
PAAWRD

SEQ ID NO: 2849 - protein, 23 aa, Mycobacterium avium
PADASGGNGAHNGAGAVPSVADG

SEQ ID NO: 2850 - protein, 6 aa, Mycobacterium avium
PADLTS

SEQ ID NO: 2851 - protein, 8 aa, Mycobacterium avium
PAEDAGPR

SEQ ID NO: 2852 - protein, 21 aa, Mycobacterium avium
PAGDGPDSAPLDEDLEAATES

SEQ ID NO: 2853 - protein, 4 aa, Mycobacterium avium
PAGL

SEQ ID NO: 2854 - protein, 5 aa, Mycobacterium avium
PAGMT

SEQ ID NO: 2855 - protein, 7 aa, Mycobacterium avium
PAGPGLS

SEQ ID NO: 2856 - protein, 15 aa, Mycobacterium avium
PAGQAATTIQPGDPA

SEQ ID NO: 2857 - protein, 6 aa, Mycobacterium avium
PAGRGP

SEQ ID NO: 2858 - protein, 19 aa, Mycobacterium avium
PAGSRRGQAAEPEPALAGA

SEQ ID NO: 2859 - protein, 4 aa, Mycobacterium avium
PAIS

SEQ ID NO: 2860 - protein, 7 aa, Mycobacterium avium
PAISPPE

SEQ ID NO: 2861 - protein, 10 aa, Mycobacterium avium
PALESTRATL

SEQ ID NO: 2862 - protein, 7 aa, Mycobacterium avium
PAPASAL

SEQ ID NO: 2863 - protein, 7 aa, Mycobacterium avium
PAPDDGH

SEQ ID NO: 2864 - protein, 13 aa, Mycobacterium avium
PAPGDPTPSAPPL

SEQ ID NO: 2865 - protein, 8 aa, Mycobacterium avium
PAPRNSAL

SEQ ID NO: 2866 - protein, 6 aa, Mycobacterium avium
PAQGTL

SEQ ID NO: 2867 - protein, 12 aa, Mycobacterium avium
PAQISDAATAVG

SEQ ID NO: 2868 - protein, 16 aa, Mycobacterium avium
PAQPSAQRLRAGQTLQ

SEQ ID NO: 2869 - protein, 25 aa, Mycobacterium avium
PAQSGGTYAGATPSFAKDDDGKSKL

SEQ ID NO: 2870 - protein, 11 aa, Mycobacterium avium
PAQSGVTTADS

SEQ ID NO: 2871 - protein, 5 aa, Mycobacterium avium
PARAA

SEQ ID NO: 2872 - protein, 5 aa, Mycobacterium avium
PARPM

SEQ ID NO: 2873 - protein, 5 aa, Mycobacterium avium
PARRV

SEQ ID NO: 2874 - protein, 5 aa, Mycobacterium avium
PASAR

SEQ ID NO: 2875 - protein, 7 aa, Mycobacterium avium
PASASGV

SEQ ID NO: 2876 - protein, 18 aa, Mycobacterium avium
PATAGAEESGGRPAVAAP

SEQ ID NO: 2877 - protein, 5 aa, Mycobacterium avium
PATTS

SEQ ID NO: 2878 - protein, 5 aa, Mycobacterium avium
PAVDT

SEQ ID NO: 2879 - protein, 4 aa, Mycobacterium avium
PAVG

SEQ ID NO: 2880 - protein, 10 aa, Mycobacterium avium
PDAGGAPGTV

SEQ ID NO: 2881 - protein, 10 aa, Mycobacterium avium
PDDAAAGDDF

SEQ ID NO: 2882 - protein, 22 aa, Mycobacterium avium
PDDEDDLVDGDDSAGEGSVSKD

SEQ ID NO: 2883 - protein, 10 aa, Mycobacterium avium
PDDGPPKTRW

SEQ ID NO: 2884 - protein, 5 aa, Mycobacterium avium
PDDTT

SEQ ID NO: 2885 - protein, 10 aa, Mycobacterium avium
PDDYPSSVNT

SEQ ID NO: 2886 - protein, 4 aa, Mycobacterium avium
PDFK

SEQ ID NO: 2887 - protein, 6 aa, Mycobacterium avium
PDGAEL

SEQ ID NO: 2888 - protein, 6 aa, Mycobacterium avium
PDGKSA

SEQ ID NO: 2889 - protein, 6 aa, Mycobacterium avium
PDGNYP

SEQ ID NO: 2890 - protein, 11 aa, Mycobacterium avium
PDGPVKPPQQL

SEQ ID NO: 2891 - protein, 4 aa, Mycobacterium avium
PDGS

SEQ ID NO: 2892 - protein, 7 aa, Mycobacterium avium
PDGSYSK

SEQ ID NO: 2893 - protein, 4 aa, Mycobacterium avium
PDGT

SEQ ID NO: 2894 - protein, 6 aa, Mycobacterium avium
PDLGQT

SEQ ID NO: 2895 - protein, 4 aa, Mycobacterium avium
PDLP

SEQ ID NO: 2896 - protein, 6 aa, Mycobacterium avium
PDLPTT

SEQ ID NO: 2897 - protein, 6 aa, Mycobacterium avium
PDPATA

SEQ ID NO: 2898 - protein, 7 aa, Mycobacterium avium
PDPDTPV

SEQ ID NO: 2899 - protein, 8 aa, Mycobacterium avium
PDPRLDQT

SEQ ID NO: 2900 - protein, 8 aa, Mycobacterium avium
PDPTPQPL

SEQ ID NO: 2901 - protein, 6 aa, Mycobacterium avium
PDQISA

SEQ ID NO: 2902 - protein, 4 aa, Mycobacterium avium
PDRV

SEQ ID NO: 2903 - protein, 8 aa, Mycobacterium avium
PDSPNQPY

SEQ ID NO: 2904 - protein, 9 aa, Mycobacterium avium
PDTDRDPDH

SEQ ID NO: 2905 - protein, 12 aa, Mycobacterium avium
PDTNTERADGTV

SEQ ID NO: 2906 - protein, 7 aa, Mycobacterium avium
PDTTHGA

SEQ ID NO: 2907 - protein, 10 aa, Mycobacterium avium
PDVGEPDVDD

SEQ ID NO: 2908 - protein, 20 aa, Mycobacterium avium
PDYTAKKMDTDTWEDGTNGG

SEQ ID NO: 2909 - protein, 5 aa, Mycobacterium avium
PDYTT

SEQ ID NO: 2910 - protein, 13 aa, Mycobacterium avium
PEAENNEASGKEL

SEQ ID NO: 2911 - protein, 6 aa, Mycobacterium avium
PEAGER

SEQ ID NO: 2912 - protein, 5 aa, Mycobacterium avium
PEAGW

SEQ ID NO: 2913 - protein, 6 aa, Mycobacterium avium
PEAQRP

SEQ ID NO: 2914 - protein, 5 aa, Mycobacterium avium
PEARA

SEQ ID NO: 2915 - protein, 8 aa, Mycobacterium avium
PEASPTLP

SEQ ID NO: 2916 - protein, 15 aa, Mycobacterium avium
PEDAAAWEAGNKRIA

SEQ ID NO: 2917 - protein, 5 aa, Mycobacterium avium
PEELT

SEQ ID NO: 2918 - protein, 5 aa, Mycobacterium avium
PEESK

SEQ ID NO: 2919 - protein, 7 aa, Mycobacterium avium
PEFASAT

SEQ ID NO: 2920 - protein, 9 aa, Mycobacterium avium
PEGLSGGAA

SEQ ID NO: 2921 - protein, 27 aa, Mycobacterium avium
PEHAVENTTEGAAGQRAKKKTSRAGRD

SEQ ID NO: 2922 - protein, 4 aa, Mycobacterium avium
PEHS

SEQ ID NO: 2923 - protein, 21 aa, Mycobacterium avium
PELGGDPGHQPVPGRGRGTTA

SEQ ID NO: 2924 - protein, 16 aa, Mycobacterium avium
PELPGRPGCARAPDSV

SEQ ID NO: 2925 - protein, 14 aa, Mycobacterium avium
PENDPQDTGYQARQ

SEQ ID NO: 2926 - protein, 5 aa, Mycobacterium avium
PEPVT

SEQ ID NO: 2927 - protein, 8 aa, Mycobacterium avium
PEPYSPTR

SEQ ID NO: 2928 - protein, 9 aa, Mycobacterium avium
PERRSGIPA

SEQ ID NO: 2929 - protein, 7 aa, Mycobacterium avium
PERSPEL

SEQ ID NO: 2930 - protein, 8 aa, Mycobacterium avium
PESGGLLP

SEQ ID NO: 2931 - protein, 4 aa, Mycobacterium avium
PETL

SEQ ID NO: 2932 - protein, 6 aa, Mycobacterium avium
PEVEGQ

SEQ ID NO: 2933 - protein, 11 aa, Mycobacterium avium
PFGGEGTTTTA

SEQ ID NO: 2934 - protein, 9 aa, Mycobacterium avium
PFPDAPPRY

SEQ ID NO: 2935 - protein, 13 aa, Mycobacterium avium
PGAAKPADREPVA

SEQ ID NO: 2936 - protein, 8 aa, Mycobacterium avium
PGAEQDAL

SEQ ID NO: 2937 - protein, 4 aa, Mycobacterium avium
PGAH

SEQ ID NO: 2938 - protein, 6 aa, Mycobacterium avium
PGAPAA

SEQ ID NO: 2939 - protein, 5 aa, Mycobacterium avium
PGAPE

SEQ ID NO: 2940 - protein, 20 aa, Mycobacterium avium
PGAPPANPALASKPSPPAAV

SEQ ID NO: 2941 - protein, 9 aa, Mycobacterium avium
PGAPPPGSW

SEQ ID NO: 2942 - protein, 15 aa, Mycobacterium avium
PGAPSNFHPTGPSTS

SEQ ID NO: 2943 - protein, 9 aa, Mycobacterium avium
PGEATGEAI

SEQ ID NO: 2944 - protein, 8 aa, Mycobacterium avium
PGEGTHDG

SEQ ID NO: 2945 - protein, 8 aa, Mycobacterium avium
PGEHGGDV

SEQ ID NO: 2946 - protein, 5 aa, Mycobacterium avium
PGEPL

SEQ ID NO: 2947 - protein, 6 aa, Mycobacterium avium
PGGDVN

SEQ ID NO: 2948 - protein, 7 aa, Mycobacterium avium
PGGEVKQ

SEQ ID NO: 2949 - protein, 11 aa, Mycobacterium avium
PGGGNFTATPA

SEQ ID NO: 2950 - protein, 11 aa, Mycobacterium avium
PGGGRLGAEGA

SEQ ID NO: 2951 - protein, 7 aa, Mycobacterium avium
PGGKTAF

SEQ ID NO: 2952 - protein, 20 aa, Mycobacterium avium
PGGKTAYCGAPDRIGPAMGT

SEQ ID NO: 2953 - protein, 4 aa, Mycobacterium avium
PGGL

SEQ ID NO: 2954 - protein, 7 aa, Mycobacterium avium
PGGMGAG

SEQ ID NO: 2955 - protein, 49 aa, Mycobacterium avium
PGGPGPGNGPWQYGGPGPGNGPWPGGPGGSGAWYGGPGGPDNGPWPGGP

SEQ ID NO: 2956 - protein, 9 aa, Mycobacterium avium
PGIAPDSGA

SEQ ID NO: 2957 - protein, 10 aa, Mycobacterium avium
PGKDDDEPQQ

SEQ ID NO: 2958 - protein, 5 aa, Mycobacterium avium
PGLAG

SEQ ID NO: 2959 - protein, 8 aa, Mycobacterium avium
PGLAGPDS

SEQ ID NO: 2960 - protein, 13 aa, Mycobacterium avium
PGNDGNEARNLGQ

SEQ ID NO: 2961 - protein, 10 aa, Mycobacterium avium
PGNEEAAATV

SEQ ID NO: 2962 - protein, 5 aa, Mycobacterium avium
PGNGR

SEQ ID NO: 2963 - protein, 5 aa, Mycobacterium avium
PGNRS

SEQ ID NO: 2964 - protein, 9 aa, Mycobacterium avium
PGPLTPKDS

SEQ ID NO: 2965 - protein, 7 aa, Mycobacterium avium
PGPNRVG

SEQ ID NO: 2966 - protein, 5 aa, Mycobacterium avium
PGPTI

SEQ ID NO: 2967 - protein, 16 aa, Mycobacterium avium
PGPVDETDAVALEGAQ

SEQ ID NO: 2968 - protein, 8 aa, Mycobacterium avium
PGQLGPDA

SEQ ID NO: 2969 - protein, 14 aa, Mycobacterium avium
PGQTFGPDGPLGGV

SEQ ID NO: 2970 - protein, 13 aa, Mycobacterium avium
PGRAGLESTPGAV

SEQ ID NO: 2971 - protein, 4 aa, Mycobacterium avium
PGRL

SEQ ID NO: 2972 - protein, 11 aa, Mycobacterium avium
PGRPAQDPRYT

SEQ ID NO: 2973 - protein, 4 aa, Mycobacterium avium
PGSA

SEQ ID NO: 2974 - protein, 4 aa, Mycobacterium avium
PGSD

SEQ ID NO: 2975 - protein, 7 aa, Mycobacterium avium
PGSDPFS

SEQ ID NO: 2976 - protein, 8 aa, Mycobacterium avium
PGSPPAGA

SEQ ID NO: 2977 - protein, 18 aa, Mycobacterium avium
PGSPSGGAGGTPGGPGGT

SEQ ID NO: 2978 - protein, 4 aa, Mycobacterium avium
PGTG

SEQ ID NO: 2979 - protein, 7 aa, Mycobacterium avium
PGTGQEY

SEQ ID NO: 2980 - protein, 4 aa, Mycobacterium avium
PGTP

SEQ ID NO: 2981 - protein, 4 aa, Mycobacterium avium
PGTR

SEQ ID NO: 2982 - protein, 5 aa, Mycobacterium avium
PGVAR

SEQ ID NO: 2983 - protein, 7 aa, Mycobacterium avium
PGVASGP

SEQ ID NO: 2984 - protein, 13 aa, Mycobacterium avium
PGVPDKVGTATAT

SEQ ID NO: 2985 - protein, 4 aa, Mycobacterium avium
PGYA

SEQ ID NO: 2986 - protein, 4 aa, Mycobacterium avium
PHGN

SEQ ID NO: 2987 - protein, 35 aa, Mycobacterium avium
PHLPPANPAVPQAPPAEPGPPGPVPPPAPNPAGPG

SEQ ID NO: 2988 - protein, 4 aa, Mycobacterium avium
PHNT

SEQ ID NO: 2989 - protein, 8 aa, Mycobacterium avium
PHQRSGGA

SEQ ID NO: 2990 - protein, 10 aa, Mycobacterium avium
PHRPGGPTPF

SEQ ID NO: 2991 - protein, 24 aa, Mycobacterium avium
PHTPPDADAVTGGIPAAEADDEYA

SEQ ID NO: 2992 - protein, 5 aa, Mycobacterium avium
PIAGA

SEQ ID NO: 2993 - protein, 33 aa, Mycobacterium avium
PIPQPSPSGGQSPSTGPQHAKDRARQREHAERS

SEQ ID NO: 2994 - protein, 12 aa, Mycobacterium avium
PIRRRPPERANR

SEQ ID NO: 2995 - protein, 8 aa, Mycobacterium avium
PISPDTAD

SEQ ID NO: 2996 - protein, 7 aa, Mycobacterium avium
PKALDNA

SEQ ID NO: 2997 - protein, 6 aa, Mycobacterium avium
PKAPWI

SEQ ID NO: 2998 - protein, 9 aa, Mycobacterium avium
PKDADDLTK

SEQ ID NO: 2999 - protein, 4 aa, Mycobacterium avium
PKET

SEQ ID NO: 3000 - protein, 4 aa, Mycobacterium avium
PKGI

SEQ ID NO: 3001 - protein, 11 aa, Mycobacterium avium
PKGKAPAQLST

SEQ ID NO: 3002 - protein, 13 aa, Mycobacterium avium
PKPARPAPPWPTA

SEQ ID NO: 3003 - protein, 7 aa, Mycobacterium avium
PKPASVR

SEQ ID NO: 3004 - protein, 5 aa, Mycobacterium avium
PKPVT

SEQ ID NO: 3005 - protein, 9 aa, Mycobacterium avium
PKQAPKAVD

SEQ ID NO: 3006 - protein, 7 aa, Mycobacterium avium
PKRPKDI

SEQ ID NO: 3007 - protein, 4 aa, Mycobacterium avium
PKTK

SEQ ID NO: 3008 - protein, 6 aa, Mycobacterium avium
PKVERY

SEQ ID NO: 3009 - protein, 15 aa, Mycobacterium avium
PLAGPEGLVPGTPAQ

SEQ ID NO: 3010 - protein, 10 aa, Mycobacterium avium
PLAPQDAPAV

SEQ ID NO: 3011 - protein, 16 aa, Mycobacterium avium
PLDGDDPLTGPQPAVA

SEQ ID NO: 3012 - protein, 4 aa, Mycobacterium avium
PLGD

SEQ ID NO: 3013 - protein, 13 aa, Mycobacterium avium
PLGDPGNDSAPAR

SEQ ID NO: 3014 - protein, 4 aa, Mycobacterium avium
PLGG

SEQ ID NO: 3015 - protein, 7 aa, Mycobacterium avium
PLGTPLD

SEQ ID NO: 3016 - protein, 9 aa, Mycobacterium avium
PLHTGGPGR

SEQ ID NO: 3017 - protein, 21 aa, Mycobacterium avium
PLNGYNGPPPPDYKPPAPPKL

SEQ ID NO: 3018 - protein, 8 aa, Mycobacterium avium
PLPGHDDA

SEQ ID NO: 3019 - protein, 10 aa, Mycobacterium avium
PLPNGTGNGL

SEQ ID NO: 3020 - protein, 10 aa, Mycobacterium avium
PLQVSGPAAG

SEQ ID NO: 3021 - protein, 11 aa, Mycobacterium avium
PLSGEGSDTDT

SEQ ID NO: 3022 - protein, 11 aa, Mycobacterium avium
PLSPSDAPSVT

SEQ ID NO: 3023 - protein, 4 aa, Mycobacterium avium
PLTA

SEQ ID NO: 3024 - protein, 15 aa, Mycobacterium avium
PLTGAGAQSNDGKAS

SEQ ID NO: 3025 - protein, 7 aa, Mycobacterium avium
PLTPPQT

SEQ ID NO: 3026 - protein, 4 aa, Mycobacterium avium
PMST

SEQ ID NO: 3027 - protein, 9 aa, Mycobacterium avium
PMTPRDAPA

SEQ ID NO: 3028 - protein, 7 aa, Mycobacterium avium
PNAEANN

SEQ ID NO: 3029 - protein, 9 aa, Mycobacterium avium
PNAGNKAQT

SEQ ID NO: 3030 - protein, 9 aa, Mycobacterium avium
PNGTAGTNA

SEQ ID NO: 3031 - protein, 5 aa, Mycobacterium avium
PNLSS

SEQ ID NO: 3032 - protein, 4 aa, Mycobacterium avium
PNND

SEQ ID NO: 3033 - protein, 8 aa, Mycobacterium avium
PNNERAHP

SEQ ID NO: 3034 - protein, 19 aa, Mycobacterium avium
PNPSAEAVKQEEESDEQNT

SEQ ID NO: 3035 - protein, 7 aa, Mycobacterium avium
PNSNAQK

SEQ ID NO: 3036 - protein, 18 aa, Mycobacterium avium
PNWTTQQKEAVADTIGGP

SEQ ID NO: 3037 - protein, 10 aa, Mycobacterium avium
PPAAKPSRGQ

SEQ ID NO: 3038 - protein, 24 aa, Mycobacterium avium
PPAGPTERLATAPNPDNGPAKKKR

SEQ ID NO: 3039 - protein, 4 aa, Mycobacterium avium
PPAL

SEQ ID NO: 3040 - protein, 5 aa, Mycobacterium avium
PPANV

SEQ ID NO: 3041 - protein, 8 aa, Mycobacterium avium
PPAQPPYW

SEQ ID NO: 3042 - protein, 6 aa, Mycobacterium avium
PPDEND

SEQ ID NO: 3043 - protein, 13 aa, Mycobacterium avium
PPDPPGGPADPQI

SEQ ID NO: 3044 - protein, 5 aa, Mycobacterium avium
PPEAN

SEQ ID NO: 3045 - protein, 5 aa, Mycobacterium avium
PPEDR

SEQ ID NO: 3046 - protein, 11 aa, Mycobacterium avium
PPEQRARPGAR

SEQ ID NO: 3047 - protein, 5 aa, Mycobacterium avium
PPFQH

SEQ ID NO: 3048 - protein, 5 aa, Mycobacterium avium
PPGAA

SEQ ID NO: 3049 - protein, 12 aa, Mycobacterium avium
PPGDRMAPGSQS

SEQ ID NO: 3050 - protein, 36 aa, Mycobacterium avium
PPGGPGGPGGPVSGPGVSGPGQPSPVSPAPSTPAPR

SEQ ID NO: 3051 - protein, 6 aa, Mycobacterium avium
PPGQPV

SEQ ID NO: 3052 - protein, 5 aa, Mycobacterium avium
PPGSA

SEQ ID NO: 3053 - protein, 5 aa, Mycobacterium avium
PPGTD

SEQ ID NO: 3054 - protein, 8 aa, Mycobacterium avium
PPGTTTDV

SEQ ID NO: 3055 - protein, 16 aa, Mycobacterium avium
PPLAAGASAAGAGHHS

SEQ ID NO: 3056 - protein, 10 aa, Mycobacterium avium
PPLARPRRGT

SEQ ID NO: 3057 - protein, 7 aa, Mycobacterium avium
PPLPPDE

SEQ ID NO: 3058 - protein, 8 aa, Mycobacterium avium
PPLPTRRN

SEQ ID NO: 3059 - protein, 12 aa, Mycobacterium avium
PPLRSAVTSKDR

SEQ ID NO: 3060 - protein, 20 aa, Mycobacterium avium
PPNNATDPPRYAEPHPAGAI

SEQ ID NO: 3061 - protein, 16 aa, Mycobacterium avium
PPNPPAVGQADTIGAR

SEQ ID NO: 3062 - protein, 9 aa, Mycobacterium avium
PPPNAGQGA

SEQ ID NO: 3063 - protein, 45 aa, Mycobacterium avium
PPPPPPPPPPPEGGGATAASNGPPDPQTEDEPAVPPLPPGAPDGV

SEQ ID NO: 3064 - protein, 7 aa, Mycobacterium avium
PPQPSGV

SEQ ID NO: 3065 - protein, 7 aa, Mycobacterium avium
PPQRRQD

SEQ ID NO: 3066 - protein, 59 aa, Mycobacterium avium
PPRATSPPGAQATRSPVPETGGPASPAPPTTSASPTPSTNATPGPASSSPAGPTTTSQT

SEQ ID NO: 3067 - protein, 7 aa, Mycobacterium avium
PPRTPDR

SEQ ID NO: 3068 - protein, 5 aa, Mycobacterium avium
PPRVP

SEQ ID NO: 3069 - protein, 8 aa, Mycobacterium avium
PPSHAGRA

SEQ ID NO: 3070 - protein, 6 aa, Mycobacterium avium
PPSHTR

SEQ ID NO: 3071 - protein, 5 aa, Mycobacterium avium
PPSWN

SEQ ID NO: 3072 - protein, 22 aa, Mycobacterium avium
PPTAAEPTQPGSPSAKPVNNDP

SEQ ID NO: 3073 - protein, 4 aa, Mycobacterium avium
PPTQ

SEQ ID NO: 3074 - protein, 6 aa, Mycobacterium avium
PPVPDD

SEQ ID NO: 3075 - protein, 6 aa, Mycobacterium avium
PPVTAT

SEQ ID NO: 3076 - protein, 11 aa, Mycobacterium avium
PQFGPRQLGPG

SEQ ID NO: 3077 - protein, 12 aa, Mycobacterium avium
PQGSRSPAEPAH

SEQ ID NO: 3078 - protein, 7 aa, Mycobacterium avium
PQIGQGT

SEQ ID NO: 3079 - protein, 4 aa, Mycobacterium avium
PQLH

SEQ ID NO: 3080 - protein, 4 aa, Mycobacterium avium
PQMG

SEQ ID NO: 3081 - protein, 18 aa, Mycobacterium avium
PQMNAGSASLPGTAAPRI

SEQ ID NO: 3082 - protein, 15 aa, Mycobacterium avium
PQNAEKARDLLARLA

SEQ ID NO: 3083 - protein, 6 aa, Mycobacterium avium
PQPGRH

SEQ ID NO: 3084 - protein, 23 aa, Mycobacterium avium
PQQGHAGHPGRPRPSHDSGPPTL

SEQ ID NO: 3085 - protein, 15 aa, Mycobacterium avium
PQQQTNTGGYSAPGF

SEQ ID NO: 3086 - protein, 6 aa, Mycobacterium avium
PQQYRR

SEQ ID NO: 3087 - protein, 6 aa, Mycobacterium avium
PQWGPP

SEQ ID NO: 3088 - protein, 4 aa, Mycobacterium avium
PRAD

SEQ ID NO: 3089 - protein, 10 aa, Mycobacterium avium
PRADASYQDM

SEQ ID NO: 3090 - protein, 8 aa, Mycobacterium avium
PRAHRSAE

SEQ ID NO: 3091 - protein, 5 aa, Mycobacterium avium
PRALA

SEQ ID NO: 3092 - protein, 12 aa, Mycobacterium avium
PRASSAAGTAGA

SEQ ID NO: 3093 - protein, 4 aa, Mycobacterium avium
PRDL

SEQ ID NO: 3094 - protein, 4 aa, Mycobacterium avium
PRDR

SEQ ID NO: 3095 - protein, 4 aa, Mycobacterium avium
PRDV

SEQ ID NO: 3096 - protein, 7 aa, Mycobacterium avium
PRGIQPP

SEQ ID NO: 3097 - protein, 5 aa, Mycobacterium avium
PRGWP

SEQ ID NO: 3098 - protein, 17 aa, Mycobacterium avium
PRNPTGKILKRELREME

SEQ ID NO: 3099 - protein, 5 aa, Mycobacterium avium
PRPAS

SEQ ID NO: 3100 - protein, 7 aa, Mycobacterium avium
PRPDSGG

SEQ ID NO: 3101 - protein, 4 aa, Mycobacterium avium
PRPP

SEQ ID NO: 3102 - protein, 6 aa, Mycobacterium avium
PRPPLG

SEQ ID NO: 3103 - protein, 4 aa, Mycobacterium avium
PRPQ

SEQ ID NO: 3104 - protein, 7 aa, Mycobacterium avium
PRPRPAS

SEQ ID NO: 3105 - protein, 7 aa, Mycobacterium avium
PRPRPSS

SEQ ID NO: 3106 - protein, 5 aa, Mycobacterium avium
PRPWH

SEQ ID NO: 3107 - protein, 7 aa, Mycobacterium avium
PRRAATP

SEQ ID NO: 3108 - protein, 6 aa, Mycobacterium avium
PRRPRA

SEQ ID NO: 3109 - protein, 7 aa, Mycobacterium avium
PRRRTDR

SEQ ID NO: 3110 - protein, 9 aa, Mycobacterium avium
PRSASARQV

SEQ ID NO: 3111 - protein, 8 aa, Mycobacterium avium
PRSRHHRN

SEQ ID NO: 3112 - protein, 8 aa, Mycobacterium avium
PRTDSKGR

SEQ ID NO: 3113 - protein, 7 aa, Mycobacterium avium
PRTKNSA

SEQ ID NO: 3114 - protein, 8 aa, Mycobacterium avium
PRTLGRQN

SEQ ID NO: 3115 - protein, 10 aa, Mycobacterium avium
PRTPSGKADL

SEQ ID NO: 3116 - protein, 4 aa, Mycobacterium avium
PRTV

SEQ ID NO: 3117 - protein, 6 aa, Mycobacterium avium
PRYAGD

SEQ ID NO: 3118 - protein, 8 aa, Mycobacterium avium
PSDAETET

SEQ ID NO: 3119 - protein, 7 aa, Mycobacterium avium
PSDDEAV

SEQ ID NO: 3120 - protein, 7 aa, Mycobacterium avium
PSDGFQP

SEQ ID NO: 3121 - protein, 7 aa, Mycobacterium avium
PSDGSHF

SEQ ID NO: 3122 - protein, 4 aa, Mycobacterium avium
PSDR

SEQ ID NO: 3123 - protein, 5 aa, Mycobacterium avium
PSFAD

SEQ ID NO: 3124 - protein, 15 aa, Mycobacterium avium
PSGASGPGRPSTPRI

SEQ ID NO: 3125 - protein, 5 aa, Mycobacterium avium
PSGGA

SEQ ID NO: 3126 - protein, 6 aa, Mycobacterium avium
PSGRRR

SEQ ID NO: 3127 - protein, 6 aa, Mycobacterium avium
PSGSGL

SEQ ID NO: 3128 - protein, 6 aa, Mycobacterium avium
PSGYID

SEQ ID NO: 3129 - protein, 4 aa, Mycobacterium avium
PSIA

SEQ ID NO: 3130 - protein, 7 aa, Mycobacterium avium
PSPTEGI

SEQ ID NO: 3131 - protein, 7 aa, Mycobacterium avium
PSQSSSR

SEQ ID NO: 3132 - protein, 12 aa, Mycobacterium avium
PSRDFATSGLES

SEQ ID NO: 3133 - protein, 11 aa, Mycobacterium avium
PSRGDERTRAD

SEQ ID NO: 3134 - protein, 5 aa, Mycobacterium avium
PSRLG

SEQ ID NO: 3135 - protein, 6 aa, Mycobacterium avium
PSSSSH

SEQ ID NO: 3136 - protein, 8 aa, Mycobacterium avium
PSSTYTRA

SEQ ID NO: 3137 - protein, 4 aa, Mycobacterium avium
PSTT

SEQ ID NO: 3138 - protein, 44 aa, Mycobacterium avium
PSVDNGLNPAPSDRVAGTPPPVSDPLSRPGSGTVQCNGQQPNPC

SEQ ID NO: 3139 - protein, 4 aa, Mycobacterium avium
PSVV

SEQ ID NO: 3140 - protein, 4 aa, Mycobacterium avium
PTAA

SEQ ID NO: 3141 - protein, 8 aa, Mycobacterium avium
PTAATAAK

SEQ ID NO: 3142 - protein, 6 aa, Mycobacterium avium
PTANGD

SEQ ID NO: 3143 - protein, 10 aa, Mycobacterium avium
PTATSVGRPA

SEQ ID NO: 3144 - protein, 4 aa, Mycobacterium avium
PTDH

SEQ ID NO: 3145 - protein, 6 aa, Mycobacterium avium
PTEQLD

SEQ ID NO: 3146 - protein, 8 aa, Mycobacterium avium
PTGQYSGF

SEQ ID NO: 3147 - protein, 6 aa, Mycobacterium avium
PTTEAR

SEQ ID NO: 3148 - protein, 13 aa, Mycobacterium avium
PTTGAFPTGTAAI

SEQ ID NO: 3149 - protein, 11 aa, Mycobacterium avium
PTTNREATKNA

SEQ ID NO: 3150 - protein, 6 aa, Mycobacterium avium
PTWSRP

SEQ ID NO: 3151 - protein, 4 aa, Mycobacterium avium
PTYS

SEQ ID NO: 3152 - protein, 6 aa, Mycobacterium avium
PVAAGT

SEQ ID NO: 3153 - protein, 20 aa, Mycobacterium avium
PVAAPEDDDEPGGCHTGGGV

SEQ ID NO: 3154 - protein, 7 aa, Mycobacterium avium
PVANPNS

SEQ ID NO: 3155 - protein, 11 aa, Mycobacterium avium
PVAVPDDANPL

SEQ ID NO: 3156 - protein, 51 aa, Mycobacterium avium
PVDSGALAAEKDGVEPDHADDPWRDPGAPAALGTPAVAPSPSRSALGYGGK

SEQ ID NO: 3157 - protein, 6 aa, Mycobacterium avium
PVISGT

SEQ ID NO: 3158 - protein, 5 aa, Mycobacterium avium
PVNAE

SEQ ID NO: 3159 - protein, 4 aa, Mycobacterium avium
PVNE

SEQ ID NO: 3160 - protein, 17 aa, Mycobacterium avium
PVPPAQPTAGAPPRAGD

SEQ ID NO: 3161 - protein, 17 aa, Mycobacterium avium
PVSEDESEEQDNELTDI

SEQ ID NO: 3162 - protein, 8 aa, Mycobacterium avium
PVSPGQLS

SEQ ID NO: 3163 - protein, 4 aa, Mycobacterium avium
PVST

SEQ ID NO: 3164 - protein, 4 aa, Mycobacterium avium
PVTG

SEQ ID NO: 3165 - protein, 7 aa, Mycobacterium avium
PVTQGLN

SEQ ID NO: 3166 - protein, 4 aa, Mycobacterium avium
PWGY

SEQ ID NO: 3167 - protein, 4 aa, Mycobacterium avium
PWPP

SEQ ID NO: 3168 - protein, 4 aa, Mycobacterium avium
PWPS

SEQ ID NO: 3169 - protein, 11 aa, Mycobacterium avium
PWTAPPQASAD

SEQ ID NO: 3170 - protein, 15 aa, Mycobacterium avium
PYATPYQETRASRPL

SEQ ID NO: 3171 - protein, 9 aa, Mycobacterium avium
PYGGHPTGW

SEQ ID NO: 3172 - protein, 12 aa, Mycobacterium avium
QAADAGEGKANV

SEQ ID NO: 3173 - protein, 13 aa, Mycobacterium avium
QAAGRLGDSRGDI

SEQ ID NO: 3174 - protein, 4 aa, Mycobacterium avium
QAAT

SEQ ID NO: 3175 - protein, 4 aa, Mycobacterium avium
QAAY

SEQ ID NO: 3176 - protein, 6 aa, Mycobacterium avium
QAEEFG

SEQ ID NO: 3177 - protein, 5 aa, Mycobacterium avium
QAERA

SEQ ID NO: 3178 - protein, 7 aa, Mycobacterium avium
QAERLGR

SEQ ID NO: 3179 - protein, 11 aa, Mycobacterium avium
QAERSRDPERR

SEQ ID NO: 3180 - protein, 6 aa, Mycobacterium avium
QAGGPV

SEQ ID NO: 3181 - protein, 16 aa, Mycobacterium avium
QAGLEAERIKSQGSRQ

SEQ ID NO: 3182 - protein, 10 aa, Mycobacterium avium
QAIPQQSRTS

SEQ ID NO: 3183 - protein, 14 aa, Mycobacterium avium
QAKLTSGALSTAAT

SEQ ID NO: 3184 - protein, 5 aa, Mycobacterium avium
QAKTR

SEQ ID NO: 3185 - protein, 4 aa, Mycobacterium avium
QALT

SEQ ID NO: 3186 - protein, 28 aa, Mycobacterium avium
QANSGHRGGIQNGRTDPSTGQRLNAPTS

SEQ ID NO: 3187 - protein, 10 aa, Mycobacterium avium
QANSPSTPEL

SEQ ID NO: 3188 - protein, 7 aa, Mycobacterium avium
QAPLPDQ

SEQ ID NO: 3189 - protein, 34 aa, Mycobacterium avium
QAPTAQPAERLDTTGLPAVGDDATVPRDAPRRTI

SEQ ID NO: 3190 - protein, 5 aa, Mycobacterium avium
QARWT

SEQ ID NO: 3191 - protein, 16 aa, Mycobacterium avium
QASSLRDNARAEGRKV

SEQ ID NO: 3192 - protein, 6 aa, Mycobacterium avium
QATAPS

SEQ ID NO: 3193 - protein, 10 aa, Mycobacterium avium
QAVGDATNYA

SEQ ID NO: 3194 - protein, 31 aa, Mycobacterium avium
QDAAAAADRLTESTTAHSKAVEAAKAESKRV

SEQ ID NO: 3195 - protein, 9 aa, Mycobacterium avium
QDATTTFEQ

SEQ ID NO: 3196 - protein, 9 aa, Mycobacterium avium
QDDGGIRSA

SEQ ID NO: 3197 - protein, 12 aa, Mycobacterium avium
QDEAENAAVSAS

SEQ ID NO: 3198 - protein, 12 aa, Mycobacterium avium
QDNKGTYEVGRP

SEQ ID NO: 3199 - protein, 7 aa, Mycobacterium avium
QDPSAGL

SEQ ID NO: 3200 - protein, 12 aa, Mycobacterium avium
QDRTKEALASAR

SEQ ID NO: 3201 - protein, 10 aa, Mycobacterium avium
QDSPLSVRGA

SEQ ID NO: 3202 - protein, 6 aa, Mycobacterium avium
QDYGTA

SEQ ID NO: 3203 - protein, 10 aa, Mycobacterium avium
QEESSQRAET

SEQ ID NO: 3204 - protein, 11 aa, Mycobacterium avium
QEGRERGLDRE

SEQ ID NO: 3205 - protein, 6 aa, Mycobacterium avium
QEGRGA

SEQ ID NO: 3206 - protein, 10 aa, Mycobacterium avium
QEPGQPRQSG

SEQ ID NO: 3207 - protein, 7 aa, Mycobacterium avium
QETQTER

SEQ ID NO: 3208 - protein, 5 aa, Mycobacterium avium
QETTR

SEQ ID NO: 3209 - protein, 8 aa, Mycobacterium avium
QFPGGDRT

SEQ ID NO: 3210 - protein, 10 aa, Mycobacterium avium
QFPGPGRTEH

SEQ ID NO: 3211 - protein, 6 aa, Mycobacterium avium
QFQGSA

SEQ ID NO: 3212 - protein, 5 aa, Mycobacterium avium
QGAAR

SEQ ID NO: 3213 - protein, 6 aa, Mycobacterium avium
QGAIQG

SEQ ID NO: 3214 - protein, 9 aa, Mycobacterium avium
QGAQLGAGP

SEQ ID NO: 3215 - protein, 7 aa, Mycobacterium avium
QGDTSSL

SEQ ID NO: 3216 - protein, 10 aa, Mycobacterium avium
QGELSTSEDH

SEQ ID NO: 3217 - protein, 9 aa, Mycobacterium avium
QGGKEFGRS

SEQ ID NO: 3218 - protein, 15 aa, Mycobacterium avium
QGGLEPSRAASITGQ

SEQ ID NO: 3219 - protein, 4 aa, Mycobacterium avium
QGGS

SEQ ID NO: 3220 - protein, 5 aa, Mycobacterium avium
QGGSA

SEQ ID NO: 3221 - protein, 6 aa, Mycobacterium avium
QGGSPA

SEQ ID NO: 3222 - protein, 5 aa, Mycobacterium avium
QGIAN

SEQ ID NO: 3223 - protein, 9 aa, Mycobacterium avium
QGIGGGGIT

SEQ ID NO: 3224 - protein, 29 aa, Mycobacterium avium
QGLNDQAKAQADNATAQGDAFDKAKNDDT

SEQ ID NO: 3225 - protein, 7 aa, Mycobacterium avium
QGPTLSR

SEQ ID NO: 3226 - protein, 9 aa, Mycobacterium avium
QGSGNGQQL

SEQ ID NO: 3227 - protein, 4 aa, Mycobacterium avium
QGSP

SEQ ID NO: 3228 - protein, 12 aa, Mycobacterium avium
QGVGSAIASPTG

SEQ ID NO: 3229 - protein, 9 aa, Mycobacterium avium
QGVPDRGPS

SEQ ID NO: 3230 - protein, 9 aa, Mycobacterium avium
QGVPPDDRV

SEQ ID NO: 3231 - protein, 6 aa, Mycobacterium avium
QHAEAN

SEQ ID NO: 3232 - protein, 6 aa, Mycobacterium avium
QHARED

SEQ ID NO: 3233 - protein, 10 aa, Mycobacterium avium
QHDPDTIARA

SEQ ID NO: 3234 - protein, 6 aa, Mycobacterium avium
QHGAGT

SEQ ID NO: 3235 - protein, 4 aa, Mycobacterium avium
QHGI

SEQ ID NO: 3236 - protein, 8 aa, Mycobacterium avium
QHTPESAD

SEQ ID NO: 3237 - protein, 8 aa, Mycobacterium avium
QIESQQRN

SEQ ID NO: 3238 - protein, 6 aa, Mycobacterium avium
QIPTND

SEQ ID NO: 3239 - protein, 7 aa, Mycobacterium avium
QISGPQQ

SEQ ID NO: 3240 - protein, 11 aa, Mycobacterium avium
QKEASAADRAL

SEQ ID NO: 3241 - protein, 7 aa, Mycobacterium avium
QKERAED

SEQ ID NO: 3242 - protein, 19 aa, Mycobacterium avium
QKGLQDQQNEAQKNSNAMG

SEQ ID NO: 3243 - protein, 16 aa, Mycobacterium avium
QKGLSTKGGPTGVANS

SEQ ID NO: 3244 - protein, 5 aa, Mycobacterium avium
QKGNP

SEQ ID NO: 3245 - protein, 6 aa, Mycobacterium avium
QKPGES

SEQ ID NO: 3246 - protein, 4 aa, Mycobacterium avium
QKRA

SEQ ID NO: 3247 - protein, 4 aa, Mycobacterium avium
QKVN

SEQ ID NO: 3248 - protein, 9 aa, Mycobacterium avium
QLAGAGSAV

SEQ ID NO: 3249 - protein, 7 aa, Mycobacterium avium
QLDEPTD

SEQ ID NO: 3250 - protein, 4 aa, Mycobacterium avium
QLGA

SEQ ID NO: 3251 - protein, 11 aa, Mycobacterium avium
QLGGKGQELTN

SEQ ID NO: 3252 - protein, 11 aa, Mycobacterium avium
QLPPLPRGTTA

SEQ ID NO: 3253 - protein, 5 aa, Mycobacterium avium
QLPTG

SEQ ID NO: 3254 - protein, 13 aa, Mycobacterium avium
QLSANTTTTLTDG

SEQ ID NO: 3255 - protein, 12 aa, Mycobacterium avium
QLSGGNAYNAAS

SEQ ID NO: 3256 - protein, 6 aa, Mycobacterium avium
QLSGGQ

SEQ ID NO: 3257 - protein, 17 aa, Mycobacterium avium
QNAGGAASFPGAPGPIG

SEQ ID NO: 3258 - protein, 7 aa, Mycobacterium avium
QNGTPGK

SEQ ID NO: 3259 - protein, 8 aa, Mycobacterium avium
QNGVDETP

SEQ ID NO: 3260 - protein, 5 aa, Mycobacterium avium
QNNDM

SEQ ID NO: 3261 - protein, 8 aa, Mycobacterium avium
QNPSTDAN

SEQ ID NO: 3262 - protein, 7 aa, Mycobacterium avium
QNSGRTD

SEQ ID NO: 3263 - protein, 7 aa, Mycobacterium avium
QNSSGRA

SEQ ID NO: 3264 - protein, 8 aa, Mycobacterium avium
QNVPGCGA

SEQ ID NO: 3265 - protein, 17 aa, Mycobacterium avium
QNYDDRQYQPRNAPANL

SEQ ID NO: 3266 - protein, 4 aa, Mycobacterium avium
QPAD

SEQ ID NO: 3267 - protein, 16 aa, Mycobacterium avium
QPARPGPRLPARGVDR

SEQ ID NO: 3268 - protein, 15 aa, Mycobacterium avium
QPATAAGAQSTDGQA

SEQ ID NO: 3269 - protein, 6 aa, Mycobacterium avium
QPDRPA

SEQ ID NO: 3270 - protein, 8 aa, Mycobacterium avium
QPEPRDGL

SEQ ID NO: 3271 - protein, 4 aa, Mycobacterium avium
QPEY

SEQ ID NO: 3272 - protein, 8 aa, Mycobacterium avium
QPHTPDIP

SEQ ID NO: 3273 - protein, 5 aa, Mycobacterium avium
QPIAP

SEQ ID NO: 3274 - protein, 7 aa, Mycobacterium avium
QPKKAAA

SEQ ID NO: 3275 - protein, 11 aa, Mycobacterium avium
QPKLADNSLTE

SEQ ID NO: 3276 - protein, 64 aa, Mycobacterium avium
QPLASDAPAAPAVEPYRDPAYDPADVSSGALTKPRTSADPEPKRGWRKNRAGGNAAYLRWPHPQ

SEQ ID NO: 3277 - protein, 12 aa, Mycobacterium avium
QPLPGAGPTDDG

SEQ ID NO: 3278 - protein, 6 aa, Mycobacterium avium
QPPDVS

SEQ ID NO: 3279 - protein, 21 aa, Mycobacterium avium
QPPKPTPAGKTPAPAKEPAIG

SEQ ID NO: 3280 - protein, 6 aa, Mycobacterium avium
QPPLGP

SEQ ID NO: 3281 - protein, 5 aa, Mycobacterium avium
QPPNA

SEQ ID NO: 3282 - protein, 8 aa, Mycobacterium avium
QPPPQPTW

SEQ ID NO: 3283 - protein, 25 aa, Mycobacterium avium
QPPSTMDGRGGFQDTSGRNGSPNAE

SEQ ID NO: 3284 - protein, 8 aa, Mycobacterium avium
QPPTGDDE

SEQ ID NO: 3285 - protein, 11 aa, Mycobacterium avium
QPQDTDPQNEV

SEQ ID NO: 3286 - protein, 5 aa, Mycobacterium avium
QPRPV

SEQ ID NO: 3287 - protein, 4 aa, Mycobacterium avium
QPSE

SEQ ID NO: 3288 - protein, 4 aa, Mycobacterium avium
QPTQ

SEQ ID NO: 3289 - protein, 4 aa, Mycobacterium avium
QPVA

SEQ ID NO: 3290 - protein, 15 aa, Mycobacterium avium
QPWPEPGDEYPVHVH

SEQ ID NO: 3291 - protein, 27 aa, Mycobacterium avium
QQADVTSNGYLPEPGIERPRDIGDPRP

SEQ ID NO: 3292 - protein, 14 aa, Mycobacterium avium
QQARSIDADERPQV

SEQ ID NO: 3293 - protein, 7 aa, Mycobacterium avium
QQFNAGA

SEQ ID NO: 3294 - protein, 9 aa, Mycobacterium avium
QQLGDDAHT

SEQ ID NO: 3295 - protein, 7 aa, Mycobacterium avium
QQMGPGP

SEQ ID NO: 3296 - protein, 7 aa, Mycobacterium avium
QQPLGAD

SEQ ID NO: 3297 - protein, 9 aa, Mycobacterium avium
QQPLGPDAH

SEQ ID NO: 3298 - protein, 19 aa, Mycobacterium avium
QQQAPLPPPPADAPNAGFQ

SEQ ID NO: 3299 - protein, 8 aa, Mycobacterium avium
QQQLGDDA

SEQ ID NO: 3300 - protein, 5 aa, Mycobacterium avium
QQRAK

SEQ ID NO: 3301 - protein, 19 aa, Mycobacterium avium
QQSAAPACAGSCTGCTQSC

SEQ ID NO: 3302 - protein, 6 aa, Mycobacterium avium
QRDLAE

SEQ ID NO: 3303 - protein, 6 aa, Mycobacterium avium
QRDPNV

SEQ ID NO: 3304 - protein, 8 aa, Mycobacterium avium
QRDRAEAS

SEQ ID NO: 3305 - protein, 5 aa, Mycobacterium avium
QREGL

SEQ ID NO: 3306 - protein, 5 aa, Mycobacterium avium
QRELD

SEQ ID NO: 3307 - protein, 9 aa, Mycobacterium avium
QRFGPDDYR

SEQ ID NO: 3308 - protein, 4 aa, Mycobacterium avium
QRGA

SEQ ID NO: 3309 - protein, 8 aa, Mycobacterium avium
QRGAADPW

SEQ ID NO: 3310 - protein, 9 aa, Mycobacterium avium
QRGDPGYKA

SEQ ID NO: 3311 - protein, 5 aa, Mycobacterium avium
QRGNY

SEQ ID NO: 3312 - protein, 7 aa, Mycobacterium avium
QRGSVPH

SEQ ID NO: 3313 - protein, 5 aa, Mycobacterium avium
QRGYE

SEQ ID NO: 3314 - protein, 11 aa, Mycobacterium avium
QRKNGTSGKAA

SEQ ID NO: 3315 - protein, 4 aa, Mycobacterium avium
QRLG

SEQ ID NO: 3316 - protein, 8 aa, Mycobacterium avium
QRLGAGDR

SEQ ID NO: 3317 - protein, 5 aa, Mycobacterium avium
QRLTA

SEQ ID NO: 3318 - protein, 10 aa, Mycobacterium avium
QRMGDDREAV

SEQ ID NO: 3319 - protein, 6 aa, Mycobacterium avium
QRPAVA

SEQ ID NO: 3320 - protein, 5 aa, Mycobacterium avium
QRPSV

SEQ ID NO: 3321 - protein, 6 aa, Mycobacterium avium
QRPVIT

SEQ ID NO: 3322 - protein, 21 aa, Mycobacterium avium
QRPVPSPWPKPAAQEREVLAD

SEQ ID NO: 3323 - protein, 11 aa, Mycobacterium avium
QRQPVPVDDET

SEQ ID NO: 3324 - protein, 10 aa, Mycobacterium avium
QRQSRPGADG

SEQ ID NO: 3325 - protein, 19 aa, Mycobacterium avium
QRSTTAAGSDDAAAGPSVD

SEQ ID NO: 3326 - protein, 4 aa, Mycobacterium avium
QRTA

SEQ ID NO: 3327 - protein, 11 aa, Mycobacterium avium
QSARAEISANG

SEQ ID NO: 3328 - protein, 16 aa, Mycobacterium avium
QSASRPDGKVPEQATL

SEQ ID NO: 3329 - protein, 10 aa, Mycobacterium avium
QSASSVQAYN

SEQ ID NO: 3330 - protein, 6 aa, Mycobacterium avium
QSGADS

SEQ ID NO: 3331 - protein, 8 aa, Mycobacterium avium
QSHAGEKG

SEQ ID NO: 3332 - protein, 6 aa, Mycobacterium avium
QSIDGN

SEQ ID NO: 3333 - protein, 8 aa, Mycobacterium avium
QSNADEDK

SEQ ID NO: 3334 - protein, 11 aa, Mycobacterium avium
QSPGRISPDTK

SEQ ID NO: 3335 - protein, 13 aa, Mycobacterium avium
QSPQGMAAESSSA

SEQ ID NO: 3336 - protein, 17 aa, Mycobacterium avium
QSQATAADLTGPAYQNT

SEQ ID NO: 3337 - protein, 24 aa, Mycobacterium avium
QSRGGDGKDVAAPEPSPSLSQGGA

SEQ ID NO: 3338 - protein, 7 aa, Mycobacterium avium
QSSEAGG

SEQ ID NO: 3339 - protein, 6 aa, Mycobacterium avium
QSSLPE

SEQ ID NO: 3340 - protein, 8 aa, Mycobacterium avium
QSSVGGRR

SEQ ID NO: 3341 - protein, 12 aa, Mycobacterium avium
QSTGTGTGDQRV

SEQ ID NO: 3342 - protein, 10 aa, Mycobacterium avium
QSVDPGQLEA

SEQ ID NO: 3343 - protein, 11 aa, Mycobacterium avium
QSWKDSPPRTE

SEQ ID NO: 3344 - protein, 11 aa, Mycobacterium avium
QTAGNNIRDAK

SEQ ID NO: 3345 - protein, 5 aa, Mycobacterium avium
QTARE

SEQ ID NO: 3346 - protein, 7 aa, Mycobacterium avium
QTDPSFD

SEQ ID NO: 3347 - protein, 8 aa, Mycobacterium avium
QTEAKTGA

SEQ ID NO: 3348 - protein, 10 aa, Mycobacterium avium
QTEIDREHQR

SEQ ID NO: 3349 - protein, 5 aa, Mycobacterium avium
QTEPW

SEQ ID NO: 3350 - protein, 16 aa, Mycobacterium avium
QTGDPKQCDTFSAPDL

SEQ ID NO: 3351 - protein, 28 aa, Mycobacterium avium
QTNGDSSGKHGSVSTTPPPEYGPRAEAE

SEQ ID NO: 3352 - protein, 6 aa, Mycobacterium avium
QTPATA

SEQ ID NO: 3353 - protein, 5 aa, Mycobacterium avium
QTPDF

SEQ ID NO: 3354 - protein, 5 aa, Mycobacterium avium
QTPSA

SEQ ID NO: 3355 - protein, 11 aa, Mycobacterium avium
QTQIDTTQRQY

SEQ ID NO: 3356 - protein, 9 aa, Mycobacterium avium
QTRGESGRA

SEQ ID NO: 3357 - protein, 8 aa, Mycobacterium avium
QTSERNQR

SEQ ID NO: 3358 - protein, 6 aa, Mycobacterium avium
QTSTLT

SEQ ID NO: 3359 - protein, 4 aa, Mycobacterium avium
QTTA

SEQ ID NO: 3360 - protein, 6 aa, Mycobacterium avium
QVDGAG

SEQ ID NO: 3361 - protein, 6 aa, Mycobacterium avium
QVGGSI

SEQ ID NO: 3362 - protein, 8 aa, Mycobacterium avium
QVKSGDAI

SEQ ID NO: 3363 - protein, 6 aa, Mycobacterium avium
QVRSTR

SEQ ID NO: 3364 - protein, 7 aa, Mycobacterium avium
QVSASSV

SEQ ID NO: 3365 - protein, 15 aa, Mycobacterium avium
QVSRQVADGVGPARV

SEQ ID NO: 3366 - protein, 11 aa, Mycobacterium avium
QVTDKGVTSHF

SEQ ID NO: 3367 - protein, 13 aa, Mycobacterium avium
QYPAGKSPAQVAT

SEQ ID NO: 3368 - protein, 5 aa, Mycobacterium avium
RAAAA

SEQ ID NO: 3369 - protein, 6 aa, Mycobacterium avium
RAAAKR

SEQ ID NO: 3370 - protein, 5 aa, Mycobacterium avium
RAAAV

SEQ ID NO: 3371 - protein, 13 aa, Mycobacterium avium
RAAGITSDSITTA

SEQ ID NO: 3372 - protein, 10 aa, Mycobacterium avium
RAAQRGETGV

SEQ ID NO: 3373 - protein, 13 aa, Mycobacterium avium
RAATVGTQKAGQP

SEQ ID NO: 3374 - protein, 11 aa, Mycobacterium avium
RADEENGRTEL

SEQ ID NO: 3375 - protein, 6 aa, Mycobacterium avium
RADGTA

SEQ ID NO: 3376 - protein, 5 aa, Mycobacterium avium
RADNP

SEQ ID NO: 3377 - protein, 13 aa, Mycobacterium avium
RADRELESQTEAF

SEQ ID NO: 3378 - protein, 5 aa, Mycobacterium avium
RADRG

SEQ ID NO: 3379 - protein, 4 aa, Mycobacterium avium
RAEH

SEQ ID NO: 3380 - protein, 14 aa, Mycobacterium avium
RAENALTGEDESAI

SEQ ID NO: 3381 - protein, 10 aa, Mycobacterium avium
RAENKITDTW

SEQ ID NO: 3382 - protein, 13 aa, Mycobacterium avium
RAESLEGTTGAGQ

SEQ ID NO: 3383 - protein, 8 aa, Mycobacterium avium
RAGAAPQP

SEQ ID NO: 3384 - protein, 5 aa, Mycobacterium avium
RAGGS

SEQ ID NO: 3385 - protein, 15 aa, Mycobacterium avium
RAGGSTTPAAETEAR

SEQ ID NO: 3386 - protein, 11 aa, Mycobacterium avium
RAGPRAEPRTA

SEQ ID NO: 3387 - protein, 8 aa, Mycobacterium avium
RAGRDDKV

SEQ ID NO: 3388 - protein, 6 aa, Mycobacterium avium
RAGRPH

SEQ ID NO: 3389 - protein, 19 aa, Mycobacterium avium
RAHGPADKDVTRLDDVQVR

SEQ ID NO: 3390 - protein, 8 aa, Mycobacterium avium
RAHSNPST

SEQ ID NO: 3391 - protein, 9 aa, Mycobacterium avium
RALTRGKRW

SEQ ID NO: 3392 - protein, 19 aa, Mycobacterium avium
RAPAGKLGAPVGDQAVDGD

SEQ ID NO: 3393 - protein, 9 aa, Mycobacterium avium
RAPHSSEIR

SEQ ID NO: 3394 - protein, 25 aa, Mycobacterium avium
RAPKPGPPADRFTRPPRRHHPGPAG

SEQ ID NO: 3395 - protein, 9 aa, Mycobacterium avium
RAQPNRRSV

SEQ ID NO: 3396 - protein, 14 aa, Mycobacterium avium
RAQSGGKWPPPPTE

SEQ ID NO: 3397 - protein, 7 aa, Mycobacterium avium
RARERDS

SEQ ID NO: 3398 - protein, 6 aa, Mycobacterium avium
RASGPV

SEQ ID NO: 3399 - protein, 12 aa, Mycobacterium avium
RATAPISEEIGS

SEQ ID NO: 3400 - protein, 20 aa, Mycobacterium avium
RATEGSAAKLAQRRNELSAK

SEQ ID NO: 3401 - protein, 16 aa, Mycobacterium avium
RATGGVDAQQRRALPG

SEQ ID NO: 3402 - protein, 6 aa, Mycobacterium avium
RATRPD

SEQ ID NO: 3403 - protein, 23 aa, Mycobacterium avium
RATVSRPAAVPAPNPSPARQVPA

SEQ ID NO: 3404 - protein, 8 aa, Mycobacterium avium
RCADPTDA

SEQ ID NO: 3405 - protein, 11 aa, Mycobacterium avium
RCDPGNPPAAV

SEQ ID NO: 3406 - protein, 7 aa, Mycobacterium avium
RCDQPVK

SEQ ID NO: 3407 - protein, 7 aa, Mycobacterium avium
RDAETAP

SEQ ID NO: 3408 - protein, 9 aa, Mycobacterium avium
RDAPGAQAQ

SEQ ID NO: 3409 - protein, 7 aa, Mycobacterium avium
RDAPRPA

SEQ ID NO: 3410 - protein, 6 aa, Mycobacterium avium
RDDAGQ

SEQ ID NO: 3411 - protein, 8 aa, Mycobacterium avium
RDDARAEL

SEQ ID NO: 3412 - protein, 9 aa, Mycobacterium avium
RDDHATPAE

SEQ ID NO: 3413 - protein, 17 aa, Mycobacterium avium
RDEHDDATPDVVPAGTG

SEQ ID NO: 3414 - protein, 5 aa, Mycobacterium avium
RDENN

SEQ ID NO: 3415 - protein, 5 aa, Mycobacterium avium
RDERA

SEQ ID NO: 3416 - protein, 7 aa, Mycobacterium avium
RDESPHS

SEQ ID NO: 3417 - protein, 11 aa, Mycobacterium avium
RDGKATTLGAA

SEQ ID NO: 3418 - protein, 4 aa, Mycobacterium avium
RDGR

SEQ ID NO: 3419 - protein, 10 aa, Mycobacterium avium
RDGRPTTFGA

SEQ ID NO: 3420 - protein, 5 aa, Mycobacterium avium
RDGST

SEQ ID NO: 3421 - protein, 8 aa, Mycobacterium avium
RDKRDEVE

SEQ ID NO: 3422 - protein, 16 aa, Mycobacterium avium
RDPAALPTQRGSDNGD

SEQ ID NO: 3423 - protein, 7 aa, Mycobacterium avium
RDPAPVT

SEQ ID NO: 3424 - protein, 6 aa, Mycobacterium avium
RDPRKP

SEQ ID NO: 3425 - protein, 7 aa, Mycobacterium avium
RDQETGL

SEQ ID NO: 3426 - protein, 6 aa, Mycobacterium avium
RDQGPV

SEQ ID NO: 3427 - protein, 5 aa, Mycobacterium avium
RDRDP

SEQ ID NO: 3428 - protein, 10 aa, Mycobacterium avium
RDSSADEDES

SEQ ID NO: 3429 - protein, 8 aa, Mycobacterium avium
RDTGLQPA

SEQ ID NO: 3430 - protein, 4 aa, Mycobacterium avium
RDTP

SEQ ID NO: 3431 - protein, 11 aa, Mycobacterium avium
RDTSAPAGPEL

SEQ ID NO: 3432 - protein, 12 aa, Mycobacterium avium
RDVEADREHPTK

SEQ ID NO: 3433 - protein, 5 aa, Mycobacterium avium
RDVTP

SEQ ID NO: 3434 - protein, 11 aa, Mycobacterium avium
REAGDRTVRTR

SEQ ID NO: 3435 - protein, 34 aa, Mycobacterium avium
REAPPSAVPPGVLPPTSTTGHPHKPRPASQDASC

SEQ ID NO: 3436 - protein, 7 aa, Mycobacterium avium
RECGRTT

SEQ ID NO: 3437 - protein, 6 aa, Mycobacterium avium
REDPTR

SEQ ID NO: 3438 - protein, 5 aa, Mycobacterium avium
REELA

SEQ ID NO: 3439 - protein, 20 aa, Mycobacterium avium
REERSTALQQRRQAKTERSI

SEQ ID NO: 3440 - protein, 5 aa, Mycobacterium avium
REGDD

SEQ ID NO: 3441 - protein, 10 aa, Mycobacterium avium
REGEETIAQK

SEQ ID NO: 3442 - protein, 4 aa, Mycobacterium avium
REGY

SEQ ID NO: 3443 - protein, 12 aa, Mycobacterium avium
REPGEPTGESAQ

SEQ ID NO: 3444 - protein, 5 aa, Mycobacterium avium
REPGF

SEQ ID NO: 3445 - protein, 6 aa, Mycobacterium avium
REPKRQ

SEQ ID NO: 3446 - protein, 14 aa, Mycobacterium avium
REPQLASPDRPQAP

SEQ ID NO: 3447 - protein, 7 aa, Mycobacterium avium
REQAGGK

SEQ ID NO: 3448 - protein, 9 aa, Mycobacterium avium
REQASAASE

SEQ ID NO: 3449 - protein, 13 aa, Mycobacterium avium
REQNSNTDAQAEI

SEQ ID NO: 3450 - protein, 8 aa, Mycobacterium avium
RERASGTL

SEQ ID NO: 3451 - protein, 4 aa, Mycobacterium avium
RERE

SEQ ID NO: 3452 - protein, 11 aa, Mycobacterium avium
RESSKGAHADR

SEQ ID NO: 3453 - protein, 8 aa, Mycobacterium avium
RETAEANA

SEQ ID NO: 3454 - protein, 6 aa, Mycobacterium avium
RETARF

SEQ ID NO: 3455 - protein, 17 aa, Mycobacterium avium
RETEEAAASLGASGPKI

SEQ ID NO: 3456 - protein, 9 aa, Mycobacterium avium
RETGRPRDQ

SEQ ID NO: 3457 - protein, 7 aa, Mycobacterium avium
RETQDRW

SEQ ID NO: 3458 - protein, 5 aa, Mycobacterium avium
RFEQP

SEQ ID NO: 3459 - protein, 18 aa, Mycobacterium avium
RFGPGSDGLGGTDANDPF

SEQ ID NO: 3460 - protein, 6 aa, Mycobacterium avium
RFSPRQ

SEQ ID NO: 3461 - protein, 6 aa, Mycobacterium avium
RGAAPE

SEQ ID NO: 3462 - protein, 9 aa, Mycobacterium avium
RGADTNNAL

SEQ ID NO: 3463 - protein, 11 aa, Mycobacterium avium
RGAEGADPASV

SEQ ID NO: 3464 - protein, 9 aa, Mycobacterium avium
RGAGTLADN

SEQ ID NO: 3465 - protein, 9 aa, Mycobacterium avium
RGAPNGLDE

SEQ ID NO: 3466 - protein, 13 aa, Mycobacterium avium
RGARKPHKSTVQK

SEQ ID NO: 3467 - protein, 6 aa, Mycobacterium avium
RGARRS

SEQ ID NO: 3468 - protein, 8 aa, Mycobacterium avium
RGATPNAG

SEQ ID NO: 3469 - protein, 8 aa, Mycobacterium avium
RGAYGPKV

SEQ ID NO: 3470 - protein, 7 aa, Mycobacterium avium
RGDAGLS

SEQ ID NO: 3471 - protein, 21 aa, Mycobacterium avium
RGDDAPTGEIPAAGAQTEAHT

SEQ ID NO: 3472 - protein, 11 aa, Mycobacterium avium
RGDEEKRKQSF

SEQ ID NO: 3473 - protein, 11 aa, Mycobacterium avium
RGDPATPEGLS

SEQ ID NO: 3474 - protein, 13 aa, Mycobacterium avium
RGDQGGAVGDKSV

SEQ ID NO: 3475 - protein, 8 aa, Mycobacterium avium
RGDSDPRV

SEQ ID NO: 3476 - protein, 15 aa, Mycobacterium avium
RGDSSRSRKGGSTGL

SEQ ID NO: 3477 - protein, 16 aa, Mycobacterium avium
RGDTPPAPKVPPDAPP

SEQ ID NO: 3478 - protein, 6 aa, Mycobacterium avium
RGEAPA

SEQ ID NO: 3479 - protein, 12 aa, Mycobacterium avium
RGEARAAGEAPV

SEQ ID NO: 3480 - protein, 4 aa, Mycobacterium avium
RGEF

SEQ ID NO: 3481 - protein, 24 aa, Mycobacterium avium
RGELQASEELREAAETLSKSPASL

SEQ ID NO: 3482 - protein, 19 aa, Mycobacterium avium
RGEQQPAPGGAVGIAKGGA

SEQ ID NO: 3483 - protein, 9 aa, Mycobacterium avium
RGEVEPADD

SEQ ID NO: 3484 - protein, 16 aa, Mycobacterium avium
RGGARRSVVAPVVGGA

SEQ ID NO: 3485 - protein, 7 aa, Mycobacterium avium
RGGDGTR

SEQ ID NO: 3486 - protein, 8 aa, Mycobacterium avium
RGGGPDNV

SEQ ID NO: 3487 - protein, 9 aa, Mycobacterium avium
RGGNQRNGI

SEQ ID NO: 3488 - protein, 7 aa, Mycobacterium avium
RGGREAP

SEQ ID NO: 3489 - protein, 11 aa, Mycobacterium avium
RGGSKGLGTAV

SEQ ID NO: 3490 - protein, 5 aa, Mycobacterium avium
RGIGN

SEQ ID NO: 3491 - protein, 7 aa, Mycobacterium avium
RGKRRRA

SEQ ID NO: 3492 - protein, 9 aa, Mycobacterium avium
RGLAQTAPD

SEQ ID NO: 3493 - protein, 8 aa, Mycobacterium avium
RGLGETRE

SEQ ID NO: 3494 - protein, 9 aa, Mycobacterium avium
RGLQSTAPD

SEQ ID NO: 3495 - protein, 9 aa, Mycobacterium avium
RGLTPASDY

SEQ ID NO: 3496 - protein, 4 aa, Mycobacterium avium
RGMQ

SEQ ID NO: 3497 - protein, 14 aa, Mycobacterium avium
RGPAANESGSGTTA

SEQ ID NO: 3498 - protein, 5 aa, Mycobacterium avium
RGPGG

SEQ ID NO: 3499 - protein, 5 aa, Mycobacterium avium
RGPHG

SEQ ID NO: 3500 - protein, 7 aa, Mycobacterium avium
RGPMPPY

SEQ ID NO: 3501 - protein, 14 aa, Mycobacterium avium
RGQGEGADKVLPPG

SEQ ID NO: 3502 - protein, 6 aa, Mycobacterium avium
RGQIGS

SEQ ID NO: 3503 - protein, 6 aa, Mycobacterium avium
RGRHGR

SEQ ID NO: 3504 - protein, 9 aa, Mycobacterium avium
RGRPAETGL

SEQ ID NO: 3505 - protein, 14 aa, Mycobacterium avium
RGRRGDFAGRRGKA

SEQ ID NO: 3506 - protein, 7 aa, Mycobacterium avium
RGRTPRQ

SEQ ID NO: 3507 - protein, 5 aa, Mycobacterium avium
RGSAV

SEQ ID NO: 3508 - protein, 6 aa, Mycobacterium avium
RGSGSI

SEQ ID NO: 3509 - protein, 8 aa, Mycobacterium avium
RGTERTEH

SEQ ID NO: 3510 - protein, 5 aa, Mycobacterium avium
RGTGG

SEQ ID NO: 3511 - protein, 7 aa, Mycobacterium avium
RGTRDFS

SEQ ID NO: 3512 - protein, 4 aa, Mycobacterium avium
RGTT

SEQ ID NO: 3513 - protein, 14 aa, Mycobacterium avium
RGVGASSAPKPVSA

SEQ ID NO: 3514 - protein, 26 aa, Mycobacterium avium
RGWAQAPRRQSSSAYEGPDPGRPPSK

SEQ ID NO: 3515 - protein, 4 aa, Mycobacterium avium
RGWP

SEQ ID NO: 3516 - protein, 17 aa, Mycobacterium avium
RGYPDDDADDACDTDPY

SEQ ID NO: 3517 - protein, 5 aa, Mycobacterium avium
RHARG

SEQ ID NO: 3518 - protein, 18 aa, Mycobacterium avium
RHATRTATVSAKSLRPGD

SEQ ID NO: 3519 - protein, 4 aa, Mycobacterium avium
RHDD

SEQ ID NO: 3520 - protein, 8 aa, Mycobacterium avium
RHGDGSAW

SEQ ID NO: 3521 - protein, 8 aa, Mycobacterium avium
RHGDTGDR

SEQ ID NO: 3522 - protein, 6 aa, Mycobacterium avium
RHPGES

SEQ ID NO: 3523 - protein, 9 aa, Mycobacterium avium
RHPPPRSGR

SEQ ID NO: 3524 - protein, 13 aa, Mycobacterium avium
RHQGSAGRPPLTT

SEQ ID NO: 3525 - protein, 8 aa, Mycobacterium avium
RHQPAAPR

SEQ ID NO: 3526 - protein, 14 aa, Mycobacterium avium
RHRDDEPSPEPATI

SEQ ID NO: 3527 - protein, 11 aa, Mycobacterium avium
RHTNVSQEDQV

SEQ ID NO: 3528 - protein, 6 aa, Mycobacterium avium
RHTRSV

SEQ ID NO: 3529 - protein, 9 aa, Mycobacterium avium
RIARPGRSM

SEQ ID NO: 3530 - protein, 8 aa, Mycobacterium avium
RIASKSSA

SEQ ID NO: 3531 - protein, 6 aa, Mycobacterium avium
RIGPTS

SEQ ID NO: 3532 - protein, 10 aa, Mycobacterium avium
RKAAATPEQA

SEQ ID NO: 3533 - protein, 4 aa, Mycobacterium avium
RKEG

SEQ ID NO: 3534 - protein, 20 aa, Mycobacterium avium
RKEHAEEPEIVEPQAVSLGE

SEQ ID NO: 3535 - protein, 9 aa, Mycobacterium avium
RKGEPMSQE

SEQ ID NO: 3536 - protein, 4 aa, Mycobacterium avium
RKGF

SEQ ID NO: 3537 - protein, 8 aa, Mycobacterium avium
RKGRGTPT

SEQ ID NO: 3538 - protein, 5 aa, Mycobacterium avium
RKGRN

SEQ ID NO: 3539 - protein, 4 aa, Mycobacterium avium
RKGY

SEQ ID NO: 3540 - protein, 8 aa, Mycobacterium avium
RKPDGKDL

SEQ ID NO: 3541 - protein, 9 aa, Mycobacterium avium
RKQTAASSN

SEQ ID NO: 3542 - protein, 13 aa, Mycobacterium avium
RKSASVDDANLLK

SEQ ID NO: 3543 - protein, 5 aa, Mycobacterium avium
RKTAE

SEQ ID NO: 3544 - protein, 32 aa, Mycobacterium avium
RKTATAVSDDTHTGGAVQKPRTINDENPPTAI

SEQ ID NO: 3545 - protein, 6 aa, Mycobacterium avium
RKVADA

SEQ ID NO: 3546 - protein, 20 aa, Mycobacterium avium
RLAGATAQKTITESHSLASS

SEQ ID NO: 3547 - protein, 13 aa, Mycobacterium avium
RLAGSGGDDQPDL

SEQ ID NO: 3548 - protein, 12 aa, Mycobacterium avium
RLATGTANQPTW

SEQ ID NO: 3549 - protein, 6 aa, Mycobacterium avium
RLDPTD

SEQ ID NO: 3550 - protein, 9 aa, Mycobacterium avium
RLERGRTAD

SEQ ID NO: 3551 - protein, 9 aa, Mycobacterium avium
RLGGAGDPR

SEQ ID NO: 3552 - protein, 8 aa, Mycobacterium avium
RLGQEDRE

SEQ ID NO: 3553 - protein, 8 aa, Mycobacterium avium
RLKGESKM

SEQ ID NO: 3554 - protein, 5 aa, Mycobacterium avium
RLPGR

SEQ ID NO: 3555 - protein, 6 aa, Mycobacterium avium
RLPRGR

SEQ ID NO: 3556 - protein, 4 aa, Mycobacterium avium
RLPS

SEQ ID NO: 3557 - protein, 9 aa, Mycobacterium avium
RLSASAADV

SEQ ID NO: 3558 - protein, 11 aa, Mycobacterium avium
RLSGGQRKRAS

SEQ ID NO: 3559 - protein, 4 aa, Mycobacterium avium
RLSP

SEQ ID NO: 3560 - protein, 9 aa, Mycobacterium avium
RMESTDSVG

SEQ ID NO: 3561 - protein, 7 aa, Mycobacterium avium
RMSRGDL

SEQ ID NO: 3562 - protein, 10 aa, Mycobacterium avium
RNAESDPPLT

SEQ ID NO: 3563 - protein, 6 aa, Mycobacterium avium
RNDTKH

SEQ ID NO: 3564 - protein, 9 aa, Mycobacterium avium
RNEDNPERL

SEQ ID NO: 3565 - protein, 22 aa, Mycobacterium avium
RNGADREYDYETSTETKNYTYT

SEQ ID NO: 3566 - protein, 9 aa, Mycobacterium avium
RNGIGNSTL

SEQ ID NO: 3567 - protein, 15 aa, Mycobacterium avium
RNGITVKDSDGTVRR

SEQ ID NO: 3568 - protein, 15 aa, Mycobacterium avium
RNGSDADGEDGRPAP

SEQ ID NO: 3569 - protein, 6 aa, Mycobacterium avium
RNPGSP

SEQ ID NO: 3570 - protein, 5 aa, Mycobacterium avium
RNPLP

SEQ ID NO: 3571 - protein, 18 aa, Mycobacterium avium
RNPPPRRPGHDDERADTD

SEQ ID NO: 3572 - protein, 11 aa, Mycobacterium avium
RNTARATSPHS

SEQ ID NO: 3573 - protein, 5 aa, Mycobacterium avium
RNYGA

SEQ ID NO: 3574 - protein, 7 aa, Mycobacterium avium
RPAAEQV

SEQ ID NO: 3575 - protein, 13 aa, Mycobacterium avium
RPARAGATLGLPS

SEQ ID NO: 3576 - protein, 4 aa, Mycobacterium avium
RPAT

SEQ ID NO: 3577 - protein, 8 aa, Mycobacterium avium
RPATESGA

SEQ ID NO: 3578 - protein, 5 aa, Mycobacterium avium
RPDAY

SEQ ID NO: 3579 - protein, 8 aa, Mycobacterium avium
RPDGSTVP

SEQ ID NO: 3580 - protein, 10 aa, Mycobacterium avium
RPDKPAPATV

SEQ ID NO: 3581 - protein, 4 aa, Mycobacterium avium
RPDL

SEQ ID NO: 3582 - protein, 5 aa, Mycobacterium avium
RPDLE

SEQ ID NO: 3583 - protein, 8 aa, Mycobacterium avium
RPDNPQTL

SEQ ID NO: 3584 - protein, 7 aa, Mycobacterium avium
RPDPGAL

SEQ ID NO: 3585 - protein, 6 aa, Mycobacterium avium
RPDQGV

SEQ ID NO: 3586 - protein, 8 aa, Mycobacterium avium
RPDSWSSA

SEQ ID NO: 3587 - protein, 9 aa, Mycobacterium avium
RPDTGPAPA

SEQ ID NO: 3588 - protein, 6 aa, Mycobacterium avium
RPERNR

SEQ ID NO: 3589 - protein, 9 aa, Mycobacterium avium
RPGADGRLQ

SEQ ID NO: 3590 - protein, 20 aa, Mycobacterium avium
RPGATEPSDPTLLAKIHASS

SEQ ID NO: 3591 - protein, 16 aa, Mycobacterium avium
RPGESPEPTPGRPASA

SEQ ID NO: 3592 - protein, 4 aa, Mycobacterium avium
RPGG

SEQ ID NO: 3593 - protein, 8 aa, Mycobacterium avium
RPGKPTAD

SEQ ID NO: 3594 - protein, 6 aa, Mycobacterium avium
RPGPDW

SEQ ID NO: 3595 - protein, 17 aa, Mycobacterium avium
RPKQPARPAGRPDPLAA

SEQ ID NO: 3596 - protein, 11 aa, Mycobacterium avium
RPLGPPIQDGS

SEQ ID NO: 3597 - protein, 7 aa, Mycobacterium avium
RPLGTPI

SEQ ID NO: 3598 - protein, 9 aa, Mycobacterium avium
RPPAGAPTR

SEQ ID NO: 3599 - protein, 6 aa, Mycobacterium avium
RPPPHG

SEQ ID NO: 3600 - protein, 6 aa, Mycobacterium avium
RPQRIP

SEQ ID NO: 3601 - protein, 4 aa, Mycobacterium avium
RPRE

SEQ ID NO: 3602 - protein, 12 aa, Mycobacterium avium
RPRRHPTQPAGL

SEQ ID NO: 3603 - protein, 8 aa, Mycobacterium avium
RPRRPAQT

SEQ ID NO: 3604 - protein, 8 aa, Mycobacterium avium
RPRRPRPA

SEQ ID NO: 3605 - protein, 10 aa, Mycobacterium avium
RPRTNSPPYL

SEQ ID NO: 3606 - protein, 16 aa, Mycobacterium avium
RPSFGGNVGPVGSQYE

SEQ ID NO: 3607 - protein, 5 aa, Mycobacterium avium
RPSLG

SEQ ID NO: 3608 - protein, 5 aa, Mycobacterium avium
RPTFS

SEQ ID NO: 3609 - protein, 12 aa, Mycobacterium avium
RPTGAGTAKTPG

SEQ ID NO: 3610 - protein, 17 aa, Mycobacterium avium
RPTGPRPLVRSLLLKQP

SEQ ID NO: 3611 - protein, 8 aa, Mycobacterium avium
RPTSTLNS

SEQ ID NO: 3612 - protein, 14 aa, Mycobacterium avium
RPWPARDRPRRAGV

SEQ ID NO: 3613 - protein, 5 aa, Mycobacterium avium
RQAET

SEQ ID NO: 3614 - protein, 24 aa, Mycobacterium avium
RQAPADGGYGFEEEDPDAVDTDSI

SEQ ID NO: 3615 - protein, 6 aa, Mycobacterium avium
RQEAPT

SEQ ID NO: 3616 - protein, 4 aa, Mycobacterium avium
RQED

SEQ ID NO: 3617 - protein, 13 aa, Mycobacterium avium
RQGEDIDTRYHPS

SEQ ID NO: 3618 - protein, 5 aa, Mycobacterium avium
RQGPK

SEQ ID NO: 3619 - protein, 7 aa, Mycobacterium avium
RQGQESF

SEQ ID NO: 3620 - protein, 5 aa, Mycobacterium avium
RQGRE

SEQ ID NO: 3621 - protein, 11 aa, Mycobacterium avium
RQGTTGSSVGK

SEQ ID NO: 3622 - protein, 5 aa, Mycobacterium avium
RQHGC

SEQ ID NO: 3623 - protein, 5 aa, Mycobacterium avium
RQMAT

SEQ ID NO: 3624 - protein, 5 aa, Mycobacterium avium
RQPGV

SEQ ID NO: 3625 - protein, 12 aa, Mycobacterium avium
RQPKPHQYAQPV

SEQ ID NO: 3626 - protein, 11 aa, Mycobacterium avium
RQPLPEDDEAA

SEQ ID NO: 3627 - protein, 15 aa, Mycobacterium avium
RQPTPIGEEIGGTRR

SEQ ID NO: 3628 - protein, 13 aa, Mycobacterium avium
RQPTSGTVHRPGA

SEQ ID NO: 3629 - protein, 10 aa, Mycobacterium avium
RQQEATGGTV

SEQ ID NO: 3630 - protein, 10 aa, Mycobacterium avium
RQREGTLSAE

SEQ ID NO: 3631 - protein, 5 aa, Mycobacterium avium
RQRGE

SEQ ID NO: 3632 - protein, 5 aa, Mycobacterium avium
RQRRA

SEQ ID NO: 3633 - protein, 13 aa, Mycobacterium avium
RQRRHEQARETVP

SEQ ID NO: 3634 - protein, 8 aa, Mycobacterium avium
RQSDSEAE

SEQ ID NO: 3635 - protein, 14 aa, Mycobacterium avium
RQTESGDSLETARP

SEQ ID NO: 3636 - protein, 20 aa, Mycobacterium avium
RRAATPPDAAGADTVTPTNT

SEQ ID NO: 3637 - protein, 6 aa, Mycobacterium avium
RRAEDM

SEQ ID NO: 3638 - protein, 9 aa, Mycobacterium avium
RRAGRDSAR

SEQ ID NO: 3639 - protein, 6 aa, Mycobacterium avium
RRASGG

SEQ ID NO: 3640 - protein, 8 aa, Mycobacterium avium
RRDSEPLR

SEQ ID NO: 3641 - protein, 4 aa, Mycobacterium avium
RRDT

SEQ ID NO: 3642 - protein, 5 aa, Mycobacterium avium
RRDYA

SEQ ID NO: 3643 - protein, 4 aa, Mycobacterium avium
RRFG

SEQ ID NO: 3644 - protein, 7 aa, Mycobacterium avium
RRGDDTR

SEQ ID NO: 3645 - protein, 13 aa, Mycobacterium avium
RRGDSDEDARRKL

SEQ ID NO: 3646 - protein, 12 aa, Mycobacterium avium
RRGGPDARSAEL

SEQ ID NO: 3647 - protein, 7 aa, Mycobacterium avium
RRGRGDE

SEQ ID NO: 3648 - protein, 7 aa, Mycobacterium avium
RRGRSLG

SEQ ID NO: 3649 - protein, 8 aa, Mycobacterium avium
RRGSRPRA

SEQ ID NO: 3650 - protein, 5 aa, Mycobacterium avium
RRGTQ

SEQ ID NO: 3651 - protein, 5 aa, Mycobacterium avium
RRISR

SEQ ID NO: 3652 - protein, 7 aa, Mycobacterium avium
RRLAEGK

SEQ ID NO: 3653 - protein, 6 aa, Mycobacterium avium
RRLSGG

SEQ ID NO: 3654 - protein, 7 aa, Mycobacterium avium
RRNARSR

SEQ ID NO: 3655 - protein, 7 aa, Mycobacterium avium
RRNPRTG

SEQ ID NO: 3656 - protein, 4 aa, Mycobacterium avium
RRNS

SEQ ID NO: 3657 - protein, 5 aa, Mycobacterium avium
RRPAS

SEQ ID NO: 3658 - protein, 11 aa, Mycobacterium avium
RRPGPEATGYG

SEQ ID NO: 3659 - protein, 6 aa, Mycobacterium avium
RRPGPL

SEQ ID NO: 3660 - protein, 6 aa, Mycobacterium avium
RRPGQV

SEQ ID NO: 3661 - protein, 11 aa, Mycobacterium avium
RRPLPEDEDQA

SEQ ID NO: 3662 - protein, 6 aa, Mycobacterium avium
RRPLPP

SEQ ID NO: 3663 - protein, 6 aa, Mycobacterium avium
RRPPAE

SEQ ID NO: 3664 - protein, 16 aa, Mycobacterium avium
RRPVPRGQVEDPDDPD

SEQ ID NO: 3665 - protein, 6 aa, Mycobacterium avium
RRQQAG

SEQ ID NO: 3666 - protein, 8 aa, Mycobacterium avium
RRRCTRAT

SEQ ID NO: 3667 - protein, 6 aa, Mycobacterium avium
RRRETG

SEQ ID NO: 3668 - protein, 4 aa, Mycobacterium avium
RRRI

SEQ ID NO: 3669 - protein, 4 aa, Mycobacterium avium
RRRP

SEQ ID NO: 3670 - protein, 8 aa, Mycobacterium avium
RRRPELSD

SEQ ID NO: 3671 - protein, 5 aa, Mycobacterium avium
RRRPS

SEQ ID NO: 3672 - protein, 5 aa, Mycobacterium avium
RRRRA

SEQ ID NO: 3673 - protein, 28 aa, Mycobacterium avium
RRRRAARGVGPGGPQDRSLGEALSTAEA

SEQ ID NO: 3674 - protein, 7 aa, Mycobacterium avium
RRSRRNT

SEQ ID NO: 3675 - protein, 5 aa, Mycobacterium avium
RRTGE

SEQ ID NO: 3676 - protein, 6 aa, Mycobacterium avium
RRTRAG

SEQ ID NO: 3677 - protein, 13 aa, Mycobacterium avium
RRVGGGLTICDAR

SEQ ID NO: 3678 - protein, 12 aa, Mycobacterium avium
RRVPERDPRTEV

SEQ ID NO: 3679 - protein, 11 aa, Mycobacterium avium
RSAASGAALAG

SEQ ID NO: 3680 - protein, 5 aa, Mycobacterium avium
RSAAT

SEQ ID NO: 3681 - protein, 11 aa, Mycobacterium avium
RSAQEVTDKPV

SEQ ID NO: 3682 - protein, 4 aa, Mycobacterium avium
RSAV

SEQ ID NO: 3683 - protein, 14 aa, Mycobacterium avium
RSDGGPPVLEGPAS

SEQ ID NO: 3684 - protein, 5 aa, Mycobacterium avium
RSDKR

SEQ ID NO: 3685 - protein, 10 aa, Mycobacterium avium
RSEASKHRQA

SEQ ID NO: 3686 - protein, 5 aa, Mycobacterium avium
RSERV

SEQ ID NO: 3687 - protein, 6 aa, Mycobacterium avium
RSEWPQ

SEQ ID NO: 3688 - protein, 5 aa, Mycobacterium avium
RSGER

SEQ ID NO: 3689 - protein, 10 aa, Mycobacterium avium
RSGRQPREAV

SEQ ID NO: 3690 - protein, 8 aa, Mycobacterium avium
RSGTTVQE

SEQ ID NO: 3691 - protein, 8 aa, Mycobacterium avium
RSGYRDLR

SEQ ID NO: 3692 - protein, 8 aa, Mycobacterium avium
RSKSRVGA

SEQ ID NO: 3693 - protein, 7 aa, Mycobacterium avium
RSLSGAE

SEQ ID NO: 3694 - protein, 6 aa, Mycobacterium avium
RSPDGE

SEQ ID NO: 3695 - protein, 7 aa, Mycobacterium avium
RSPPGVE

SEQ ID NO: 3696 - protein, 8 aa, Mycobacterium avium
RSPRPPQA

SEQ ID NO: 3697 - protein, 9 aa, Mycobacterium avium
RSPSSPNGT

SEQ ID NO: 3698 - protein, 7 aa, Mycobacterium avium
RSPVETT

SEQ ID NO: 3699 - protein, 4 aa, Mycobacterium avium
RSRA

SEQ ID NO: 3700 - protein, 5 aa, Mycobacterium avium
RSREM

SEQ ID NO: 3701 - protein, 14 aa, Mycobacterium avium
RSREYQADESGAVL

SEQ ID NO: 3702 - protein, 6 aa, Mycobacterium avium
RSRNTV

SEQ ID NO: 3703 - protein, 7 aa, Mycobacterium avium
RSRRNRT

SEQ ID NO: 3704 - protein, 5 aa, Mycobacterium avium
RSRSL

SEQ ID NO: 3705 - protein, 9 aa, Mycobacterium avium
RSSGGLSDS

SEQ ID NO: 3706 - protein, 6 aa, Mycobacterium avium
RSTNDV

SEQ ID NO: 3707 - protein, 6 aa, Mycobacterium avium
RSTPNR

SEQ ID NO: 3708 - protein, 15 aa, Mycobacterium avium
RSTVEANARTGGRRD

SEQ ID NO: 3709 - protein, 8 aa, Mycobacterium avium
RTAATRGW

SEQ ID NO: 3710 - protein, 7 aa, Mycobacterium avium
RTADKVA

SEQ ID NO: 3711 - protein, 13 aa, Mycobacterium avium
RTAGAAQAAGVPN

SEQ ID NO: 3712 - protein, 6 aa, Mycobacterium avium
RTAGDQ

SEQ ID NO: 3713 - protein, 10 aa, Mycobacterium avium
RTARGGAARA

SEQ ID NO: 3714 - protein, 6 aa, Mycobacterium avium
RTELAD

SEQ ID NO: 3715 - protein, 12 aa, Mycobacterium avium
RTEPEPGGEPGK

SEQ ID NO: 3716 - protein, 6 aa, Mycobacterium avium
RTEPIS

SEQ ID NO: 3717 - protein, 4 aa, Mycobacterium avium
RTFA

SEQ ID NO: 3718 - protein, 8 aa, Mycobacterium avium
RTGATNGY

SEQ ID NO: 3719 - protein, 8 aa, Mycobacterium avium
RTGELGRD

SEQ ID NO: 3720 - protein, 9 aa, Mycobacterium avium
RTGSGARLT

SEQ ID NO: 3721 - protein, 12 aa, Mycobacterium avium
RTLTKDAVTSPL

SEQ ID NO: 3722 - protein, 8 aa, Mycobacterium avium
RTNGYSAE

SEQ ID NO: 3723 - protein, 7 aa, Mycobacterium avium
RTNPAAL

SEQ ID NO: 3724 - protein, 7 aa, Mycobacterium avium
RTNSSYE

SEQ ID NO: 3725 - protein, 7 aa, Mycobacterium avium
RTPADRD

SEQ ID NO: 3726 - protein, 6 aa, Mycobacterium avium
RTPDCA

SEQ ID NO: 3727 - protein, 7 aa, Mycobacterium avium
RTPGELS

SEQ ID NO: 3728 - protein, 7 aa, Mycobacterium avium
RTPGPLD

SEQ ID NO: 3729 - protein, 8 aa, Mycobacterium avium
RTPQPATV

SEQ ID NO: 3730 - protein, 4 aa, Mycobacterium avium
RTPW

SEQ ID NO: 3731 - protein, 5 aa, Mycobacterium avium
RTQSR

SEQ ID NO: 3732 - protein, 10 aa, Mycobacterium avium
RTQTKSDSKV

SEQ ID NO: 3733 - protein, 6 aa, Mycobacterium avium
RTRRAA

SEQ ID NO: 3734 - protein, 6 aa, Mycobacterium avium
RTRRGG

SEQ ID NO: 3735 - protein, 13 aa, Mycobacterium avium
RTSPGATDRGSDA

SEQ ID NO: 3736 - protein, 4 aa, Mycobacterium avium
RTSQ

SEQ ID NO: 3737 - protein, 9 aa, Mycobacterium avium
RTSSPYSLT

SEQ ID NO: 3738 - protein, 6 aa, Mycobacterium avium
RTSTGE

SEQ ID NO: 3739 - protein, 4 aa, Mycobacterium avium
RTTE

SEQ ID NO: 3740 - protein, 8 aa, Mycobacterium avium
RTTGGFGQ

SEQ ID NO: 3741 - protein, 6 aa, Mycobacterium avium
RVEAAG

SEQ ID NO: 3742 - protein, 11 aa, Mycobacterium avium
RVEEAARQGRL

SEQ ID NO: 3743 - protein, 6 aa, Mycobacterium avium
RVEPAR

SEQ ID NO: 3744 - protein, 9 aa, Mycobacterium avium
RVGNQGAYG

SEQ ID NO: 3745 - protein, 13 aa, Mycobacterium avium
RVGPPAAATGLAN

SEQ ID NO: 3746 - protein, 17 aa, Mycobacterium avium
RVGSRRPGSSDATADAG

SEQ ID NO: 3747 - protein, 5 aa, Mycobacterium avium
RVNEK

SEQ ID NO: 3748 - protein, 5 aa, Mycobacterium avium
RVPAN

SEQ ID NO: 3749 - protein, 9 aa, Mycobacterium avium
RVPANATAS

SEQ ID NO: 3750 - protein, 6 aa, Mycobacterium avium
RVSATE

SEQ ID NO: 3751 - protein, 5 aa, Mycobacterium avium
RVSGY

SEQ ID NO: 3752 - protein, 5 aa, Mycobacterium avium
RVTPD

SEQ ID NO: 3753 - protein, 6 aa, Mycobacterium avium
RYDGQP

SEQ ID NO: 3754 - protein, 9 aa, Mycobacterium avium
RYPGAPRRD

SEQ ID NO: 3755 - protein, 7 aa, Mycobacterium avium
RYPRTAA

SEQ ID NO: 3756 - protein, 5 aa, Mycobacterium avium
RYPTN

SEQ ID NO: 3757 - protein, 10 aa, Mycobacterium avium
RYTPSSASKL

SEQ ID NO: 3758 - protein, 6 aa, Mycobacterium avium
SAAAAE

SEQ ID NO: 3759 - protein, 14 aa, Mycobacterium avium
SAAAEFSSPLPTGA

SEQ ID NO: 3760 - protein, 5 aa, Mycobacterium avium
SAAGT

SEQ ID NO: 3761 - protein, 8 aa, Mycobacterium avium
SAAPARPK

SEQ ID NO: 3762 - protein, 8 aa, Mycobacterium avium
SAATDPRA

SEQ ID NO: 3763 - protein, 6 aa, Mycobacterium avium
SAATPL

SEQ ID NO: 3764 - protein, 7 aa, Mycobacterium avium
SADEKIR

SEQ ID NO: 3765 - protein, 7 aa, Mycobacterium avium
SADGSIA

SEQ ID NO: 3766 - protein, 8 aa, Mycobacterium avium
SADPAKPI

SEQ ID NO: 3767 - protein, 15 aa, Mycobacterium avium
SADPVGGWRREDPAT

SEQ ID NO: 3768 - protein, 23 aa, Mycobacterium avium
SADTHDDPASEPTREGRSPKSVA

SEQ ID NO: 3769 - protein, 8 aa, Mycobacterium avium
SAEALTNQ

SEQ ID NO: 3770 - protein, 6 aa, Mycobacterium avium
SAERER

SEQ ID NO: 3771 - protein, 6 aa, Mycobacterium avium
SAETSM

SEQ ID NO: 3772 - protein, 7 aa, Mycobacterium avium
SAETSTL

SEQ ID NO: 3773 - protein, 8 aa, Mycobacterium avium
SAGAGDIT

SEQ ID NO: 3774 - protein, 10 aa, Mycobacterium avium
SAGATVPLEA

SEQ ID NO: 3775 - protein, 12 aa, Mycobacterium avium
SAGDPIAATERK

SEQ ID NO: 3776 - protein, 4 aa, Mycobacterium avium
SAGG

SEQ ID NO: 3777 - protein, 4 aa, Mycobacterium avium
SAGL

SEQ ID NO: 3778 - protein, 8 aa, Mycobacterium avium
SAGPRRST

SEQ ID NO: 3779 - protein, 7 aa, Mycobacterium avium
SAGTGTM

SEQ ID NO: 3780 - protein, 12 aa, Mycobacterium avium
SAGVDDAKEYNA

SEQ ID NO: 3781 - protein, 5 aa, Mycobacterium avium
SAKPV

SEQ ID NO: 3782 - protein, 9 aa, Mycobacterium avium
SALAANGTA

SEQ ID NO: 3783 - protein, 8 aa, Mycobacterium avium
SALRGKNT

SEQ ID NO: 3784 - protein, 7 aa, Mycobacterium avium
SAMPSRH

SEQ ID NO: 3785 - protein, 8 aa, Mycobacterium avium
SAPGWYPD

SEQ ID NO: 3786 - protein, 6 aa, Mycobacterium avium
SAPIRS

SEQ ID NO: 3787 - protein, 8 aa, Mycobacterium avium
SAPPPTPE

SEQ ID NO: 3788 - protein, 19 aa, Mycobacterium avium
SAPRPGTRMDAASTDPDGA

SEQ ID NO: 3789 - protein, 9 aa, Mycobacterium avium
SAPTADLGK

SEQ ID NO: 3790 - protein, 7 aa, Mycobacterium avium
SAPTAVR

SEQ ID NO: 3791 - protein, 17 aa, Mycobacterium avium
SAPVAPSAKSAALGRQL

SEQ ID NO: 3792 - protein, 14 aa, Mycobacterium avium
SAQDHRNDPYGAAS

SEQ ID NO: 3793 - protein, 21 aa, Mycobacterium avium
SAQLGSGAAKLTTGSNTAATA

SEQ ID NO: 3794 - protein, 4 aa, Mycobacterium avium
SAQR

SEQ ID NO: 3795 - protein, 4 aa, Mycobacterium avium
SAQV

SEQ ID NO: 3796 - protein, 6 aa, Mycobacterium avium
SARHPR

SEQ ID NO: 3797 - protein, 5 aa, Mycobacterium avium
SARNR

SEQ ID NO: 3798 - protein, 7 aa, Mycobacterium avium
SARPRAE

SEQ ID NO: 3799 - protein, 4 aa, Mycobacterium avium
SARQ

SEQ ID NO: 3800 - protein, 9 aa, Mycobacterium avium
SARQASETR

SEQ ID NO: 3801 - protein, 11 aa, Mycobacterium avium
SARRESLPPSA

SEQ ID NO: 3802 - protein, 26 aa, Mycobacterium avium
SARRPLRTRARTEPSIAAASTEVIEK

SEQ ID NO: 3803 - protein, 13 aa, Mycobacterium avium
SARSDPGEPANTK

SEQ ID NO: 3804 - protein, 4 aa, Mycobacterium avium
SASD

SEQ ID NO: 3805 - protein, 7 aa, Mycobacterium avium
SASEKIS

SEQ ID NO: 3806 - protein, 9 aa, Mycobacterium avium
SASGGKSGR

SEQ ID NO: 3807 - protein, 6 aa, Mycobacterium avium
SASLGT

SEQ ID NO: 3808 - protein, 6 aa, Mycobacterium avium
SASSDS

SEQ ID NO: 3809 - protein, 7 aa, Mycobacterium avium
SASTADL

SEQ ID NO: 3810 - protein, 5 aa, Mycobacterium avium
SASTV

SEQ ID NO: 3811 - protein, 19 aa, Mycobacterium avium
SATAIAEATAAAAAQGLTT

SEQ ID NO: 3812 - protein, 9 aa, Mycobacterium avium
SATDGASVA

SEQ ID NO: 3813 - protein, 10 aa, Mycobacterium avium
SATGEAGEVR

SEQ ID NO: 3814 - protein, 11 aa, Mycobacterium avium
SAVPDDDAEAK

SEQ ID NO: 3815 - protein, 5 aa, Mycobacterium avium
SAVTG

SEQ ID NO: 3816 - protein, 8 aa, Mycobacterium avium
SAYPTGTV

SEQ ID NO: 3817 - protein, 7 aa, Mycobacterium avium
SCPPPRH

SEQ ID NO: 3818 - protein, 4 aa, Mycobacterium avium
SDAH

SEQ ID NO: 3819 - protein, 5 aa, Mycobacterium avium
SDEPA

SEQ ID NO: 3820 - protein, 13 aa, Mycobacterium avium
SDETNGYGAKNVK

SEQ ID NO: 3821 - protein, 4 aa, Mycobacterium avium
SDFE

SEQ ID NO: 3822 - protein, 18 aa, Mycobacterium avium
SDGAENVPLDPNAPQGAF

SEQ ID NO: 3823 - protein, 10 aa, Mycobacterium avium
SDGPPAPRRD

SEQ ID NO: 3824 - protein, 9 aa, Mycobacterium avium
SDGSGPIPA

SEQ ID NO: 3825 - protein, 15 aa, Mycobacterium avium
SDGTGTALDSASLST

SEQ ID NO: 3826 - protein, 12 aa, Mycobacterium avium
SDIGNGRGPVDD

SEQ ID NO: 3827 - protein, 6 aa, Mycobacterium avium
SDITTD

SEQ ID NO: 3828 - protein, 13 aa, Mycobacterium avium
SDKNNGLGAAATE

SEQ ID NO: 3829 - protein, 5 aa, Mycobacterium avium
SDLPG

SEQ ID NO: 3830 - protein, 6 aa, Mycobacterium avium
SDMPAD

SEQ ID NO: 3831 - protein, 8 aa, Mycobacterium avium
SDPDGSGY

SEQ ID NO: 3832 - protein, 5 aa, Mycobacterium avium
SDPRE

SEQ ID NO: 3833 - protein, 21 aa, Mycobacterium avium
SDRRTAKRLDRAADRDDDAEL

SEQ ID NO: 3834 - protein, 5 aa, Mycobacterium avium
SDSGA

SEQ ID NO: 3835 - protein, 19 aa, Mycobacterium avium
SDSPDNAVAAETNAAAAPA

SEQ ID NO: 3836 - protein, 8 aa, Mycobacterium avium
SDTGPGGF

SEQ ID NO: 3837 - protein, 6 aa, Mycobacterium avium
SDWADG

SEQ ID NO: 3838 - protein, 5 aa, Mycobacterium avium
SDYGG

SEQ ID NO: 3839 - protein, 12 aa, Mycobacterium avium
SEDEPRPAPPDV

SEQ ID NO: 3840 - protein, 6 aa, Mycobacterium avium
SEELAG

SEQ ID NO: 3841 - protein, 8 aa, Mycobacterium avium
SEGPLPPL

SEQ ID NO: 3842 - protein, 7 aa, Mycobacterium avium
SEGTRRS

SEQ ID NO: 3843 - protein, 8 aa, Mycobacterium avium
SEGVHDEQ

SEQ ID NO: 3844 - protein, 7 aa, Mycobacterium avium
SEKLSNG

SEQ ID NO: 3845 - protein, 5 aa, Mycobacterium avium
SELSL

SEQ ID NO: 3846 - protein, 10 aa, Mycobacterium avium
SEPEGGSDVR

SEQ ID NO: 3847 - protein, 11 aa, Mycobacterium avium
SEQIDSAGNAA

SEQ ID NO: 3848 - protein, 4 aa, Mycobacterium avium
SERP

SEQ ID NO: 3849 - protein, 4 aa, Mycobacterium avium
SERQ

SEQ ID NO: 3850 - protein, 7 aa, Mycobacterium avium
SERTTVP

SEQ ID NO: 3851 - protein, 16 aa, Mycobacterium avium
SESALTDPGLDRGDQD

SEQ ID NO: 3852 - protein, 4 aa, Mycobacterium avium
SETY

SEQ ID NO: 3853 - protein, 17 aa, Mycobacterium avium
SEYAEPAARADDNKTEY

SEQ ID NO: 3854 - protein, 7 aa, Mycobacterium avium
SEYQRSE

SEQ ID NO: 3855 - protein, 5 aa, Mycobacterium avium
SFPSR

SEQ ID NO: 3856 - protein, 6 aa, Mycobacterium avium
SGAIRD

SEQ ID NO: 3857 - protein, 19 aa, Mycobacterium avium
SGALTEQEYNSRRAAIIAE

SEQ ID NO: 3858 - protein, 5 aa, Mycobacterium avium
SGAPL

SEQ ID NO: 3859 - protein, 6 aa, Mycobacterium avium
SGAPRA

SEQ ID NO: 3860 - protein, 10 aa, Mycobacterium avium
SGASAIAKAS

SEQ ID NO: 3861 - protein, 9 aa, Mycobacterium avium
SGASVTAQV

SEQ ID NO: 3862 - protein, 5 aa, Mycobacterium avium
SGAVV

SEQ ID NO: 3863 - protein, 45 aa, Mycobacterium avium
SGDSASTKATVGASAPHSVTSAPATTKASVPPSASPSPSRPLPAE

SEQ ID NO: 3864 - protein, 4 aa, Mycobacterium avium
SGEE

SEQ ID NO: 3865 - protein, 5 aa, Mycobacterium avium
SGEGR

SEQ ID NO: 3866 - protein, 6 aa, Mycobacterium avium
SGEQDA

SEQ ID NO: 3867 - protein, 13 aa, Mycobacterium avium
SGEVVRGPAAAPL

SEQ ID NO: 3868 - protein, 12 aa, Mycobacterium avium
SGGNETATLARD

SEQ ID NO: 3869 - protein, 15 aa, Mycobacterium avium
SGGPAGVGNATGNAV

SEQ ID NO: 3870 - protein, 11 aa, Mycobacterium avium
SGGQSYTATNL

SEQ ID NO: 3871 - protein, 29 aa, Mycobacterium avium
SGGQVAPPPGYQPGPPPGYQPGPPPGAPP

SEQ ID NO: 3872 - protein, 6 aa, Mycobacterium avium
SGGRSN

SEQ ID NO: 3873 - protein, 6 aa, Mycobacterium avium
SGGVSS

SEQ ID NO: 3874 - protein, 6 aa, Mycobacterium avium
SGHPPG

SEQ ID NO: 3875 - protein, 7 aa, Mycobacterium avium
SGHPPTL

SEQ ID NO: 3876 - protein, 5 aa, Mycobacterium avium
SGHPV

SEQ ID NO: 3877 - protein, 15 aa, Mycobacterium avium
SGKPAPGHTDDPGKR

SEQ ID NO: 3878 - protein, 10 aa, Mycobacterium avium
SGLGKPGGEV

SEQ ID NO: 3879 - protein, 8 aa, Mycobacterium avium
SGLSPTSC

SEQ ID NO: 3880 - protein, 6 aa, Mycobacterium avium
SGNPLD

SEQ ID NO: 3881 - protein, 4 aa, Mycobacterium avium
SGNY

SEQ ID NO: 3882 - protein, 9 aa, Mycobacterium avium
SGPAPPGLS

SEQ ID NO: 3883 - protein, 12 aa, Mycobacterium avium
SGPETKQVPDIA

SEQ ID NO: 3884 - protein, 4 aa, Mycobacterium avium
SGPI

SEQ ID NO: 3885 - protein, 4 aa, Mycobacterium avium
SGPT

SEQ ID NO: 3886 - protein, 8 aa, Mycobacterium avium
SGQAVTDR

SEQ ID NO: 3887 - protein, 15 aa, Mycobacterium avium
SGQNQPSSSAMPAHP

SEQ ID NO: 3888 - protein, 7 aa, Mycobacterium avium
SGQPGGI

SEQ ID NO: 3889 - protein, 5 aa, Mycobacterium avium
SGQRD

SEQ ID NO: 3890 - protein, 9 aa, Mycobacterium avium
SGRHHPSAT

SEQ ID NO: 3891 - protein, 6 aa, Mycobacterium avium
SGRNAL

SEQ ID NO: 3892 - protein, 9 aa, Mycobacterium avium
SGRPLEREP

SEQ ID NO: 3893 - protein, 10 aa, Mycobacterium avium
SGRTGALSRS

SEQ ID NO: 3894 - protein, 8 aa, Mycobacterium avium
SGSGGVGN

SEQ ID NO: 3895 - protein, 24 aa, Mycobacterium avium
SGSGIKQAADGAARLDDGAGQLAA

SEQ ID NO: 3896 - protein, 4 aa, Mycobacterium avium
SGSK

SEQ ID NO: 3897 - protein, 10 aa, Mycobacterium avium
SGSTSTPKGV

SEQ ID NO: 3898 - protein, 13 aa, Mycobacterium avium
SGTNGFDSDPNCT

SEQ ID NO: 3899 - protein, 5 aa, Mycobacterium avium
SGTSF

SEQ ID NO: 3900 - protein, 10 aa, Mycobacterium avium
SGTTGPPKRI

SEQ ID NO: 3901 - protein, 11 aa, Mycobacterium avium
SGTTGSGKSTL

SEQ ID NO: 3902 - protein, 7 aa, Mycobacterium avium
SGTTPKL

SEQ ID NO: 3903 - protein, 6 aa, Mycobacterium avium
SGTTTA

SEQ ID NO: 3904 - protein, 6 aa, Mycobacterium avium
SGVASA

SEQ ID NO: 3905 - protein, 5 aa, Mycobacterium avium
SGVAV

SEQ ID NO: 3906 - protein, 9 aa, Mycobacterium avium
SGVPENVKA

SEQ ID NO: 3907 - protein, 6 aa, Mycobacterium avium
SGVSAG

SEQ ID NO: 3908 - protein, 6 aa, Mycobacterium avium
SGVTTQ

SEQ ID NO: 3909 - protein, 50 aa, Mycobacterium avium
SHAGDADPKVSTRNPDTRPDDDAGAPAPVPEPGTKPDAAAPTEGSKRSTL

SEQ ID NO: 3910 - protein, 8 aa, Mycobacterium avium
SHGSTNPL

SEQ ID NO: 3911 - protein, 7 aa, Mycobacterium avium
SHLEQAG

SEQ ID NO: 3912 - protein, 6 aa, Mycobacterium avium
SHPAVA

SEQ ID NO: 3913 - protein, 12 aa, Mycobacterium avium
SIAAGDDTEPDV

SEQ ID NO: 3914 - protein, 5 aa, Mycobacterium avium
SIEGN

SEQ ID NO: 3915 - protein, 9 aa, Mycobacterium avium
SIESASRDR

SEQ ID NO: 3916 - protein, 4 aa, Mycobacterium avium
SIGS

SEQ ID NO: 3917 - protein, 8 aa, Mycobacterium avium
SIPPPEGK

SEQ ID NO: 3918 - protein, 21 aa, Mycobacterium avium
SIRETPPTAREARAETDESTA

SEQ ID NO: 3919 - protein, 6 aa, Mycobacterium avium
SISDPI

SEQ ID NO: 3920 - protein, 9 aa, Mycobacterium avium
SKAERGHRP

SEQ ID NO: 3921 - protein, 10 aa, Mycobacterium avium
SKDGKQFSGA

SEQ ID NO: 3922 - protein, 7 aa, Mycobacterium avium
SKDNKSG

SEQ ID NO: 3923 - protein, 7 aa, Mycobacterium avium
SKDPSRW

SEQ ID NO: 3924 - protein, 8 aa, Mycobacterium avium
SKETRPEV

SEQ ID NO: 3925 - protein, 7 aa, Mycobacterium avium
SKNARLN

SEQ ID NO: 3926 - protein, 9 aa, Mycobacterium avium
SKPGQTIPG

SEQ ID NO: 3927 - protein, 6 aa, Mycobacterium avium
SKQTAL

SEQ ID NO: 3928 - protein, 9 aa, Mycobacterium avium
SKRSHTAAG

SEQ ID NO: 3929 - protein, 6 aa, Mycobacterium avium
SKSPVA

SEQ ID NO: 3930 - protein, 16 aa, Mycobacterium avium
SLAADPGKAIEGTAYS

SEQ ID NO: 3931 - protein, 5 aa, Mycobacterium avium
SLAAS

SEQ ID NO: 3932 - protein, 6 aa, Mycobacterium avium
SLDGGG

SEQ ID NO: 3933 - protein, 12 aa, Mycobacterium avium
SLDPEDGADVDP

SEQ ID NO: 3934 - protein, 5 aa, Mycobacterium avium
SLGAS

SEQ ID NO: 3935 - protein, 4 aa, Mycobacterium avium
SLGG

SEQ ID NO: 3936 - protein, 10 aa, Mycobacterium avium
SLGGPAGSDL

SEQ ID NO: 3937 - protein, 27 aa, Mycobacterium avium
SLGGPAGSDLGFPTTNETDGGIGPSSR

SEQ ID NO: 3938 - protein, 13 aa, Mycobacterium avium
SLKTEGEVSEPTL

SEQ ID NO: 3939 - protein, 8 aa, Mycobacterium avium
SLPASGRA

SEQ ID NO: 3940 - protein, 6 aa, Mycobacterium avium
SLPATI

SEQ ID NO: 3941 - protein, 7 aa, Mycobacterium avium
SLPQAQQ

SEQ ID NO: 3942 - protein, 5 aa, Mycobacterium avium
SLPQT

SEQ ID NO: 3943 - protein, 6 aa, Mycobacterium avium
SLQPDK

SEQ ID NO: 3944 - protein, 6 aa, Mycobacterium avium
SLRAGN

SEQ ID NO: 3945 - protein, 7 aa, Mycobacterium avium
SLRPGDN

SEQ ID NO: 3946 - protein, 12 aa, Mycobacterium avium
SLRRTDKQKDTG

SEQ ID NO: 3947 - protein, 6 aa, Mycobacterium avium
SLRSGE

SEQ ID NO: 3948 - protein, 8 aa, Mycobacterium avium
SLSEQNGA

SEQ ID NO: 3949 - protein, 10 aa, Mycobacterium avium
SLSKEGPAKL

SEQ ID NO: 3950 - protein, 17 aa, Mycobacterium avium
SLSPGGFQDPDSESARA

SEQ ID NO: 3951 - protein, 12 aa, Mycobacterium avium
SMASTDVPPNRL

SEQ ID NO: 3952 - protein, 4 aa, Mycobacterium avium
SMEP

SEQ ID NO: 3953 - protein, 11 aa, Mycobacterium avium
SMRATDVAPNR

SEQ ID NO: 3954 - protein, 6 aa, Mycobacterium avium
SNAAGT

SEQ ID NO: 3955 - protein, 19 aa, Mycobacterium avium
SNATTQSGLAATATSQLKR

SEQ ID NO: 3956 - protein, 8 aa, Mycobacterium avium
SNDNDPVA

SEQ ID NO: 3957 - protein, 8 aa, Mycobacterium avium
SNGAAGQL

SEQ ID NO: 3958 - protein, 5 aa, Mycobacterium avium
SNPAL

SEQ ID NO: 3959 - protein, 8 aa, Mycobacterium avium
SNPDGSMA

SEQ ID NO: 3960 - protein, 7 aa, Mycobacterium avium
SNPPPRL

SEQ ID NO: 3961 - protein, 12 aa, Mycobacterium avium
SNSTGAGAPSGV

SEQ ID NO: 3962 - protein, 6 aa, Mycobacterium avium
SNVGDL

SEQ ID NO: 3963 - protein, 10 aa, Mycobacterium avium
SNYDSDGYVG

SEQ ID NO: 3964 - protein, 5 aa, Mycobacterium avium
SPAAF

SEQ ID NO: 3965 - protein, 6 aa, Mycobacterium avium
SPAAGG

SEQ ID NO: 3966 - protein, 7 aa, Mycobacterium avium
SPAGAAF

SEQ ID NO: 3967 - protein, 4 aa, Mycobacterium avium
SPAP

SEQ ID NO: 3968 - protein, 8 aa, Mycobacterium avium
SPAPRPSI

SEQ ID NO: 3969 - protein, 6 aa, Mycobacterium avium
SPAQRA

SEQ ID NO: 3970 - protein, 8 aa, Mycobacterium avium
SPASSQVA

SEQ ID NO: 3971 - protein, 7 aa, Mycobacterium avium
SPATRAT

SEQ ID NO: 3972 - protein, 4 aa, Mycobacterium avium
SPDA

SEQ ID NO: 3973 - protein, 4 aa, Mycobacterium avium
SPDG

SEQ ID NO: 3974 - protein, 5 aa, Mycobacterium avium
SPDGK

SEQ ID NO: 3975 - protein, 7 aa, Mycobacterium avium
SPDGSVA

SEQ ID NO: 3976 - protein, 5 aa, Mycobacterium avium
SPDLE

SEQ ID NO: 3977 - protein, 5 aa, Mycobacterium avium
SPDPE

SEQ ID NO: 3978 - protein, 5 aa, Mycobacterium avium
SPEQK

SEQ ID NO: 3979 - protein, 16 aa, Mycobacterium avium
SPEQVRDGAATPRSDV

SEQ ID NO: 3980 - protein, 6 aa, Mycobacterium avium
SPFSTQ

SEQ ID NO: 3981 - protein, 7 aa, Mycobacterium avium
SPGDDPA

SEQ ID NO: 3982 - protein, 9 aa, Mycobacterium avium
SPGDRPRGQ

SEQ ID NO: 3983 - protein, 10 aa, Mycobacterium avium
SPGLDPPAVH

SEQ ID NO: 3984 - protein, 4 aa, Mycobacterium avium
SPGT

SEQ ID NO: 3985 - protein, 19 aa, Mycobacterium avium
SPIANPATQRREVAPAEPR

SEQ ID NO: 3986 - protein, 7 aa, Mycobacterium avium
SPIGAPS

SEQ ID NO: 3987 - protein, 4 aa, Mycobacterium avium
SPIT

SEQ ID NO: 3988 - protein, 8 aa, Mycobacterium avium
SPKDAEGI

SEQ ID NO: 3989 - protein, 9 aa, Mycobacterium avium
SPKKSWEGL

SEQ ID NO: 3990 - protein, 16 aa, Mycobacterium avium
SPLRATQSLSEQDVYD

SEQ ID NO: 3991 - protein, 8 aa, Mycobacterium avium
SPNPAAPS

SEQ ID NO: 3992 - protein, 20 aa, Mycobacterium avium
SPPGWTPDKTDRLRPLLHAN

SEQ ID NO: 3993 - protein, 12 aa, Mycobacterium avium
SPPQFAEDNGSA

SEQ ID NO: 3994 - protein, 9 aa, Mycobacterium avium
SPPYTGGPV

SEQ ID NO: 3995 - protein, 20 aa, Mycobacterium avium
SPQGGGPVNAYPPSRPGEKN

SEQ ID NO: 3996 - protein, 9 aa, Mycobacterium avium
SPQIETTKA

SEQ ID NO: 3997 - protein, 6 aa, Mycobacterium avium
SPQTAD

SEQ ID NO: 3998 - protein, 6 aa, Mycobacterium avium
SPRLNR

SEQ ID NO: 3999 - protein, 13 aa, Mycobacterium avium
SPRNQNYSSRAGA

SEQ ID NO: 4000 - protein, 5 aa, Mycobacterium avium
SPRRG

SEQ ID NO: 4001 - protein, 7 aa, Mycobacterium avium
SPSAGTL

SEQ ID NO: 4002 - protein, 6 aa, Mycobacterium avium
SPSSRT

SEQ ID NO: 4003 - protein, 8 aa, Mycobacterium avium
SPTDAAAV

SEQ ID NO: 4004 - protein, 5 aa, Mycobacterium avium
SPTQS

SEQ ID NO: 4005 - protein, 10 aa, Mycobacterium avium
SPVTGQPKKA

SEQ ID NO: 4006 - protein, 13 aa, Mycobacterium avium
SQGPSAMPAQGLE

SEQ ID NO: 4007 - protein, 8 aa, Mycobacterium avium
SQGQSGST

SEQ ID NO: 4008 - protein, 24 aa, Mycobacterium avium
SQIGGSTEQLQQGATALAQANDQL

SEQ ID NO: 4009 - protein, 6 aa, Mycobacterium avium
SQIPDA

SEQ ID NO: 4010 - protein, 6 aa, Mycobacterium avium
SQLPPQ

SEQ ID NO: 4011 - protein, 8 aa, Mycobacterium avium
SQRPKNPW

SEQ ID NO: 4012 - protein, 4 aa, Mycobacterium avium
SQRV

SEQ ID NO: 4013 - protein, 23 aa, Mycobacterium avium
SRAGDNANMGAGSTDDADGARSD

SEQ ID NO: 4014 - protein, 14 aa, Mycobacterium avium
SRAKQLSKDMPKTT

SEQ ID NO: 4015 - protein, 14 aa, Mycobacterium avium
SRAQRAVADARRAA

SEQ ID NO: 4016 - protein, 4 aa, Mycobacterium avium
SRAR

SEQ ID NO: 4017 - protein, 4 aa, Mycobacterium avium
SRDR

SEQ ID NO: 4018 - protein, 14 aa, Mycobacterium avium
SRHDDAGADLPPEA

SEQ ID NO: 4019 - protein, 7 aa, Mycobacterium avium
SRISGQA

SEQ ID NO: 4020 - protein, 15 aa, Mycobacterium avium
SRITNAAGAKDEPRN

SEQ ID NO: 4021 - protein, 6 aa, Mycobacterium avium
SRLDGL

SEQ ID NO: 4022 - protein, 6 aa, Mycobacterium avium
SRMGEE

SEQ ID NO: 4023 - protein, 5 aa, Mycobacterium avium
SRNGI

SEQ ID NO: 4024 - protein, 11 aa, Mycobacterium avium
SRPDGSPETLQ

SEQ ID NO: 4025 - protein, 10 aa, Mycobacterium avium
SRPPDGWRSR

SEQ ID NO: 4026 - protein, 12 aa, Mycobacterium avium
SRPRAAVGADPE

SEQ ID NO: 4027 - protein, 24 aa, Mycobacterium avium
SRPSAAGTGYDPTSSGGSNLGPES

SEQ ID NO: 4028 - protein, 8 aa, Mycobacterium avium
SRPVTGAD

SEQ ID NO: 4029 - protein, 13 aa, Mycobacterium avium
SRQNYPASKITPR

SEQ ID NO: 4030 - protein, 5 aa, Mycobacterium avium
SRQPW

SEQ ID NO: 4031 - protein, 4 aa, Mycobacterium avium
SRRA

SEQ ID NO: 4032 - protein, 11 aa, Mycobacterium avium
SRRARDRAAAA

SEQ ID NO: 4033 - protein, 8 aa, Mycobacterium avium
SRRSPVPG

SEQ ID NO: 4034 - protein, 9 aa, Mycobacterium avium
SRRTRGPVR

SEQ ID NO: 4035 - protein, 14 aa, Mycobacterium avium
SRSDAVDKPDLEGA

SEQ ID NO: 4036 - protein, 9 aa, Mycobacterium avium
SRSEGFSRL

SEQ ID NO: 4037 - protein, 21 aa, Mycobacterium avium
SRSGAIQKPAGSQTIGRATDN

SEQ ID NO: 4038 - protein, 14 aa, Mycobacterium avium
SRTELNPPRFDGPG

SEQ ID NO: 4039 - protein, 5 aa, Mycobacterium avium
SRTIR

SEQ ID NO: 4040 - protein, 4 aa, Mycobacterium avium
SRTP

SEQ ID NO: 4041 - protein, 9 aa, Mycobacterium avium
SRTRSATAT

SEQ ID NO: 4042 - protein, 5 aa, Mycobacterium avium
SSAAA

SEQ ID NO: 4043 - protein, 7 aa, Mycobacterium avium
SSAGIAA

SEQ ID NO: 4044 - protein, 19 aa, Mycobacterium avium
SSAKFGPAGNRSGGGVGDV

SEQ ID NO: 4045 - protein, 5 aa, Mycobacterium avium
SSANA

SEQ ID NO: 4046 - protein, 11 aa, Mycobacterium avium
SSARSGALDAA

SEQ ID NO: 4047 - protein, 9 aa, Mycobacterium avium
SSCGPTDHI

SEQ ID NO: 4048 - protein, 9 aa, Mycobacterium avium
SSEAQTVSA

SEQ ID NO: 4049 - protein, 10 aa, Mycobacterium avium
SSGAARDTDD

SEQ ID NO: 4050 - protein, 33 aa, Mycobacterium avium
SSGNPGKYLSSGQTITKGTVPAEIGPALDTANR

SEQ ID NO: 4051 - protein, 5 aa, Mycobacterium avium
SSGPL

SEQ ID NO: 4052 - protein, 7 aa, Mycobacterium avium
SSGQAGI

SEQ ID NO: 4053 - protein, 8 aa, Mycobacterium avium
SSHPRPAD

SEQ ID NO: 4054 - protein, 4 aa, Mycobacterium avium
SSLG

SEQ ID NO: 4055 - protein, 8 aa, Mycobacterium avium
SSLNGKPV

SEQ ID NO: 4056 - protein, 10 aa, Mycobacterium avium
SSLNGQRDSD

SEQ ID NO: 4057 - protein, 5 aa, Mycobacterium avium
SSLPA

SEQ ID NO: 4058 - protein, 4 aa, Mycobacterium avium
SSMR

SEQ ID NO: 4059 - protein, 5 aa, Mycobacterium avium
SSPVA

SEQ ID NO: 4060 - protein, 14 aa, Mycobacterium avium
SSQTLSRDANGVVD

SEQ ID NO: 4061 - protein, 27 aa, Mycobacterium avium
SSRAFEPVNPPPGDPNSDEKVKAGTLN

SEQ ID NO: 4062 - protein, 7 aa, Mycobacterium avium
SSRGPEY

SEQ ID NO: 4063 - protein, 4 aa, Mycobacterium avium
SSRR

SEQ ID NO: 4064 - protein, 9 aa, Mycobacterium avium
SSSERRKTL

SEQ ID NO: 4065 - protein, 7 aa, Mycobacterium avium
SSSGRGG

SEQ ID NO: 4066 - protein, 10 aa, Mycobacterium avium
SSSLAGARAT

SEQ ID NO: 4067 - protein, 6 aa, Mycobacterium avium
SSSNEQ

SEQ ID NO: 4068 - protein, 6 aa, Mycobacterium avium
SSTGGV

SEQ ID NO: 4069 - protein, 7 aa, Mycobacterium avium
SSTGQFR

SEQ ID NO: 4070 - protein, 4 aa, Mycobacterium avium
SSTH

SEQ ID NO: 4071 - protein, 7 aa, Mycobacterium avium
SSTHPVR

SEQ ID NO: 4072 - protein, 9 aa, Mycobacterium avium
SSTKPGIPA

SEQ ID NO: 4073 - protein, 9 aa, Mycobacterium avium
SSVSSYREV

SEQ ID NO: 4074 - protein, 12 aa, Mycobacterium avium
SSYDNTGALGAS

SEQ ID NO: 4075 - protein, 7 aa, Mycobacterium avium
SSYPDAP

SEQ ID NO: 4076 - protein, 7 aa, Mycobacterium avium
STAGWRD

SEQ ID NO: 4077 - protein, 4 aa, Mycobacterium avium
STAS

SEQ ID NO: 4078 - protein, 11 aa, Mycobacterium avium
STASSSGGGGM

SEQ ID NO: 4079 - protein, 8 aa, Mycobacterium avium
STDGTPFT

SEQ ID NO: 4080 - protein, 7 aa, Mycobacterium avium
STDRYPP

SEQ ID NO: 4081 - protein, 9 aa, Mycobacterium avium
STDTGPSTV

SEQ ID NO: 4082 - protein, 4 aa, Mycobacterium avium
STEE

SEQ ID NO: 4083 - protein, 6 aa, Mycobacterium avium
STGGEY

SEQ ID NO: 4084 - protein, 11 aa, Mycobacterium avium
STGPEQREVPD

SEQ ID NO: 4085 - protein, 14 aa, Mycobacterium avium
STGSPSPRRDVDST

SEQ ID NO: 4086 - protein, 5 aa, Mycobacterium avium
STGTI

SEQ ID NO: 4087 - protein, 5 aa, Mycobacterium avium
STHKS

SEQ ID NO: 4088 - protein, 9 aa, Mycobacterium avium
STNATSEAV

SEQ ID NO: 4089 - protein, 7 aa, Mycobacterium avium
STNRQPL

SEQ ID NO: 4090 - protein, 13 aa, Mycobacterium avium
STNVNAGARSRAS

SEQ ID NO: 4091 - protein, 8 aa, Mycobacterium avium
STPRTAGR

SEQ ID NO: 4092 - protein, 4 aa, Mycobacterium avium
STQG

SEQ ID NO: 4093 - protein, 7 aa, Mycobacterium avium
STQPEKM

SEQ ID NO: 4094 - protein, 7 aa, Mycobacterium avium
STQRDTE

SEQ ID NO: 4095 - protein, 8 aa, Mycobacterium avium
STRDEYRY

SEQ ID NO: 4096 - protein, 4 aa, Mycobacterium avium
STRQ

SEQ ID NO: 4097 - protein, 15 aa, Mycobacterium avium
STRSVSNAIASGAQV

SEQ ID NO: 4098 - protein, 6 aa, Mycobacterium avium
STSSDG

SEQ ID NO: 4099 - protein, 17 aa, Mycobacterium avium
STTASRSAKDTAAESLK

SEQ ID NO: 4100 - protein, 14 aa, Mycobacterium avium
STTGYGDITPYTET

SEQ ID NO: 4101 - protein, 6 aa, Mycobacterium avium
STVNGS

SEQ ID NO: 4102 - protein, 16 aa, Mycobacterium avium
SVARQSPEAAANPQTA

SEQ ID NO: 4103 - protein, 12 aa, Mycobacterium avium
SVDETPAPLRDA

SEQ ID NO: 4104 - protein, 20 aa, Mycobacterium avium
SVENSTRTGDDGWKEMLAPA

SEQ ID NO: 4105 - protein, 8 aa, Mycobacterium avium
SVESPANA

SEQ ID NO: 4106 - protein, 22 aa, Mycobacterium avium
SVIEPPTAIPEPSLSAGQHDDV

SEQ ID NO: 4107 - protein, 11 aa, Mycobacterium avium
SVNEPDPRQQR

SEQ ID NO: 4108 - protein, 5 aa, Mycobacterium avium
SVPAE

SEQ ID NO: 4109 - protein, 5 aa, Mycobacterium avium
SVPSD

SEQ ID NO: 4110 - protein, 12 aa, Mycobacterium avium
SVRGKGERIGEA

SEQ ID NO: 4111 - protein, 5 aa, Mycobacterium avium
SVSAA

SEQ ID NO: 4112 - protein, 11 aa, Mycobacterium avium
SVSDGNGHSIG

SEQ ID NO: 4113 - protein, 9 aa, Mycobacterium avium
SVSGPSQDQ

SEQ ID NO: 4114 - protein, 8 aa, Mycobacterium avium
SVSKTAAM

SEQ ID NO: 4115 - protein, 10 aa, Mycobacterium avium
SVVNPDRGLR

SEQ ID NO: 4116 - protein, 6 aa, Mycobacterium avium
SYADDP

SEQ ID NO: 4117 - protein, 8 aa, Mycobacterium avium
SYATEREA

SEQ ID NO: 4118 - protein, 13 aa, Mycobacterium avium
SYGENSLAATATS

SEQ ID NO: 4119 - protein, 11 aa, Mycobacterium avium
SYGGQGRVPGN

SEQ ID NO: 4120 - protein, 16 aa, Mycobacterium avium
SYGSADLQSIQTDQTY

SEQ ID NO: 4121 - protein, 11 aa, Mycobacterium avium
SYHKQAADTGA

SEQ ID NO: 4122 - protein, 7 aa, Mycobacterium avium
TAAATGL

SEQ ID NO: 4123 - protein, 10 aa, Mycobacterium avium
TAAGAQSVDG

SEQ ID NO: 4124 - protein, 13 aa, Mycobacterium avium
TAAGSQSKDGKAA

SEQ ID NO: 4125 - protein, 13 aa, Mycobacterium avium
TAAGSQSPDGKSA

SEQ ID NO: 4126 - protein, 12 aa, Mycobacterium avium
TAAQRTGSDPGW

SEQ ID NO: 4127 - protein, 6 aa, Mycobacterium avium
TAATKV

SEQ ID NO: 4128 - protein, 4 aa, Mycobacterium avium
TACS

SEQ ID NO: 4129 - protein, 4 aa, Mycobacterium avium
TADE

SEQ ID NO: 4130 - protein, 9 aa, Mycobacterium avium
TADGSVSEV

SEQ ID NO: 4131 - protein, 8 aa, Mycobacterium avium
TADPRSRT

SEQ ID NO: 4132 - protein, 7 aa, Mycobacterium avium
TADRSRP

SEQ ID NO: 4133 - protein, 6 aa, Mycobacterium avium
TADVSN

SEQ ID NO: 4134 - protein, 4 aa, Mycobacterium avium
TAGA

SEQ ID NO: 4135 - protein, 9 aa, Mycobacterium avium
TAGFGGGNF

SEQ ID NO: 4136 - protein, 8 aa, Mycobacterium avium
TAGGGSDI

SEQ ID NO: 4137 - protein, 6 aa, Mycobacterium avium
TAGPAS

SEQ ID NO: 4138 - protein, 7 aa, Mycobacterium avium
TAGPGNQ

SEQ ID NO: 4139 - protein, 5 aa, Mycobacterium avium
TAGPL

SEQ ID NO: 4140 - protein, 15 aa, Mycobacterium avium
TAGPLKPPDLNATSD

SEQ ID NO: 4141 - protein, 16 aa, Mycobacterium avium
TAGPTGELFPGVPNQP

SEQ ID NO: 4142 - protein, 4 aa, Mycobacterium avium
TAGQ

SEQ ID NO: 4143 - protein, 7 aa, Mycobacterium avium
TAGQATA

SEQ ID NO: 4144 - protein, 12 aa, Mycobacterium avium
TAGRPRSPEKPV

SEQ ID NO: 4145 - protein, 9 aa, Mycobacterium avium
TAGTKRKPV

SEQ ID NO: 4146 - protein, 10 aa, Mycobacterium avium
TAHESADSMD

SEQ ID NO: 4147 - protein, 4 aa, Mycobacterium avium
TALT

SEQ ID NO: 4148 - protein, 10 aa, Mycobacterium avium
TAPFKSATKW

SEQ ID NO: 4149 - protein, 20 aa, Mycobacterium avium
TAPPSGRASTRAKDSDRQST

SEQ ID NO: 4150 - protein, 46 aa, Mycobacterium avium
TAPQSGPAPAGGAPAPGPAPGSAFGPRPGPPPGQAPGGLGADLGGG

SEQ ID NO: 4151 - protein, 9 aa, Mycobacterium avium
TAPSTRRDH

SEQ ID NO: 4152 - protein, 9 aa, Mycobacterium avium
TAQARDSVN

SEQ ID NO: 4153 - protein, 8 aa, Mycobacterium avium
TAQPGLSA

SEQ ID NO: 4154 - protein, 5 aa, Mycobacterium avium
TAQPW

SEQ ID NO: 4155 - protein, 11 aa, Mycobacterium avium
TAQSVGGLGPN

SEQ ID NO: 4156 - protein, 9 aa, Mycobacterium avium
TARDEHADA

SEQ ID NO: 4157 - protein, 8 aa, Mycobacterium avium
TARGGIGQ

SEQ ID NO: 4158 - protein, 7 aa, Mycobacterium avium
TARPGTL

SEQ ID NO: 4159 - protein, 9 aa, Mycobacterium avium
TARPGTTTA

SEQ ID NO: 4160 - protein, 6 aa, Mycobacterium avium
TARRPL

SEQ ID NO: 4161 - protein, 8 aa, Mycobacterium avium
TASGGPVG

SEQ ID NO: 4162 - protein, 9 aa, Mycobacterium avium
TASQSGAQW

SEQ ID NO: 4163 - protein, 14 aa, Mycobacterium avium
TASSGPAKQAGGQS

SEQ ID NO: 4164 - protein, 13 aa, Mycobacterium avium
TATARGAQPNTAL

SEQ ID NO: 4165 - protein, 8 aa, Mycobacterium avium
TATGGDEM

SEQ ID NO: 4166 - protein, 12 aa, Mycobacterium avium
TATGLPDPGPVT

SEQ ID NO: 4167 - protein, 6 aa, Mycobacterium avium
TATGLS

SEQ ID NO: 4168 - protein, 7 aa, Mycobacterium avium
TATPTWN

SEQ ID NO: 4169 - protein, 8 aa, Mycobacterium avium
TATRQAYG

SEQ ID NO: 4170 - protein, 6 aa, Mycobacterium avium
TCPTTS

SEQ ID NO: 4171 - protein, 25 aa, Mycobacterium avium
TDAERSSLLSSGAGAAGPSRTDPLP

SEQ ID NO: 4172 - protein, 14 aa, Mycobacterium avium
TDASINHGNSGGPL

SEQ ID NO: 4173 - protein, 6 aa, Mycobacterium avium
TDAYRS

SEQ ID NO: 4174 - protein, 8 aa, Mycobacterium avium
TDDEVTNS

SEQ ID NO: 4175 - protein, 8 aa, Mycobacterium avium
TDDGPGID

SEQ ID NO: 4176 - protein, 4 aa, Mycobacterium avium
TDDT

SEQ ID NO: 4177 - protein, 13 aa, Mycobacterium avium
TDEQAAGGHPGGS

SEQ ID NO: 4178 - protein, 5 aa, Mycobacterium avium
TDGAV

SEQ ID NO: 4179 - protein, 6 aa, Mycobacterium avium
TDGHGT

SEQ ID NO: 4180 - protein, 7 aa, Mycobacterium avium
TDGPIPA

SEQ ID NO: 4181 - protein, 8 aa, Mycobacterium avium
TDGSGGMG

SEQ ID NO: 4182 - protein, 9 aa, Mycobacterium avium
TDKSGHTTE

SEQ ID NO: 4183 - protein, 9 aa, Mycobacterium avium
TDLGPGEVP

SEQ ID NO: 4184 - protein, 7 aa, Mycobacterium avium
TDLQGKT

SEQ ID NO: 4185 - protein, 7 aa, Mycobacterium avium
TDPATVK

SEQ ID NO: 4186 - protein, 8 aa, Mycobacterium avium
TDPGPSTV

SEQ ID NO: 4187 - protein, 10 aa, Mycobacterium avium
TDPYGNTSTQ

SEQ ID NO: 4188 - protein, 12 aa, Mycobacterium avium
TDRARSGGGAGL

SEQ ID NO: 4189 - protein, 10 aa, Mycobacterium avium
TDRTDEKAEK

SEQ ID NO: 4190 - protein, 14 aa, Mycobacterium avium
TDSSRARASGGTGL

SEQ ID NO: 4191 - protein, 18 aa, Mycobacterium avium
TDTDGHGQRGDRRPPSAE

SEQ ID NO: 4192 - protein, 4 aa, Mycobacterium avium
TDVG

SEQ ID NO: 4193 - protein, 9 aa, Mycobacterium avium
TDVPAGGSL

SEQ ID NO: 4194 - protein, 7 aa, Mycobacterium avium
TDVRDPD

SEQ ID NO: 4195 - protein, 13 aa, Mycobacterium avium
TDVTNADNTNRPP

SEQ ID NO: 4196 - protein, 7 aa, Mycobacterium avium
TEAARTR

SEQ ID NO: 4197 - protein, 11 aa, Mycobacterium avium
TEAATRSGGLE

SEQ ID NO: 4198 - protein, 8 aa, Mycobacterium avium
TEASGTVE

SEQ ID NO: 4199 - protein, 5 aa, Mycobacterium avium
TEDIA

SEQ ID NO: 4200 - protein, 10 aa, Mycobacterium avium
TEERQPGGYG

SEQ ID NO: 4201 - protein, 5 aa, Mycobacterium avium
TEFGG

SEQ ID NO: 4202 - protein, 7 aa, Mycobacterium avium
TEGEGRR

SEQ ID NO: 4203 - protein, 9 aa, Mycobacterium avium
TEGPNTNGS

SEQ ID NO: 4204 - protein, 11 aa, Mycobacterium avium
TEHLDAGDAER

SEQ ID NO: 4205 - protein, 5 aa, Mycobacterium avium
TEHRS

SEQ ID NO: 4206 - protein, 5 aa, Mycobacterium avium
TEHTD

SEQ ID NO: 4207 - protein, 10 aa, Mycobacterium avium
TEIRDNSVNG

SEQ ID NO: 4208 - protein, 9 aa, Mycobacterium avium
TENGSPDNR

SEQ ID NO: 4209 - protein, 8 aa, Mycobacterium avium
TEPDPDVR

SEQ ID NO: 4210 - protein, 6 aa, Mycobacterium avium
TEPGER

SEQ ID NO: 4211 - protein, 8 aa, Mycobacterium avium
TEPGPGLD

SEQ ID NO: 4212 - protein, 8 aa, Mycobacterium avium
TEQVTNTL

SEQ ID NO: 4213 - protein, 4 aa, Mycobacterium avium
TERH

SEQ ID NO: 4214 - protein, 5 aa, Mycobacterium avium
TERQV

SEQ ID NO: 4215 - protein, 6 aa, Mycobacterium avium
TESQHR

SEQ ID NO: 4216 - protein, 9 aa, Mycobacterium avium
TETDPAARR

SEQ ID NO: 4217 - protein, 13 aa, Mycobacterium avium
TFTNRGKRSEEQV

SEQ ID NO: 4218 - protein, 21 aa, Mycobacterium avium
TGAAEGVKRGMNSGSHSTPAA

SEQ ID NO: 4219 - protein, 8 aa, Mycobacterium avium
TGAGGATQ

SEQ ID NO: 4220 - protein, 18 aa, Mycobacterium avium
TGAGRRIDGRDPATGQSR

SEQ ID NO: 4221 - protein, 9 aa, Mycobacterium avium
TGAGSGIGR

SEQ ID NO: 4222 - protein, 9 aa, Mycobacterium avium
TGANGAGKT

SEQ ID NO: 4223 - protein, 9 aa, Mycobacterium avium
TGANGSGKT

SEQ ID NO: 4224 - protein, 8 aa, Mycobacterium avium
TGASGCGK

SEQ ID NO: 4225 - protein, 9 aa, Mycobacterium avium
TGCGPATTA

SEQ ID NO: 4226 - protein, 10 aa, Mycobacterium avium
TGCTRGPTVT

SEQ ID NO: 4227 - protein, 4 aa, Mycobacterium avium
TGDA

SEQ ID NO: 4228 - protein, 13 aa, Mycobacterium avium
TGDGTNDAPALAQ

SEQ ID NO: 4229 - protein, 12 aa, Mycobacterium avium
TGDGTVKQMNLP

SEQ ID NO: 4230 - protein, 7 aa, Mycobacterium avium
TGDSARV

SEQ ID NO: 4231 - protein, 9 aa, Mycobacterium avium
TGEADPIAK

SEQ ID NO: 4232 - protein, 11 aa, Mycobacterium avium
TGEAETPSGPL

SEQ ID NO: 4233 - protein, 7 aa, Mycobacterium avium
TGESKGR

SEQ ID NO: 4234 - protein, 9 aa, Mycobacterium avium
TGETATRTR

SEQ ID NO: 4235 - protein, 12 aa, Mycobacterium avium
TGETSPGVTGGA

SEQ ID NO: 4236 - protein, 12 aa, Mycobacterium avium
TGFRAPEGPYET

SEQ ID NO: 4237 - protein, 13 aa, Mycobacterium avium
TGGAQRLRAESAA

SEQ ID NO: 4238 - protein, 9 aa, Mycobacterium avium
TGGPASEAT

SEQ ID NO: 4239 - protein, 9 aa, Mycobacterium avium
TGGPESETL

SEQ ID NO: 4240 - protein, 9 aa, Mycobacterium avium
TGHPADDEL

SEQ ID NO: 4241 - protein, 4 aa, Mycobacterium avium
TGHR

SEQ ID NO: 4242 - protein, 8 aa, Mycobacterium avium
TGHSSGVD

SEQ ID NO: 4243 - protein, 4 aa, Mycobacterium avium
TGIV

SEQ ID NO: 4244 - protein, 4 aa, Mycobacterium avium
TGKA

SEQ ID NO: 4245 - protein, 5 aa, Mycobacterium avium
TGKAH

SEQ ID NO: 4246 - protein, 7 aa, Mycobacterium avium
TGKPLSP

SEQ ID NO: 4247 - protein, 14 aa, Mycobacterium avium
TGLPGGSLDQAESQ

SEQ ID NO: 4248 - protein, 5 aa, Mycobacterium avium
TGLRD

SEQ ID NO: 4249 - protein, 11 aa, Mycobacterium avium
TGNDPGAKTTE

SEQ ID NO: 4250 - protein, 8 aa, Mycobacterium avium
TGNGLDSN

SEQ ID NO: 4251 - protein, 5 aa, Mycobacterium avium
TGNSV

SEQ ID NO: 4252 - protein, 4 aa, Mycobacterium avium
TGPA

SEQ ID NO: 4253 - protein, 6 aa, Mycobacterium avium
TGPAAL

SEQ ID NO: 4254 - protein, 16 aa, Mycobacterium avium
TGPAALSADQHTAGDR

SEQ ID NO: 4255 - protein, 7 aa, Mycobacterium avium
TGPAATV

SEQ ID NO: 4256 - protein, 6 aa, Mycobacterium avium
TGPGAT

SEQ ID NO: 4257 - protein, 6 aa, Mycobacterium avium
TGPHGG

SEQ ID NO: 4258 - protein, 8 aa, Mycobacterium avium
TGPKTAVR

SEQ ID NO: 4259 - protein, 9 aa, Mycobacterium avium
TGPQNMPKF

SEQ ID NO: 4260 - protein, 17 aa, Mycobacterium avium
TGPQPPALDPSPPSGRV

SEQ ID NO: 4261 - protein, 35 aa, Mycobacterium avium
TGPQQRADGGAEQAEVEGPRRRARRERAERRAAQA

SEQ ID NO: 4262 - protein, 8 aa, Mycobacterium avium
TGPTPSLD

SEQ ID NO: 4263 - protein, 5 aa, Mycobacterium avium
TGQPL

SEQ ID NO: 4264 - protein, 14 aa, Mycobacterium avium
TGQRQAKDPASFQA

SEQ ID NO: 4265 - protein, 9 aa, Mycobacterium avium
TGRERPTGI

SEQ ID NO: 4266 - protein, 8 aa, Mycobacterium avium
TGRPDNPH

SEQ ID NO: 4267 - protein, 22 aa, Mycobacterium avium
TGSFDNDTECVNGSRGNAADHL

SEQ ID NO: 4268 - protein, 5 aa, Mycobacterium avium
TGSGG

SEQ ID NO: 4269 - protein, 5 aa, Mycobacterium avium
TGTIE

SEQ ID NO: 4270 - protein, 20 aa, Mycobacterium avium
TGTSSPKPTASQPIQSPTAI

SEQ ID NO: 4271 - protein, 6 aa, Mycobacterium avium
TGTYTG

SEQ ID NO: 4272 - protein, 14 aa, Mycobacterium avium
TGVTDQNGDEPPRM

SEQ ID NO: 4273 - protein, 12 aa, Mycobacterium avium
TGWGAAPNEIRT

SEQ ID NO: 4274 - protein, 8 aa, Mycobacterium avium
THEEDRRV

SEQ ID NO: 4275 - protein, 9 aa, Mycobacterium avium
THGRAKTAE

SEQ ID NO: 4276 - protein, 17 aa, Mycobacterium avium
THHDEEAHTAPIRQPAL

SEQ ID NO: 4277 - protein, 7 aa, Mycobacterium avium
THPTTGT

SEQ ID NO: 4278 - protein, 5 aa, Mycobacterium avium
THTPE

SEQ ID NO: 4279 - protein, 6 aa, Mycobacterium avium
TIESRA

SEQ ID NO: 4280 - protein, 4 aa, Mycobacterium avium
TIGT

SEQ ID NO: 4281 - protein, 5 aa, Mycobacterium avium
TIPGI

SEQ ID NO: 4282 - protein, 9 aa, Mycobacterium avium
TISASYSRS

SEQ ID NO: 4283 - protein, 16 aa, Mycobacterium avium
TISVGGTDQAIYRLLE

SEQ ID NO: 4284 - protein, 7 aa, Mycobacterium avium
TITPAQQ

SEQ ID NO: 4285 - protein, 6 aa, Mycobacterium avium
TITPGG

SEQ ID NO: 4286 - protein, 13 aa, Mycobacterium avium
TKAAPTTPEPGLD

SEQ ID NO: 4287 - protein, 6 aa, Mycobacterium avium
TKAATS

SEQ ID NO: 4288 - protein, 15 aa, Mycobacterium avium
TKANPWGQNASDRTN

SEQ ID NO: 4289 - protein, 7 aa, Mycobacterium avium
TKPGEVA

SEQ ID NO: 4290 - protein, 5 aa, Mycobacterium avium
TKPGN

SEQ ID NO: 4291 - protein, 5 aa, Mycobacterium avium
TKPRI

SEQ ID NO: 4292 - protein, 13 aa, Mycobacterium avium
TKQFSTEPPGLAD

SEQ ID NO: 4293 - protein, 4 aa, Mycobacterium avium
TLDG

SEQ ID NO: 4294 - protein, 20 aa, Mycobacterium avium
TLDGSTGRRGPARSGYADPR

SEQ ID NO: 4295 - protein, 5 aa, Mycobacterium avium
TLEAA

SEQ ID NO: 4296 - protein, 10 aa, Mycobacterium avium
TLGETGGDTV

SEQ ID NO: 4297 - protein, 30 aa, Mycobacterium avium
TLGGSTAAHRAAHEATTSAGPPPPTVPPDT

SEQ ID NO: 4298 - protein, 5 aa, Mycobacterium avium
TLGPQ

SEQ ID NO: 4299 - protein, 9 aa, Mycobacterium avium
TLNSRNKNL

SEQ ID NO: 4300 - protein, 5 aa, Mycobacterium avium
TLPPR

SEQ ID NO: 4301 - protein, 8 aa, Mycobacterium avium
TLQRPAAD

SEQ ID NO: 4302 - protein, 7 aa, Mycobacterium avium
TLQSGED

SEQ ID NO: 4303 - protein, 12 aa, Mycobacterium avium
TLRQAEEARAAL

SEQ ID NO: 4304 - protein, 6 aa, Mycobacterium avium
TLRRAR

SEQ ID NO: 4305 - protein, 9 aa, Mycobacterium avium
TLRTSDLGD

SEQ ID NO: 4306 - protein, 9 aa, Mycobacterium avium
TLSDQSDNI

SEQ ID NO: 4307 - protein, 14 aa, Mycobacterium avium
TLSTNGNGEAPAGR

SEQ ID NO: 4308 - protein, 15 aa, Mycobacterium avium
TLTERGQTATRSGGL

SEQ ID NO: 4309 - protein, 4 aa, Mycobacterium avium
TLTP

SEQ ID NO: 4310 - protein, 17 aa, Mycobacterium avium
TLTSKTDSASGAGTAGT

SEQ ID NO: 4311 - protein, 17 aa, Mycobacterium avium
TLTSTGAVDSAHDSLTS

SEQ ID NO: 4312 - protein, 4 aa, Mycobacterium avium
TMGT

SEQ ID NO: 4313 - protein, 12 aa, Mycobacterium avium
TMPDANPQDDIR

SEQ ID NO: 4314 - protein, 9 aa, Mycobacterium avium
TMPGRGQAN

SEQ ID NO: 4315 - protein, 5 aa, Mycobacterium avium
TNEAG

SEQ ID NO: 4316 - protein, 4 aa, Mycobacterium avium
TNEL

SEQ ID NO: 4317 - protein, 7 aa, Mycobacterium avium
TNGRTAQ

SEQ ID NO: 4318 - protein, 9 aa, Mycobacterium avium
TNKIGPAVS

SEQ ID NO: 4319 - protein, 7 aa, Mycobacterium avium
TNNNPYP

SEQ ID NO: 4320 - protein, 5 aa, Mycobacterium avium
TNPEF

SEQ ID NO: 4321 - protein, 5 aa, Mycobacterium avium
TNPEH

SEQ ID NO: 4322 - protein, 10 aa, Mycobacterium avium
TNSAGNYHPW

SEQ ID NO: 4323 - protein, 14 aa, Mycobacterium avium
TNSYGLDQPPRLGA

SEQ ID NO: 4324 - protein, 6 aa, Mycobacterium avium
TPAARG

SEQ ID NO: 4325 - protein, 9 aa, Mycobacterium avium
TPADAGNGI

SEQ ID NO: 4326 - protein, 11 aa, Mycobacterium avium
TPAPAPSTPTD

SEQ ID NO: 4327 - protein, 13 aa, Mycobacterium avium
TPAPPPPPPDHRA

SEQ ID NO: 4328 - protein, 6 aa, Mycobacterium avium
TPAPYG

SEQ ID NO: 4329 - protein, 8 aa, Mycobacterium avium
TPARAGIT

SEQ ID NO: 4330 - protein, 5 aa, Mycobacterium avium
TPDAL

SEQ ID NO: 4331 - protein, 6 aa, Mycobacterium avium
TPEATT

SEQ ID NO: 4332 - protein, 4 aa, Mycobacterium avium
TPEY

SEQ ID NO: 4333 - protein, 10 aa, Mycobacterium avium
TPFSHGNHEP

SEQ ID NO: 4334 - protein, 7 aa, Mycobacterium avium
TPGEQVT

SEQ ID NO: 4335 - protein, 7 aa, Mycobacterium avium
TPGFPSD

SEQ ID NO: 4336 - protein, 6 aa, Mycobacterium avium
TPGPMP

SEQ ID NO: 4337 - protein, 10 aa, Mycobacterium avium
TPGTERRTAT

SEQ ID NO: 4338 - protein, 7 aa, Mycobacterium avium
TPHGPRE

SEQ ID NO: 4339 - protein, 17 aa, Mycobacterium avium
TPNDPKYQPGFEDADTS

SEQ ID NO: 4340 - protein, 4 aa, Mycobacterium avium
TPPA

SEQ ID NO: 4341 - protein, 4 aa, Mycobacterium avium
TPPM

SEQ ID NO: 4342 - protein, 8 aa, Mycobacterium avium
TPPYRGGP

SEQ ID NO: 4343 - protein, 7 aa, Mycobacterium avium
TPQVNEP

SEQ ID NO: 4344 - protein, 6 aa, Mycobacterium avium
TPRAPA

SEQ ID NO: 4345 - protein, 6 aa, Mycobacterium avium
TPRYPG

SEQ ID NO: 4346 - protein, 5 aa, Mycobacterium avium
TPSAH

SEQ ID NO: 4347 - protein, 9 aa, Mycobacterium avium
TPSNAPQHL

SEQ ID NO: 4348 - protein, 7 aa, Mycobacterium avium
TPSTRSL

SEQ ID NO: 4349 - protein, 4 aa, Mycobacterium avium
TPTA

SEQ ID NO: 4350 - protein, 6 aa, Mycobacterium avium
TPTPRM

SEQ ID NO: 4351 - protein, 5 aa, Mycobacterium avium
TPTQR

SEQ ID NO: 4352 - protein, 4 aa, Mycobacterium avium
TPTV

SEQ ID NO: 4353 - protein, 12 aa, Mycobacterium avium
TQAGAQSPDGKA

SEQ ID NO: 4354 - protein, 9 aa, Mycobacterium avium
TQAQTTDSI

SEQ ID NO: 4355 - protein, 6 aa, Mycobacterium avium
TQGPPV

SEQ ID NO: 4356 - protein, 12 aa, Mycobacterium avium
TQLAESRPPQEV

SEQ ID NO: 4357 - protein, 14 aa, Mycobacterium avium
TQLGDSSEPRVSKT

SEQ ID NO: 4358 - protein, 17 aa, Mycobacterium avium
TQPGKTYDVSSPDLPTV

SEQ ID NO: 4359 - protein, 6 aa, Mycobacterium avium
TQPMPG

SEQ ID NO: 4360 - protein, 7 aa, Mycobacterium avium
TQQERRV

SEQ ID NO: 4361 - protein, 5 aa, Mycobacterium avium
TQRAE

SEQ ID NO: 4362 - protein, 6 aa, Mycobacterium avium
TQTDPD

SEQ ID NO: 4363 - protein, 11 aa, Mycobacterium avium
TRAGRSAFSPD

SEQ ID NO: 4364 - protein, 6 aa, Mycobacterium avium
TRARRA

SEQ ID NO: 4365 - protein, 8 aa, Mycobacterium avium
TRARRDGD

SEQ ID NO: 4366 - protein, 12 aa, Mycobacterium avium
TRASAGRVPNPY

SEQ ID NO: 4367 - protein, 10 aa, Mycobacterium avium
TRASSGLTDE

SEQ ID NO: 4368 - protein, 5 aa, Mycobacterium avium
TRDDA

SEQ ID NO: 4369 - protein, 15 aa, Mycobacterium avium
TRDGGQLKMSKVDFL

SEQ ID NO: 4370 - protein, 7 aa, Mycobacterium avium
TRDNSDA

SEQ ID NO: 4371 - protein, 10 aa, Mycobacterium avium
TRDRRPFQPP

SEQ ID NO: 4372 - protein, 7 aa, Mycobacterium avium
TRDRSAA

SEQ ID NO: 4373 - protein, 12 aa, Mycobacterium avium
TRDSATQGGYRL

SEQ ID NO: 4374 - protein, 10 aa, Mycobacterium avium
TREGAADSGY

SEQ ID NO: 4375 - protein, 17 aa, Mycobacterium avium
TRGAALDAAAAAEKVAA

SEQ ID NO: 4376 - protein, 13 aa, Mycobacterium avium
TRGAAQSQDGKAA

SEQ ID NO: 4377 - protein, 5 aa, Mycobacterium avium
TRGDT

SEQ ID NO: 4378 - protein, 5 aa, Mycobacterium avium
TRGLG

SEQ ID NO: 4379 - protein, 4 aa, Mycobacterium avium
TRGT

SEQ ID NO: 4380 - protein, 4 aa, Mycobacterium avium
TRHK

SEQ ID NO: 4381 - protein, 4 aa, Mycobacterium avium
TRIE

SEQ ID NO: 4382 - protein, 5 aa, Mycobacterium avium
TRLPS

SEQ ID NO: 4383 - protein, 4 aa, Mycobacterium avium
TRMS

SEQ ID NO: 4384 - protein, 5 aa, Mycobacterium avium
TRNGQ

SEQ ID NO: 4385 - protein, 7 aa, Mycobacterium avium
TRNGTVT

SEQ ID NO: 4386 - protein, 9 aa, Mycobacterium avium
TRPQGTPIE

SEQ ID NO: 4387 - protein, 12 aa, Mycobacterium avium
TRQGAAEGGYQL

SEQ ID NO: 4388 - protein, 13 aa, Mycobacterium avium
TRQSGRLPETPAY

SEQ ID NO: 4389 - protein, 8 aa, Mycobacterium avium
TRRGETEY

SEQ ID NO: 4390 - protein, 6 aa, Mycobacterium avium
TRRQTL

SEQ ID NO: 4391 - protein, 4 aa, Mycobacterium avium
TRRT

SEQ ID NO: 4392 - protein, 8 aa, Mycobacterium avium
TRSDPSRP

SEQ ID NO: 4393 - protein, 4 aa, Mycobacterium avium
TRTG

SEQ ID NO: 4394 - protein, 13 aa, Mycobacterium avium
TRTLQKPDSAIPP

SEQ ID NO: 4395 - protein, 10 aa, Mycobacterium avium
TSALDTENEA

SEQ ID NO: 4396 - protein, 8 aa, Mycobacterium avium
TSAPLDDQ

SEQ ID NO: 4397 - protein, 10 aa, Mycobacterium avium
TSARAMPGSG

SEQ ID NO: 4398 - protein, 5 aa, Mycobacterium avium
TSAVA

SEQ ID NO: 4399 - protein, 5 aa, Mycobacterium avium
TSFNG

SEQ ID NO: 4400 - protein, 7 aa, Mycobacterium avium
TSGALGT

SEQ ID NO: 4401 - protein, 8 aa, Mycobacterium avium
TSGENRAR

SEQ ID NO: 4402 - protein, 7 aa, Mycobacterium avium
TSGPAKI

SEQ ID NO: 4403 - protein, 14 aa, Mycobacterium avium
TSGPLPDQTDQATV

SEQ ID NO: 4404 - protein, 8 aa, Mycobacterium avium
TSGSTRLP

SEQ ID NO: 4405 - protein, 6 aa, Mycobacterium avium
TSHDEP

SEQ ID NO: 4406 - protein, 5 aa, Mycobacterium avium
TSLQP

SEQ ID NO: 4407 - protein, 4 aa, Mycobacterium avium
TSNL

SEQ ID NO: 4408 - protein, 4 aa, Mycobacterium avium
TSPA

SEQ ID NO: 4409 - protein, 11 aa, Mycobacterium avium
TSPADDSAAQA

SEQ ID NO: 4410 - protein, 9 aa, Mycobacterium avium
TSPGLPARG

SEQ ID NO: 4411 - protein, 4 aa, Mycobacterium avium
TSQN

SEQ ID NO: 4412 - protein, 9 aa, Mycobacterium avium
TSQTPQTLS

SEQ ID NO: 4413 - protein, 4 aa, Mycobacterium avium
TSRA

SEQ ID NO: 4414 - protein, 10 aa, Mycobacterium avium
TSSGVESYDH

SEQ ID NO: 4415 - protein, 7 aa, Mycobacterium avium
TSTGVPS

SEQ ID NO: 4416 - protein, 10 aa, Mycobacterium avium
TSTNGDRVEP

SEQ ID NO: 4417 - protein, 10 aa, Mycobacterium avium
TSTRDAGSPE

SEQ ID NO: 4418 - protein, 8 aa, Mycobacterium avium
TSTSPNQQ

SEQ ID NO: 4419 - protein, 8 aa, Mycobacterium avium
TSTTSGGL

SEQ ID NO: 4420 - protein, 11 aa, Mycobacterium avium
TSVSGNVTAAK

SEQ ID NO: 4421 - protein, 7 aa, Mycobacterium avium
TSYTDGT

SEQ ID NO: 4422 - protein, 12 aa, Mycobacterium avium
TTAAAGAVGGAA

SEQ ID NO: 4423 - protein, 4 aa, Mycobacterium avium
TTAG

SEQ ID NO: 4424 - protein, 5 aa, Mycobacterium avium
TTAHI

SEQ ID NO: 4425 - protein, 10 aa, Mycobacterium avium
TTANANGNVE

SEQ ID NO: 4426 - protein, 7 aa, Mycobacterium avium
TTASSHA

SEQ ID NO: 4427 - protein, 5 aa, Mycobacterium avium
TTDDI

SEQ ID NO: 4428 - protein, 5 aa, Mycobacterium avium
TTGGA

SEQ ID NO: 4429 - protein, 10 aa, Mycobacterium avium
TTGSLGPQTD

SEQ ID NO: 4430 - protein, 9 aa, Mycobacterium avium
TTHPADGTI

SEQ ID NO: 4431 - protein, 5 aa, Mycobacterium avium
TTHSL

SEQ ID NO: 4432 - protein, 7 aa, Mycobacterium avium
TTIPGSA

SEQ ID NO: 4433 - protein, 13 aa, Mycobacterium avium
TTKGGPKGVGTAV

SEQ ID NO: 4434 - protein, 19 aa, Mycobacterium avium
TTKNPPEAPRYFWRGGQPP

SEQ ID NO: 4435 - protein, 10 aa, Mycobacterium avium
TTKSPDEKQV

SEQ ID NO: 4436 - protein, 16 aa, Mycobacterium avium
TTLEDHHDESRQAQRH

SEQ ID NO: 4437 - protein, 18 aa, Mycobacterium avium
TTLQNGADQFAGGSRQVA

SEQ ID NO: 4438 - protein, 8 aa, Mycobacterium avium
TTPEPATE

SEQ ID NO: 4439 - protein, 7 aa, Mycobacterium avium
TTPHPQL

SEQ ID NO: 4440 - protein, 4 aa, Mycobacterium avium
TTPL

SEQ ID NO: 4441 - protein, 7 aa, Mycobacterium avium
TTPPPAL

SEQ ID NO: 4442 - protein, 6 aa, Mycobacterium avium
TTPTSG

SEQ ID NO: 4443 - protein, 9 aa, Mycobacterium avium
TTPTSGTVT

SEQ ID NO: 4444 - protein, 4 aa, Mycobacterium avium
TTRG

SEQ ID NO: 4445 - protein, 8 aa, Mycobacterium avium
TTRPLAGE

SEQ ID NO: 4446 - protein, 5 aa, Mycobacterium avium
TTRRR

SEQ ID NO: 4447 - protein, 6 aa, Mycobacterium avium
TTSPSL

SEQ ID NO: 4448 - protein, 6 aa, Mycobacterium avium
TTTGTG

SEQ ID NO: 4449 - protein, 5 aa, Mycobacterium avium
TTTPS

SEQ ID NO: 4450 - protein, 5 aa, Mycobacterium avium
TTTTG

SEQ ID NO: 4451 - protein, 19 aa, Mycobacterium avium
TVARQNDDLDQALNQTRDA

SEQ ID NO: 4452 - protein, 10 aa, Mycobacterium avium
TVGAPGGGID

SEQ ID NO: 4453 - protein, 13 aa, Mycobacterium avium
TVGNANGNPSDTP

SEQ ID NO: 4454 - protein, 8 aa, Mycobacterium avium
TVGRPVPG

SEQ ID NO: 4455 - protein, 6 aa, Mycobacterium avium
TVKGDA

SEQ ID NO: 4456 - protein, 11 aa, Mycobacterium avium
TVKPKSDISPE

SEQ ID NO: 4457 - protein, 9 aa, Mycobacterium avium
TVKQESTGV

SEQ ID NO: 4458 - protein, 10 aa, Mycobacterium avium
TVPAGHPGPG

SEQ ID NO: 4459 - protein, 4 aa, Mycobacterium avium
TVPG

SEQ ID NO: 4460 - protein, 11 aa, Mycobacterium avium
TVPGGQPPGTS

SEQ ID NO: 4461 - protein, 8 aa, Mycobacterium avium
TVPGPGSA

SEQ ID NO: 4462 - protein, 6 aa, Mycobacterium avium
TVPVGT

SEQ ID NO: 4463 - protein, 9 aa, Mycobacterium avium
TVTAPGGQP

SEQ ID NO: 4464 - protein, 5 aa, Mycobacterium avium
TVTPA

SEQ ID NO: 4465 - protein, 6 aa, Mycobacterium avium
TVTRRT

SEQ ID NO: 4466 - protein, 40 aa, Mycobacterium avium
TVTSPSAAPSVAPSLTPGVAPAQTPTAAPPLAAAPTVTVD

SEQ ID NO: 4467 - protein, 6 aa, Mycobacterium avium
TVYPSE

SEQ ID NO: 4468 - protein, 15 aa, Mycobacterium avium
TWRSPDDLSDIDTPD

SEQ ID NO: 4469 - protein, 4 aa, Mycobacterium avium
TYAQ

SEQ ID NO: 4470 - protein, 5 aa, Mycobacterium avium
TYPSN

SEQ ID NO: 4471 - protein, 8 aa, Mycobacterium avium
TYSRPPGW

SEQ ID NO: 4472 - protein, 21 aa, Mycobacterium avium
VAADEPGDQDDDADTDELSRR

SEQ ID NO: 4473 - protein, 33 aa, Mycobacterium avium
VAAGPGEKTGSNGHTNGSAGAKKPAARNGRNGI

SEQ ID NO: 4474 - protein, 10 aa, Mycobacterium avium
VAAGTPRNTV

SEQ ID NO: 4475 - protein, 8 aa, Mycobacterium avium
VAATGGPK

SEQ ID NO: 4476 - protein, 22 aa, Mycobacterium avium
VAEGRGKAQAETLRRAKTQTMA

SEQ ID NO: 4477 - protein, 8 aa, Mycobacterium avium
VAGDTARY

SEQ ID NO: 4478 - protein, 8 aa, Mycobacterium avium
VAGPTTPY

SEQ ID NO: 4479 - protein, 6 aa, Mycobacterium avium
VAGSQS

SEQ ID NO: 4480 - protein, 8 aa, Mycobacterium avium
VAKGDTST

SEQ ID NO: 4481 - protein, 7 aa, Mycobacterium avium
VANGPTA

SEQ ID NO: 4482 - protein, 9 aa, Mycobacterium avium
VAPGGTGSG

SEQ ID NO: 4483 - protein, 13 aa, Mycobacterium avium
VAPGPGDRQGQPV

SEQ ID NO: 4484 - protein, 10 aa, Mycobacterium avium
VAPPRGLDAP

SEQ ID NO: 4485 - protein, 7 aa, Mycobacterium avium
VAPTDPV

SEQ ID NO: 4486 - protein, 5 aa, Mycobacterium avium
VAQGG

SEQ ID NO: 4487 - protein, 8 aa, Mycobacterium avium
VAQRPTVA

SEQ ID NO: 4488 - protein, 16 aa, Mycobacterium avium
VARTAQQGNADPAPAL

SEQ ID NO: 4489 - protein, 7 aa, Mycobacterium avium
VASGGFA

SEQ ID NO: 4490 - protein, 10 aa, Mycobacterium avium
VATDPAERRR

SEQ ID NO: 4491 - protein, 14 aa, Mycobacterium avium
VATSEDAATVTASD

SEQ ID NO: 4492 - protein, 9 aa, Mycobacterium avium
VDASSLGSA

SEQ ID NO: 4493 - protein, 5 aa, Mycobacterium avium
VDDAR

SEQ ID NO: 4494 - protein, 4 aa, Mycobacterium avium
VDDF

SEQ ID NO: 4495 - protein, 7 aa, Mycobacterium avium
VDDPDTG

SEQ ID NO: 4496 - protein, 13 aa, Mycobacterium avium
VDEAQADAKRITE

SEQ ID NO: 4497 - protein, 5 aa, Mycobacterium avium
VDGAA

SEQ ID NO: 4498 - protein, 4 aa, Mycobacterium avium
VDGG

SEQ ID NO: 4499 - protein, 4 aa, Mycobacterium avium
VDGP

SEQ ID NO: 4500 - protein, 6 aa, Mycobacterium avium
VDGQRR

SEQ ID NO: 4501 - protein, 4 aa, Mycobacterium avium
VDRM

SEQ ID NO: 4502 - protein, 10 aa, Mycobacterium avium
VDRPRPPTAL

SEQ ID NO: 4503 - protein, 12 aa, Mycobacterium avium
VDRRGRTVEGDD

SEQ ID NO: 4504 - protein, 6 aa, Mycobacterium avium
VDSQGG

SEQ ID NO: 4505 - protein, 6 aa, Mycobacterium avium
VEAAGD

SEQ ID NO: 4506 - protein, 10 aa, Mycobacterium avium
VEAHGDPGNW

SEQ ID NO: 4507 - protein, 8 aa, Mycobacterium avium
VEAPGRRA

SEQ ID NO: 4508 - protein, 7 aa, Mycobacterium avium
VEATPAT

SEQ ID NO: 4509 - protein, 6 aa, Mycobacterium avium
VEDNPG

SEQ ID NO: 4510 - protein, 7 aa, Mycobacterium avium
VEETGAE

SEQ ID NO: 4511 - protein, 9 aa, Mycobacterium avium
VEETQDESR

SEQ ID NO: 4512 - protein, 4 aa, Mycobacterium avium
VEGS

SEQ ID NO: 4513 - protein, 6 aa, Mycobacterium avium
VENHPD

SEQ ID NO: 4514 - protein, 14 aa, Mycobacterium avium
VEPGTAPAPTEPRR

SEQ ID NO: 4515 - protein, 6 aa, Mycobacterium avium
VEPKEE

SEQ ID NO: 4516 - protein, 7 aa, Mycobacterium avium
VEPSRTD

SEQ ID NO: 4517 - protein, 10 aa, Mycobacterium avium
VEQGNSGGPL

SEQ ID NO: 4518 - protein, 6 aa, Mycobacterium avium
VERGDL

SEQ ID NO: 4519 - protein, 5 aa, Mycobacterium avium
VERGS

SEQ ID NO: 4520 - protein, 9 aa, Mycobacterium avium
VERNNPDGS

SEQ ID NO: 4521 - protein, 7 aa, Mycobacterium avium
VETAAGV

SEQ ID NO: 4522 - protein, 7 aa, Mycobacterium avium
VETEPSW

SEQ ID NO: 4523 - protein, 7 aa, Mycobacterium avium
VETTSRP

SEQ ID NO: 4524 - protein, 7 aa, Mycobacterium avium
VGAENRY

SEQ ID NO: 4525 - protein, 8 aa, Mycobacterium avium
VGAGATAE

SEQ ID NO: 4526 - protein, 8 aa, Mycobacterium avium
VGAGATAQ

SEQ ID NO: 4527 - protein, 5 aa, Mycobacterium avium
VGARE

SEQ ID NO: 4528 - protein, 10 aa, Mycobacterium avium
VGDGLPARSD

SEQ ID NO: 4529 - protein, 5 aa, Mycobacterium avium
VGDPP

SEQ ID NO: 4530 - protein, 12 aa, Mycobacterium avium
VGEASQESDRAD

SEQ ID NO: 4531 - protein, 11 aa, Mycobacterium avium
VGGGPTGVGNA

SEQ ID NO: 4532 - protein, 7 aa, Mycobacterium avium
VGGPDVT

SEQ ID NO: 4533 - protein, 9 aa, Mycobacterium avium
VGGPGSARV

SEQ ID NO: 4534 - protein, 6 aa, Mycobacterium avium
VGGQEQ

SEQ ID NO: 4535 - protein, 5 aa, Mycobacterium avium
VGGRM

SEQ ID NO: 4536 - protein, 9 aa, Mycobacterium avium
VGGTAAATF

SEQ ID NO: 4537 - protein, 6 aa, Mycobacterium avium
VGKGTR

SEQ ID NO: 4538 - protein, 7 aa, Mycobacterium avium
VGKPETL

SEQ ID NO: 4539 - protein, 4 aa, Mycobacterium avium
VGMT

SEQ ID NO: 4540 - protein, 6 aa, Mycobacterium avium
VGNQTT

SEQ ID NO: 4541 - protein, 10 aa, Mycobacterium avium
VGNSSLSAGA

SEQ ID NO: 4542 - protein, 23 aa, Mycobacterium avium
VGPGTAARPPHGQSLQTQEEAAI

SEQ ID NO: 4543 - protein, 24 aa, Mycobacterium avium
VGPRPLEPSTLDNPRIVGDMRHGY

SEQ ID NO: 4544 - protein, 4 aa, Mycobacterium avium
VGPS

SEQ ID NO: 4545 - protein, 10 aa, Mycobacterium avium
VGPSEGSKAR

SEQ ID NO: 4546 - protein, 7 aa, Mycobacterium avium
VGPTRDG

SEQ ID NO: 4547 - protein, 20 aa, Mycobacterium avium
VGPTWNSPGRSAQDGSIDRP

SEQ ID NO: 4548 - protein, 5 aa, Mycobacterium avium
VGPVT

SEQ ID NO: 4549 - protein, 8 aa, Mycobacterium avium
VGRPRKAF

SEQ ID NO: 4550 - protein, 19 aa, Mycobacterium avium
VGRQRGAGLGGGHDEREQT

SEQ ID NO: 4551 - protein, 6 aa, Mycobacterium avium
VGRRPP

SEQ ID NO: 4552 - protein, 14 aa, Mycobacterium avium
VGSTNGSTNGEDGQ

SEQ ID NO: 4553 - protein, 5 aa, Mycobacterium avium
VGSTQ

SEQ ID NO: 4554 - protein, 5 aa, Mycobacterium avium
VGTAA

SEQ ID NO: 4555 - protein, 5 aa, Mycobacterium avium
VGTAT

SEQ ID NO: 4556 - protein, 8 aa, Mycobacterium avium
VGTDGDDA

SEQ ID NO: 4557 - protein, 10 aa, Mycobacterium avium
VGTEEQGGVI

SEQ ID NO: 4558 - protein, 11 aa, Mycobacterium avium
VGTPGQANYAA

SEQ ID NO: 4559 - protein, 4 aa, Mycobacterium avium
VGTQ

SEQ ID NO: 4560 - protein, 10 aa, Mycobacterium avium
VHEAGSAGYG

SEQ ID NO: 4561 - protein, 5 aa, Mycobacterium avium
VHPPY

SEQ ID NO: 4562 - protein, 7 aa, Mycobacterium avium
VHSDPRG

SEQ ID NO: 4563 - protein, 8 aa, Mycobacterium avium
VHSPGAGG

SEQ ID NO: 4564 - protein, 6 aa, Mycobacterium avium
VHTGHH

SEQ ID NO: 4565 - protein, 8 aa, Mycobacterium avium
VHTPPGVT

SEQ ID NO: 4566 - protein, 7 aa, Mycobacterium avium
VIPGDGD

SEQ ID NO: 4567 - protein, 5 aa, Mycobacterium avium
VKAER

SEQ ID NO: 4568 - protein, 12 aa, Mycobacterium avium
VKAGSPAQKGGV

SEQ ID NO: 4569 - protein, 12 aa, Mycobacterium avium
VKGGPKGVGNAV

SEQ ID NO: 4570 - protein, 12 aa, Mycobacterium avium
VKGQDNPAERKP

SEQ ID NO: 4571 - protein, 7 aa, Mycobacterium avium
VKKSYEP

SEQ ID NO: 4572 - protein, 13 aa, Mycobacterium avium
VKRSGSAPATPLV

SEQ ID NO: 4573 - protein, 7 aa, Mycobacterium avium
VKVPKDA

SEQ ID NO: 4574 - protein, 5 aa, Mycobacterium avium
VKYTP

SEQ ID NO: 4575 - protein, 9 aa, Mycobacterium avium
VMERPGDRS

SEQ ID NO: 4576 - protein, 23 aa, Mycobacterium avium
VNATGGPGGRPSCGSLPDPSANF

SEQ ID NO: 4577 - protein, 14 aa, Mycobacterium avium
VNDPAEGGAASAAI

SEQ ID NO: 4578 - protein, 13 aa, Mycobacterium avium
VNDRQEEAGRSGV

SEQ ID NO: 4579 - protein, 6 aa, Mycobacterium avium
VNGGGW

SEQ ID NO: 4580 - protein, 9 aa, Mycobacterium avium
VNRDSVDAV

SEQ ID NO: 4581 - protein, 32 aa, Mycobacterium avium
VNSDASPNKPNVAYSDSAGTAGGKGPVGVNGS

SEQ ID NO: 4582 - protein, 11 aa, Mycobacterium avium
VNSGDKPTKLT

SEQ ID NO: 4583 - protein, 7 aa, Mycobacterium avium
VPADETE

SEQ ID NO: 4584 - protein, 14 aa, Mycobacterium avium
VPAFQKPKSRNAAT

SEQ ID NO: 4585 - protein, 10 aa, Mycobacterium avium
VPAGPAAPGI

SEQ ID NO: 4586 - protein, 8 aa, Mycobacterium avium
VPAPPGDL

SEQ ID NO: 4587 - protein, 7 aa, Mycobacterium avium
VPAPPGI

SEQ ID NO: 4588 - protein, 8 aa, Mycobacterium avium
VPAPTSVT

SEQ ID NO: 4589 - protein, 16 aa, Mycobacterium avium
VPARNTPFPDPAAKIP

SEQ ID NO: 4590 - protein, 4 aa, Mycobacterium avium
VPAT

SEQ ID NO: 4591 - protein, 6 aa, Mycobacterium avium
VPDEPE

SEQ ID NO: 4592 - protein, 24 aa, Mycobacterium avium
VPDPSSRPVSPPPSGRVPTTPGQI

SEQ ID NO: 4593 - protein, 6 aa, Mycobacterium avium
VPEAGP

SEQ ID NO: 4594 - protein, 12 aa, Mycobacterium avium
VPEEDKGLRTRS

SEQ ID NO: 4595 - protein, 4 aa, Mycobacterium avium
VPES

SEQ ID NO: 4596 - protein, 8 aa, Mycobacterium avium
VPGKTEVS

SEQ ID NO: 4597 - protein, 10 aa, Mycobacterium avium
VPGPAGRSVE

SEQ ID NO: 4598 - protein, 8 aa, Mycobacterium avium
VPGQDPVT

SEQ ID NO: 4599 - protein, 8 aa, Mycobacterium avium
VPGSAGFG

SEQ ID NO: 4600 - protein, 6 aa, Mycobacterium avium
VPGSSP

SEQ ID NO: 4601 - protein, 7 aa, Mycobacterium avium
VPGTGRL

SEQ ID NO: 4602 - protein, 6 aa, Mycobacterium avium
VPNTDR

SEQ ID NO: 4603 - protein, 7 aa, Mycobacterium avium
VPPARRA

SEQ ID NO: 4604 - protein, 7 aa, Mycobacterium avium
VPPEELA

SEQ ID NO: 4605 - protein, 28 aa, Mycobacterium avium
VPPGQDNTTQFGVPPKAAVPQSIPPRLG

SEQ ID NO: 4606 - protein, 13 aa, Mycobacterium avium
VPPRDRGAASGVR

SEQ ID NO: 4607 - protein, 7 aa, Mycobacterium avium
VPPYRAD

SEQ ID NO: 4608 - protein, 10 aa, Mycobacterium avium
VPQPGSHDER

SEQ ID NO: 4609 - protein, 6 aa, Mycobacterium avium
VPRGAT

SEQ ID NO: 4610 - protein, 8 aa, Mycobacterium avium
VPSPDAAS

SEQ ID NO: 4611 - protein, 8 aa, Mycobacterium avium
VPTANGKK

SEQ ID NO: 4612 - protein, 4 aa, Mycobacterium avium
VPTT

SEQ ID NO: 4613 - protein, 9 aa, Mycobacterium avium
VPVPDGRDE

SEQ ID NO: 4614 - protein, 9 aa, Mycobacterium avium
VPVSGSSYS

SEQ ID NO: 4615 - protein, 7 aa, Mycobacterium avium
VQAPNGV

SEQ ID NO: 4616 - protein, 15 aa, Mycobacterium avium
VQPDPAALGAPPRPP

SEQ ID NO: 4617 - protein, 15 aa, Mycobacterium avium
VQQQTGRPLPEPQGK

SEQ ID NO: 4618 - protein, 5 aa, Mycobacterium avium
VQRER

SEQ ID NO: 4619 - protein, 6 aa, Mycobacterium avium
VQRQYP

SEQ ID NO: 4620 - protein, 7 aa, Mycobacterium avium
VQSGPGL

SEQ ID NO: 4621 - protein, 10 aa, Mycobacterium avium
VQSSLSGSTV

SEQ ID NO: 4622 - protein, 5 aa, Mycobacterium avium
VQTES

SEQ ID NO: 4623 - protein, 11 aa, Mycobacterium avium
VREAEPALEDS

SEQ ID NO: 4624 - protein, 4 aa, Mycobacterium avium
VREY

SEQ ID NO: 4625 - protein, 6 aa, Mycobacterium avium
VRGEDD

SEQ ID NO: 4626 - protein, 15 aa, Mycobacterium avium
VRPAGQPQPSDRLKG

SEQ ID NO: 4627 - protein, 7 aa, Mycobacterium avium
VRPDARE

SEQ ID NO: 4628 - protein, 6 aa, Mycobacterium avium
VRPDQK

SEQ ID NO: 4629 - protein, 5 aa, Mycobacterium avium
VRPPR

SEQ ID NO: 4630 - protein, 11 aa, Mycobacterium avium
VRRNPDHELRR

SEQ ID NO: 4631 - protein, 8 aa, Mycobacterium avium
VRTERGMA

SEQ ID NO: 4632 - protein, 10 aa, Mycobacterium avium
VSADSATPGV

SEQ ID NO: 4633 - protein, 9 aa, Mycobacterium avium
VSAPTGTFS

SEQ ID NO: 4634 - protein, 8 aa, Mycobacterium avium
VSATTSGL

SEQ ID NO: 4635 - protein, 9 aa, Mycobacterium avium
VSDPNLPGR

SEQ ID NO: 4636 - protein, 7 aa, Mycobacterium avium
VSEEAAS

SEQ ID NO: 4637 - protein, 8 aa, Mycobacterium avium
VSEGSYGN

SEQ ID NO: 4638 - protein, 4 aa, Mycobacterium avium
VSES

SEQ ID NO: 4639 - protein, 44 aa, Mycobacterium avium
VSGDEDQLTLPNTSAGRASAIRPRDESAKRVAPQPETPSRPRWS

SEQ ID NO: 4640 - protein, 4 aa, Mycobacterium avium
VSGP

SEQ ID NO: 4641 - protein, 13 aa, Mycobacterium avium
VSGRGSSAARGAA

SEQ ID NO: 4642 - protein, 5 aa, Mycobacterium avium
VSGTW

SEQ ID NO: 4643 - protein, 15 aa, Mycobacterium avium
VSKPEGKDAHGEERV

SEQ ID NO: 4644 - protein, 7 aa, Mycobacterium avium
VSLAGGG

SEQ ID NO: 4645 - protein, 10 aa, Mycobacterium avium
VSMSPTDAAS

SEQ ID NO: 4646 - protein, 13 aa, Mycobacterium avium
VSNGAAPAPQLDR

SEQ ID NO: 4647 - protein, 9 aa, Mycobacterium avium
VSNPDLAGR

SEQ ID NO: 4648 - protein, 15 aa, Mycobacterium avium
VSPLTRPHRSRPGVA

SEQ ID NO: 4649 - protein, 6 aa, Mycobacterium avium
VSPRRR

SEQ ID NO: 4650 - protein, 8 aa, Mycobacterium avium
VSRDGKSG

SEQ ID NO: 4651 - protein, 6 aa, Mycobacterium avium
VSRQRD

SEQ ID NO: 4652 - protein, 10 aa, Mycobacterium avium
VSRTGGAPTL

SEQ ID NO: 4653 - protein, 6 aa, Mycobacterium avium
VSSRAG

SEQ ID NO: 4654 - protein, 31 aa, Mycobacterium avium
VSSSASDSTAMPDVAPATSPAAAIDGDPATA

SEQ ID NO: 4655 - protein, 8 aa, Mycobacterium avium
VSSSGEGV

SEQ ID NO: 4656 - protein, 9 aa, Mycobacterium avium
VSTSARTIT

SEQ ID NO: 4657 - protein, 8 aa, Mycobacterium avium
VTAAGATA

SEQ ID NO: 4658 - protein, 11 aa, Mycobacterium avium
VTAPSPSGSTM

SEQ ID NO: 4659 - protein, 5 aa, Mycobacterium avium
VTASM

SEQ ID NO: 4660 - protein, 16 aa, Mycobacterium avium
VTDEGGQYKMSKLEFV

SEQ ID NO: 4661 - protein, 21 aa, Mycobacterium avium
VTDPGAGPNLSDVSKQRVSGS

SEQ ID NO: 4662 - protein, 6 aa, Mycobacterium avium
VTGQPV

SEQ ID NO: 4663 - protein, 6 aa, Mycobacterium avium
VTGSDV

SEQ ID NO: 4664 - protein, 7 aa, Mycobacterium avium
VTNPTGD

SEQ ID NO: 4665 - protein, 8 aa, Mycobacterium avium
VTPAGTST

SEQ ID NO: 4666 - protein, 5 aa, Mycobacterium avium
VTPEE

SEQ ID NO: 4667 - protein, 12 aa, Mycobacterium avium
VTPGRGLRNGPF

SEQ ID NO: 4668 - protein, 17 aa, Mycobacterium avium
VTPPPGQPVVAESWAQV

SEQ ID NO: 4669 - protein, 6 aa, Mycobacterium avium
VTQGTV

SEQ ID NO: 4670 - protein, 5 aa, Mycobacterium avium
VTQSS

SEQ ID NO: 4671 - protein, 7 aa, Mycobacterium avium
VTRPEGV

SEQ ID NO: 4672 - protein, 20 aa, Mycobacterium avium
VTSNEDTVESQVNAARDERD

SEQ ID NO: 4673 - protein, 8 aa, Mycobacterium avium
VTSPTDPE

SEQ ID NO: 4674 - protein, 11 aa, Mycobacterium avium
VTTEVNGDYGR

SEQ ID NO: 4675 - protein, 6 aa, Mycobacterium avium
VTTSPL

SEQ ID NO: 4676 - protein, 8 aa, Mycobacterium avium
VTVRAGGA

SEQ ID NO: 4677 - protein, 34 aa, Mycobacterium avium
VTVTDTPVARETDYGRVDQHSSAIRAPGDARHTY

SEQ ID NO: 4678 - protein, 8 aa, Mycobacterium avium
VYPNQPNV

SEQ ID NO: 4679 - protein, 14 aa, Mycobacterium avium
WAPAANETNPTKQL

SEQ ID NO: 4680 - protein, 11 aa, Mycobacterium avium
WAPGSHPHEAP

SEQ ID NO: 4681 - protein, 15 aa, Mycobacterium avium
WDAPGGKVVPKPAPR

SEQ ID NO: 4682 - protein, 21 aa, Mycobacterium avium
WDPSTGKYGPIYDPKTKSWGP

SEQ ID NO: 4683 - protein, 14 aa, Mycobacterium avium
WESAPQDDPGNPLQ

SEQ ID NO: 4684 - protein, 5 aa, Mycobacterium avium
WGEPG

SEQ ID NO: 4685 - protein, 8 aa, Mycobacterium avium
WGPESDAN

SEQ ID NO: 4686 - protein, 17 aa, Mycobacterium avium
WKHDTDDDDTDADAVDA

SEQ ID NO: 4687 - protein, 8 aa, Mycobacterium avium
WNDDGSAN

SEQ ID NO: 4688 - protein, 10 aa, Mycobacterium avium
WNDGGDRQRG

SEQ ID NO: 4689 - protein, 18 aa, Mycobacterium avium
WQPTATSVPALAGGGTLR

SEQ ID NO: 4690 - protein, 9 aa, Mycobacterium avium
WRDTQTERG

SEQ ID NO: 4691 - protein, 4 aa, Mycobacterium avium
WRPG

SEQ ID NO: 4692 - protein, 4 aa, Mycobacterium avium
WRRT

SEQ ID NO: 4693 - protein, 15 aa, Mycobacterium avium
WRSPADTSLQPLPTG

SEQ ID NO: 4694 - protein, 17 aa, Mycobacterium avium
WSPTSRSEIDDSVSGAT

SEQ ID NO: 4695 - protein, 10 aa, Mycobacterium avium
WTDDRDKLAG

SEQ ID NO: 4696 - protein, 9 aa, Mycobacterium avium
WTSRSSQIY

SEQ ID NO: 4697 - protein, 14 aa, Mycobacterium avium
YADPAGESAGEAGT

SEQ ID NO: 4698 - protein, 5 aa, Mycobacterium avium
YADRA

SEQ ID NO: 4699 - protein, 12 aa, Mycobacterium avium
YAEAQASADSAK

SEQ ID NO: 4700 - protein, 21 aa, Mycobacterium avium
YAGDRRRAREAMKTAVDLQGH

SEQ ID NO: 4701 - protein, 4 aa, Mycobacterium avium
YAGH

SEQ ID NO: 4702 - protein, 7 aa, Mycobacterium avium
YASGTPW

SEQ ID NO: 4703 - protein, 10 aa, Mycobacterium avium
YATPTSGSVT

SEQ ID NO: 4704 - protein, 4 aa, Mycobacterium avium
YDPR

SEQ ID NO: 4705 - protein, 17 aa, Mycobacterium avium
YDPRTGRYVGPDGKLYQ

SEQ ID NO: 4706 - protein, 4 aa, Mycobacterium avium
YDPS

SEQ ID NO: 4707 - protein, 11 aa, Mycobacterium avium
YDQTKRTTNGI

SEQ ID NO: 4708 - protein, 5 aa, Mycobacterium avium
YDSDS

SEQ ID NO: 4709 - protein, 10 aa, Mycobacterium avium
YDSQEDVNGL

SEQ ID NO: 4710 - protein, 6 aa, Mycobacterium avium
YEESDR

SEQ ID NO: 4711 - protein, 8 aa, Mycobacterium avium
YEPPPIPV

SEQ ID NO: 4712 - protein, 12 aa, Mycobacterium avium
YFTQGAPPSPLQ

SEQ ID NO: 4713 - protein, 9 aa, Mycobacterium avium
YGAKSSEKL

SEQ ID NO: 4714 - protein, 4 aa, Mycobacterium avium
YGDR

SEQ ID NO: 4715 - protein, 4 aa, Mycobacterium avium
YGEF

SEQ ID NO: 4716 - protein, 10 aa, Mycobacterium avium
YGEQPGTQAA

SEQ ID NO: 4717 - protein, 5 aa, Mycobacterium avium
YGGPK

SEQ ID NO: 4718 - protein, 10 aa, Mycobacterium avium
YGGSAAPLSV

SEQ ID NO: 4719 - protein, 6 aa, Mycobacterium avium
YGGTAG

SEQ ID NO: 4720 - protein, 14 aa, Mycobacterium avium
YGNDDSAGAPDSPL

SEQ ID NO: 4721 - protein, 7 aa, Mycobacterium avium
YGPHGRA

SEQ ID NO: 4722 - protein, 7 aa, Mycobacterium avium
YGPPDRA

SEQ ID NO: 4723 - protein, 5 aa, Mycobacterium avium
YGPRR

SEQ ID NO: 4724 - protein, 8 aa, Mycobacterium avium
YGQDRPVD

SEQ ID NO: 4725 - protein, 6 aa, Mycobacterium avium
YGQTQP

SEQ ID NO: 4726 - protein, 6 aa, Mycobacterium avium
YGSTEV

SEQ ID NO: 4727 - protein, 5 aa, Mycobacterium avium
YGTGW

SEQ ID NO: 4728 - protein, 12 aa, Mycobacterium avium
YKPSHVSAGSQP

SEQ ID NO: 4729 - protein, 5 aa, Mycobacterium avium
YKSNS

SEQ ID NO: 4730 - protein, 4 aa, Mycobacterium avium
YKTS

SEQ ID NO: 4731 - protein, 9 aa, Mycobacterium avium
YNPATRRAE

SEQ ID NO: 4732 - protein, 8 aa, Mycobacterium avium
YNRGAEYG

SEQ ID NO: 4733 - protein, 15 aa, Mycobacterium avium
YPAAQSSAGPAAPPA

SEQ ID NO: 4734 - protein, 13 aa, Mycobacterium avium
YPANQYRPDDPAL

SEQ ID NO: 4735 - protein, 8 aa, Mycobacterium avium
YPASTPVL

SEQ ID NO: 4736 - protein, 20 aa, Mycobacterium avium
YPDRPAEVGVPAENPRLQGP

SEQ ID NO: 4737 - protein, 5 aa, Mycobacterium avium
YPEDI

SEQ ID NO: 4738 - protein, 4 aa, Mycobacterium avium
YPGD

SEQ ID NO: 4739 - protein, 13 aa, Mycobacterium avium
YPGTDSAGVPPGL

SEQ ID NO: 4740 - protein, 8 aa, Mycobacterium avium
YPPAGLNP

SEQ ID NO: 4741 - protein, 6 aa, Mycobacterium avium
YPPPQL

SEQ ID NO: 4742 - protein, 4 aa, Mycobacterium avium
YPRE

SEQ ID NO: 4743 - protein, 7 aa, Mycobacterium avium
YQPQLDA

SEQ ID NO: 4744 - protein, 8 aa, Mycobacterium avium
YQPQLGQP

SEQ ID NO: 4745 - protein, 18 aa, Mycobacterium avium
YRGNDNKTRTEEVDAERA

SEQ ID NO: 4746 - protein, 14 aa, Mycobacterium avium
YRPEPAPKPPAQQV

SEQ ID NO: 4747 - protein, 7 aa, Mycobacterium avium
YRPSYDD

SEQ ID NO: 4748 - protein, 8 aa, Mycobacterium avium
YRTNYNDR

SEQ ID NO: 4749 - protein, 9 aa, Mycobacterium avium
YRVGPASGL

SEQ ID NO: 4750 - protein, 6 aa, Mycobacterium avium
YSEHPA

SEQ ID NO: 4751 - protein, 17 aa, Mycobacterium avium
YSEPRLQPPNGYKDTTV

SEQ ID NO: 4752 - protein, 11 aa, Mycobacterium avium
YSGGLGSPAAH

SEQ ID NO: 4753 - protein, 4 aa, Mycobacterium avium
YSGL

SEQ ID NO: 4754 - protein, 5 aa, Mycobacterium avium
YSGSS

SEQ ID NO: 4755 - protein, 11 aa, Mycobacterium avium
YSGTETAQERL

SEQ ID NO: 4756 - protein, 9 aa, Mycobacterium avium
YSKGSTPSQ

SEQ ID NO: 4757 - protein, 19 aa, Mycobacterium avium
YSPPTTSARVSASRGGDGG

SEQ ID NO: 4758 - protein, 7 aa, Mycobacterium avium
YSRKDST

SEQ ID NO: 4759 - protein, 21 aa, Mycobacterium avium
YTGDAQATAQQVADDRATTSN

SEQ ID NO: 4760 - protein, 8 aa, Mycobacterium avium
YTGGGNKQ

SEQ ID NO: 4761 - protein, 13 aa, Mycobacterium avium
YTKAVSKAEPPLG

SEQ ID NO: 4762 - protein, 10 aa, Mycobacterium avium
YTTPSSGSVT

SEQ ID NO: 4763 - protein, 5 aa, Mycobacterium avium
YTTPY

SEQ ID NO: 4764 - protein, 9 aa, Mycobacterium avium
YTTTTSGAR

SEQ ID NO: 4765 - protein, 10 aa, Mycobacterium avium
YTVGTTRQSF

SEQ ID NO: 4766 - protein, 22 aa, Mycobacterium avium
YVEPDEAEYPSAADAEAARREH

SEQ ID NO: 4767 - protein, 10 aa, Mycobacterium avium
YYGSDSAGTF

SEQ ID NO: 4768 - protein, 7 aa, Mycobacterium avium
YYPDARP

SEQ ID NO: 4769 - protein, 10 aa, Mycobacterium avium
AAAAGGAAAA

SEQ ID NO: 4770 - protein, 11 aa, Mycobacterium avium
AAAARAEHDGK

SEQ ID NO: 4771 - protein, 14 aa, Mycobacterium avium
AAAGRTSAAMASTA

SEQ ID NO: 4772 - protein, 26 aa, Mycobacterium avium
AAAGTSGDDAAAEDVEQRATKSARGR

SEQ ID NO: 4773 - protein, 7 aa, Mycobacterium avium
AAAGTTV

SEQ ID NO: 4774 - protein, 7 aa, Mycobacterium avium
AAALPPV

SEQ ID NO: 4775 - protein, 11 aa, Mycobacterium avium
AAAPPLPPGRG

SEQ ID NO: 4776 - protein, 5 aa, Mycobacterium avium
AAARV

SEQ ID NO: 4777 - protein, 13 aa, Mycobacterium avium
AADAARSVKTYPA

SEQ ID NO: 4778 - protein, 15 aa, Mycobacterium avium
AADPKSDEFSGIAPE

SEQ ID NO: 4779 - protein, 29 aa, Mycobacterium avium
AADQTGQTDAYSRAYSAPESEHFTSGPYV

SEQ ID NO: 4780 - protein, 23 aa, Mycobacterium avium
AAEAPGPAPLGGGAVPAKRPPAW

SEQ ID NO: 4781 - protein, 14 aa, Mycobacterium avium
AAEDKPVESHTTDH

SEQ ID NO: 4782 - protein, 6 aa, Mycobacterium avium
AAEFGG

SEQ ID NO: 4783 - protein, 9 aa, Mycobacterium avium
AAERPGHKY

SEQ ID NO: 4784 - protein, 16 aa, Mycobacterium avium
AAESSSPWNNAGTGHS

SEQ ID NO: 4785 - protein, 8 aa, Mycobacterium avium
AAGAGESG

SEQ ID NO: 4786 - protein, 5 aa, Mycobacterium avium
AAGAL

SEQ ID NO: 4787 - protein, 21 aa, Mycobacterium avium
AAGDAAGEATGDATGDAAEPV

SEQ ID NO: 4788 - protein, 10 aa, Mycobacterium avium
AAGDRNRGEG

SEQ ID NO: 4789 - protein, 12 aa, Mycobacterium avium
AAGFSPTDQDRV

SEQ ID NO: 4790 - protein, 4 aa, Mycobacterium avium
AAGG

SEQ ID NO: 4791 - protein, 11 aa, Mycobacterium avium
AAGGAVSTQAG

SEQ ID NO: 4792 - protein, 9 aa, Mycobacterium avium
AAGGDGLGE

SEQ ID NO: 4793 - protein, 9 aa, Mycobacterium avium
AAGGGIGPD

SEQ ID NO: 4794 - protein, 22 aa, Mycobacterium avium
AAGGPGGPLGAKQGGPTPVGGD

SEQ ID NO: 4795 - protein, 18 aa, Mycobacterium avium
AAGLQGAARDVEAGGGKA

SEQ ID NO: 4796 - protein, 9 aa, Mycobacterium avium
AAGSAAFGR

SEQ ID NO: 4797 - protein, 6 aa, Mycobacterium avium
AAGSPA

SEQ ID NO: 4798 - protein, 6 aa, Mycobacterium avium
AAHQDS

SEQ ID NO: 4799 - protein, 9 aa, Mycobacterium avium
AAHYGKQAP

SEQ ID NO: 4800 - protein, 7 aa, Mycobacterium avium
AAKSHLS

SEQ ID NO: 4801 - protein, 19 aa, Mycobacterium avium
AAKSSTAASLHETAAGAYT

SEQ ID NO: 4802 - protein, 7 aa, Mycobacterium avium
AALAGSA

SEQ ID NO: 4803 - protein, 17 aa, Mycobacterium avium
AALEPPPAAQARWQPGG

SEQ ID NO: 4804 - protein, 6 aa, Mycobacterium avium
AALGST

SEQ ID NO: 4805 - protein, 9 aa, Mycobacterium avium
AALSNTALA

SEQ ID NO: 4806 - protein, 5 aa, Mycobacterium avium
AALST

SEQ ID NO: 4807 - protein, 4 aa, Mycobacterium avium
AALT

SEQ ID NO: 4808 - protein, 10 aa, Mycobacterium avium
AANPAGAKRI

SEQ ID NO: 4809 - protein, 13 aa, Mycobacterium avium
AAPALAAGDATAM

SEQ ID NO: 4810 - protein, 29 aa, Mycobacterium avium
AAPAPAPKPSAKSGKTLKSLKPPPRRQPH

SEQ ID NO: 4811 - protein, 12 aa, Mycobacterium avium
AAPDRARPMPGA

SEQ ID NO: 4812 - protein, 15 aa, Mycobacterium avium
AAPEVAKAAGGNGYS

SEQ ID NO: 4813 - protein, 16 aa, Mycobacterium avium
AAPPPAPARDSRARDV

SEQ ID NO: 4814 - protein, 8 aa, Mycobacterium avium
AAPQRLRG

SEQ ID NO: 4815 - protein, 24 aa, Mycobacterium avium
AAPRPTPDSLPVQDAGDGSAWSAA

SEQ ID NO: 4816 - protein, 8 aa, Mycobacterium avium
AAPSTLTP

SEQ ID NO: 4817 - protein, 8 aa, Mycobacterium avium
AAPTADQV

SEQ ID NO: 4818 - protein, 27 aa, Mycobacterium avium
AAPTGSGRVYAPGPDFGRPVAPTDNKR

SEQ ID NO: 4819 - protein, 8 aa, Mycobacterium avium
AAQAQQAL

SEQ ID NO: 4820 - protein, 11 aa, Mycobacterium avium
AAQDAAASSLT

SEQ ID NO: 4821 - protein, 6 aa, Mycobacterium avium
AAQETL

SEQ ID NO: 4822 - protein, 5 aa, Mycobacterium avium
AAQGW

SEQ ID NO: 4823 - protein, 6 aa, Mycobacterium avium
AAQRRE

SEQ ID NO: 4824 - protein, 23 aa, Mycobacterium avium
AAQSKSEGTVTDAGLESQRGDSA

SEQ ID NO: 4825 - protein, 10 aa, Mycobacterium avium
AARAASGRRR

SEQ ID NO: 4826 - protein, 7 aa, Mycobacterium avium
AARAGPR

SEQ ID NO: 4827 - protein, 5 aa, Mycobacterium avium
AARIG

SEQ ID NO: 4828 - protein, 19 aa, Mycobacterium avium
AARQASAGCTDHPGAGRGL

SEQ ID NO: 4829 - protein, 5 aa, Mycobacterium avium
AARRA

SEQ ID NO: 4830 - protein, 6 aa, Mycobacterium avium
AARTTG

SEQ ID NO: 4831 - protein, 6 aa, Mycobacterium avium
AASDGT

SEQ ID NO: 4832 - protein, 5 aa, Mycobacterium avium
AASEH

SEQ ID NO: 4833 - protein, 4 aa, Mycobacterium avium
AATD

SEQ ID NO: 4834 - protein, 7 aa, Mycobacterium avium
AATDGKH

SEQ ID NO: 4835 - protein, 9 aa, Mycobacterium avium
AATGGRALP

SEQ ID NO: 4836 - protein, 12 aa, Mycobacterium avium
AATGVSAPPAAM

SEQ ID NO: 4837 - protein, 7 aa, Mycobacterium avium
AATPAGA

SEQ ID NO: 4838 - protein, 10 aa, Mycobacterium avium
AATPHTEPAP

SEQ ID NO: 4839 - protein, 8 aa, Mycobacterium avium
AATPRPLS

SEQ ID NO: 4840 - protein, 15 aa, Mycobacterium avium
AATTAERGHPATTAA

SEQ ID NO: 4841 - protein, 4 aa, Mycobacterium avium
AAVG

SEQ ID NO: 4842 - protein, 6 aa, Mycobacterium avium
ADAAGD

SEQ ID NO: 4843 - protein, 8 aa, Mycobacterium avium
ADATPAAA

SEQ ID NO: 4844 - protein, 5 aa, Mycobacterium avium
ADATR

SEQ ID NO: 4845 - protein, 29 aa, Mycobacterium avium
ADDVEQPPDDDRKATADRTESQPKTAARQ

SEQ ID NO: 4846 - protein, 5 aa, Mycobacterium avium
ADEAG

SEQ ID NO: 4847 - protein, 8 aa, Mycobacterium avium
ADETEAAF

SEQ ID NO: 4848 - protein, 17 aa, Mycobacterium avium
ADGAPHHTGPDFGKASP

SEQ ID NO: 4849 - protein, 7 aa, Mycobacterium avium
ADGLDTS

SEQ ID NO: 4850 - protein, 7 aa, Mycobacterium avium
ADGTDRA

SEQ ID NO: 4851 - protein, 6 aa, Mycobacterium avium
ADHPDQ

SEQ ID NO: 4852 - protein, 7 aa, Mycobacterium avium
ADKVNTI

SEQ ID NO: 4853 - protein, 6 aa, Mycobacterium avium
ADNAQR

SEQ ID NO: 4854 - protein, 8 aa, Mycobacterium avium
ADPDAVGK

SEQ ID NO: 4855 - protein, 8 aa, Mycobacterium avium
ADPGRAGA

SEQ ID NO: 4856 - protein, 26 aa, Mycobacterium avium
ADPPPPRAFEPTSELTSELTSEPARD

SEQ ID NO: 4857 - protein, 4 aa, Mycobacterium avium
ADPR

SEQ ID NO: 4858 - protein, 21 aa, Mycobacterium avium
ADPSEPAHQQGPALPPGPVYG

SEQ ID NO: 4859 - protein, 5 aa, Mycobacterium avium
ADQRN

SEQ ID NO: 4860 - protein, 5 aa, Mycobacterium avium
ADRAN

SEQ ID NO: 4861 - protein, 18 aa, Mycobacterium avium
ADRASDQTRAQIATQGPK

SEQ ID NO: 4862 - protein, 4 aa, Mycobacterium avium
ADRD

SEQ ID NO: 4863 - protein, 7 aa, Mycobacterium avium
ADRDKAI

SEQ ID NO: 4864 - protein, 19 aa, Mycobacterium avium
ADRGADRGYGEPYQTPDGT

SEQ ID NO: 4865 - protein, 6 aa, Mycobacterium avium
ADRPGM

SEQ ID NO: 4866 - protein, 6 aa, Mycobacterium avium
ADSRAA

SEQ ID NO: 4867 - protein, 10 aa, Mycobacterium avium
ADSSCSATRA

SEQ ID NO: 4868 - protein, 8 aa, Mycobacterium avium
ADSTATGE

SEQ ID NO: 4869 - protein, 8 aa, Mycobacterium avium
ADTPNSPV

SEQ ID NO: 4870 - protein, 6 aa, Mycobacterium avium
ADVAES

SEQ ID NO: 4871 - protein, 5 aa, Mycobacterium avium
ADVDQ

SEQ ID NO: 4872 - protein, 14 aa, Mycobacterium avium
ADVSSGRRAAPPDW

SEQ ID NO: 4873 - protein, 12 aa, Mycobacterium avium
ADYRTTAQPGYP

SEQ ID NO: 4874 - protein, 11 aa, Mycobacterium avium
AEAAKKGEDVD

SEQ ID NO: 4875 - protein, 10 aa, Mycobacterium avium
AEEAGTAKPK

SEQ ID NO: 4876 - protein, 9 aa, Mycobacterium avium
AEEPETALA

SEQ ID NO: 4877 - protein, 4 aa, Mycobacterium avium
AEGS

SEQ ID NO: 4878 - protein, 4 aa, Mycobacterium avium
AEGV

SEQ ID NO: 4879 - protein, 13 aa, Mycobacterium avium
AEIPEDYWRSLVH

SEQ ID NO: 4880 - protein, 14 aa, Mycobacterium avium
AELAGRSPEHVPPG

SEQ ID NO: 4881 - protein, 8 aa, Mycobacterium avium
AEPSGPRH

SEQ ID NO: 4882 - protein, 8 aa, Mycobacterium avium
AEQAPDVA

SEQ ID NO: 4883 - protein, 17 aa, Mycobacterium avium
AESIDKGQWDQARTQLT

SEQ ID NO: 4884 - protein, 7 aa, Mycobacterium avium
AETGRPA

SEQ ID NO: 4885 - protein, 12 aa, Mycobacterium avium
AETKRRTAEQLG

SEQ ID NO: 4886 - protein, 5 aa, Mycobacterium avium
AETRI

SEQ ID NO: 4887 - protein, 4 aa, Mycobacterium avium
AEVT

SEQ ID NO: 4888 - protein, 9 aa, Mycobacterium avium
AEYASAAEQ

SEQ ID NO: 4889 - protein, 11 aa, Mycobacterium avium
AEYGATEAQLQ

SEQ ID NO: 4890 - protein, 6 aa, Mycobacterium avium
AFSAPS

SEQ ID NO: 4891 - protein, 5 aa, Mycobacterium avium
AFSSK

SEQ ID NO: 4892 - protein, 7 aa, Mycobacterium avium
AFTGEAA

SEQ ID NO: 4893 - protein, 10 aa, Mycobacterium avium
AGAAATAGAL

SEQ ID NO: 4894 - protein, 11 aa, Mycobacterium avium
AGAAEQRSTHW

SEQ ID NO: 4895 - protein, 4 aa, Mycobacterium avium
AGAD

SEQ ID NO: 4896 - protein, 12 aa, Mycobacterium avium
AGADPRAGTGRE

SEQ ID NO: 4897 - protein, 8 aa, Mycobacterium avium
AGADSTGR

SEQ ID NO: 4898 - protein, 5 aa, Mycobacterium avium
AGAGE

SEQ ID NO: 4899 - protein, 10 aa, Mycobacterium avium
AGAGVNPEVP

SEQ ID NO: 4900 - protein, 61 aa, Mycobacterium avium
AGAKPANADKPNSAQSKPGSPAPQAPPPPGPEGPAPAVPPAQGQNPETPTPTAAVQPPPVL

SEQ ID NO: 4901 - protein, 7 aa, Mycobacterium avium
AGANAGT

SEQ ID NO: 4902 - protein, 11 aa, Mycobacterium avium
AGAPGQGAQLT

SEQ ID NO: 4903 - protein, 5 aa, Mycobacterium avium
AGARR

SEQ ID NO: 4904 - protein, 5 aa, Mycobacterium avium
AGASS

SEQ ID NO: 4905 - protein, 6 aa, Mycobacterium avium
AGASSI

SEQ ID NO: 4906 - protein, 9 aa, Mycobacterium avium
AGDDGAPVT

SEQ ID NO: 4907 - protein, 10 aa, Mycobacterium avium
AGDESSGGYN

SEQ ID NO: 4908 - protein, 8 aa, Mycobacterium avium
AGDGAAEI

SEQ ID NO: 4909 - protein, 9 aa, Mycobacterium avium
AGDGGAGRY

SEQ ID NO: 4910 - protein, 7 aa, Mycobacterium avium
AGDHASV

SEQ ID NO: 4911 - protein, 27 aa, Mycobacterium avium
AGDQPGPAAKPIAVPPAPAPPDTTPRT

SEQ ID NO: 4912 - protein, 5 aa, Mycobacterium avium
AGDVT

SEQ ID NO: 4913 - protein, 7 aa, Mycobacterium avium
AGEKDQT

SEQ ID NO: 4914 - protein, 6 aa, Mycobacterium avium
AGEPVK

SEQ ID NO: 4915 - protein, 8 aa, Mycobacterium avium
AGETAGPV

SEQ ID NO: 4916 - protein, 11 aa, Mycobacterium avium
AGFSPDDHDRV

SEQ ID NO: 4917 - protein, 38 aa, Mycobacterium avium
AGGAKRPGAKKSAPAAEAKTEAPAEAKTEAPAAPAKGL

SEQ ID NO: 4918 - protein, 10 aa, Mycobacterium avium
AGGGTEDAAA

SEQ ID NO: 4919 - protein, 6 aa, Mycobacterium avium
AGGINV

SEQ ID NO: 4920 - protein, 5 aa, Mycobacterium avium
AGGLR

SEQ ID NO: 4921 - protein, 28 aa, Mycobacterium avium
AGHPETAAAHAESARRHSAALPAGSPAS

SEQ ID NO: 4922 - protein, 11 aa, Mycobacterium avium
AGHRVSGAADS

SEQ ID NO: 4923 - protein, 4 aa, Mycobacterium avium
AGKE

SEQ ID NO: 4924 - protein, 11 aa, Mycobacterium avium
AGKTGTAQQIN

SEQ ID NO: 4925 - protein, 7 aa, Mycobacterium avium
AGLPPGV

SEQ ID NO: 4926 - protein, 4 aa, Mycobacterium avium
AGMP

SEQ ID NO: 4927 - protein, 6 aa, Mycobacterium avium
AGNQAP

SEQ ID NO: 4928 - protein, 19 aa, Mycobacterium avium
AGPAAGHQHPGGPAAADNA

SEQ ID NO: 4929 - protein, 7 aa, Mycobacterium avium
AGPDRTA

SEQ ID NO: 4930 - protein, 6 aa, Mycobacterium avium
AGPGGR

SEQ ID NO: 4931 - protein, 9 aa, Mycobacterium avium
AGPSVAAAS

SEQ ID NO: 4932 - protein, 7 aa, Mycobacterium avium
AGPSVQN

SEQ ID NO: 4933 - protein, 6 aa, Mycobacterium avium
AGQPGA

SEQ ID NO: 4934 - protein, 14 aa, Mycobacterium avium
AGQTVTVTNKSKTY

SEQ ID NO: 4935 - protein, 9 aa, Mycobacterium avium
AGRAEPRRV

SEQ ID NO: 4936 - protein, 9 aa, Mycobacterium avium
AGRDGQAPC

SEQ ID NO: 4937 - protein, 7 aa, Mycobacterium avium
AGRSTEK

SEQ ID NO: 4938 - protein, 12 aa, Mycobacterium avium
AGRTVSGLVSGR

SEQ ID NO: 4939 - protein, 9 aa, Mycobacterium avium
AGSADDLTQ

SEQ ID NO: 4940 - protein, 9 aa, Mycobacterium avium
AGSDNPVRG

SEQ ID NO: 4941 - protein, 5 aa, Mycobacterium avium
AGSGA

SEQ ID NO: 4942 - protein, 7 aa, Mycobacterium avium
AGSGQLG

SEQ ID NO: 4943 - protein, 5 aa, Mycobacterium avium
AGSHP

SEQ ID NO: 4944 - protein, 7 aa, Mycobacterium avium
AGSRKSV

SEQ ID NO: 4945 - protein, 4 aa, Mycobacterium avium
AGSV

SEQ ID NO: 4946 - protein, 7 aa, Mycobacterium avium
AGTEPST

SEQ ID NO: 4947 - protein, 4 aa, Mycobacterium avium
AGTG

SEQ ID NO: 4948 - protein, 9 aa, Mycobacterium avium
AGTQQRRKA

SEQ ID NO: 4949 - protein, 13 aa, Mycobacterium avium
AGTRYTDGGGKTV

SEQ ID NO: 4950 - protein, 13 aa, Mycobacterium avium
AGTVSPSRPDRMT

SEQ ID NO: 4951 - protein, 6 aa, Mycobacterium avium
AGWPRG

SEQ ID NO: 4952 - protein, 20 aa, Mycobacterium avium
AHAPPGARTENPPDATGGST

SEQ ID NO: 4953 - protein, 6 aa, Mycobacterium avium
AHASES

SEQ ID NO: 4954 - protein, 8 aa, Mycobacterium avium
AHATSTTA

SEQ ID NO: 4955 - protein, 6 aa, Mycobacterium avium
AHGGNS

SEQ ID NO: 4956 - protein, 10 aa, Mycobacterium avium
AHGGPGGRPG

SEQ ID NO: 4957 - protein, 16 aa, Mycobacterium avium
AHGQSNAVRQRATRSI

SEQ ID NO: 4958 - protein, 19 aa, Mycobacterium avium
AHNGARDPSNVVGAGSVDP

SEQ ID NO: 4959 - protein, 9 aa, Mycobacterium avium
AHPDAGPAE

SEQ ID NO: 4960 - protein, 7 aa, Mycobacterium avium
AHPSGDD

SEQ ID NO: 4961 - protein, 5 aa, Mycobacterium avium
AHQSG

SEQ ID NO: 4962 - protein, 9 aa, Mycobacterium avium
AHYDPKSAV

SEQ ID NO: 4963 - protein, 8 aa, Mycobacterium avium
AIAATGPE

SEQ ID NO: 4964 - protein, 6 aa, Mycobacterium avium
AIPPIP

SEQ ID NO: 4965 - protein, 9 aa, Mycobacterium avium
AIRARNSDV

SEQ ID NO: 4966 - protein, 7 aa, Mycobacterium avium
AKEQLST

SEQ ID NO: 4967 - protein, 7 aa, Mycobacterium avium
AKERLST

SEQ ID NO: 4968 - protein, 4 aa, Mycobacterium avium
AKGL

SEQ ID NO: 4969 - protein, 13 aa, Mycobacterium avium
AKKPEDRYASAGD

SEQ ID NO: 4970 - protein, 32 aa, Mycobacterium avium
AKNAPRPGGDDTAGPPPGADLGQTTDPTPKGR

SEQ ID NO: 4971 - protein, 13 aa, Mycobacterium avium
AKNPDNRYQTAAE

SEQ ID NO: 4972 - protein, 11 aa, Mycobacterium avium
AKQASNDTEAI

SEQ ID NO: 4973 - protein, 5 aa, Mycobacterium avium
AKRGV

SEQ ID NO: 4974 - protein, 6 aa, Mycobacterium avium
ALAPRG

SEQ ID NO: 4975 - protein, 13 aa, Mycobacterium avium
ALDPGSGPARGGR

SEQ ID NO: 4976 - protein, 17 aa, Mycobacterium avium
ALEAASPVPVTGPEEPD

SEQ ID NO: 4977 - protein, 6 aa, Mycobacterium avium
ALEPER

SEQ ID NO: 4978 - protein, 7 aa, Mycobacterium avium
ALGPAAA

SEQ ID NO: 4979 - protein, 5 aa, Mycobacterium avium
ALGSD

SEQ ID NO: 4980 - protein, 8 aa, Mycobacterium avium
ALLGGSPT

SEQ ID NO: 4981 - protein, 8 aa, Mycobacterium avium
ALNGTKNI

SEQ ID NO: 4982 - protein, 16 aa, Mycobacterium avium
ALPGPPLQPGIDCRTV

SEQ ID NO: 4983 - protein, 14 aa, Mycobacterium avium
ALPRRPSGRIRRDA

SEQ ID NO: 4984 - protein, 10 aa, Mycobacterium avium
ALPSHTPANR

SEQ ID NO: 4985 - protein, 41 aa, Mycobacterium avium
ALPVGASGSAAENNDEQPAEDDDVDTEAVAKGGDEQDSYEY

SEQ ID NO: 4986 - protein, 7 aa, Mycobacterium avium
ALRADAA

SEQ ID NO: 4987 - protein, 10 aa, Mycobacterium avium
ALRPSAAAPS

SEQ ID NO: 4988 - protein, 7 aa, Mycobacterium avium
ALTPRPV

SEQ ID NO: 4989 - protein, 23 aa, Mycobacterium avium
AMGTRRGDESATTDGGTEAAEDI

SEQ ID NO: 4990 - protein, 7 aa, Mycobacterium avium
ANDPTAV

SEQ ID NO: 4991 - protein, 5 aa, Mycobacterium avium
ANGAT

SEQ ID NO: 4992 - protein, 5 aa, Mycobacterium avium
ANLTG

SEQ ID NO: 4993 - protein, 11 aa, Mycobacterium avium
ANPAIAPGDRA

SEQ ID NO: 4994 - protein, 6 aa, Mycobacterium avium
ANQTTV

SEQ ID NO: 4995 - protein, 6 aa, Mycobacterium avium
ANQVDQ

SEQ ID NO: 4996 - protein, 5 aa, Mycobacterium avium
ANRDN

SEQ ID NO: 4997 - protein, 10 aa, Mycobacterium avium
ANRNDAAKKI

SEQ ID NO: 4998 - protein, 8 aa, Mycobacterium avium
ANSAGTLG

SEQ ID NO: 4999 - protein, 8 aa, Mycobacterium avium
ANSKGRAL

SEQ ID NO: 5000 - protein, 8 aa, Mycobacterium avium
ANTSGYSD

SEQ ID NO: 5001 - protein, 4 aa, Mycobacterium avium
ANVG

SEQ ID NO: 5002 - protein, 10 aa, Mycobacterium avium
ANVRPSPNQN

SEQ ID NO: 5003 - protein, 11 aa, Mycobacterium avium
APAAGTPDEAA

SEQ ID NO: 5004 - protein, 5 aa, Mycobacterium avium
APAAL

SEQ ID NO: 5005 - protein, 18 aa, Mycobacterium avium
APAATAAQSSSYPPDTQD

SEQ ID NO: 5006 - protein, 21 aa, Mycobacterium avium
APARSPSTPRPTPAHDAYADS

SEQ ID NO: 5007 - protein, 11 aa, Mycobacterium avium
APDGASTLGGQ

SEQ ID NO: 5008 - protein, 42 aa, Mycobacterium avium
APDNPPPPSAAPPPPPAAPVPAAPPPQAPVSPAPSPHSGDHE

SEQ ID NO: 5009 - protein, 27 aa, Mycobacterium avium
APDPSLAPAKRDGAADRLAGNTAAAGM

SEQ ID NO: 5010 - protein, 8 aa, Mycobacterium avium
APDSTNPV

SEQ ID NO: 5011 - protein, 4 aa, Mycobacterium avium
APEH

SEQ ID NO: 5012 - protein, 5 aa, Mycobacterium avium
APEPE

SEQ ID NO: 5013 - protein, 5 aa, Mycobacterium avium
APGAI

SEQ ID NO: 5014 - protein, 7 aa, Mycobacterium avium
APGATPI

SEQ ID NO: 5015 - protein, 4 aa, Mycobacterium avium
APGE

SEQ ID NO: 5016 - protein, 6 aa, Mycobacterium avium
APGVGK

SEQ ID NO: 5017 - protein, 14 aa, Mycobacterium avium
APGWPPQQSQQPNY

SEQ ID NO: 5018 - protein, 7 aa, Mycobacterium avium
APKRPST

SEQ ID NO: 5019 - protein, 6 aa, Mycobacterium avium
APKTTV

SEQ ID NO: 5020 - protein, 4 aa, Mycobacterium avium
APLD

SEQ ID NO: 5021 - protein, 7 aa, Mycobacterium avium
APLGPSE

SEQ ID NO: 5022 - protein, 5 aa, Mycobacterium avium
APLPG

SEQ ID NO: 5023 - protein, 68 aa, Mycobacterium avium
APLPPPLPRTAGRAGRQSGGNTRARARHHGSGQRYASLGANSGANPAASSRAGQRQPRRARALEGQRY

SEQ ID NO: 5024 - protein, 6 aa, Mycobacterium avium
APLRDD

SEQ ID NO: 5025 - protein, 11 aa, Mycobacterium avium
APNTPPLPGDV

SEQ ID NO: 5026 - protein, 6 aa, Mycobacterium avium
APPGMN

SEQ ID NO: 5027 - protein, 4 aa, Mycobacterium avium
APPT

SEQ ID NO: 5028 - protein, 6 aa, Mycobacterium avium
APPVAR

SEQ ID NO: 5029 - protein, 16 aa, Mycobacterium avium
APQSDGTLRGTETETV

SEQ ID NO: 5030 - protein, 10 aa, Mycobacterium avium
APRAEPGLGT

SEQ ID NO: 5031 - protein, 9 aa, Mycobacterium avium
APRPPRDGW

SEQ ID NO: 5032 - protein, 8 aa, Mycobacterium avium
APRRGEGV

SEQ ID NO: 5033 - protein, 12 aa, Mycobacterium avium
APSKSYGGSPAW

SEQ ID NO: 5034 - protein, 5 aa, Mycobacterium avium
APSNL

SEQ ID NO: 5035 - protein, 4 aa, Mycobacterium avium
APSQ

SEQ ID NO: 5036 - protein, 12 aa, Mycobacterium avium
APSSRAARAGDG

SEQ ID NO: 5037 - protein, 9 aa, Mycobacterium avium
APSYEEQHR

SEQ ID NO: 5038 - protein, 6 aa, Mycobacterium avium
APTAAL

SEQ ID NO: 5039 - protein, 5 aa, Mycobacterium avium
APTTL

SEQ ID NO: 5040 - protein, 6 aa, Mycobacterium avium
APVAQS

SEQ ID NO: 5041 - protein, 9 aa, Mycobacterium avium
APWDAQPGY

SEQ ID NO: 5042 - protein, 5 aa, Mycobacterium avium
APYPQ

SEQ ID NO: 5043 - protein, 8 aa, Mycobacterium avium
AQAATVSA

SEQ ID NO: 5044 - protein, 8 aa, Mycobacterium avium
AQADYEEA

SEQ ID NO: 5045 - protein, 10 aa, Mycobacterium avium
AQDPGTGAVD

SEQ ID NO: 5046 - protein, 11 aa, Mycobacterium avium
AQDTTGSLTNR

SEQ ID NO: 5047 - protein, 8 aa, Mycobacterium avium
AQGNSDSL

SEQ ID NO: 5048 - protein, 13 aa, Mycobacterium avium
AQLTSQLGERDQA

SEQ ID NO: 5049 - protein, 77 aa, Mycobacterium avium
AQNKSDKSVTTPAPTLSTTPAPPPPSVTAEPAPPPADIPVPSTSDTNPPAETETPMTTTPRATPQAAPPAHPLPPRR

SEQ ID NO: 5050 - protein, 4 aa, Mycobacterium avium
AQQP

SEQ ID NO: 5051 - protein, 33 aa, Mycobacterium avium
AQQQAPAGQPAPAGQPATGQPSAPVAAPPGPSI

SEQ ID NO: 5052 - protein, 16 aa, Mycobacterium avium
AQRPSFRTDEANSTHR

SEQ ID NO: 5053 - protein, 21 aa, Mycobacterium avium
ARADPADWQDPRQQRRRNDYA

SEQ ID NO: 5054 - protein, 5 aa, Mycobacterium avium
ARAGD

SEQ ID NO: 5055 - protein, 14 aa, Mycobacterium avium
ARAQEVKKAVDAGE

SEQ ID NO: 5056 - protein, 5 aa, Mycobacterium avium
ARATR

SEQ ID NO: 5057 - protein, 8 aa, Mycobacterium avium
ARGARSRD

SEQ ID NO: 5058 - protein, 6 aa, Mycobacterium avium
ARGLDD

SEQ ID NO: 5059 - protein, 13 aa, Mycobacterium avium
ARNRRAAAEQTRP

SEQ ID NO: 5060 - protein, 14 aa, Mycobacterium avium
ARPAPGAHQTRDSL

SEQ ID NO: 5061 - protein, 74 aa, Mycobacterium avium
ARPPAPGHGPFGGHGPFGGGHGPFGGHGPFGGHGPFGGGHGPFGGHGPFGGGHGPFGGHGPFGGGHGFGGGHGH

SEQ ID NO: 5062 - protein, 20 aa, Mycobacterium avium
ARPSGGRKRGEAGRGGPPPS

SEQ ID NO: 5063 - protein, 15 aa, Mycobacterium avium
ARRADSTAAEANSAL

SEQ ID NO: 5064 - protein, 6 aa, Mycobacterium avium
ARRAGR

SEQ ID NO: 5065 - protein, 12 aa, Mycobacterium avium
ARRGSSSPARTY

SEQ ID NO: 5066 - protein, 39 aa, Mycobacterium avium
ARRRGRRADRLPDPAAAAAPQVADQHHEDQRRESDQKPV

SEQ ID NO: 5067 - protein, 8 aa, Mycobacterium avium
ARRTPDRA

SEQ ID NO: 5068 - protein, 11 aa, Mycobacterium avium
ARSGGALSSVS

SEQ ID NO: 5069 - protein, 10 aa, Mycobacterium avium
ARSPEGRGVR

SEQ ID NO: 5070 - protein, 7 aa, Mycobacterium avium
ARSPRTG

SEQ ID NO: 5071 - protein, 4 aa, Mycobacterium avium
ARTL

SEQ ID NO: 5072 - protein, 9 aa, Mycobacterium avium
ARTRGPFQG

SEQ ID NO: 5073 - protein, 6 aa, Mycobacterium avium
ARYPDQ

SEQ ID NO: 5074 - protein, 5 aa, Mycobacterium avium
ASAAA

SEQ ID NO: 5075 - protein, 34 aa, Mycobacterium avium
ASADGAGVPPAAPRKPVTIPTTEPPPKAPPPQTV

SEQ ID NO: 5076 - protein, 20 aa, Mycobacterium avium
ASADSAAMAARQETAATAYT

SEQ ID NO: 5077 - protein, 8 aa, Mycobacterium avium
ASADSAAV

SEQ ID NO: 5078 - protein, 5 aa, Mycobacterium avium
ASAPV

SEQ ID NO: 5079 - protein, 5 aa, Mycobacterium avium
ASEAA

SEQ ID NO: 5080 - protein, 5 aa, Mycobacterium avium
ASEAP

SEQ ID NO: 5081 - protein, 8 aa, Mycobacterium avium
ASEDTSGA

SEQ ID NO: 5082 - protein, 7 aa, Mycobacterium avium
ASESAKV

SEQ ID NO: 5083 - protein, 8 aa, Mycobacterium avium
ASGAAAGL

SEQ ID NO: 5084 - protein, 8 aa, Mycobacterium avium
ASGASRAR

SEQ ID NO: 5085 - protein, 17 aa, Mycobacterium avium
ASGEPAGAGEVGEIQAR

SEQ ID NO: 5086 - protein, 8 aa, Mycobacterium avium
ASGRRRTQ

SEQ ID NO: 5087 - protein, 6 aa, Mycobacterium avium
ASIPGM

SEQ ID NO: 5088 - protein, 5 aa, Mycobacterium avium
ASLAP

SEQ ID NO: 5089 - protein, 5 aa, Mycobacterium avium
ASLPR

SEQ ID NO: 5090 - protein, 7 aa, Mycobacterium avium
ASNDTKL

SEQ ID NO: 5091 - protein, 17 aa, Mycobacterium avium
ASNGPRDEFHNQPTQHA

SEQ ID NO: 5092 - protein, 4 aa, Mycobacterium avium
ASPA

SEQ ID NO: 5093 - protein, 5 aa, Mycobacterium avium
ASPGA

SEQ ID NO: 5094 - protein, 6 aa, Mycobacterium avium
ASPKRT

SEQ ID NO: 5095 - protein, 6 aa, Mycobacterium avium
ASPSGN

SEQ ID NO: 5096 - protein, 6 aa, Mycobacterium avium
ASPSVS

SEQ ID NO: 5097 - protein, 10 aa, Mycobacterium avium
ASRAEGTRAT

SEQ ID NO: 5098 - protein, 10 aa, Mycobacterium avium
ASRDQVAGAG

SEQ ID NO: 5099 - protein, 5 aa, Mycobacterium avium
ASSPI

SEQ ID NO: 5100 - protein, 8 aa, Mycobacterium avium
ASTSFPSG

SEQ ID NO: 5101 - protein, 12 aa, Mycobacterium avium
ATAGAASLAGPL

SEQ ID NO: 5102 - protein, 10 aa, Mycobacterium avium
ATAGAATADR

SEQ ID NO: 5103 - protein, 15 aa, Mycobacterium avium
ATAPGATDEASTAFS

SEQ ID NO: 5104 - protein, 15 aa, Mycobacterium avium
ATAPHREQYSDPEKP

SEQ ID NO: 5105 - protein, 10 aa, Mycobacterium avium
ATARDPADRY

SEQ ID NO: 5106 - protein, 18 aa, Mycobacterium avium
ATATQEGNQWKISSLQQV

SEQ ID NO: 5107 - protein, 11 aa, Mycobacterium avium
ATDDRPAGTEV

SEQ ID NO: 5108 - protein, 10 aa, Mycobacterium avium
ATDQRITSGP

SEQ ID NO: 5109 - protein, 4 aa, Mycobacterium avium
ATDW

SEQ ID NO: 5110 - protein, 20 aa, Mycobacterium avium
ATEPPRPAGSAPRPTGPGRL

SEQ ID NO: 5111 - protein, 5 aa, Mycobacterium avium
ATGAF

SEQ ID NO: 5112 - protein, 8 aa, Mycobacterium avium
ATGANALE

SEQ ID NO: 5113 - protein, 16 aa, Mycobacterium avium
ATGATPPPGPATTGRR

SEQ ID NO: 5114 - protein, 5 aa, Mycobacterium avium
ATGEF

SEQ ID NO: 5115 - protein, 10 aa, Mycobacterium avium
ATGGAPPGAA

SEQ ID NO: 5116 - protein, 7 aa, Mycobacterium avium
ATGGKDL

SEQ ID NO: 5117 - protein, 16 aa, Mycobacterium avium
ATGGPAGVGEAVGRSV

SEQ ID NO: 5118 - protein, 6 aa, Mycobacterium avium
ATGGTV

SEQ ID NO: 5119 - protein, 4 aa, Mycobacterium avium
ATGI

SEQ ID NO: 5120 - protein, 20 aa, Mycobacterium avium
ATGPPLYNPNPSLADPNPPL

SEQ ID NO: 5121 - protein, 10 aa, Mycobacterium avium
ATGRGREDHS

SEQ ID NO: 5122 - protein, 8 aa, Mycobacterium avium
ATGSGKSE

SEQ ID NO: 5123 - protein, 5 aa, Mycobacterium avium
ATGTL

SEQ ID NO: 5124 - protein, 17 aa, Mycobacterium avium
ATNLGGREDVRTATAAP

SEQ ID NO: 5125 - protein, 19 aa, Mycobacterium avium
ATPGVVSATESGRSASGLT

SEQ ID NO: 5126 - protein, 16 aa, Mycobacterium avium
ATPPSNVPAVSAQEAA

SEQ ID NO: 5127 - protein, 7 aa, Mycobacterium avium
ATQDVAD

SEQ ID NO: 5128 - protein, 7 aa, Mycobacterium avium
ATRGRSV

SEQ ID NO: 5129 - protein, 101 aa, Mycobacterium avium
ATSSPAHGPAATTTTTTPSTTTPVTTTTHEPRHHGGGGAPAPTQTVTETVPPSSTDTPTTTEPPSTVTVSPSTETSTVTQTVTEPPRRGPYGGPFGGPFGG

SEQ ID NO: 5130 - protein, 9 aa, Mycobacterium avium
ATSSVDTRT

SEQ ID NO: 5131 - protein, 6 aa, Mycobacterium avium
ATVDED

SEQ ID NO: 5132 - protein, 17 aa, Mycobacterium avium
ATVPGSRRQWERDPHDP

SEQ ID NO: 5133 - protein, 11 aa, Mycobacterium avium
ATYAPDEPALA

SEQ ID NO: 5134 - protein, 11 aa, Mycobacterium avium
AVAGGDTPPPA

SEQ ID NO: 5135 - protein, 9 aa, Mycobacterium avium
AVDAPAQDG

SEQ ID NO: 5136 - protein, 12 aa, Mycobacterium avium
AVDHPDAPGPIT

SEQ ID NO: 5137 - protein, 19 aa, Mycobacterium avium
AVESPKPKPQLPSDSATLR

SEQ ID NO: 5138 - protein, 12 aa, Mycobacterium avium
AVGPAAPKSTLA

SEQ ID NO: 5139 - protein, 13 aa, Mycobacterium avium
AVPDEEEPAPRRP

SEQ ID NO: 5140 - protein, 14 aa, Mycobacterium avium
AVPGSQPPAAPAEP

SEQ ID NO: 5141 - protein, 7 aa, Mycobacterium avium
AVPGSRT

SEQ ID NO: 5142 - protein, 11 aa, Mycobacterium avium
AVQSSAVSDAA

SEQ ID NO: 5143 - protein, 10 aa, Mycobacterium avium
AVRAAGRAPL

SEQ ID NO: 5144 - protein, 10 aa, Mycobacterium avium
AWTSPPAAAA

SEQ ID NO: 5145 - protein, 6 aa, Mycobacterium avium
AYPDTF

SEQ ID NO: 5146 - protein, 13 aa, Mycobacterium avium
AYTGDEDPQTQAK

SEQ ID NO: 5147 - protein, 7 aa, Mycobacterium avium
AYTGGPV

SEQ ID NO: 5148 - protein, 4 aa, Mycobacterium avium
CAAR

SEQ ID NO: 5149 - protein, 9 aa, Mycobacterium avium
CASGASGEF

SEQ ID NO: 5150 - protein, 8 aa, Mycobacterium avium
CGPAPALT

SEQ ID NO: 5151 - protein, 26 aa, Mycobacterium avium
CNPPPKSTGPAGSTASAPAQLGEQVS

SEQ ID NO: 5152 - protein, 10 aa, Mycobacterium avium
CNRSGEPSKV

SEQ ID NO: 5153 - protein, 8 aa, Mycobacterium avium
CRPDGDNA

SEQ ID NO: 5154 - protein, 15 aa, Mycobacterium avium
CTRPGGPAGATQQET

SEQ ID NO: 5155 - protein, 31 aa, Mycobacterium avium
CTSSGCAATGTRLDDATHQTAGGPDGGQTDT

SEQ ID NO: 5156 - protein, 10 aa, Mycobacterium avium
DAAGKPAAVA

SEQ ID NO: 5157 - protein, 8 aa, Mycobacterium avium
DAFGGAPT

SEQ ID NO: 5158 - protein, 15 aa, Mycobacterium avium
DAGRQVESGAHGVAG

SEQ ID NO: 5159 - protein, 7 aa, Mycobacterium avium
DAHRRRD

SEQ ID NO: 5160 - protein, 14 aa, Mycobacterium avium
DAKAELGPLPTPTG

SEQ ID NO: 5161 - protein, 5 aa, Mycobacterium avium
DALRT

SEQ ID NO: 5162 - protein, 13 aa, Mycobacterium avium
DAQPGAARPPVTT

SEQ ID NO: 5163 - protein, 8 aa, Mycobacterium avium
DARDTRAD

SEQ ID NO: 5164 - protein, 4 aa, Mycobacterium avium
DASQ

SEQ ID NO: 5165 - protein, 4 aa, Mycobacterium avium
DAVE

SEQ ID NO: 5166 - protein, 7 aa, Mycobacterium avium
DDADDAA

SEQ ID NO: 5167 - protein, 9 aa, Mycobacterium avium
DDASQSVKA

SEQ ID NO: 5168 - protein, 9 aa, Mycobacterium avium
DDDFGGSPR

SEQ ID NO: 5169 - protein, 4 aa, Mycobacterium avium
DDDP

SEQ ID NO: 5170 - protein, 6 aa, Mycobacterium avium
DDDPAT

SEQ ID NO: 5171 - protein, 94 aa, Mycobacterium avium
DDEPDDQPGATDTVDTAAPAQPVAEPAEPVAEDEPKTPYWSEPEPRWPKSPPQPKRAPGPERSAYPRPLPEPGPSANGTGRRSSGAEDMSPDPM

SEQ ID NO: 5172 - protein, 12 aa, Mycobacterium avium
DDGSGIPESERA

SEQ ID NO: 5173 - protein, 20 aa, Mycobacterium avium
DDGTIGASGFRDGPARHWTS

SEQ ID NO: 5174 - protein, 7 aa, Mycobacterium avium
DDLANGL

SEQ ID NO: 5175 - protein, 9 aa, Mycobacterium avium
DDLPRGVTG

SEQ ID NO: 5176 - protein, 6 aa, Mycobacterium avium
DDNSDT

SEQ ID NO: 5177 - protein, 4 aa, Mycobacterium avium
DDPT

SEQ ID NO: 5178 - protein, 8 aa, Mycobacterium avium
DDQHAGAH

SEQ ID NO: 5179 - protein, 5 aa, Mycobacterium avium
DDRNG

SEQ ID NO: 5180 - protein, 8 aa, Mycobacterium avium
DDRTGLTG

SEQ ID NO: 5181 - protein, 16 aa, Mycobacterium avium
DDSADRPEPGRPRARR

SEQ ID NO: 5182 - protein, 44 aa, Mycobacterium avium
DDSSGLEEPAAEGDEADEEAPAPMPRNASRRRRFDTKTAAAVSA

SEQ ID NO: 5183 - protein, 6 aa, Mycobacterium avium
DDTPRT

SEQ ID NO: 5184 - protein, 4 aa, Mycobacterium avium
DDVS

SEQ ID NO: 5185 - protein, 12 aa, Mycobacterium avium
DDYAPEEFAPGE

SEQ ID NO: 5186 - protein, 5 aa, Mycobacterium avium
DEADR

SEQ ID NO: 5187 - protein, 9 aa, Mycobacterium avium
DEAEGGMGP

SEQ ID NO: 5188 - protein, 8 aa, Mycobacterium avium
DEAEYADR

SEQ ID NO: 5189 - protein, 10 aa, Mycobacterium avium
DEAGPAPQLS

SEQ ID NO: 5190 - protein, 29 aa, Mycobacterium avium
DEAPYAAAKTPPHAPTGQPGATEREYPDK

SEQ ID NO: 5191 - protein, 6 aa, Mycobacterium avium
DEEEDY

SEQ ID NO: 5192 - protein, 7 aa, Mycobacterium avium
DEEGVPR

SEQ ID NO: 5193 - protein, 10 aa, Mycobacterium avium
DELGDSGQAR

SEQ ID NO: 5194 - protein, 5 aa, Mycobacterium avium
DETDA

SEQ ID NO: 5195 - protein, 18 aa, Mycobacterium avium
DETYNGEVSTQKFSGGQV

SEQ ID NO: 5196 - protein, 6 aa, Mycobacterium avium
DEYPDK

SEQ ID NO: 5197 - protein, 5 aa, Mycobacterium avium
DFDQA

SEQ ID NO: 5198 - protein, 5 aa, Mycobacterium avium
DFGPE

SEQ ID NO: 5199 - protein, 6 aa, Mycobacterium avium
DFSEPT

SEQ ID NO: 5200 - protein, 13 aa, Mycobacterium avium
DGAEDDISTPERI

SEQ ID NO: 5201 - protein, 12 aa, Mycobacterium avium
DGAEGGPARRNP

SEQ ID NO: 5202 - protein, 6 aa, Mycobacterium avium
DGARKR

SEQ ID NO: 5203 - protein, 43 aa, Mycobacterium avium
DGAVLGPADLGAARAARDRAQAAAQPGAAPAQPLTPSQDGKAA

SEQ ID NO: 5204 - protein, 7 aa, Mycobacterium avium
DGDGPVT

SEQ ID NO: 5205 - protein, 5 aa, Mycobacterium avium
DGDVE

SEQ ID NO: 5206 - protein, 17 aa, Mycobacterium avium
DGGENKPSNPSDPHDGV

SEQ ID NO: 5207 - protein, 12 aa, Mycobacterium avium
DGGHARGPRRVD

SEQ ID NO: 5208 - protein, 4 aa, Mycobacterium avium
DGIA

SEQ ID NO: 5209 - protein, 10 aa, Mycobacterium avium
DGMPETPAQR

SEQ ID NO: 5210 - protein, 5 aa, Mycobacterium avium
DGNRL

SEQ ID NO: 5211 - protein, 7 aa, Mycobacterium avium
DGPLPPR

SEQ ID NO: 5212 - protein, 5 aa, Mycobacterium avium
DGSVH

SEQ ID NO: 5213 - protein, 16 aa, Mycobacterium avium
DGTLTYDGADPERKKA

SEQ ID NO: 5214 - protein, 4 aa, Mycobacterium avium
DGTR

SEQ ID NO: 5215 - protein, 5 aa, Mycobacterium avium
DGTRD

SEQ ID NO: 5216 - protein, 12 aa, Mycobacterium avium
DGVTGGTVNAGG

SEQ ID NO: 5217 - protein, 10 aa, Mycobacterium avium
DGYSRSGSGF

SEQ ID NO: 5218 - protein, 5 aa, Mycobacterium avium
DHAVT

SEQ ID NO: 5219 - protein, 6 aa, Mycobacterium avium
DHPGRK

SEQ ID NO: 5220 - protein, 39 aa, Mycobacterium avium
DHPNAGDTGYAAAPQAPPGSANYAGPPPAPAPYPPRRSK

SEQ ID NO: 5221 - protein, 9 aa, Mycobacterium avium
DIDKNTSYR

SEQ ID NO: 5222 - protein, 15 aa, Mycobacterium avium
DKDSAAGLEPGTTPY

SEQ ID NO: 5223 - protein, 16 aa, Mycobacterium avium
DKGYGDRGGRAQEGAS

SEQ ID NO: 5224 - protein, 4 aa, Mycobacterium avium
DKPQ

SEQ ID NO: 5225 - protein, 8 aa, Mycobacterium avium
DKRPEVGT

SEQ ID NO: 5226 - protein, 7 aa, Mycobacterium avium
DLNPGGW

SEQ ID NO: 5227 - protein, 10 aa, Mycobacterium avium
DLPANEGYAA

SEQ ID NO: 5228 - protein, 9 aa, Mycobacterium avium
DLPASTRDG

SEQ ID NO: 5229 - protein, 15 aa, Mycobacterium avium
DLRPDQSYPPKPPVG

SEQ ID NO: 5230 - protein, 6 aa, Mycobacterium avium
DLRPDS

SEQ ID NO: 5231 - protein, 7 aa, Mycobacterium avium
DLTNEYA

SEQ ID NO: 5232 - protein, 15 aa, Mycobacterium avium
DLTTDTAGTNTTALN

SEQ ID NO: 5233 - protein, 16 aa, Mycobacterium avium
DNANNKNAAMKTVCGG

SEQ ID NO: 5234 - protein, 10 aa, Mycobacterium avium
DNGKELPQGE

SEQ ID NO: 5235 - protein, 4 aa, Mycobacterium avium
DNGV

SEQ ID NO: 5236 - protein, 11 aa, Mycobacterium avium
DNHSKVTDQQV

SEQ ID NO: 5237 - protein, 7 aa, Mycobacterium avium
DNPLTAK

SEQ ID NO: 5238 - protein, 9 aa, Mycobacterium avium
DNPVSVSGV

SEQ ID NO: 5239 - protein, 6 aa, Mycobacterium avium
DNTTRK

SEQ ID NO: 5240 - protein, 6 aa, Mycobacterium avium
DPAPAI

SEQ ID NO: 5241 - protein, 8 aa, Mycobacterium avium
DPAQQSAT

SEQ ID NO: 5242 - protein, 11 aa, Mycobacterium avium
DPDTGASCPPG

SEQ ID NO: 5243 - protein, 7 aa, Mycobacterium avium
DPGESLS

SEQ ID NO: 5244 - protein, 13 aa, Mycobacterium avium
DPGTGEMDPPAFN

SEQ ID NO: 5245 - protein, 8 aa, Mycobacterium avium
DPHDPASI

SEQ ID NO: 5246 - protein, 4 aa, Mycobacterium avium
DPLG

SEQ ID NO: 5247 - protein, 7 aa, Mycobacterium avium
DPNAGHS

SEQ ID NO: 5248 - protein, 8 aa, Mycobacterium avium
DPPKPRRP

SEQ ID NO: 5249 - protein, 24 aa, Mycobacterium avium
DPRAPAPPAGALSETLGAGRGRPT

SEQ ID NO: 5250 - protein, 6 aa, Mycobacterium avium
DPRDSN

SEQ ID NO: 5251 - protein, 6 aa, Mycobacterium avium
DPRNGC

SEQ ID NO: 5252 - protein, 5 aa, Mycobacterium avium
DPRVT

SEQ ID NO: 5253 - protein, 4 aa, Mycobacterium avium
DPSH

SEQ ID NO: 5254 - protein, 15 aa, Mycobacterium avium
DPTYADPAQSLLPPS

SEQ ID NO: 5255 - protein, 11 aa, Mycobacterium avium
DPYQAPEGYPI

SEQ ID NO: 5256 - protein, 15 aa, Mycobacterium avium
DQARGLGEAAEHTPE

SEQ ID NO: 5257 - protein, 4 aa, Mycobacterium avium
DQDE

SEQ ID NO: 5258 - protein, 23 aa, Mycobacterium avium
DQEPGSDHGAHGEFDDTSHAHSP

SEQ ID NO: 5259 - protein, 16 aa, Mycobacterium avium
DQGDQIADKIVAKIDN

SEQ ID NO: 5260 - protein, 5 aa, Mycobacterium avium
DQGRR

SEQ ID NO: 5261 - protein, 14 aa, Mycobacterium avium
DQKFTPKDMPANAA

SEQ ID NO: 5262 - protein, 9 aa, Mycobacterium avium
DQLGDDYTE

SEQ ID NO: 5263 - protein, 6 aa, Mycobacterium avium
DQPPWT

SEQ ID NO: 5264 - protein, 28 aa, Mycobacterium avium
DQPTSRPRARRRASRAAGPAKSESTQAV

SEQ ID NO: 5265 - protein, 8 aa, Mycobacterium avium
DQRSAQFS

SEQ ID NO: 5266 - protein, 6 aa, Mycobacterium avium
DQTAPH

SEQ ID NO: 5267 - protein, 6 aa, Mycobacterium avium
DQVAER

SEQ ID NO: 5268 - protein, 4 aa, Mycobacterium avium
DRAA

SEQ ID NO: 5269 - protein, 10 aa, Mycobacterium avium
DRDAASGTVR

SEQ ID NO: 5270 - protein, 7 aa, Mycobacterium avium
DRDPASV

SEQ ID NO: 5271 - protein, 7 aa, Mycobacterium avium
DREQAER

SEQ ID NO: 5272 - protein, 4 aa, Mycobacterium avium
DRFP

SEQ ID NO: 5273 - protein, 7 aa, Mycobacterium avium
DRGAGVP

SEQ ID NO: 5274 - protein, 14 aa, Mycobacterium avium
DRGLVRSNNEDSVY

SEQ ID NO: 5275 - protein, 6 aa, Mycobacterium avium
DRGQDW

SEQ ID NO: 5276 - protein, 5 aa, Mycobacterium avium
DRKGW

SEQ ID NO: 5277 - protein, 45 aa, Mycobacterium avium
DRKRTGPQQAPKSAPKSRPAPRKGAKPAGRKPTRNAGRNATRNAG

SEQ ID NO: 5278 - protein, 28 aa, Mycobacterium avium
DRNAEPALPANNDVGPNPTTLPSVNGSD

SEQ ID NO: 5279 - protein, 13 aa, Mycobacterium avium
DRPPRSPDEPRRF

SEQ ID NO: 5280 - protein, 6 aa, Mycobacterium avium
DRRDEA

SEQ ID NO: 5281 - protein, 7 aa, Mycobacterium avium
DRRGYRP

SEQ ID NO: 5282 - protein, 6 aa, Mycobacterium avium
DRSGQV

SEQ ID NO: 5283 - protein, 11 aa, Mycobacterium avium
DRSRAKGPSRW

SEQ ID NO: 5284 - protein, 4 aa, Mycobacterium avium
DRST

SEQ ID NO: 5285 - protein, 6 aa, Mycobacterium avium
DRTEEP

SEQ ID NO: 5286 - protein, 6 aa, Mycobacterium avium
DRTRRQ

SEQ ID NO: 5287 - protein, 17 aa, Mycobacterium avium
DRVTSAPQEHPPGRHDE

SEQ ID NO: 5288 - protein, 9 aa, Mycobacterium avium
DRWPPGRTS

SEQ ID NO: 5289 - protein, 7 aa, Mycobacterium avium
DSAERSY

SEQ ID NO: 5290 - protein, 8 aa, Mycobacterium avium
DSAGEVGA

SEQ ID NO: 5291 - protein, 7 aa, Mycobacterium avium
DSASGLY

SEQ ID NO: 5292 - protein, 10 aa, Mycobacterium avium
DSGGINTGDK

SEQ ID NO: 5293 - protein, 18 aa, Mycobacterium avium
DSNPTHTGLRSAATRGAT

SEQ ID NO: 5294 - protein, 16 aa, Mycobacterium avium
DSQSVGAVPSGHTGST

SEQ ID NO: 5295 - protein, 15 aa, Mycobacterium avium
DSVGADARSRLDEAT

SEQ ID NO: 5296 - protein, 4 aa, Mycobacterium avium
DSWT

SEQ ID NO: 5297 - protein, 9 aa, Mycobacterium avium
DTGAGTGVR

SEQ ID NO: 5298 - protein, 6 aa, Mycobacterium avium
DTGPAA

SEQ ID NO: 5299 - protein, 12 aa, Mycobacterium avium
DTIAGPASPAAN

SEQ ID NO: 5300 - protein, 4 aa, Mycobacterium avium
DTKH

SEQ ID NO: 5301 - protein, 11 aa, Mycobacterium avium
DTPTSHRNTQP

SEQ ID NO: 5302 - protein, 10 aa, Mycobacterium avium
DTQERTGSQV

SEQ ID NO: 5303 - protein, 10 aa, Mycobacterium avium
DTRDSYSGAD

SEQ ID NO: 5304 - protein, 39 aa, Mycobacterium avium
DTTKLANPNTTTASTPPLQDEITTTKPPPPTTPTGPRQV

SEQ ID NO: 5305 - protein, 7 aa, Mycobacterium avium
DTTPESA

SEQ ID NO: 5306 - protein, 10 aa, Mycobacterium avium
DTTQDRRSGY

SEQ ID NO: 5307 - protein, 5 aa, Mycobacterium avium
DVPGM

SEQ ID NO: 5308 - protein, 7 aa, Mycobacterium avium
DVPRTGA

SEQ ID NO: 5309 - protein, 9 aa, Mycobacterium avium
DYAKSIPAS

SEQ ID NO: 5310 - protein, 15 aa, Mycobacterium avium
DYDEPAELDEEHGTA

SEQ ID NO: 5311 - protein, 14 aa, Mycobacterium avium
DYPAAEADYTDYTD

SEQ ID NO: 5312 - protein, 23 aa, Mycobacterium avium
DYPNDGDSDQQSADAAGEPRRRR

SEQ ID NO: 5313 - protein, 15 aa, Mycobacterium avium
EAAATQEDRPQPPID

SEQ ID NO: 5314 - protein, 8 aa, Mycobacterium avium
EAADEEPR

SEQ ID NO: 5315 - protein, 40 aa, Mycobacterium avium
EAEAASRAITQAPQPRVECDPGPQQLPSSPPPNDAVEQDW

SEQ ID NO: 5316 - protein, 9 aa, Mycobacterium avium
EAHGNPNNW

SEQ ID NO: 5317 - protein, 12 aa, Mycobacterium avium
EALSTPDQDRAA

SEQ ID NO: 5318 - protein, 20 aa, Mycobacterium avium
EAPSLSAPGIPNAGAPAPFA

SEQ ID NO: 5319 - protein, 24 aa, Mycobacterium avium
EARGSQQLRPGSTLPLGQSTTPYQ

SEQ ID NO: 5320 - protein, 11 aa, Mycobacterium avium
EARQAGEDRAT

SEQ ID NO: 5321 - protein, 11 aa, Mycobacterium avium
EARQAGESREE

SEQ ID NO: 5322 - protein, 5 aa, Mycobacterium avium
EATRV

SEQ ID NO: 5323 - protein, 5 aa, Mycobacterium avium
EAVRQ

SEQ ID NO: 5324 - protein, 4 aa, Mycobacterium avium
EAVS

SEQ ID NO: 5325 - protein, 6 aa, Mycobacterium avium
ECGAQG

SEQ ID NO: 5326 - protein, 12 aa, Mycobacterium avium
ECTSSEHGREIS

SEQ ID NO: 5327 - protein, 5 aa, Mycobacterium avium
EDDGR

SEQ ID NO: 5328 - protein, 4 aa, Mycobacterium avium
EDKK

SEQ ID NO: 5329 - protein, 15 aa, Mycobacterium avium
EDLGSNASNLNKPQF

SEQ ID NO: 5330 - protein, 5 aa, Mycobacterium avium
EDPEP

SEQ ID NO: 5331 - protein, 22 aa, Mycobacterium avium
EDPKFASSVRGGGFRAPTARRR

SEQ ID NO: 5332 - protein, 4 aa, Mycobacterium avium
EDQD

SEQ ID NO: 5333 - protein, 9 aa, Mycobacterium avium
EDRADPGTL

SEQ ID NO: 5334 - protein, 7 aa, Mycobacterium avium
EDRPSLH

SEQ ID NO: 5335 - protein, 23 aa, Mycobacterium avium
EDSDESRAKLRNRRPTGKGTHRM

SEQ ID NO: 5336 - protein, 8 aa, Mycobacterium avium
EDSEPRRR

SEQ ID NO: 5337 - protein, 17 aa, Mycobacterium avium
EEAKSKNPSAPDPQQRL

SEQ ID NO: 5338 - protein, 13 aa, Mycobacterium avium
EEEPPRPRDTAAV

SEQ ID NO: 5339 - protein, 8 aa, Mycobacterium avium
EENPANKQ

SEQ ID NO: 5340 - protein, 42 aa, Mycobacterium avium
EEPDPAADPIDHQPDPGGPPADEFPGEDFPAGGDHEDAVEPF

SEQ ID NO: 5341 - protein, 7 aa, Mycobacterium avium
EEPIDHT

SEQ ID NO: 5342 - protein, 16 aa, Mycobacterium avium
EEQPQAGAVQAPPGAR

SEQ ID NO: 5343 - protein, 9 aa, Mycobacterium avium
EESKRGFRA

SEQ ID NO: 5344 - protein, 12 aa, Mycobacterium avium
EGAGKPPRATRP

SEQ ID NO: 5345 - protein, 8 aa, Mycobacterium avium
EGAQWDED

SEQ ID NO: 5346 - protein, 14 aa, Mycobacterium avium
EGARRGVGRPAVVA

SEQ ID NO: 5347 - protein, 8 aa, Mycobacterium avium
EGGATGAA

SEQ ID NO: 5348 - protein, 13 aa, Mycobacterium avium
EGQAAPPAPPQSL

SEQ ID NO: 5349 - protein, 16 aa, Mycobacterium avium
EGRDPTDRPSGSDTEG

SEQ ID NO: 5350 - protein, 8 aa, Mycobacterium avium
EGYDTEAA

SEQ ID NO: 5351 - protein, 10 aa, Mycobacterium avium
EHPASPGAGG

SEQ ID NO: 5352 - protein, 10 aa, Mycobacterium avium
EHPDSPGGAL

SEQ ID NO: 5353 - protein, 7 aa, Mycobacterium avium
EHSSPDQ

SEQ ID NO: 5354 - protein, 10 aa, Mycobacterium avium
EIERDGAPAA

SEQ ID NO: 5355 - protein, 11 aa, Mycobacterium avium
EIGTPPYAGRR

SEQ ID NO: 5356 - protein, 8 aa, Mycobacterium avium
EKKSLADR

SEQ ID NO: 5357 - protein, 7 aa, Mycobacterium avium
ELGATGG

SEQ ID NO: 5358 - protein, 34 aa, Mycobacterium avium
ELGEPGIQPGGSPAEDAGGEKTEKPASRSEDGDR

SEQ ID NO: 5359 - protein, 31 aa, Mycobacterium avium
ELGLNGPSSSTSAPQTTTSTAAGSVVKPTRA

SEQ ID NO: 5360 - protein, 16 aa, Mycobacterium avium
ELHGGTAELQNSPLGG

SEQ ID NO: 5361 - protein, 6 aa, Mycobacterium avium
ELPGCP

SEQ ID NO: 5362 - protein, 9 aa, Mycobacterium avium
EMNRRQEAL

SEQ ID NO: 5363 - protein, 6 aa, Mycobacterium avium
ENLGAA

SEQ ID NO: 5364 - protein, 8 aa, Mycobacterium avium
EPAEHGMG

SEQ ID NO: 5365 - protein, 8 aa, Mycobacterium avium
EPAGLPAR

SEQ ID NO: 5366 - protein, 36 aa, Mycobacterium avium
EPEPEAQQRAGQPRRPQPTPAPPADVRRRDPVESRR

SEQ ID NO: 5367 - protein, 20 aa, Mycobacterium avium
EPERKGRSGRKTGAVAPRPK

SEQ ID NO: 5368 - protein, 11 aa, Mycobacterium avium
EPETVAPQGGD

SEQ ID NO: 5369 - protein, 5 aa, Mycobacterium avium
EPGLP

SEQ ID NO: 5370 - protein, 5 aa, Mycobacterium avium
EPIPG

SEQ ID NO: 5371 - protein, 8 aa, Mycobacterium avium
EPNQTEMQ

SEQ ID NO: 5372 - protein, 5 aa, Mycobacterium avium
EPTRG

SEQ ID NO: 5373 - protein, 10 aa, Mycobacterium avium
EPTSNTGPFL

SEQ ID NO: 5374 - protein, 8 aa, Mycobacterium avium
EPVEPRGT

SEQ ID NO: 5375 - protein, 15 aa, Mycobacterium avium
EQDSDADEPPEAADG

SEQ ID NO: 5376 - protein, 16 aa, Mycobacterium avium
EQDTQNGAHPTEPGKG

SEQ ID NO: 5377 - protein, 11 aa, Mycobacterium avium
EQPAPGSPDEI

SEQ ID NO: 5378 - protein, 9 aa, Mycobacterium avium
EQPETPEMS

SEQ ID NO: 5379 - protein, 29 aa, Mycobacterium avium
EQTNPTRPPRRPVPPRRPARPPSTPPEER

SEQ ID NO: 5380 - protein, 14 aa, Mycobacterium avium
ERAENTGRADELVS

SEQ ID NO: 5381 - protein, 6 aa, Mycobacterium avium
ERDGEG

SEQ ID NO: 5382 - protein, 5 aa, Mycobacterium avium
ERDGG

SEQ ID NO: 5383 - protein, 7 aa, Mycobacterium avium
ERDTGKK

SEQ ID NO: 5384 - protein, 14 aa, Mycobacterium avium
ERGPRLGPPPAMPP

SEQ ID NO: 5385 - protein, 5 aa, Mycobacterium avium
ERGQA

SEQ ID NO: 5386 - protein, 11 aa, Mycobacterium avium
ERGTELGGQER

SEQ ID NO: 5387 - protein, 5 aa, Mycobacterium avium
ERGTP

SEQ ID NO: 5388 - protein, 12 aa, Mycobacterium avium
ERHDGASREIDR

SEQ ID NO: 5389 - protein, 11 aa, Mycobacterium avium
ERNGENPRDTP

SEQ ID NO: 5390 - protein, 4 aa, Mycobacterium avium
ERPH

SEQ ID NO: 5391 - protein, 5 aa, Mycobacterium avium
ERWSA

SEQ ID NO: 5392 - protein, 4 aa, Mycobacterium avium
ERYG

SEQ ID NO: 5393 - protein, 7 aa, Mycobacterium avium
ESAAADW

SEQ ID NO: 5394 - protein, 10 aa, Mycobacterium avium
ESAITGESAP

SEQ ID NO: 5395 - protein, 12 aa, Mycobacterium avium
ESEDARAGGTKT

SEQ ID NO: 5396 - protein, 8 aa, Mycobacterium avium
ESGKEHKG

SEQ ID NO: 5397 - protein, 6 aa, Mycobacterium avium
ESISPQ

SEQ ID NO: 5398 - protein, 8 aa, Mycobacterium avium
ESQRRQRA

SEQ ID NO: 5399 - protein, 7 aa, Mycobacterium avium
ESYDGDV

SEQ ID NO: 5400 - protein, 8 aa, Mycobacterium avium
ESYPDGMP

SEQ ID NO: 5401 - protein, 4 aa, Mycobacterium avium
ESYT

SEQ ID NO: 5402 - protein, 11 aa, Mycobacterium avium
ETAIPSNVTAT

SEQ ID NO: 5403 - protein, 21 aa, Mycobacterium avium
ETSHDRRAAARARRERAELDA

SEQ ID NO: 5404 - protein, 12 aa, Mycobacterium avium
ETTDGLTDCDGH

SEQ ID NO: 5405 - protein, 7 aa, Mycobacterium avium
ETVEGRG

SEQ ID NO: 5406 - protein, 10 aa, Mycobacterium avium
ETYDEDGPAG

SEQ ID NO: 5407 - protein, 6 aa, Mycobacterium avium
EVAPGK

SEQ ID NO: 5408 - protein, 15 aa, Mycobacterium avium
EVRDTTEPAARRRNS

SEQ ID NO: 5409 - protein, 7 aa, Mycobacterium avium
EVRPEAA

SEQ ID NO: 5410 - protein, 14 aa, Mycobacterium avium
EVSGRLGNKPDSAT

SEQ ID NO: 5411 - protein, 11 aa, Mycobacterium avium
EYASGTPWSRT

SEQ ID NO: 5412 - protein, 7 aa, Mycobacterium avium
EYDPEFD

SEQ ID NO: 5413 - protein, 4 aa, Mycobacterium avium
EYTA

SEQ ID NO: 5414 - protein, 8 aa, Mycobacterium avium
FASGNPAT

SEQ ID NO: 5415 - protein, 26 aa, Mycobacterium avium
FDDATAQPEPEPAAWAPDDDAQAALQ

SEQ ID NO: 5416 - protein, 8 aa, Mycobacterium avium
FDRNKSRP

SEQ ID NO: 5417 - protein, 11 aa, Mycobacterium avium
FEGEPQPERAY

SEQ ID NO: 5418 - protein, 8 aa, Mycobacterium avium
FEQRSKPF

SEQ ID NO: 5419 - protein, 31 aa, Mycobacterium avium
FGPPPGISTTPAPSTSRRTPTSPAAPPGTEL

SEQ ID NO: 5420 - protein, 8 aa, Mycobacterium avium
FGQAQNQA

SEQ ID NO: 5421 - protein, 7 aa, Mycobacterium avium
FGSAASA

SEQ ID NO: 5422 - protein, 4 aa, Mycobacterium avium
FGST

SEQ ID NO: 5423 - protein, 7 aa, Mycobacterium avium
FGSTEGG

SEQ ID NO: 5424 - protein, 10 aa, Mycobacterium avium
FPATQTYADG

SEQ ID NO: 5425 - protein, 55 aa, Mycobacterium avium
FPDPNGTRFPNGAPPPAPPVLEGTPDHPGPAVPPGSPCSYTPAADGLPRPDNPLP

SEQ ID NO: 5426 - protein, 19 aa, Mycobacterium avium
FPEVGSERQDLRQYPGGSL

SEQ ID NO: 5427 - protein, 7 aa, Mycobacterium avium
FPGGTVD

SEQ ID NO: 5428 - protein, 8 aa, Mycobacterium avium
FPNNTESR

SEQ ID NO: 5429 - protein, 4 aa, Mycobacterium avium
FQPP

SEQ ID NO: 5430 - protein, 12 aa, Mycobacterium avium
FRQPGDVGLTPA

SEQ ID NO: 5431 - protein, 27 aa, Mycobacterium avium
FSGGRFGADPPGSRRESIQSTLGETHM

SEQ ID NO: 5432 - protein, 25 aa, Mycobacterium avium
FSPDGDADNPGTAGQAIDGDPSTAW

SEQ ID NO: 5433 - protein, 11 aa, Mycobacterium avium
FSPTAPTGAID

SEQ ID NO: 5434 - protein, 7 aa, Mycobacterium avium
FSTSDPH

SEQ ID NO: 5435 - protein, 7 aa, Mycobacterium avium
FSTTPTT

SEQ ID NO: 5436 - protein, 7 aa, Mycobacterium avium
FTAGPAF

SEQ ID NO: 5437 - protein, 5 aa, Mycobacterium avium
GAAAA

SEQ ID NO: 5438 - protein, 8 aa, Mycobacterium avium
GAAAELDD

SEQ ID NO: 5439 - protein, 6 aa, Mycobacterium avium
GAADRQ

SEQ ID NO: 5440 - protein, 17 aa, Mycobacterium avium
GAAGAVASGRPGRPGGR

SEQ ID NO: 5441 - protein, 8 aa, Mycobacterium avium
GAAGGLAG

SEQ ID NO: 5442 - protein, 5 aa, Mycobacterium avium
GAAGN

SEQ ID NO: 5443 - protein, 7 aa, Mycobacterium avium
GADGYTD

SEQ ID NO: 5444 - protein, 8 aa, Mycobacterium avium
GADPDGAH

SEQ ID NO: 5445 - protein, 37 aa, Mycobacterium avium
GADPEEANRRFREQREAQQRSHKSDRADEPEDLGEPV

SEQ ID NO: 5446 - protein, 6 aa, Mycobacterium avium
GAEFDD

SEQ ID NO: 5447 - protein, 12 aa, Mycobacterium avium
GAEVVNGNGEKI

SEQ ID NO: 5448 - protein, 15 aa, Mycobacterium avium
GAEWGADGAGRAEQV

SEQ ID NO: 5449 - protein, 7 aa, Mycobacterium avium
GAGARIQ

SEQ ID NO: 5450 - protein, 6 aa, Mycobacterium avium
GAGFGR

SEQ ID NO: 5451 - protein, 5 aa, Mycobacterium avium
GAGGL

SEQ ID NO: 5452 - protein, 5 aa, Mycobacterium avium
GAGGM

SEQ ID NO: 5453 - protein, 8 aa, Mycobacterium avium
GAGPTTAA

SEQ ID NO: 5454 - protein, 4 aa, Mycobacterium avium
GAGR

SEQ ID NO: 5455 - protein, 9 aa, Mycobacterium avium
GAGSDNTVT

SEQ ID NO: 5456 - protein, 12 aa, Mycobacterium avium
GAGVSLQVDRLA

SEQ ID NO: 5457 - protein, 5 aa, Mycobacterium avium
GAHGR

SEQ ID NO: 5458 - protein, 5 aa, Mycobacterium avium
GAITG

SEQ ID NO: 5459 - protein, 10 aa, Mycobacterium avium
GALPAEPDQD

SEQ ID NO: 5460 - protein, 5 aa, Mycobacterium avium
GANDL

SEQ ID NO: 5461 - protein, 5 aa, Mycobacterium avium
GAPAA

SEQ ID NO: 5462 - protein, 17 aa, Mycobacterium avium
GAPAALADSVRNGDTQV

SEQ ID NO: 5463 - protein, 10 aa, Mycobacterium avium
GAPAPGAPPL

SEQ ID NO: 5464 - protein, 7 aa, Mycobacterium avium
GAPETRV

SEQ ID NO: 5465 - protein, 4 aa, Mycobacterium avium
GAPG

SEQ ID NO: 5466 - protein, 9 aa, Mycobacterium avium
GAPGAPGLD

SEQ ID NO: 5467 - protein, 6 aa, Mycobacterium avium
GAPGSF

SEQ ID NO: 5468 - protein, 5 aa, Mycobacterium avium
GAPLG

SEQ ID NO: 5469 - protein, 17 aa, Mycobacterium avium
GAPPSGEPPAGSGAAAR

SEQ ID NO: 5470 - protein, 6 aa, Mycobacterium avium
GAPRPG

SEQ ID NO: 5471 - protein, 10 aa, Mycobacterium avium
GAPRSGKSTA

SEQ ID NO: 5472 - protein, 23 aa, Mycobacterium avium
GAQYASGAAPTAAAAAAVETPTE

SEQ ID NO: 5473 - protein, 18 aa, Mycobacterium avium
GARAPGVAAAGRALAASA

SEQ ID NO: 5474 - protein, 9 aa, Mycobacterium avium
GAREISAGN

SEQ ID NO: 5475 - protein, 7 aa, Mycobacterium avium
GASARVA

SEQ ID NO: 5476 - protein, 14 aa, Mycobacterium avium
GATGEFKDTYTKAS

SEQ ID NO: 5477 - protein, 5 aa, Mycobacterium avium
GAVGP

SEQ ID NO: 5478 - protein, 12 aa, Mycobacterium avium
GAWEGPSAAQYA

SEQ ID NO: 5479 - protein, 10 aa, Mycobacterium avium
GAWEGPSAEQ

SEQ ID NO: 5480 - protein, 16 aa, Mycobacterium avium
GAWSSLSTEYAAAASE

SEQ ID NO: 5481 - protein, 6 aa, Mycobacterium avium
GCGKTA

SEQ ID NO: 5482 - protein, 8 aa, Mycobacterium avium
GDAGPGGL

SEQ ID NO: 5483 - protein, 8 aa, Mycobacterium avium
GDAGPGSA

SEQ ID NO: 5484 - protein, 10 aa, Mycobacterium avium
GDDSGTRQIP

SEQ ID NO: 5485 - protein, 6 aa, Mycobacterium avium
GDEIDQ

SEQ ID NO: 5486 - protein, 7 aa, Mycobacterium avium
GDEPTSY

SEQ ID NO: 5487 - protein, 6 aa, Mycobacterium avium
GDGDRA

SEQ ID NO: 5488 - protein, 4 aa, Mycobacterium avium
GDGP

SEQ ID NO: 5489 - protein, 9 aa, Mycobacterium avium
GDLPARPGL

SEQ ID NO: 5490 - protein, 9 aa, Mycobacterium avium
GDNLAHPKA

SEQ ID NO: 5491 - protein, 11 aa, Mycobacterium avium
GDPADSEIDRR

SEQ ID NO: 5492 - protein, 44 aa, Mycobacterium avium
GDPDTGVGPTLSGRGGAKAPAATIPAAGAAAPARAEARARRRRR

SEQ ID NO: 5493 - protein, 10 aa, Mycobacterium avium
GDPIGDPRAW

SEQ ID NO: 5494 - protein, 7 aa, Mycobacterium avium
GDPRRGH

SEQ ID NO: 5495 - protein, 9 aa, Mycobacterium avium
GDPYTRKAG

SEQ ID NO: 5496 - protein, 11 aa, Mycobacterium avium
GDQTYGRDRTS

SEQ ID NO: 5497 - protein, 5 aa, Mycobacterium avium
GDRFD

SEQ ID NO: 5498 - protein, 7 aa, Mycobacterium avium
GDRFDGG

SEQ ID NO: 5499 - protein, 5 aa, Mycobacterium avium
GDRPV

SEQ ID NO: 5500 - protein, 7 aa, Mycobacterium avium
GDRSDQI

SEQ ID NO: 5501 - protein, 6 aa, Mycobacterium avium
GDTIGR

SEQ ID NO: 5502 - protein, 9 aa, Mycobacterium avium
GDTSAGEMR

SEQ ID NO: 5503 - protein, 6 aa, Mycobacterium avium
GDVKDE

SEQ ID NO: 5504 - protein, 24 aa, Mycobacterium avium
GDWAPSADGAAAGSDGTEGRNSTD

SEQ ID NO: 5505 - protein, 10 aa, Mycobacterium avium
GDWDGPTAGA

SEQ ID NO: 5506 - protein, 10 aa, Mycobacterium avium
GEAQAPRKEP

SEQ ID NO: 5507 - protein, 8 aa, Mycobacterium avium
GECNRGQQ

SEQ ID NO: 5508 - protein, 4 aa, Mycobacterium avium
GEGA

SEQ ID NO: 5509 - protein, 5 aa, Mycobacterium avium
GEGNF

SEQ ID NO: 5510 - protein, 8 aa, Mycobacterium avium
GELPDGRR

SEQ ID NO: 5511 - protein, 22 aa, Mycobacterium avium
GEPGGPSAAKVRTRTVTARGAP

SEQ ID NO: 5512 - protein, 13 aa, Mycobacterium avium
GEPWPPPAPEPAF

SEQ ID NO: 5513 - protein, 8 aa, Mycobacterium avium
GEQAAAAA

SEQ ID NO: 5514 - protein, 10 aa, Mycobacterium avium
GEQEKGASPV

SEQ ID NO: 5515 - protein, 5 aa, Mycobacterium avium
GEQLR

SEQ ID NO: 5516 - protein, 8 aa, Mycobacterium avium
GEQPTGRP

SEQ ID NO: 5517 - protein, 11 aa, Mycobacterium avium
GESFEPQYESL

SEQ ID NO: 5518 - protein, 12 aa, Mycobacterium avium
GESVMASEAQRE

SEQ ID NO: 5519 - protein, 11 aa, Mycobacterium avium
GETARQRARKK

SEQ ID NO: 5520 - protein, 11 aa, Mycobacterium avium
GETPLEATGRG

SEQ ID NO: 5521 - protein, 4 aa, Mycobacterium avium
GEVA

SEQ ID NO: 5522 - protein, 4 aa, Mycobacterium avium
GFTT

SEQ ID NO: 5523 - protein, 8 aa, Mycobacterium avium
GGAAARQP

SEQ ID NO: 5524 - protein, 11 aa, Mycobacterium avium
GGAGLGLRSGG

SEQ ID NO: 5525 - protein, 9 aa, Mycobacterium avium
GGERISPQR

SEQ ID NO: 5526 - protein, 8 aa, Mycobacterium avium
GGGGVHGR

SEQ ID NO: 5527 - protein, 7 aa, Mycobacterium avium
GGGLNKD

SEQ ID NO: 5528 - protein, 13 aa, Mycobacterium avium
GGGRYPVDGTQVH

SEQ ID NO: 5529 - protein, 11 aa, Mycobacterium avium
GGGSPQNGPVA

SEQ ID NO: 5530 - protein, 7 aa, Mycobacterium avium
GGINPGN

SEQ ID NO: 5531 - protein, 19 aa, Mycobacterium avium
GGKTAFCGPPDQVEPALGT

SEQ ID NO: 5532 - protein, 9 aa, Mycobacterium avium
GGNGSGKST

SEQ ID NO: 5533 - protein, 5 aa, Mycobacterium avium
GGNLA

SEQ ID NO: 5534 - protein, 6 aa, Mycobacterium avium
GGPAVG

SEQ ID NO: 5535 - protein, 41 aa, Mycobacterium avium
GGPDAAPPPPGVTAAGPPNAYDESNPPSPPWFSRPTPPGPG

SEQ ID NO: 5536 - protein, 24 aa, Mycobacterium avium
GGPFEGTGSAPDDAGDGSAWSAAN

SEQ ID NO: 5537 - protein, 10 aa, Mycobacterium avium
GGPKSGKSTA

SEQ ID NO: 5538 - protein, 6 aa, Mycobacterium avium
GGPTQY

SEQ ID NO: 5539 - protein, 14 aa, Mycobacterium avium
GGQGPTPPSESQPL

SEQ ID NO: 5540 - protein, 9 aa, Mycobacterium avium
GGQPGTNGL

SEQ ID NO: 5541 - protein, 8 aa, Mycobacterium avium
GGQTHGQA

SEQ ID NO: 5542 - protein, 8 aa, Mycobacterium avium
GGRGDGWR

SEQ ID NO: 5543 - protein, 8 aa, Mycobacterium avium
GGRGNSPL

SEQ ID NO: 5544 - protein, 5 aa, Mycobacterium avium
GGSAA

SEQ ID NO: 5545 - protein, 4 aa, Mycobacterium avium
GGSH

SEQ ID NO: 5546 - protein, 10 aa, Mycobacterium avium
GGSPSGAARA

SEQ ID NO: 5547 - protein, 6 aa, Mycobacterium avium
GGSRAI

SEQ ID NO: 5548 - protein, 9 aa, Mycobacterium avium
GGTAATYKD

SEQ ID NO: 5549 - protein, 8 aa, Mycobacterium avium
GGTSLTRT

SEQ ID NO: 5550 - protein, 5 aa, Mycobacterium avium
GHEGE

SEQ ID NO: 5551 - protein, 8 aa, Mycobacterium avium
GHNGGPYA

SEQ ID NO: 5552 - protein, 4 aa, Mycobacterium avium
GHRQ

SEQ ID NO: 5553 - protein, 15 aa, Mycobacterium avium
GHTASPAGSISTPVD

SEQ ID NO: 5554 - protein, 4 aa, Mycobacterium avium
GIAA

SEQ ID NO: 5555 - protein, 11 aa, Mycobacterium avium
GIASGNDAVKH

SEQ ID NO: 5556 - protein, 12 aa, Mycobacterium avium
GIDPATLRGSAT

SEQ ID NO: 5557 - protein, 7 aa, Mycobacterium avium
GIGDDTQ

SEQ ID NO: 5558 - protein, 15 aa, Mycobacterium avium
GIGPARLEKLRALVR

SEQ ID NO: 5559 - protein, 5 aa, Mycobacterium avium
GIGQA

SEQ ID NO: 5560 - protein, 5 aa, Mycobacterium avium
GIPAG

SEQ ID NO: 5561 - protein, 9 aa, Mycobacterium avium
GKDPNGSDI

SEQ ID NO: 5562 - protein, 78 aa, Mycobacterium avium
GKDTTKTAEPADDDGAAADTGAVPDGAPEADDEQDQQVTDEPTKASQKASKKASTKASKKESKKAPKDKPKDGSSHSR

SEQ ID NO: 5563 - protein, 7 aa, Mycobacterium avium
GKPGGVR

SEQ ID NO: 5564 - protein, 20 aa, Mycobacterium avium
GKPSRYRSEPQRQHLAAVPA

SEQ ID NO: 5565 - protein, 6 aa, Mycobacterium avium
GKSRPV

SEQ ID NO: 5566 - protein, 7 aa, Mycobacterium avium
GKSSNVG

SEQ ID NO: 5567 - protein, 12 aa, Mycobacterium avium
GKTIGAQSRAAI

SEQ ID NO: 5568 - protein, 14 aa, Mycobacterium avium
GKYSSSRGPSFSSY

SEQ ID NO: 5569 - protein, 9 aa, Mycobacterium avium
GLAGDSAKI

SEQ ID NO: 5570 - protein, 4 aa, Mycobacterium avium
GLDE

SEQ ID NO: 5571 - protein, 11 aa, Mycobacterium avium
GLGGAAPGLPG

SEQ ID NO: 5572 - protein, 7 aa, Mycobacterium avium
GLGGGNY

SEQ ID NO: 5573 - protein, 6 aa, Mycobacterium avium
GLGGKF

SEQ ID NO: 5574 - protein, 52 aa, Mycobacterium avium
GLGGPGFGGPPGHGGGDGGGHGGGGFPGFPGGGGHGGGGFPGFGGGHGGFGH

SEQ ID NO: 5575 - protein, 9 aa, Mycobacterium avium
GLGPPKAVT

SEQ ID NO: 5576 - protein, 22 aa, Mycobacterium avium
GLPPDQAPGRVAAAAPQAEGAP

SEQ ID NO: 5577 - protein, 8 aa, Mycobacterium avium
GLQPGGPV

SEQ ID NO: 5578 - protein, 6 aa, Mycobacterium avium
GLRPDA

SEQ ID NO: 5579 - protein, 7 aa, Mycobacterium avium
GLSDCDA

SEQ ID NO: 5580 - protein, 8 aa, Mycobacterium avium
GLSPAGEQ

SEQ ID NO: 5581 - protein, 6 aa, Mycobacterium avium
GLSPNG

SEQ ID NO: 5582 - protein, 9 aa, Mycobacterium avium
GLSSGQAEV

SEQ ID NO: 5583 - protein, 13 aa, Mycobacterium avium
GLTEPRAAAGDGA

SEQ ID NO: 5584 - protein, 8 aa, Mycobacterium avium
GMGPATET

SEQ ID NO: 5585 - protein, 9 aa, Mycobacterium avium
GMQGTDVQP

SEQ ID NO: 5586 - protein, 17 aa, Mycobacterium avium
GNGDGAGLTNGLPDEHQ

SEQ ID NO: 5587 - protein, 24 aa, Mycobacterium avium
GNGLRGGSAGLADMSGAADDMRAG

SEQ ID NO: 5588 - protein, 18 aa, Mycobacterium avium
GNGPGSKIRDGAHIPEDK

SEQ ID NO: 5589 - protein, 5 aa, Mycobacterium avium
GNIGG

SEQ ID NO: 5590 - protein, 6 aa, Mycobacterium avium
GNPDGP

SEQ ID NO: 5591 - protein, 12 aa, Mycobacterium avium
GNPQDSGKIRGQ

SEQ ID NO: 5592 - protein, 11 aa, Mycobacterium avium
GNTSAAGGGTI

SEQ ID NO: 5593 - protein, 7 aa, Mycobacterium avium
GNVEEPD

SEQ ID NO: 5594 - protein, 13 aa, Mycobacterium avium
GNVVSDGPAPLDQ

SEQ ID NO: 5595 - protein, 18 aa, Mycobacterium avium
GPAAQAAPCAGAGSNPVS

SEQ ID NO: 5596 - protein, 6 aa, Mycobacterium avium
GPALSR

SEQ ID NO: 5597 - protein, 5 aa, Mycobacterium avium
GPATA

SEQ ID NO: 5598 - protein, 5 aa, Mycobacterium avium
GPDAS

SEQ ID NO: 5599 - protein, 8 aa, Mycobacterium avium
GPDPAALA

SEQ ID NO: 5600 - protein, 19 aa, Mycobacterium avium
GPELSRPNASVARDTVAGA

SEQ ID NO: 5601 - protein, 5 aa, Mycobacterium avium
GPEST

SEQ ID NO: 5602 - protein, 29 aa, Mycobacterium avium
GPEVTDRPMESAASSAGPGTGSGAPRPVA

SEQ ID NO: 5603 - protein, 56 aa, Mycobacterium avium
GPGAGAAATNIQPTEGGAPAASPPANAPAPAVTPGSAPPVAAPPVPDGSVTLSPAK

SEQ ID NO: 5604 - protein, 5 aa, Mycobacterium avium
GPGRY

SEQ ID NO: 5605 - protein, 27 aa, Mycobacterium avium
GPKGADGKPSKQAISDSAVSETWGDQI

SEQ ID NO: 5606 - protein, 13 aa, Mycobacterium avium
GPLRPDTAPRPPA

SEQ ID NO: 5607 - protein, 13 aa, Mycobacterium avium
GPPGPPPPGPPPM

SEQ ID NO: 5608 - protein, 8 aa, Mycobacterium avium
GPPSPRRR

SEQ ID NO: 5609 - protein, 4 aa, Mycobacterium avium
GPRH

SEQ ID NO: 5610 - protein, 7 aa, Mycobacterium avium
GPRPPLR

SEQ ID NO: 5611 - protein, 6 aa, Mycobacterium avium
GPSGVR

SEQ ID NO: 5612 - protein, 8 aa, Mycobacterium avium
GPTDHVSP

SEQ ID NO: 5613 - protein, 5 aa, Mycobacterium avium
GPTGI

SEQ ID NO: 5614 - protein, 11 aa, Mycobacterium avium
GPTPQQPAGPF

SEQ ID NO: 5615 - protein, 15 aa, Mycobacterium avium
GPVTPRAVAGEPGVT

SEQ ID NO: 5616 - protein, 25 aa, Mycobacterium avium
GPYSGYPADTDMPVSARGSCGKPFD

SEQ ID NO: 5617 - protein, 10 aa, Mycobacterium avium
GQADEIAPGV

SEQ ID NO: 5618 - protein, 6 aa, Mycobacterium avium
GQGGAL

SEQ ID NO: 5619 - protein, 15 aa, Mycobacterium avium
GQGPFGPVPDGFPAP

SEQ ID NO: 5620 - protein, 6 aa, Mycobacterium avium
GQPFDP

SEQ ID NO: 5621 - protein, 6 aa, Mycobacterium avium
GQPGGL

SEQ ID NO: 5622 - protein, 10 aa, Mycobacterium avium
GQPSPDDGFA

SEQ ID NO: 5623 - protein, 5 aa, Mycobacterium avium
GQRPA

SEQ ID NO: 5624 - protein, 4 aa, Mycobacterium avium
GQRS

SEQ ID NO: 5625 - protein, 4 aa, Mycobacterium avium
GQRT

SEQ ID NO: 5626 - protein, 15 aa, Mycobacterium avium
GQSECATGDTASPTT

SEQ ID NO: 5627 - protein, 4 aa, Mycobacterium avium
GRAA

SEQ ID NO: 5628 - protein, 21 aa, Mycobacterium avium
GRAAATQEDIARQQHSQRDSA

SEQ ID NO: 5629 - protein, 12 aa, Mycobacterium avium
GRAAYDAERRGE

SEQ ID NO: 5630 - protein, 5 aa, Mycobacterium avium
GRAIT

SEQ ID NO: 5631 - protein, 10 aa, Mycobacterium avium
GRARDHGGAG

SEQ ID NO: 5632 - protein, 8 aa, Mycobacterium avium
GRDDGGPD

SEQ ID NO: 5633 - protein, 5 aa, Mycobacterium avium
GRDGE

SEQ ID NO: 5634 - protein, 18 aa, Mycobacterium avium
GRGAERESEHDADDLGDS

SEQ ID NO: 5635 - protein, 30 aa, Mycobacterium avium
GRGFTRGSATTAPTQAEDSSIEYGPGAEAA

SEQ ID NO: 5636 - protein, 36 aa, Mycobacterium avium
GRGPRPRKPAAPDRSSHRRPVTYPEQRNSSPPGVNA

SEQ ID NO: 5637 - protein, 11 aa, Mycobacterium avium
GRHGDGAPLET

SEQ ID NO: 5638 - protein, 9 aa, Mycobacterium avium
GRKAGTAAG

SEQ ID NO: 5639 - protein, 5 aa, Mycobacterium avium
GRLTG

SEQ ID NO: 5640 - protein, 17 aa, Mycobacterium avium
GRPDSSGARAAALPSQQ

SEQ ID NO: 5641 - protein, 11 aa, Mycobacterium avium
GRPGAAPQPVV

SEQ ID NO: 5642 - protein, 5 aa, Mycobacterium avium
GRPPE

SEQ ID NO: 5643 - protein, 5 aa, Mycobacterium avium
GRPVP

SEQ ID NO: 5644 - protein, 8 aa, Mycobacterium avium
GRQQPNIA

SEQ ID NO: 5645 - protein, 15 aa, Mycobacterium avium
GRRDAVTVGTAGEVA

SEQ ID NO: 5646 - protein, 10 aa, Mycobacterium avium
GRRPLGPTPR

SEQ ID NO: 5647 - protein, 8 aa, Mycobacterium avium
GRRVQGSA

SEQ ID NO: 5648 - protein, 6 aa, Mycobacterium avium
GRSDLS

SEQ ID NO: 5649 - protein, 9 aa, Mycobacterium avium
GRSGAGKTT

SEQ ID NO: 5650 - protein, 4 aa, Mycobacterium avium
GRSR

SEQ ID NO: 5651 - protein, 10 aa, Mycobacterium avium
GRSSGPDRSI

SEQ ID NO: 5652 - protein, 4 aa, Mycobacterium avium
GRVP

SEQ ID NO: 5653 - protein, 10 aa, Mycobacterium avium
GSDDDTEAEH

SEQ ID NO: 5654 - protein, 9 aa, Mycobacterium avium
GSGDSAVPR

SEQ ID NO: 5655 - protein, 7 aa, Mycobacterium avium
GSGKSQT

SEQ ID NO: 5656 - protein, 6 aa, Mycobacterium avium
GSGPGF

SEQ ID NO: 5657 - protein, 9 aa, Mycobacterium avium
GSGRIGSQS

SEQ ID NO: 5658 - protein, 4 aa, Mycobacterium avium
GSGV

SEQ ID NO: 5659 - protein, 5 aa, Mycobacterium avium
GSLNG

SEQ ID NO: 5660 - protein, 7 aa, Mycobacterium avium
GSPEPYS

SEQ ID NO: 5661 - protein, 9 aa, Mycobacterium avium
GSRLGYQDS

SEQ ID NO: 5662 - protein, 8 aa, Mycobacterium avium
GSVDGPLR

SEQ ID NO: 5663 - protein, 27 aa, Mycobacterium avium
GTAAPGTASHAKEPERGEGPPAEAYAS

SEQ ID NO: 5664 - protein, 9 aa, Mycobacterium avium
GTADDDITD

SEQ ID NO: 5665 - protein, 7 aa, Mycobacterium avium
GTATTGR

SEQ ID NO: 5666 - protein, 11 aa, Mycobacterium avium
GTEDSGPRETD

SEQ ID NO: 5667 - protein, 6 aa, Mycobacterium avium
GTGKVV

SEQ ID NO: 5668 - protein, 5 aa, Mycobacterium avium
GTGTD

SEQ ID NO: 5669 - protein, 8 aa, Mycobacterium avium
GTIATDQR

SEQ ID NO: 5670 - protein, 9 aa, Mycobacterium avium
GTIGNRDEQ

SEQ ID NO: 5671 - protein, 7 aa, Mycobacterium avium
GTKGKTA

SEQ ID NO: 5672 - protein, 6 aa, Mycobacterium avium
GTLSTL

SEQ ID NO: 5673 - protein, 4 aa, Mycobacterium avium
GTPH

SEQ ID NO: 5674 - protein, 4 aa, Mycobacterium avium
GTPM

SEQ ID NO: 5675 - protein, 7 aa, Mycobacterium avium
GTPSRLS

SEQ ID NO: 5676 - protein, 8 aa, Mycobacterium avium
GTPYSPAR

SEQ ID NO: 5677 - protein, 5 aa, Mycobacterium avium
GTRPI

SEQ ID NO: 5678 - protein, 12 aa, Mycobacterium avium
GTRTPSSGRVTV

SEQ ID NO: 5679 - protein, 8 aa, Mycobacterium avium
GTSGEPKA

SEQ ID NO: 5680 - protein, 6 aa, Mycobacterium avium
GTVGEL

SEQ ID NO: 5681 - protein, 8 aa, Mycobacterium avium
GVFSPTRA

SEQ ID NO: 5682 - protein, 5 aa, Mycobacterium avium
GVGNL

SEQ ID NO: 5683 - protein, 19 aa, Mycobacterium avium
GVKAGESGDIEEAPDVVPT

SEQ ID NO: 5684 - protein, 6 aa, Mycobacterium avium
GVNDAA

SEQ ID NO: 5685 - protein, 13 aa, Mycobacterium avium
GVPGPGPETRTAN

SEQ ID NO: 5686 - protein, 11 aa, Mycobacterium avium
GVPPDYGAEEE

SEQ ID NO: 5687 - protein, 5 aa, Mycobacterium avium
GVPPR

SEQ ID NO: 5688 - protein, 8 aa, Mycobacterium avium
GVSPNPRL

SEQ ID NO: 5689 - protein, 17 aa, Mycobacterium avium
GWGDPTSSAKSSSDGPV

SEQ ID NO: 5690 - protein, 5 aa, Mycobacterium avium
GWNQS

SEQ ID NO: 5691 - protein, 6 aa, Mycobacterium avium
GYGGDP

SEQ ID NO: 5692 - protein, 8 aa, Mycobacterium avium
GYGPPRGE

SEQ ID NO: 5693 - protein, 12 aa, Mycobacterium avium
GYSFPSGHATGT

SEQ ID NO: 5694 - protein, 19 aa, Mycobacterium avium
HAATGRTPNLYRPAGGLSN

SEQ ID NO: 5695 - protein, 5 aa, Mycobacterium avium
HAEPA

SEQ ID NO: 5696 - protein, 5 aa, Mycobacterium avium
HAETR

SEQ ID NO: 5697 - protein, 6 aa, Mycobacterium avium
HAPGRW

SEQ ID NO: 5698 - protein, 4 aa, Mycobacterium avium
HARA

SEQ ID NO: 5699 - protein, 5 aa, Mycobacterium avium
HARER

SEQ ID NO: 5700 - protein, 13 aa, Mycobacterium avium
HDEQPTAAITAAA

SEQ ID NO: 5701 - protein, 5 aa, Mycobacterium avium
HDKND

SEQ ID NO: 5702 - protein, 42 aa, Mycobacterium avium
HEHKASTAAPSTSTSAPETTTPGQPSQVPPLPPFKPSADVGA

SEQ ID NO: 5703 - protein, 6 aa, Mycobacterium avium
HESGSD

SEQ ID NO: 5704 - protein, 7 aa, Mycobacterium avium
HESNSTN

SEQ ID NO: 5705 - protein, 13 aa, Mycobacterium avium
HGASEHPDDGQYR

SEQ ID NO: 5706 - protein, 15 aa, Mycobacterium avium
HGDEQAVGSPLNDTE

SEQ ID NO: 5707 - protein, 9 aa, Mycobacterium avium
HGDHPGYEL

SEQ ID NO: 5708 - protein, 5 aa, Mycobacterium avium
HGPYR

SEQ ID NO: 5709 - protein, 14 aa, Mycobacterium avium
HGSGLDPASTAGVG

SEQ ID NO: 5710 - protein, 14 aa, Mycobacterium avium
HHGQPPAVAPVNPN

SEQ ID NO: 5711 - protein, 6 aa, Mycobacterium avium
HKDDIA

SEQ ID NO: 5712 - protein, 7 aa, Mycobacterium avium
HNADYTQ

SEQ ID NO: 5713 - protein, 30 aa, Mycobacterium avium
HNNSAPPPAPTTRALAPPPPTTPPPPLTPT

SEQ ID NO: 5714 - protein, 10 aa, Mycobacterium avium
HNTGSPTPGR

SEQ ID NO: 5715 - protein, 4 aa, Mycobacterium avium
HPAA

SEQ ID NO: 5716 - protein, 8 aa, Mycobacterium avium
HPERDKRV

SEQ ID NO: 5717 - protein, 39 aa, Mycobacterium avium
HPGASGSGQVSTVSATGTGDHAPAPTDLSQMTATSVPCV

SEQ ID NO: 5718 - protein, 13 aa, Mycobacterium avium
HPIAPPPPAPPPI

SEQ ID NO: 5719 - protein, 8 aa, Mycobacterium avium
HPTSAKAD

SEQ ID NO: 5720 - protein, 19 aa, Mycobacterium avium
HQPQPDRGAGAPPRGPVAG

SEQ ID NO: 5721 - protein, 11 aa, Mycobacterium avium
HQTRSSTTQTG

SEQ ID NO: 5722 - protein, 15 aa, Mycobacterium avium
HRGSARPAPRPAAPT

SEQ ID NO: 5723 - protein, 12 aa, Mycobacterium avium
HRQGGQPSSREV

SEQ ID NO: 5724 - protein, 12 aa, Mycobacterium avium
HSGHDGAARESR

SEQ ID NO: 5725 - protein, 6 aa, Mycobacterium avium
HSPEPR

SEQ ID NO: 5726 - protein, 10 aa, Mycobacterium avium
HSRTSQQNHQ

SEQ ID NO: 5727 - protein, 7 aa, Mycobacterium avium
HTATARQ

SEQ ID NO: 5728 - protein, 4 aa, Mycobacterium avium
HTDD

SEQ ID NO: 5729 - protein, 8 aa, Mycobacterium avium
HTPPPPGV

SEQ ID NO: 5730 - protein, 12 aa, Mycobacterium avium
HVPRDSPGRGLS

SEQ ID NO: 5731 - protein, 4 aa, Mycobacterium avium
HVTT

SEQ ID NO: 5732 - protein, 7 aa, Mycobacterium avium
IADRSSP

SEQ ID NO: 5733 - protein, 37 aa, Mycobacterium avium
IAEQAGEQTDEAETDEAEGDEAEDEAPDEAEDGGELL

SEQ ID NO: 5734 - protein, 6 aa, Mycobacterium avium
IAGQTL

SEQ ID NO: 5735 - protein, 18 aa, Mycobacterium avium
IAGRPPRPGHAHPPAGRN

SEQ ID NO: 5736 - protein, 6 aa, Mycobacterium avium
IAPAES

SEQ ID NO: 5737 - protein, 15 aa, Mycobacterium avium
IAPDGTRTEEPRPEG

SEQ ID NO: 5738 - protein, 47 aa, Mycobacterium avium
IAPNTGPNTVGAQATAGPRPEVAETTPAPGQPPEAPAAVGPTGKPWP

SEQ ID NO: 5739 - protein, 9 aa, Mycobacterium avium
IDNPDQRIQ

SEQ ID NO: 5740 - protein, 6 aa, Mycobacterium avium
IDPGKV

SEQ ID NO: 5741 - protein, 6 aa, Mycobacterium avium
IDPQRD

SEQ ID NO: 5742 - protein, 14 aa, Mycobacterium avium
IETNGKNSDRANLA

SEQ ID NO: 5743 - protein, 11 aa, Mycobacterium avium
IGDGAPTDTQP

SEQ ID NO: 5744 - protein, 8 aa, Mycobacterium avium
IGGPRRKG

SEQ ID NO: 5745 - protein, 10 aa, Mycobacterium avium
IGGSTTPASW

SEQ ID NO: 5746 - protein, 9 aa, Mycobacterium avium
IGKPDGPRI

SEQ ID NO: 5747 - protein, 10 aa, Mycobacterium avium
IGPQHTTTPI

SEQ ID NO: 5748 - protein, 7 aa, Mycobacterium avium
IGSPGSR

SEQ ID NO: 5749 - protein, 11 aa, Mycobacterium avium
IKTQTAVPPLP

SEQ ID NO: 5750 - protein, 10 aa, Mycobacterium avium
INDDGVPAAL

SEQ ID NO: 5751 - protein, 8 aa, Mycobacterium avium
INDQTDDL

SEQ ID NO: 5752 - protein, 4 aa, Mycobacterium avium
INTG

SEQ ID NO: 5753 - protein, 13 aa, Mycobacterium avium
IPAPSARRPGVPK

SEQ ID NO: 5754 - protein, 5 aa, Mycobacterium avium
IPDDQ

SEQ ID NO: 5755 - protein, 5 aa, Mycobacterium avium
IPGGP

SEQ ID NO: 5756 - protein, 29 aa, Mycobacterium avium
IPGKRAATPRECRDPKPYVPAGTNPWYGD

SEQ ID NO: 5757 - protein, 50 aa, Mycobacterium avium
IPPDAEPDPGTPIVGPPPPGVVPGPGPLPNKQPAYAPPPPNDNGPPPPFT

SEQ ID NO: 5758 - protein, 6 aa, Mycobacterium avium
IPPPAG

SEQ ID NO: 5759 - protein, 6 aa, Mycobacterium avium
IPRPET

SEQ ID NO: 5760 - protein, 5 aa, Mycobacterium avium
IPSGT

SEQ ID NO: 5761 - protein, 4 aa, Mycobacterium avium
IPTE

SEQ ID NO: 5762 - protein, 13 aa, Mycobacterium avium
IQPRGADPLPPNG

SEQ ID NO: 5763 - protein, 20 aa, Mycobacterium avium
IRAPSDPGYEPTAPPAMTTP

SEQ ID NO: 5764 - protein, 17 aa, Mycobacterium avium
IRESGGDRSAVTGGTTV

SEQ ID NO: 5765 - protein, 6 aa, Mycobacterium avium
IRTPDE

SEQ ID NO: 5766 - protein, 8 aa, Mycobacterium avium
ISAGGGTP

SEQ ID NO: 5767 - protein, 4 aa, Mycobacterium avium
ISGR

SEQ ID NO: 5768 - protein, 7 aa, Mycobacterium avium
ISKDGQQ

SEQ ID NO: 5769 - protein, 5 aa, Mycobacterium avium
ISPEA

SEQ ID NO: 5770 - protein, 8 aa, Mycobacterium avium
ISPTPRPA

SEQ ID NO: 5771 - protein, 11 aa, Mycobacterium avium
ISVGPSETVDA

SEQ ID NO: 5772 - protein, 10 aa, Mycobacterium avium
ITAPSSGRVT

SEQ ID NO: 5773 - protein, 20 aa, Mycobacterium avium
ITARGGTGQISAAPSRPKRN

SEQ ID NO: 5774 - protein, 5 aa, Mycobacterium avium
ITETG

SEQ ID NO: 5775 - protein, 6 aa, Mycobacterium avium
ITRGQE

SEQ ID NO: 5776 - protein, 22 aa, Mycobacterium avium
ITTGDRGRRLRPHRADTELGRA

SEQ ID NO: 5777 - protein, 20 aa, Mycobacterium avium
ITTSDGTVLSSNSNDAPQTS

SEQ ID NO: 5778 - protein, 8 aa, Mycobacterium avium
IVGAPNPY

SEQ ID NO: 5779 - protein, 10 aa, Mycobacterium avium
KAAEQAASQF

SEQ ID NO: 5780 - protein, 10 aa, Mycobacterium avium
KAAGEQAQQA

SEQ ID NO: 5781 - protein, 18 aa, Mycobacterium avium
KAGGDTSPLGARKGDVYP

SEQ ID NO: 5782 - protein, 5 aa, Mycobacterium avium
KAGQK

SEQ ID NO: 5783 - protein, 8 aa, Mycobacterium avium
KALPDGST

SEQ ID NO: 5784 - protein, 7 aa, Mycobacterium avium
KAPEDRF

SEQ ID NO: 5785 - protein, 21 aa, Mycobacterium avium
KDAAVKQNSVTKEIRTNVAAS

SEQ ID NO: 5786 - protein, 7 aa, Mycobacterium avium
KDRGAQR

SEQ ID NO: 5787 - protein, 5 aa, Mycobacterium avium
KEAGE

SEQ ID NO: 5788 - protein, 7 aa, Mycobacterium avium
KEALERD

SEQ ID NO: 5789 - protein, 74 aa, Mycobacterium avium
KEDEAKKQEAIQRRAANAPAPGAKPKRNLKAGAGNGVDADAAQSDAGATEGQAGGGSDAPSRTPRPGARPKKRK

SEQ ID NO: 5790 - protein, 6 aa, Mycobacterium avium
KEFDRT

SEQ ID NO: 5791 - protein, 14 aa, Mycobacterium avium
KEKHISSAARVNAA

SEQ ID NO: 5792 - protein, 7 aa, Mycobacterium avium
KENPDAH

SEQ ID NO: 5793 - protein, 12 aa, Mycobacterium avium
KEQYTKSSAELA

SEQ ID NO: 5794 - protein, 5 aa, Mycobacterium avium
KEYDS

SEQ ID NO: 5795 - protein, 7 aa, Mycobacterium avium
KFDPNSK

SEQ ID NO: 5796 - protein, 14 aa, Mycobacterium avium
KGAQTPPAVQNPAD

SEQ ID NO: 5797 - protein, 8 aa, Mycobacterium avium
KGDDDDTI

SEQ ID NO: 5798 - protein, 9 aa, Mycobacterium avium
KGEPMSPAE

SEQ ID NO: 5799 - protein, 4 aa, Mycobacterium avium
KGPV

SEQ ID NO: 5800 - protein, 19 aa, Mycobacterium avium
KGQPPQQPANEERPADKAT

SEQ ID NO: 5801 - protein, 9 aa, Mycobacterium avium
KIDGRDGSI

SEQ ID NO: 5802 - protein, 14 aa, Mycobacterium avium
KKAGPTGAGDTVRV

SEQ ID NO: 5803 - protein, 9 aa, Mycobacterium avium
KKATDTELP

SEQ ID NO: 5804 - protein, 4 aa, Mycobacterium avium
KKEL

SEQ ID NO: 5805 - protein, 9 aa, Mycobacterium avium
KKWRQSTRQ

SEQ ID NO: 5806 - protein, 5 aa, Mycobacterium avium
KLSGR

SEQ ID NO: 5807 - protein, 5 aa, Mycobacterium avium
KMPAS

SEQ ID NO: 5808 - protein, 4 aa, Mycobacterium avium
KNEV

SEQ ID NO: 5809 - protein, 6 aa, Mycobacterium avium
KNPWNP

SEQ ID NO: 5810 - protein, 14 aa, Mycobacterium avium
KPAAETAVKRTSKY

SEQ ID NO: 5811 - protein, 9 aa, Mycobacterium avium
KPAGAATSS

SEQ ID NO: 5812 - protein, 7 aa, Mycobacterium avium
KPRPARP

SEQ ID NO: 5813 - protein, 5 aa, Mycobacterium avium
KPVPR

SEQ ID NO: 5814 - protein, 6 aa, Mycobacterium avium
KQDPHV

SEQ ID NO: 5815 - protein, 18 aa, Mycobacterium avium
KQRSARFASAGELARAAS

SEQ ID NO: 5816 - protein, 14 aa, Mycobacterium avium
KRGGDWLVADVLPI

SEQ ID NO: 5817 - protein, 9 aa, Mycobacterium avium
KRGSTAQSC

SEQ ID NO: 5818 - protein, 14 aa, Mycobacterium avium
KRLGGAASGAPGGL

SEQ ID NO: 5819 - protein, 9 aa, Mycobacterium avium
KRTTADELQ

SEQ ID NO: 5820 - protein, 8 aa, Mycobacterium avium
KRVPKGTQ

SEQ ID NO: 5821 - protein, 8 aa, Mycobacterium avium
KSMSTGGV

SEQ ID NO: 5822 - protein, 7 aa, Mycobacterium avium
KSTTAFG

SEQ ID NO: 5823 - protein, 14 aa, Mycobacterium avium
KTAADNRKAAEQFE

SEQ ID NO: 5824 - protein, 15 aa, Mycobacterium avium
KTAAEESLKGTPLEN

SEQ ID NO: 5825 - protein, 7 aa, Mycobacterium avium
KTDSARE

SEQ ID NO: 5826 - protein, 12 aa, Mycobacterium avium
KTVTGQPVGASL

SEQ ID NO: 5827 - protein, 25 aa, Mycobacterium avium
KVEPNTSASPATPAPGPPNTGPPEV

SEQ ID NO: 5828 - protein, 16 aa, Mycobacterium avium
KVSEAGTARVDVGGPT

SEQ ID NO: 5829 - protein, 5 aa, Mycobacterium avium
KYGPQ

SEQ ID NO: 5830 - protein, 6 aa, Mycobacterium avium
KYPDLS

SEQ ID NO: 5831 - protein, 10 aa, Mycobacterium avium
KYPPGATSGT

SEQ ID NO: 5832 - protein, 12 aa, Mycobacterium avium
LAAPPPPTRSTV

SEQ ID NO: 5833 - protein, 6 aa, Mycobacterium avium
LADTGR

SEQ ID NO: 5834 - protein, 4 aa, Mycobacterium avium
LAGA

SEQ ID NO: 5835 - protein, 7 aa, Mycobacterium avium
LAGGAPT

SEQ ID NO: 5836 - protein, 9 aa, Mycobacterium avium
LAGGTGERQ

SEQ ID NO: 5837 - protein, 35 aa, Mycobacterium avium
LAGLPPAAAISPPTIDPAAVPPDGPPGPGAPMKQN

SEQ ID NO: 5838 - protein, 10 aa, Mycobacterium avium
LAGNDDPAQP

SEQ ID NO: 5839 - protein, 6 aa, Mycobacterium avium
LAPEQT

SEQ ID NO: 5840 - protein, 4 aa, Mycobacterium avium
LAPG

SEQ ID NO: 5841 - protein, 6 aa, Mycobacterium avium
LAPHGL

SEQ ID NO: 5842 - protein, 68 aa, Mycobacterium avium
LAPPPAVNTRQPGSAASQAGRGWTPESGPIPAAGQPGPPYYQGGNANWAAAPAQFAGPPPWGRPPPKR

SEQ ID NO: 5843 - protein, 5 aa, Mycobacterium avium
LAPSG

SEQ ID NO: 5844 - protein, 7 aa, Mycobacterium avium
LARSGPA

SEQ ID NO: 5845 - protein, 4 aa, Mycobacterium avium
LASN

SEQ ID NO: 5846 - protein, 8 aa, Mycobacterium avium
LATGAAAG

SEQ ID NO: 5847 - protein, 7 aa, Mycobacterium avium
LATKPST

SEQ ID NO: 5848 - protein, 8 aa, Mycobacterium avium
LDAGTEER

SEQ ID NO: 5849 - protein, 5 aa, Mycobacterium avium
LDDGE

SEQ ID NO: 5850 - protein, 9 aa, Mycobacterium avium
LDEPNSASI

SEQ ID NO: 5851 - protein, 8 aa, Mycobacterium avium
LDPARPPH

SEQ ID NO: 5852 - protein, 10 aa, Mycobacterium avium
LDPDTSRSAR

SEQ ID NO: 5853 - protein, 8 aa, Mycobacterium avium
LDPGSAVQ

SEQ ID NO: 5854 - protein, 8 aa, Mycobacterium avium
LDPSDPRD

SEQ ID NO: 5855 - protein, 12 aa, Mycobacterium avium
LDRDPDDDAGTA

SEQ ID NO: 5856 - protein, 27 aa, Mycobacterium avium
LDSARTGSATLAAGAKQLSDGINQATD

SEQ ID NO: 5857 - protein, 16 aa, Mycobacterium avium
LDTATDDAGERRQANR

SEQ ID NO: 5858 - protein, 7 aa, Mycobacterium avium
LENPRTV

SEQ ID NO: 5859 - protein, 7 aa, Mycobacterium avium
LEQRPEC

SEQ ID NO: 5860 - protein, 4 aa, Mycobacterium avium
LERG

SEQ ID NO: 5861 - protein, 20 aa, Mycobacterium avium
LGADGNPIAPADAGRNRARE

SEQ ID NO: 5862 - protein, 10 aa, Mycobacterium avium
LGAGREPTVT

SEQ ID NO: 5863 - protein, 4 aa, Mycobacterium avium
LGDE

SEQ ID NO: 5864 - protein, 7 aa, Mycobacterium avium
LGDTERR

SEQ ID NO: 5865 - protein, 9 aa, Mycobacterium avium
LGDTQGDTA

SEQ ID NO: 5866 - protein, 4 aa, Mycobacterium avium
LGGR

SEQ ID NO: 5867 - protein, 6 aa, Mycobacterium avium
LGGTAE

SEQ ID NO: 5868 - protein, 6 aa, Mycobacterium avium
LGKSPS

SEQ ID NO: 5869 - protein, 13 aa, Mycobacterium avium
LGNGQPDTVPAAS

SEQ ID NO: 5870 - protein, 5 aa, Mycobacterium avium
LGPAG

SEQ ID NO: 5871 - protein, 9 aa, Mycobacterium avium
LGPAGTYTA

SEQ ID NO: 5872 - protein, 8 aa, Mycobacterium avium
LGPPDQQA

SEQ ID NO: 5873 - protein, 8 aa, Mycobacterium avium
LGPSGRDR

SEQ ID NO: 5874 - protein, 9 aa, Mycobacterium avium
LGSSPLAPV

SEQ ID NO: 5875 - protein, 9 aa, Mycobacterium avium
LGTNGGGFY

SEQ ID NO: 5876 - protein, 17 aa, Mycobacterium avium
LGTNPDADEPSGSTDET

SEQ ID NO: 5877 - protein, 19 aa, Mycobacterium avium
LGTPGASRISLPGNASRQA

SEQ ID NO: 5878 - protein, 9 aa, Mycobacterium avium
LHSEPGAGT

SEQ ID NO: 5879 - protein, 5 aa, Mycobacterium avium
LHSPR

SEQ ID NO: 5880 - protein, 11 aa, Mycobacterium avium
LKENERLKREN

SEQ ID NO: 5881 - protein, 7 aa, Mycobacterium avium
LKEPRES

SEQ ID NO: 5882 - protein, 8 aa, Mycobacterium avium
LKSAARDG

SEQ ID NO: 5883 - protein, 33 aa, Mycobacterium avium
LNAQAAGNSGAGATDLAAREQTAREAGRKAEIG

SEQ ID NO: 5884 - protein, 4 aa, Mycobacterium avium
LNPD

SEQ ID NO: 5885 - protein, 5 aa, Mycobacterium avium
LPAGE

SEQ ID NO: 5886 - protein, 15 aa, Mycobacterium avium
LPAGGTINSQHTQPA

SEQ ID NO: 5887 - protein, 8 aa, Mycobacterium avium
LPAGISKA

SEQ ID NO: 5888 - protein, 55 aa, Mycobacterium avium
LPAPPPSNPPAAQPPAPSTPAPAPTPTEVAAPAPEPVQQAAPQTPVTTAPPAPVY

SEQ ID NO: 5889 - protein, 20 aa, Mycobacterium avium
LPDERKRPTLNGRPARPPVA

SEQ ID NO: 5890 - protein, 9 aa, Mycobacterium avium
LPDPRSARA

SEQ ID NO: 5891 - protein, 14 aa, Mycobacterium avium
LPEAGEAPAVETTA

SEQ ID NO: 5892 - protein, 19 aa, Mycobacterium avium
LPEPETPAAPAPEAPAPEI

SEQ ID NO: 5893 - protein, 10 aa, Mycobacterium avium
LPGQGEPSAS

SEQ ID NO: 5894 - protein, 5 aa, Mycobacterium avium
LPGTP

SEQ ID NO: 5895 - protein, 5 aa, Mycobacterium avium
LPNGD

SEQ ID NO: 5896 - protein, 19 aa, Mycobacterium avium
LPPAPGQGPMTGPPNPTQW

SEQ ID NO: 5897 - protein, 6 aa, Mycobacterium avium
LPPETR

SEQ ID NO: 5898 - protein, 12 aa, Mycobacterium avium
LPPETSAEQRDR

SEQ ID NO: 5899 - protein, 33 aa, Mycobacterium avium
LPPGSPGSNWAGADAESTGGRRRARHSGADEAW

SEQ ID NO: 5900 - protein, 7 aa, Mycobacterium avium
LPPGTGY

SEQ ID NO: 5901 - protein, 6 aa, Mycobacterium avium
LPPGTS

SEQ ID NO: 5902 - protein, 18 aa, Mycobacterium avium
LPPGWKPGSQAVAPPKLP

SEQ ID NO: 5903 - protein, 87 aa, Mycobacterium avium
LPPPPPKPIKAKKPKKRRLRRKKAGEEVETAETAEAEEAEAEEADETEAAQTVTAETEAAEAAGETEAAEDTAEAEKPAANEPEAET

SEQ ID NO: 5904 - protein, 6 aa, Mycobacterium avium
LPPVEK

SEQ ID NO: 5905 - protein, 6 aa, Mycobacterium avium
LQPTPN

SEQ ID NO: 5906 - protein, 12 aa, Mycobacterium avium
LQQPGVNAATLT

SEQ ID NO: 5907 - protein, 39 aa, Mycobacterium avium
LQQPPATVTYTPTPTSTPPPPPPPPPVTTTTTTTTTPPF

SEQ ID NO: 5908 - protein, 7 aa, Mycobacterium avium
LQRTGGL

SEQ ID NO: 5909 - protein, 10 aa, Mycobacterium avium
LQSKSSGRVD

SEQ ID NO: 5910 - protein, 14 aa, Mycobacterium avium
LQTPPGPPNAYDEN

SEQ ID NO: 5911 - protein, 8 aa, Mycobacterium avium
LRDNPKQT

SEQ ID NO: 5912 - protein, 10 aa, Mycobacterium avium
LRDREARRDK

SEQ ID NO: 5913 - protein, 4 aa, Mycobacterium avium
LRPG

SEQ ID NO: 5914 - protein, 19 aa, Mycobacterium avium
LRPNQTPRSRRARRRQQAR

SEQ ID NO: 5915 - protein, 8 aa, Mycobacterium avium
LRPSPNEN

SEQ ID NO: 5916 - protein, 4 aa, Mycobacterium avium
LSAA

SEQ ID NO: 5917 - protein, 13 aa, Mycobacterium avium
LSAAAAANTKHDI

SEQ ID NO: 5918 - protein, 5 aa, Mycobacterium avium
LSDCD

SEQ ID NO: 5919 - protein, 8 aa, Mycobacterium avium
LSDPVSDE

SEQ ID NO: 5920 - protein, 6 aa, Mycobacterium avium
LSERNQ

SEQ ID NO: 5921 - protein, 25 aa, Mycobacterium avium
LSGGSYQNLATSASPDLATAVNAFL

SEQ ID NO: 5922 - protein, 6 aa, Mycobacterium avium
LSGGTW

SEQ ID NO: 5923 - protein, 16 aa, Mycobacterium avium
LSGTDGSVTYDRGSDG

SEQ ID NO: 5924 - protein, 7 aa, Mycobacterium avium
LSNPAGG

SEQ ID NO: 5925 - protein, 9 aa, Mycobacterium avium
LSNQGPQKL

SEQ ID NO: 5926 - protein, 6 aa, Mycobacterium avium
LSPDAV

SEQ ID NO: 5927 - protein, 18 aa, Mycobacterium avium
LSPGDVTGGGALSDCSDG

SEQ ID NO: 5928 - protein, 5 aa, Mycobacterium avium
LSPPR

SEQ ID NO: 5929 - protein, 8 aa, Mycobacterium avium
LSQPCSRT

SEQ ID NO: 5930 - protein, 6 aa, Mycobacterium avium
LSQRSI

SEQ ID NO: 5931 - protein, 6 aa, Mycobacterium avium
LSSDAF

SEQ ID NO: 5932 - protein, 12 aa, Mycobacterium avium
LSSTATAPPAAE

SEQ ID NO: 5933 - protein, 8 aa, Mycobacterium avium
LSTGTETS

SEQ ID NO: 5934 - protein, 5 aa, Mycobacterium avium
LSTTG

SEQ ID NO: 5935 - protein, 7 aa, Mycobacterium avium
LTIGRRR

SEQ ID NO: 5936 - protein, 10 aa, Mycobacterium avium
LTPDGQPSKF

SEQ ID NO: 5937 - protein, 7 aa, Mycobacterium avium
LTPEQRR

SEQ ID NO: 5938 - protein, 19 aa, Mycobacterium avium
LTPNDPKYQPGFEDADTRV

SEQ ID NO: 5939 - protein, 10 aa, Mycobacterium avium
LTPSQPAFAA

SEQ ID NO: 5940 - protein, 14 aa, Mycobacterium avium
LTRQDSSALPPTTE

SEQ ID NO: 5941 - protein, 6 aa, Mycobacterium avium
LTSRGG

SEQ ID NO: 5942 - protein, 18 aa, Mycobacterium avium
LTSSGTRDALTSTAQTQL

SEQ ID NO: 5943 - protein, 4 aa, Mycobacterium avium
LTST

SEQ ID NO: 5944 - protein, 11 aa, Mycobacterium avium
MAPGSSAGDDN

SEQ ID NO: 5945 - protein, 9 aa, Mycobacterium avium
MDKAAKTWN

SEQ ID NO: 5946 - protein, 12 aa, Mycobacterium avium
MDSNSKDATAMG

SEQ ID NO: 5947 - protein, 19 aa, Mycobacterium avium
MGDRDAVSDLSRSQPTASV

SEQ ID NO: 5948 - protein, 8 aa, Mycobacterium avium
MGHKKDSL

SEQ ID NO: 5949 - protein, 7 aa, Mycobacterium avium
MGTSPYA

SEQ ID NO: 5950 - protein, 5 aa, Mycobacterium avium
MHDGS

SEQ ID NO: 5951 - protein, 16 aa, Mycobacterium avium
MPGQPGGGGEDSAGPV

SEQ ID NO: 5952 - protein, 9 aa, Mycobacterium avium
MQGQQVGPI

SEQ ID NO: 5953 - protein, 15 aa, Mycobacterium avium
MSGGAASPSEQARQL

SEQ ID NO: 5954 - protein, 5 aa, Mycobacterium avium
MSNAT

SEQ ID NO: 5955 - protein, 10 aa, Mycobacterium avium
MSQAEPTARA

SEQ ID NO: 5956 - protein, 4 aa, Mycobacterium avium
NAAA

SEQ ID NO: 5957 - protein, 7 aa, Mycobacterium avium
NAAATAW

SEQ ID NO: 5958 - protein, 15 aa, Mycobacterium avium
NAGGTPNVPSNGTGS

SEQ ID NO: 5959 - protein, 5 aa, Mycobacterium avium
NAHGP

SEQ ID NO: 5960 - protein, 6 aa, Mycobacterium avium
NANYPQ

SEQ ID NO: 5961 - protein, 5 aa, Mycobacterium avium
NARPD

SEQ ID NO: 5962 - protein, 9 aa, Mycobacterium avium
NARPGTNGS

SEQ ID NO: 5963 - protein, 6 aa, Mycobacterium avium
NARRRT

SEQ ID NO: 5964 - protein, 8 aa, Mycobacterium avium
NASDVSQR

SEQ ID NO: 5965 - protein, 13 aa, Mycobacterium avium
NASPTATAPAPPV

SEQ ID NO: 5966 - protein, 18 aa, Mycobacterium avium
NAVGEPEPVEDKQPIPRA

SEQ ID NO: 5967 - protein, 5 aa, Mycobacterium avium
NDAET

SEQ ID NO: 5968 - protein, 4 aa, Mycobacterium avium
NDAK

SEQ ID NO: 5969 - protein, 6 aa, Mycobacterium avium
NDESTL

SEQ ID NO: 5970 - protein, 20 aa, Mycobacterium avium
NDGELSAEEHRERVSAATRA

SEQ ID NO: 5971 - protein, 6 aa, Mycobacterium avium
NDGQRP

SEQ ID NO: 5972 - protein, 8 aa, Mycobacterium avium
NDNGSALT

SEQ ID NO: 5973 - protein, 5 aa, Mycobacterium avium
NDNPN

SEQ ID NO: 5974 - protein, 4 aa, Mycobacterium avium
NDNR

SEQ ID NO: 5975 - protein, 6 aa, Mycobacterium avium
NDPPPC

SEQ ID NO: 5976 - protein, 8 aa, Mycobacterium avium
NDPQNRIN

SEQ ID NO: 5977 - protein, 18 aa, Mycobacterium avium
NDYSDGIRGTDDDRAGPV

SEQ ID NO: 5978 - protein, 14 aa, Mycobacterium avium
NEAEHSAAGHGKTV

SEQ ID NO: 5979 - protein, 6 aa, Mycobacterium avium
NEGVPA

SEQ ID NO: 5980 - protein, 4 aa, Mycobacterium avium
NENR

SEQ ID NO: 5981 - protein, 17 aa, Mycobacterium avium
NESPPDRSGDPEPPERA

SEQ ID NO: 5982 - protein, 11 aa, Mycobacterium avium
NGDAPSSAAHV

SEQ ID NO: 5983 - protein, 8 aa, Mycobacterium avium
NGESAKHA

SEQ ID NO: 5984 - protein, 4 aa, Mycobacterium avium
NGGA

SEQ ID NO: 5985 - protein, 18 aa, Mycobacterium avium
NGGEDETGSRHRHRAASP

SEQ ID NO: 5986 - protein, 6 aa, Mycobacterium avium
NGIGIP

SEQ ID NO: 5987 - protein, 6 aa, Mycobacterium avium
NGPAGS

SEQ ID NO: 5988 - protein, 5 aa, Mycobacterium avium
NGRFT

SEQ ID NO: 5989 - protein, 7 aa, Mycobacterium avium
NGSGPEL

SEQ ID NO: 5990 - protein, 5 aa, Mycobacterium avium
NGSPE

SEQ ID NO: 5991 - protein, 6 aa, Mycobacterium avium
NGTGYA

SEQ ID NO: 5992 - protein, 23 aa, Mycobacterium avium
NGTIGAPAVTRRRRRRRGDSDAV

SEQ ID NO: 5993 - protein, 7 aa, Mycobacterium avium
NHTTGNV

SEQ ID NO: 5994 - protein, 10 aa, Mycobacterium avium
NNRSGGGVRV

SEQ ID NO: 5995 - protein, 9 aa, Mycobacterium avium
NPADINAGR

SEQ ID NO: 5996 - protein, 6 aa, Mycobacterium avium
NPAVPG

SEQ ID NO: 5997 - protein, 6 aa, Mycobacterium avium
NPDLAD

SEQ ID NO: 5998 - protein, 7 aa, Mycobacterium avium
NPGGSYT

SEQ ID NO: 5999 - protein, 6 aa, Mycobacterium avium
NPGRYQ

SEQ ID NO: 6000 - protein, 5 aa, Mycobacterium avium
NPIET

SEQ ID NO: 6001 - protein, 6 aa, Mycobacterium avium
NPLPGG

SEQ ID NO: 6002 - protein, 100 aa, Mycobacterium avium
NPPYNPPYTPPYNPTTPYTPPTTTYEPPTTTYQPPTTTYQPPTTTYQPPTTTYQPPTTTYQPPTTTHEPPTTTYQPPSTRATTEAPLPTHTQQTVPPTHS

SEQ ID NO: 6003 - protein, 15 aa, Mycobacterium avium
NPQHNSPDRATPDGN

SEQ ID NO: 6004 - protein, 14 aa, Mycobacterium avium
NPRNRRSRTNPDAT

SEQ ID NO: 6005 - protein, 9 aa, Mycobacterium avium
NPSHRVRGE

SEQ ID NO: 6006 - protein, 4 aa, Mycobacterium avium
NPSV

SEQ ID NO: 6007 - protein, 4 aa, Mycobacterium avium
NPTT

SEQ ID NO: 6008 - protein, 15 aa, Mycobacterium avium
NPWRGPPVPYDTPVT

SEQ ID NO: 6009 - protein, 12 aa, Mycobacterium avium
NQHYADSAARQS

SEQ ID NO: 6010 - protein, 5 aa, Mycobacterium avium
NQLSG

SEQ ID NO: 6011 - protein, 4 aa, Mycobacterium avium
NQSD

SEQ ID NO: 6012 - protein, 7 aa, Mycobacterium avium
NRADDSV

SEQ ID NO: 6013 - protein, 7 aa, Mycobacterium avium
NRADPLA

SEQ ID NO: 6014 - protein, 12 aa, Mycobacterium avium
NRDDSDSMSTNE

SEQ ID NO: 6015 - protein, 5 aa, Mycobacterium avium
NRDNT

SEQ ID NO: 6016 - protein, 15 aa, Mycobacterium avium
NRQAPPAPSVAPLPP

SEQ ID NO: 6017 - protein, 4 aa, Mycobacterium avium
NSAN

SEQ ID NO: 6018 - protein, 6 aa, Mycobacterium avium
NSCSAP

SEQ ID NO: 6019 - protein, 6 aa, Mycobacterium avium
NSERRT

SEQ ID NO: 6020 - protein, 9 aa, Mycobacterium avium
NSPDSIADS

SEQ ID NO: 6021 - protein, 4 aa, Mycobacterium avium
NSPG

SEQ ID NO: 6022 - protein, 7 aa, Mycobacterium avium
NSPPTIS

SEQ ID NO: 6023 - protein, 7 aa, Mycobacterium avium
NTAADQL

SEQ ID NO: 6024 - protein, 30 aa, Mycobacterium avium
NTFDPSQDIGRQGDKQLGNPAVSSPFEPGS

SEQ ID NO: 6025 - protein, 11 aa, Mycobacterium avium
NTFSTDPSNLA

SEQ ID NO: 6026 - protein, 13 aa, Mycobacterium avium
NTPDGKPLDPAAV

SEQ ID NO: 6027 - protein, 9 aa, Mycobacterium avium
NTTASVTKS

SEQ ID NO: 6028 - protein, 11 aa, Mycobacterium avium
NVGLPGESAGL

SEQ ID NO: 6029 - protein, 9 aa, Mycobacterium avium
NVPHRSPRR

SEQ ID NO: 6030 - protein, 4 aa, Mycobacterium avium
NVYP

SEQ ID NO: 6031 - protein, 12 aa, Mycobacterium avium
PAAEMPARRTGP

SEQ ID NO: 6032 - protein, 12 aa, Mycobacterium avium
PAAGDPDAPPTL

SEQ ID NO: 6033 - protein, 12 aa, Mycobacterium avium
PAAKQKSLKTNA

SEQ ID NO: 6034 - protein, 10 aa, Mycobacterium avium
PADDAIPAAE

SEQ ID NO: 6035 - protein, 4 aa, Mycobacterium avium
PADR

SEQ ID NO: 6036 - protein, 4 aa, Mycobacterium avium
PAEL

SEQ ID NO: 6037 - protein, 4 aa, Mycobacterium avium
PAER

SEQ ID NO: 6038 - protein, 7 aa, Mycobacterium avium
PAGAPTG

SEQ ID NO: 6039 - protein, 7 aa, Mycobacterium avium
PAGGQLS

SEQ ID NO: 6040 - protein, 11 aa, Mycobacterium avium
PAGGRGPMGRG

SEQ ID NO: 6041 - protein, 12 aa, Mycobacterium avium
PAGPAVAPAPAE

SEQ ID NO: 6042 - protein, 6 aa, Mycobacterium avium
PAGRSR

SEQ ID NO: 6043 - protein, 11 aa, Mycobacterium avium
PAGTTLSEAQR

SEQ ID NO: 6044 - protein, 11 aa, Mycobacterium avium
PAHRRGPAEDA

SEQ ID NO: 6045 - protein, 5 aa, Mycobacterium avium
PALER

SEQ ID NO: 6046 - protein, 10 aa, Mycobacterium avium
PALGDRRSGP

SEQ ID NO: 6047 - protein, 4 aa, Mycobacterium avium
PAMG

SEQ ID NO: 6048 - protein, 5 aa, Mycobacterium avium
PANVG

SEQ ID NO: 6049 - protein, 25 aa, Mycobacterium avium
PAPAPPPPAPPVQAQPKITPPRPLA

SEQ ID NO: 6050 - protein, 15 aa, Mycobacterium avium
PAPARNQPFDGRRAT

SEQ ID NO: 6051 - protein, 21 aa, Mycobacterium avium
PAPASVTAVPRTAPPRSVADG

SEQ ID NO: 6052 - protein, 9 aa, Mycobacterium avium
PAPDPHSSA

SEQ ID NO: 6053 - protein, 8 aa, Mycobacterium avium
PAPHAGDA

SEQ ID NO: 6054 - protein, 17 aa, Mycobacterium avium
PAPPPAAHQPPERRHST

SEQ ID NO: 6055 - protein, 62 aa, Mycobacterium avium
PAPPPPSSEAPPPPATTTTAPPEPSTTTTTTTPPPSSTTTTSAAPTTTAQPSTTSAAPTTTR

SEQ ID NO: 6056 - protein, 12 aa, Mycobacterium avium
PAPQRAPDGQPV

SEQ ID NO: 6057 - protein, 4 aa, Mycobacterium avium
PAPR

SEQ ID NO: 6058 - protein, 9 aa, Mycobacterium avium
PAPRQPKSA

SEQ ID NO: 6059 - protein, 4 aa, Mycobacterium avium
PAQA

SEQ ID NO: 6060 - protein, 4 aa, Mycobacterium avium
PARY

SEQ ID NO: 6061 - protein, 36 aa, Mycobacterium avium
PASIPTRSTRTSSRCSTVRPGSSRTCTPSPVSSFGN

SEQ ID NO: 6062 - protein, 16 aa, Mycobacterium avium
PASLDNPRSPRRRAGI

SEQ ID NO: 6063 - protein, 10 aa, Mycobacterium avium
PASPWATPPP

SEQ ID NO: 6064 - protein, 10 aa, Mycobacterium avium
PASRAPAESR

SEQ ID NO: 6065 - protein, 37 aa, Mycobacterium avium
PASRPGKAGDSVRRRRAAKPSQTVTARKTARAQHEPA

SEQ ID NO: 6066 - protein, 9 aa, Mycobacterium avium
PATTSNEYE

SEQ ID NO: 6067 - protein, 5 aa, Mycobacterium avium
PAVAS

SEQ ID NO: 6068 - protein, 26 aa, Mycobacterium avium
PAVSGTASPLGRAEPGAEPNAAPTNC

SEQ ID NO: 6069 - protein, 7 aa, Mycobacterium avium
PAVTADT

SEQ ID NO: 6070 - protein, 5 aa, Mycobacterium avium
PDADT

SEQ ID NO: 6071 - protein, 12 aa, Mycobacterium avium
PDAGATPLGRGG

SEQ ID NO: 6072 - protein, 16 aa, Mycobacterium avium
PDATAAQIEQAAREAQ

SEQ ID NO: 6073 - protein, 19 aa, Mycobacterium avium
PDDDAAADLGLGQPSPAPW

SEQ ID NO: 6074 - protein, 12 aa, Mycobacterium avium
PDGARSPQAHRV

SEQ ID NO: 6075 - protein, 4 aa, Mycobacterium avium
PDGN

SEQ ID NO: 6076 - protein, 8 aa, Mycobacterium avium
PDGSPSYQ

SEQ ID NO: 6077 - protein, 9 aa, Mycobacterium avium
PDGYANTTI

SEQ ID NO: 6078 - protein, 7 aa, Mycobacterium avium
PDHRETY

SEQ ID NO: 6079 - protein, 9 aa, Mycobacterium avium
PDKRTDARV

SEQ ID NO: 6080 - protein, 7 aa, Mycobacterium avium
PDPLNGL

SEQ ID NO: 6081 - protein, 53 aa, Mycobacterium avium
PDPNGTRLPNGAPPPAPPVAEGTPAHPGPAVPPGSPCSYTPAADSPPRPGNPL

SEQ ID NO: 6082 - protein, 13 aa, Mycobacterium avium
PDPQSAGDAGRST

SEQ ID NO: 6083 - protein, 5 aa, Mycobacterium avium
PDPRI

SEQ ID NO: 6084 - protein, 8 aa, Mycobacterium avium
PDPVSPPQ

SEQ ID NO: 6085 - protein, 4 aa, Mycobacterium avium
PDQP

SEQ ID NO: 6086 - protein, 4 aa, Mycobacterium avium
PDSN

SEQ ID NO: 6087 - protein, 7 aa, Mycobacterium avium
PDVAAAR

SEQ ID NO: 6088 - protein, 6 aa, Mycobacterium avium
PDYDLS

SEQ ID NO: 6089 - protein, 18 aa, Mycobacterium avium
PEAEASGIDEAEHAESGY

SEQ ID NO: 6090 - protein, 5 aa, Mycobacterium avium
PEAQW

SEQ ID NO: 6091 - protein, 49 aa, Mycobacterium avium
PEDAPTESTADATESTEATEPSDQSDQSGQAGRSEESAVPADGRGDEST

SEQ ID NO: 6092 - protein, 5 aa, Mycobacterium avium
PEERT

SEQ ID NO: 6093 - protein, 12 aa, Mycobacterium avium
PELPAPESTGLP

SEQ ID NO: 6094 - protein, 26 aa, Mycobacterium avium
PEPAGGKRRKGKRGGRRGAGDGSREM

SEQ ID NO: 6095 - protein, 8 aa, Mycobacterium avium
PEPDSPRL

SEQ ID NO: 6096 - protein, 5 aa, Mycobacterium avium
PEQVP

SEQ ID NO: 6097 - protein, 13 aa, Mycobacterium avium
PERNADGTPGHSA

SEQ ID NO: 6098 - protein, 17 aa, Mycobacterium avium
PERPRPTPQPPDDPALR

SEQ ID NO: 6099 - protein, 50 aa, Mycobacterium avium
PESFDPQHPEPDQAADEGTDAVDAEGAPDADPGPDQANGSPRPPGSGDEP

SEQ ID NO: 6100 - protein, 5 aa, Mycobacterium avium
PESGG

SEQ ID NO: 6101 - protein, 4 aa, Mycobacterium avium
PESR

SEQ ID NO: 6102 - protein, 52 aa, Mycobacterium avium
PEWQGQQPEWQQPEGQGQQPPWQGQPPPAWQAPQPGGWPGQQPGAWPPPQPG

SEQ ID NO: 6103 - protein, 5 aa, Mycobacterium avium
PFATR

SEQ ID NO: 6104 - protein, 22 aa, Mycobacterium avium
PFPEPSATPISPWGQGRPHAGD

SEQ ID NO: 6105 - protein, 8 aa, Mycobacterium avium
PGADPAAV

SEQ ID NO: 6106 - protein, 6 aa, Mycobacterium avium
PGAGDA

SEQ ID NO: 6107 - protein, 9 aa, Mycobacterium avium
PGANNQQQV

SEQ ID NO: 6108 - protein, 5 aa, Mycobacterium avium
PGAPS

SEQ ID NO: 6109 - protein, 23 aa, Mycobacterium avium
PGGALDNDTECVNGSRGNAADHL

SEQ ID NO: 6110 - protein, 4 aa, Mycobacterium avium
PGGF

SEQ ID NO: 6111 - protein, 10 aa, Mycobacterium avium
PGGSGRATPV

SEQ ID NO: 6112 - protein, 8 aa, Mycobacterium avium
PGGVDSPE

SEQ ID NO: 6113 - protein, 8 aa, Mycobacterium avium
PGGVTLDG

SEQ ID NO: 6114 - protein, 5 aa, Mycobacterium avium
PGIGG

SEQ ID NO: 6115 - protein, 14 aa, Mycobacterium avium
PGNVAANVSAGSQY

SEQ ID NO: 6116 - protein, 11 aa, Mycobacterium avium
PGPDGRPTTSI

SEQ ID NO: 6117 - protein, 8 aa, Mycobacterium avium
PGQPASEV

SEQ ID NO: 6118 - protein, 7 aa, Mycobacterium avium
PGRDRDR

SEQ ID NO: 6119 - protein, 16 aa, Mycobacterium avium
PGSEYGPNAAPPTPAR

SEQ ID NO: 6120 - protein, 5 aa, Mycobacterium avium
PGSGL

SEQ ID NO: 6121 - protein, 12 aa, Mycobacterium avium
PGSIPTTTSGKI

SEQ ID NO: 6122 - protein, 28 aa, Mycobacterium avium
PGSPARSRVAPASAPAGPPRTSPTPATE

SEQ ID NO: 6123 - protein, 20 aa, Mycobacterium avium
PGTGTPGPAAAGHAGGGGGA

SEQ ID NO: 6124 - protein, 7 aa, Mycobacterium avium
PGVVDPA

SEQ ID NO: 6125 - protein, 20 aa, Mycobacterium avium
PGWAPRSAGRTAAGAPVVTS

SEQ ID NO: 6126 - protein, 5 aa, Mycobacterium avium
PGYRT

SEQ ID NO: 6127 - protein, 9 aa, Mycobacterium avium
PHGPGAPVA

SEQ ID NO: 6128 - protein, 5 aa, Mycobacterium avium
PHGSG

SEQ ID NO: 6129 - protein, 7 aa, Mycobacterium avium
PHNEPPA

SEQ ID NO: 6130 - protein, 50 aa, Mycobacterium avium
PIDTDDDSLSPQDKDEDSTAPASTDEQTGSQGAPGVAGESAPDDADDAVP

SEQ ID NO: 6131 - protein, 4 aa, Mycobacterium avium
PIPS

SEQ ID NO: 6132 - protein, 12 aa, Mycobacterium avium
PISQSDVGSVEA

SEQ ID NO: 6133 - protein, 6 aa, Mycobacterium avium
PKAKRI

SEQ ID NO: 6134 - protein, 14 aa, Mycobacterium avium
PKGREDPESLRGNQ

SEQ ID NO: 6135 - protein, 14 aa, Mycobacterium avium
PKPEAGGQAKGIDQ

SEQ ID NO: 6136 - protein, 14 aa, Mycobacterium avium
PKPEPPQAAPLTSD

SEQ ID NO: 6137 - protein, 15 aa, Mycobacterium avium
PKPGTGPSPSARERG

SEQ ID NO: 6138 - protein, 7 aa, Mycobacterium avium
PKTAPHG

SEQ ID NO: 6139 - protein, 13 aa, Mycobacterium avium
PLDENDVYEPGEP

SEQ ID NO: 6140 - protein, 4 aa, Mycobacterium avium
PLEG

SEQ ID NO: 6141 - protein, 5 aa, Mycobacterium avium
PLESY

SEQ ID NO: 6142 - protein, 10 aa, Mycobacterium avium
PLGGAVGGDV

SEQ ID NO: 6143 - protein, 9 aa, Mycobacterium avium
PLPAPRPAT

SEQ ID NO: 6144 - protein, 6 aa, Mycobacterium avium
PLPPPR

SEQ ID NO: 6145 - protein, 10 aa, Mycobacterium avium
PLSGDTQMTY

SEQ ID NO: 6146 - protein, 14 aa, Mycobacterium avium
PLSPDPGPPLTLQA

SEQ ID NO: 6147 - protein, 40 aa, Mycobacterium avium
PMPATPAFPPPAGPPPAVGAPPPPVEVPPPVAPPPPPPPV

SEQ ID NO: 6148 - protein, 12 aa, Mycobacterium avium
PNESNTGAATTA

SEQ ID NO: 6149 - protein, 16 aa, Mycobacterium avium
PNKQAKITNHTDVTGA

SEQ ID NO: 6150 - protein, 12 aa, Mycobacterium avium
PPAHAVSPPAVD

SEQ ID NO: 6151 - protein, 5 aa, Mycobacterium avium
PPDHT

SEQ ID NO: 6152 - protein, 5 aa, Mycobacterium avium
PPDLG

SEQ ID NO: 6153 - protein, 5 aa, Mycobacterium avium
PPEVH

SEQ ID NO: 6154 - protein, 9 aa, Mycobacterium avium
PPKGLSQEE

SEQ ID NO: 6155 - protein, 40 aa, Mycobacterium avium
PPKRPGFDPRASRASDEWTPETGEEPDGGFDSSEDATESV

SEQ ID NO: 6156 - protein, 10 aa, Mycobacterium avium
PPLASTTTDL

SEQ ID NO: 6157 - protein, 4 aa, Mycobacterium avium
PPLP

SEQ ID NO: 6158 - protein, 12 aa, Mycobacterium avium
PPLPTGSSPEVS

SEQ ID NO: 6159 - protein, 10 aa, Mycobacterium avium
PPMSPSLPAD

SEQ ID NO: 6160 - protein, 19 aa, Mycobacterium avium
PPPAAAPAQPAQPAPATTG

SEQ ID NO: 6161 - protein, 5 aa, Mycobacterium avium
PPPDD

SEQ ID NO: 6162 - protein, 5 aa, Mycobacterium avium
PPPEL

SEQ ID NO: 6163 - protein, 58 aa, Mycobacterium avium
PPPPRQPKPPGQPPTRSFRRRDTQRSAVPPDAATRGVPQPGPPPRTQTGRTGGSGEFP

SEQ ID NO: 6164 - protein, 64 aa, Mycobacterium avium
PPPPSQEQQQPPPGPFGAPPPPPAAGPAPAGPPPGPPQGGQAPAGNHGGGTVTIPGHAGAARVT

SEQ ID NO: 6165 - protein, 60 aa, Mycobacterium avium
PPPPSSPGSPGGQPTPPPGGQQPPPPPGGSYPPPPPPGGSYPPPPPPSGGYAPPPPGPAI

SEQ ID NO: 6166 - protein, 6 aa, Mycobacterium avium
PPQHTR

SEQ ID NO: 6167 - protein, 25 aa, Mycobacterium avium
PPSAPASTKLRNGSRIERQNTRIGQ

SEQ ID NO: 6168 - protein, 47 aa, Mycobacterium avium
PPSAVAPPTAVPPPPPPSAQPVPSPAPPPPQPPPPPPSPPPAPPPPV

SEQ ID NO: 6169 - protein, 11 aa, Mycobacterium avium
PPSGAATVEVT

SEQ ID NO: 6170 - protein, 8 aa, Mycobacterium avium
PPTTNRAA

SEQ ID NO: 6171 - protein, 14 aa, Mycobacterium avium
PPVPAEEVRDPVTA

SEQ ID NO: 6172 - protein, 9 aa, Mycobacterium avium
PQDFDTPSE

SEQ ID NO: 6173 - protein, 9 aa, Mycobacterium avium
PQDYPGARA

SEQ ID NO: 6174 - protein, 8 aa, Mycobacterium avium
PQNGSFGS

SEQ ID NO: 6175 - protein, 7 aa, Mycobacterium avium
PQPPEGS

SEQ ID NO: 6176 - protein, 7 aa, Mycobacterium avium
PQPVQPP

SEQ ID NO: 6177 - protein, 11 aa, Mycobacterium avium
PQQNSAAPAEQ

SEQ ID NO: 6178 - protein, 5 aa, Mycobacterium avium
PQTNL

SEQ ID NO: 6179 - protein, 8 aa, Mycobacterium avium
PQYEGTQR

SEQ ID NO: 6180 - protein, 6 aa, Mycobacterium avium
PQYQAG

SEQ ID NO: 6181 - protein, 5 aa, Mycobacterium avium
PRADQ

SEQ ID NO: 6182 - protein, 5 aa, Mycobacterium avium
PRAGS

SEQ ID NO: 6183 - protein, 4 aa, Mycobacterium avium
PRDD

SEQ ID NO: 6184 - protein, 11 aa, Mycobacterium avium
PRLAPGVPGGT

SEQ ID NO: 6185 - protein, 30 aa, Mycobacterium avium
PRLPGRPDLSGSAPTSLRQRRNRSGGSFTS

SEQ ID NO: 6186 - protein, 6 aa, Mycobacterium avium
PRPGPS

SEQ ID NO: 6187 - protein, 5 aa, Mycobacterium avium
PRPTQ

SEQ ID NO: 6188 - protein, 6 aa, Mycobacterium avium
PRQGRL

SEQ ID NO: 6189 - protein, 22 aa, Mycobacterium avium
PRRAPEPRTAPDWQPMAEQPVS

SEQ ID NO: 6190 - protein, 7 aa, Mycobacterium avium
PRRPGRP

SEQ ID NO: 6191 - protein, 12 aa, Mycobacterium avium
PRRPVDERAGRA

SEQ ID NO: 6192 - protein, 6 aa, Mycobacterium avium
PRTMTP

SEQ ID NO: 6193 - protein, 8 aa, Mycobacterium avium
PSAPVAPR

SEQ ID NO: 6194 - protein, 7 aa, Mycobacterium avium
PSEETAV

SEQ ID NO: 6195 - protein, 7 aa, Mycobacterium avium
PSGPGEV

SEQ ID NO: 6196 - protein, 9 aa, Mycobacterium avium
PSGQTTTPY

SEQ ID NO: 6197 - protein, 10 aa, Mycobacterium avium
PSGSGPAPIQ

SEQ ID NO: 6198 - protein, 5 aa, Mycobacterium avium
PSPLP

SEQ ID NO: 6199 - protein, 8 aa, Mycobacterium avium
PTASRAER

SEQ ID NO: 6200 - protein, 10 aa, Mycobacterium avium
PTATAGAPLV

SEQ ID NO: 6201 - protein, 5 aa, Mycobacterium avium
PTAVD

SEQ ID NO: 6202 - protein, 16 aa, Mycobacterium avium
PTEVGLPDENPNLTEP

SEQ ID NO: 6203 - protein, 11 aa, Mycobacterium avium
PTNEPASAALA

SEQ ID NO: 6204 - protein, 6 aa, Mycobacterium avium
PTNTRY

SEQ ID NO: 6205 - protein, 15 aa, Mycobacterium avium
PTPAGTEIHDNRSIN

SEQ ID NO: 6206 - protein, 4 aa, Mycobacterium avium
PTPG

SEQ ID NO: 6207 - protein, 32 aa, Mycobacterium avium
PTPGGPPDPTDTALQGPLPPDRSPADPNPDKD

SEQ ID NO: 6208 - protein, 18 aa, Mycobacterium avium
PTPTGAEIRDANSSNGTF

SEQ ID NO: 6209 - protein, 14 aa, Mycobacterium avium
PTPYGGPVLPIEPP

SEQ ID NO: 6210 - protein, 8 aa, Mycobacterium avium
PTRAGRRQ

SEQ ID NO: 6211 - protein, 7 aa, Mycobacterium avium
PTSSYRR

SEQ ID NO: 6212 - protein, 6 aa, Mycobacterium avium
PTTDQA

SEQ ID NO: 6213 - protein, 13 aa, Mycobacterium avium
PTTGAVSDIEQAT

SEQ ID NO: 6214 - protein, 5 aa, Mycobacterium avium
PTTNE

SEQ ID NO: 6215 - protein, 5 aa, Mycobacterium avium
PTTPL

SEQ ID NO: 6216 - protein, 11 aa, Mycobacterium avium
PVAGGNEKIGD

SEQ ID NO: 6217 - protein, 14 aa, Mycobacterium avium
PVEGTKAEKRAERG

SEQ ID NO: 6218 - protein, 11 aa, Mycobacterium avium
PVGASAADAVP

SEQ ID NO: 6219 - protein, 17 aa, Mycobacterium avium
PVGGPAGSSAADALGAG

SEQ ID NO: 6220 - protein, 7 aa, Mycobacterium avium
PVKPGRG

SEQ ID NO: 6221 - protein, 5 aa, Mycobacterium avium
PVNEA

SEQ ID NO: 6222 - protein, 4 aa, Mycobacterium avium
PVPA

SEQ ID NO: 6223 - protein, 12 aa, Mycobacterium avium
PVPDPNTPTGSR

SEQ ID NO: 6224 - protein, 20 aa, Mycobacterium avium
PVPEAPAPAPAAPPPPPPAV

SEQ ID NO: 6225 - protein, 9 aa, Mycobacterium avium
PVPGQPPVL

SEQ ID NO: 6226 - protein, 8 aa, Mycobacterium avium
PVPPGRAP

SEQ ID NO: 6227 - protein, 24 aa, Mycobacterium avium
PVPPPPYAESGRRARSRHSAEYRD

SEQ ID NO: 6228 - protein, 8 aa, Mycobacterium avium
PVRDDSSA

SEQ ID NO: 6229 - protein, 6 aa, Mycobacterium avium
PVRTPG

SEQ ID NO: 6230 - protein, 12 aa, Mycobacterium avium
PVSGGPARGQVQ

SEQ ID NO: 6231 - protein, 4 aa, Mycobacterium avium
PVYR

SEQ ID NO: 6232 - protein, 4 aa, Mycobacterium avium
PWEG

SEQ ID NO: 6233 - protein, 6 aa, Mycobacterium avium
PWPHSD

SEQ ID NO: 6234 - protein, 21 aa, Mycobacterium avium
PYSRGGEKPDGRLYPEDQPDR

SEQ ID NO: 6235 - protein, 9 aa, Mycobacterium avium
QAAASATAE

SEQ ID NO: 6236 - protein, 6 aa, Mycobacterium avium
QAAATE

SEQ ID NO: 6237 - protein, 13 aa, Mycobacterium avium
QAADTFDGKGESF

SEQ ID NO: 6238 - protein, 9 aa, Mycobacterium avium
QAAGDEKLS

SEQ ID NO: 6239 - protein, 14 aa, Mycobacterium avium
QAAGGAVNGADTAG

SEQ ID NO: 6240 - protein, 9 aa, Mycobacterium avium
QADGRGPAL

SEQ ID NO: 6241 - protein, 9 aa, Mycobacterium avium
QAESAMGSA

SEQ ID NO: 6242 - protein, 4 aa, Mycobacterium avium
QAGL

SEQ ID NO: 6243 - protein, 6 aa, Mycobacterium avium
QALAPN

SEQ ID NO: 6244 - protein, 7 aa, Mycobacterium avium
QALPPGR

SEQ ID NO: 6245 - protein, 102 aa, Mycobacterium avium
QAPAYTPPAEYPQYQQPGEQAYPQPYPQQQGYAQPGQYGQYGQPGQYGQPGQYAQPGQYPQPGQYPQPGQYPQPGQYGQYGQPGQYPQQYQPYEQPGKKRPV

SEQ ID NO: 6246 - protein, 44 aa, Mycobacterium avium
QAPSNAPAPQPAVPAPANPAPEAPSNPGVVPNPNPGWAPNPNPL

SEQ ID NO: 6247 - protein, 13 aa, Mycobacterium avium
QAVAAARSRGQNT

SEQ ID NO: 6248 - protein, 12 aa, Mycobacterium avium
QDARRAQRRGKR

SEQ ID NO: 6249 - protein, 8 aa, Mycobacterium avium
QDEDQKVA

SEQ ID NO: 6250 - protein, 6 aa, Mycobacterium avium
QDEQDP

SEQ ID NO: 6251 - protein, 4 aa, Mycobacterium avium
QDPK

SEQ ID NO: 6252 - protein, 5 aa, Mycobacterium avium
QDPSG

SEQ ID NO: 6253 - protein, 6 aa, Mycobacterium avium
QDRPPR

SEQ ID NO: 6254 - protein, 9 aa, Mycobacterium avium
QDVSPDDRS

SEQ ID NO: 6255 - protein, 17 aa, Mycobacterium avium
QEAALPAAGQRDAGAST

SEQ ID NO: 6256 - protein, 6 aa, Mycobacterium avium
QERGAP

SEQ ID NO: 6257 - protein, 4 aa, Mycobacterium avium
QERP

SEQ ID NO: 6258 - protein, 6 aa, Mycobacterium avium
QFGRQN

SEQ ID NO: 6259 - protein, 6 aa, Mycobacterium avium
QGAPPK

SEQ ID NO: 6260 - protein, 4 aa, Mycobacterium avium
QGAT

SEQ ID NO: 6261 - protein, 5 aa, Mycobacterium avium
QGERT

SEQ ID NO: 6262 - protein, 6 aa, Mycobacterium avium
QGGTAG

SEQ ID NO: 6263 - protein, 5 aa, Mycobacterium avium
QGGTT

SEQ ID NO: 6264 - protein, 13 aa, Mycobacterium avium
QGMAGRPPRTESM

SEQ ID NO: 6265 - protein, 21 aa, Mycobacterium avium
QGPNTEHPGAPLRGEKSGYDF

SEQ ID NO: 6266 - protein, 8 aa, Mycobacterium avium
QGVADPRE

SEQ ID NO: 6267 - protein, 13 aa, Mycobacterium avium
QGVDCGDPVWKIG

SEQ ID NO: 6268 - protein, 7 aa, Mycobacterium avium
QHDAQAR

SEQ ID NO: 6269 - protein, 14 aa, Mycobacterium avium
QHDATRSEAGGRAA

SEQ ID NO: 6270 - protein, 19 aa, Mycobacterium avium
QHGQQQPEDDQADDVPGPV

SEQ ID NO: 6271 - protein, 6 aa, Mycobacterium avium
QHQPAQ

SEQ ID NO: 6272 - protein, 12 aa, Mycobacterium avium
QIPDSPAMSGPY

SEQ ID NO: 6273 - protein, 8 aa, Mycobacterium avium
QKGQKSLF

SEQ ID NO: 6274 - protein, 9 aa, Mycobacterium avium
QKTKTREEV

SEQ ID NO: 6275 - protein, 5 aa, Mycobacterium avium
QLDPG

SEQ ID NO: 6276 - protein, 26 aa, Mycobacterium avium
QLHGGTAALENSPLGGARLVLRLPGP

SEQ ID NO: 6277 - protein, 12 aa, Mycobacterium avium
QLPQPGAENSEE

SEQ ID NO: 6278 - protein, 14 aa, Mycobacterium avium
QNAPGQPPSQAAPA

SEQ ID NO: 6279 - protein, 4 aa, Mycobacterium avium
QNGR

SEQ ID NO: 6280 - protein, 6 aa, Mycobacterium avium
QNQAAA

SEQ ID NO: 6281 - protein, 8 aa, Mycobacterium avium
QNTSTAGV

SEQ ID NO: 6282 - protein, 4 aa, Mycobacterium avium
QNVG

SEQ ID NO: 6283 - protein, 9 aa, Mycobacterium avium
QPDLGPKQW

SEQ ID NO: 6284 - protein, 15 aa, Mycobacterium avium
QPHPQPAPEAPPARA

SEQ ID NO: 6285 - protein, 6 aa, Mycobacterium avium
QPPGHP

SEQ ID NO: 6286 - protein, 12 aa, Mycobacterium avium
QPPGVPPVPPQL

SEQ ID NO: 6287 - protein, 16 aa, Mycobacterium avium
QPPLPDGGEPEHPAPT

SEQ ID NO: 6288 - protein, 31 aa, Mycobacterium avium
QPPPPPGPVPGPGQPGAVPQPEAPPVPPPPA

SEQ ID NO: 6289 - protein, 12 aa, Mycobacterium avium
QPPVPPPDIPEE

SEQ ID NO: 6290 - protein, 6 aa, Mycobacterium avium
QPSTPA

SEQ ID NO: 6291 - protein, 5 aa, Mycobacterium avium
QQPDF

SEQ ID NO: 6292 - protein, 4 aa, Mycobacterium avium
QQPR

SEQ ID NO: 6293 - protein, 22 aa, Mycobacterium avium
QRAAAPPPDDRTSELSAAPGAT

SEQ ID NO: 6294 - protein, 5 aa, Mycobacterium avium
QRAEQ

SEQ ID NO: 6295 - protein, 7 aa, Mycobacterium avium
QRAGASA

SEQ ID NO: 6296 - protein, 6 aa, Mycobacterium avium
QRPSTH

SEQ ID NO: 6297 - protein, 9 aa, Mycobacterium avium
QRRQHPGTD

SEQ ID NO: 6298 - protein, 24 aa, Mycobacterium avium
QRSDLTETKPRVASGEDSGATDPA

SEQ ID NO: 6299 - protein, 9 aa, Mycobacterium avium
QSDADQSRV

SEQ ID NO: 6300 - protein, 4 aa, Mycobacterium avium
QSDE

SEQ ID NO: 6301 - protein, 9 aa, Mycobacterium avium
QSGNLTGGG

SEQ ID NO: 6302 - protein, 10 aa, Mycobacterium avium
QSGPRIPQSQ

SEQ ID NO: 6303 - protein, 24 aa, Mycobacterium avium
QSGTGRRIDEANPTMDGDRPSATI

SEQ ID NO: 6304 - protein, 13 aa, Mycobacterium avium
QSIADTDEPDTRL

SEQ ID NO: 6305 - protein, 8 aa, Mycobacterium avium
QSLATDKY

SEQ ID NO: 6306 - protein, 9 aa, Mycobacterium avium
QSLPDAKGA

SEQ ID NO: 6307 - protein, 9 aa, Mycobacterium avium
QSPDCRTAN

SEQ ID NO: 6308 - protein, 11 aa, Mycobacterium avium
QSPSTAESDTA

SEQ ID NO: 6309 - protein, 10 aa, Mycobacterium avium
QSRPGAEQAV

SEQ ID NO: 6310 - protein, 5 aa, Mycobacterium avium
QSRTG

SEQ ID NO: 6311 - protein, 11 aa, Mycobacterium avium
QSSGGAAQFGK

SEQ ID NO: 6312 - protein, 15 aa, Mycobacterium avium
QSTTSKDNPDPAMAS

SEQ ID NO: 6313 - protein, 10 aa, Mycobacterium avium
QTARRAHDEL

SEQ ID NO: 6314 - protein, 14 aa, Mycobacterium avium
QTDPDSGADRPRFR

SEQ ID NO: 6315 - protein, 6 aa, Mycobacterium avium
QTEYPG

SEQ ID NO: 6316 - protein, 11 aa, Mycobacterium avium
QTKKRSTAVAG

SEQ ID NO: 6317 - protein, 12 aa, Mycobacterium avium
QVDPSKGRCAFV

SEQ ID NO: 6318 - protein, 13 aa, Mycobacterium avium
RAAADPGDQAAAA

SEQ ID NO: 6319 - protein, 4 aa, Mycobacterium avium
RAAE

SEQ ID NO: 6320 - protein, 14 aa, Mycobacterium avium
RAAEAAGRDPTSLG

SEQ ID NO: 6321 - protein, 5 aa, Mycobacterium avium
RAAGA

SEQ ID NO: 6322 - protein, 9 aa, Mycobacterium avium
RAAGEGRAL

SEQ ID NO: 6323 - protein, 11 aa, Mycobacterium avium
RAANGGSLDNP

SEQ ID NO: 6324 - protein, 21 aa, Mycobacterium avium
RAAPDPTASSTTTRRRIGKPA

SEQ ID NO: 6325 - protein, 14 aa, Mycobacterium avium
RAAPRTEPASPRWR

SEQ ID NO: 6326 - protein, 4 aa, Mycobacterium avium
RAAT

SEQ ID NO: 6327 - protein, 8 aa, Mycobacterium avium
RADPGART

SEQ ID NO: 6328 - protein, 6 aa, Mycobacterium avium
RADPHA

SEQ ID NO: 6329 - protein, 36 aa, Mycobacterium avium
RADQQQQPPTVTDTGTPPASAPPPTKTPSGSGAHPG

SEQ ID NO: 6330 - protein, 7 aa, Mycobacterium avium
RAEAGAP

SEQ ID NO: 6331 - protein, 13 aa, Mycobacterium avium
RAEASGLRGDGGI

SEQ ID NO: 6332 - protein, 50 aa, Mycobacterium avium
RAEGSGGSESDAAGDQANARGQGENGDPARQRRRAGGGLSAQDLLRREGR

SEQ ID NO: 6333 - protein, 30 aa, Mycobacterium avium
RAEPDADAAVQPEEPGPIAGEDFPDDDQNS

SEQ ID NO: 6334 - protein, 15 aa, Mycobacterium avium
RAERRRKPATGAFPA

SEQ ID NO: 6335 - protein, 12 aa, Mycobacterium avium
RAESYGDAAGQL

SEQ ID NO: 6336 - protein, 6 aa, Mycobacterium avium
RAGGKR

SEQ ID NO: 6337 - protein, 5 aa, Mycobacterium avium
RAGGR

SEQ ID NO: 6338 - protein, 5 aa, Mycobacterium avium
RAGLD

SEQ ID NO: 6339 - protein, 10 aa, Mycobacterium avium
RAGPAVPHGP

SEQ ID NO: 6340 - protein, 10 aa, Mycobacterium avium
RAGSLRPGEL

SEQ ID NO: 6341 - protein, 4 aa, Mycobacterium avium
RAHG

SEQ ID NO: 6342 - protein, 12 aa, Mycobacterium avium
RAIEEGASLSGD

SEQ ID NO: 6343 - protein, 12 aa, Mycobacterium avium
RALQQDRDVDDA

SEQ ID NO: 6344 - protein, 10 aa, Mycobacterium avium
RALTEDTGPL

SEQ ID NO: 6345 - protein, 7 aa, Mycobacterium avium
RANPSPI

SEQ ID NO: 6346 - protein, 7 aa, Mycobacterium avium
RAPEKSW

SEQ ID NO: 6347 - protein, 23 aa, Mycobacterium avium
RAPLEQPAPAGAAAWRTGPDSEP

SEQ ID NO: 6348 - protein, 7 aa, Mycobacterium avium
RAQAADD

SEQ ID NO: 6349 - protein, 8 aa, Mycobacterium avium
RAQDGTLA

SEQ ID NO: 6350 - protein, 13 aa, Mycobacterium avium
RAQSGKADAQRLA

SEQ ID NO: 6351 - protein, 5 aa, Mycobacterium avium
RARRA

SEQ ID NO: 6352 - protein, 5 aa, Mycobacterium avium
RASRL

SEQ ID NO: 6353 - protein, 8 aa, Mycobacterium avium
RATAPKLR

SEQ ID NO: 6354 - protein, 5 aa, Mycobacterium avium
RATAR

SEQ ID NO: 6355 - protein, 10 aa, Mycobacterium avium
RATDVEPNRL

SEQ ID NO: 6356 - protein, 5 aa, Mycobacterium avium
RATES

SEQ ID NO: 6357 - protein, 7 aa, Mycobacterium avium
RATGSGH

SEQ ID NO: 6358 - protein, 19 aa, Mycobacterium avium
RAVPSNLDPPLAQAPADKA

SEQ ID NO: 6359 - protein, 5 aa, Mycobacterium avium
RAVTG

SEQ ID NO: 6360 - protein, 4 aa, Mycobacterium avium
RCDK

SEQ ID NO: 6361 - protein, 4 aa, Mycobacterium avium
RDAS

SEQ ID NO: 6362 - protein, 5 aa, Mycobacterium avium
RDDTD

SEQ ID NO: 6363 - protein, 7 aa, Mycobacterium avium
RDFTDDS

SEQ ID NO: 6364 - protein, 26 aa, Mycobacterium avium
RDGGTDAFGPDDYGGDYHDDYDDDDA

SEQ ID NO: 6365 - protein, 7 aa, Mycobacterium avium
RDGSRTR

SEQ ID NO: 6366 - protein, 9 aa, Mycobacterium avium
RDGSTGPFG

SEQ ID NO: 6367 - protein, 7 aa, Mycobacterium avium
RDHPDPD

SEQ ID NO: 6368 - protein, 6 aa, Mycobacterium avium
RDIAER

SEQ ID NO: 6369 - protein, 6 aa, Mycobacterium avium
RDLAAE

SEQ ID NO: 6370 - protein, 10 aa, Mycobacterium avium
RDNTDQFNTR

SEQ ID NO: 6371 - protein, 8 aa, Mycobacterium avium
RDPAALDA

SEQ ID NO: 6372 - protein, 6 aa, Mycobacterium avium
RDRGQV

SEQ ID NO: 6373 - protein, 7 aa, Mycobacterium avium
RDSPTWS

SEQ ID NO: 6374 - protein, 4 aa, Mycobacterium avium
RDSV

SEQ ID NO: 6375 - protein, 4 aa, Mycobacterium avium
RDTL

SEQ ID NO: 6376 - protein, 9 aa, Mycobacterium avium
RDTVSKGDC

SEQ ID NO: 6377 - protein, 18 aa, Mycobacterium avium
REAGRRAPGAEPPARHPT

SEQ ID NO: 6378 - protein, 10 aa, Mycobacterium avium
REARTAGRLQ

SEQ ID NO: 6379 - protein, 12 aa, Mycobacterium avium
REEAARHGTRQG

SEQ ID NO: 6380 - protein, 5 aa, Mycobacterium avium
REEDL

SEQ ID NO: 6381 - protein, 5 aa, Mycobacterium avium
REGGD

SEQ ID NO: 6382 - protein, 8 aa, Mycobacterium avium
REHTGTQV

SEQ ID NO: 6383 - protein, 6 aa, Mycobacterium avium
RELMGS

SEQ ID NO: 6384 - protein, 14 aa, Mycobacterium avium
REPTSGTIERPGSV

SEQ ID NO: 6385 - protein, 8 aa, Mycobacterium avium
RERGMSTA

SEQ ID NO: 6386 - protein, 5 aa, Mycobacterium avium
RESDR

SEQ ID NO: 6387 - protein, 17 aa, Mycobacterium avium
REVRTQTATFEDEPYDL

SEQ ID NO: 6388 - protein, 6 aa, Mycobacterium avium
RGAGQK

SEQ ID NO: 6389 - protein, 5 aa, Mycobacterium avium
RGAPR

SEQ ID NO: 6390 - protein, 12 aa, Mycobacterium avium
RGDNARRPVPAS

SEQ ID NO: 6391 - protein, 7 aa, Mycobacterium avium
RGDVPAS

SEQ ID NO: 6392 - protein, 12 aa, Mycobacterium avium
RGDYDPHTDAAE

SEQ ID NO: 6393 - protein, 49 aa, Mycobacterium avium
RGEAASINRPEPGPGSAPRKARDATADVAADDDDTGPFSGRLLVADSSR

SEQ ID NO: 6394 - protein, 6 aa, Mycobacterium avium
RGGELD

SEQ ID NO: 6395 - protein, 8 aa, Mycobacterium avium
RGGQGGGH

SEQ ID NO: 6396 - protein, 5 aa, Mycobacterium avium
RGHTT

SEQ ID NO: 6397 - protein, 22 aa, Mycobacterium avium
RGKANPAEAAPGHSARQRRTRQ

SEQ ID NO: 6398 - protein, 11 aa, Mycobacterium avium
RGLDRAERAQA

SEQ ID NO: 6399 - protein, 8 aa, Mycobacterium avium
RGLPTPSY

SEQ ID NO: 6400 - protein, 4 aa, Mycobacterium avium
RGPA

SEQ ID NO: 6401 - protein, 19 aa, Mycobacterium avium
RGPASRLSRPLTEDEPVPS

SEQ ID NO: 6402 - protein, 50 aa, Mycobacterium avium
RGPRQTIESVKETRTALTPGHDKAAGARALTESHGKHAKPGDGAAADPSG

SEQ ID NO: 6403 - protein, 5 aa, Mycobacterium avium
RGPVG

SEQ ID NO: 6404 - protein, 21 aa, Mycobacterium avium
RGRAAVDPEEPAEMLTFGQEI

SEQ ID NO: 6405 - protein, 7 aa, Mycobacterium avium
RGRGDED

SEQ ID NO: 6406 - protein, 7 aa, Mycobacterium avium
RGRQESR

SEQ ID NO: 6407 - protein, 4 aa, Mycobacterium avium
RGRR

SEQ ID NO: 6408 - protein, 20 aa, Mycobacterium avium
RGRRRPTRTPERESERLPAS

SEQ ID NO: 6409 - protein, 9 aa, Mycobacterium avium
RGRRSLPAA

SEQ ID NO: 6410 - protein, 12 aa, Mycobacterium avium
RGSTASQSGSGL

SEQ ID NO: 6411 - protein, 6 aa, Mycobacterium avium
RGTGQR

SEQ ID NO: 6412 - protein, 7 aa, Mycobacterium avium
RGVTPTE

SEQ ID NO: 6413 - protein, 9 aa, Mycobacterium avium
RHPQPVPPI

SEQ ID NO: 6414 - protein, 8 aa, Mycobacterium avium
RHPTHDDA

SEQ ID NO: 6415 - protein, 7 aa, Mycobacterium avium
RHSESPA

SEQ ID NO: 6416 - protein, 4 aa, Mycobacterium avium
RHSP

SEQ ID NO: 6417 - protein, 12 aa, Mycobacterium avium
RHSTPNGSTNGE

SEQ ID NO: 6418 - protein, 20 aa, Mycobacterium avium
RHTPDTSVGTASGAGASADI

SEQ ID NO: 6419 - protein, 7 aa, Mycobacterium avium
RKEFGPA

SEQ ID NO: 6420 - protein, 12 aa, Mycobacterium avium
RKEGQSGQAKMT

SEQ ID NO: 6421 - protein, 11 aa, Mycobacterium avium
RKERQPEPRAV

SEQ ID NO: 6422 - protein, 8 aa, Mycobacterium avium
RKLPTERY

SEQ ID NO: 6423 - protein, 14 aa, Mycobacterium avium
RKRGTQDPPARPWR

SEQ ID NO: 6424 - protein, 7 aa, Mycobacterium avium
RLDEGRL

SEQ ID NO: 6425 - protein, 12 aa, Mycobacterium avium
RLDQNGRPLPPE

SEQ ID NO: 6426 - protein, 4 aa, Mycobacterium avium
RLGG

SEQ ID NO: 6427 - protein, 12 aa, Mycobacterium avium
RLGSRPAAMARP

SEQ ID NO: 6428 - protein, 12 aa, Mycobacterium avium
RLPPPGSAARPA

SEQ ID NO: 6429 - protein, 8 aa, Mycobacterium avium
RLSGTTGL

SEQ ID NO: 6430 - protein, 4 aa, Mycobacterium avium
RMPA

SEQ ID NO: 6431 - protein, 13 aa, Mycobacterium avium
RMPPPDASQAQLR

SEQ ID NO: 6432 - protein, 10 aa, Mycobacterium avium
RNAAADDTRA

SEQ ID NO: 6433 - protein, 9 aa, Mycobacterium avium
RNANRKRHE

SEQ ID NO: 6434 - protein, 19 aa, Mycobacterium avium
RNDGTYATPAQRPDRPSEE

SEQ ID NO: 6435 - protein, 10 aa, Mycobacterium avium
RNNSGRPGGR

SEQ ID NO: 6436 - protein, 6 aa, Mycobacterium avium
RNPSDD

SEQ ID NO: 6437 - protein, 11 aa, Mycobacterium avium
RNPVSNTGSAQ

SEQ ID NO: 6438 - protein, 6 aa, Mycobacterium avium
RNPYAK

SEQ ID NO: 6439 - protein, 5 aa, Mycobacterium avium
RPAAP

SEQ ID NO: 6440 - protein, 15 aa, Mycobacterium avium
RPAEAVPHDQPGRGL

SEQ ID NO: 6441 - protein, 7 aa, Mycobacterium avium
RPAPAEL

SEQ ID NO: 6442 - protein, 11 aa, Mycobacterium avium
RPDAYTAADKL

SEQ ID NO: 6443 - protein, 5 aa, Mycobacterium avium
RPEDP

SEQ ID NO: 6444 - protein, 7 aa, Mycobacterium avium
RPESTQS

SEQ ID NO: 6445 - protein, 8 aa, Mycobacterium avium
RPGANDRV

SEQ ID NO: 6446 - protein, 19 aa, Mycobacterium avium
RPGRHPGRPEAGAAQSPTA

SEQ ID NO: 6447 - protein, 13 aa, Mycobacterium avium
RPGRTDPQPPTGA

SEQ ID NO: 6448 - protein, 6 aa, Mycobacterium avium
RPLGDS

SEQ ID NO: 6449 - protein, 9 aa, Mycobacterium avium
RPLRADDDE

SEQ ID NO: 6450 - protein, 45 aa, Mycobacterium avium
RPPAPWPAPGYPPAWPGSGPAPQWPAPGPANPGPPEGFSAGFTPP

SEQ ID NO: 6451 - protein, 6 aa, Mycobacterium avium
RPQPEL

SEQ ID NO: 6452 - protein, 6 aa, Mycobacterium avium
RPRDRG

SEQ ID NO: 6453 - protein, 9 aa, Mycobacterium avium
RPRTSAPSV

SEQ ID NO: 6454 - protein, 4 aa, Mycobacterium avium
RPTA

SEQ ID NO: 6455 - protein, 11 aa, Mycobacterium avium
RPTGPSREEFS

SEQ ID NO: 6456 - protein, 4 aa, Mycobacterium avium
RPTM

SEQ ID NO: 6457 - protein, 7 aa, Mycobacterium avium
RPTVEQH

SEQ ID NO: 6458 - protein, 9 aa, Mycobacterium avium
RQAAPPPWS

SEQ ID NO: 6459 - protein, 8 aa, Mycobacterium avium
RQADPQLR

SEQ ID NO: 6460 - protein, 4 aa, Mycobacterium avium
RQGA

SEQ ID NO: 6461 - protein, 4 aa, Mycobacterium avium
RQIA

SEQ ID NO: 6462 - protein, 6 aa, Mycobacterium avium
RQLPSD

SEQ ID NO: 6463 - protein, 9 aa, Mycobacterium avium
RQLQTQQDV

SEQ ID NO: 6464 - protein, 8 aa, Mycobacterium avium
RQPNLADA

SEQ ID NO: 6465 - protein, 64 aa, Mycobacterium avium
RQRPGRSGAPKHPDASPAETEGDTHPAHNAAPDEDGDHAPPEDGGDDTGPPEGGRPHIGRHRGA

SEQ ID NO: 6466 - protein, 10 aa, Mycobacterium avium
RQRRPGSDPF

SEQ ID NO: 6467 - protein, 6 aa, Mycobacterium avium
RQRTDA

SEQ ID NO: 6468 - protein, 8 aa, Mycobacterium avium
RQTGRDRL

SEQ ID NO: 6469 - protein, 9 aa, Mycobacterium avium
RQVGESRED

SEQ ID NO: 6470 - protein, 10 aa, Mycobacterium avium
RRAAADPALQ

SEQ ID NO: 6471 - protein, 8 aa, Mycobacterium avium
RRAPRGDE

SEQ ID NO: 6472 - protein, 10 aa, Mycobacterium avium
RRDENDGSFT

SEQ ID NO: 6473 - protein, 14 aa, Mycobacterium avium
RRDGGGADGAAGGR

SEQ ID NO: 6474 - protein, 5 aa, Mycobacterium avium
RRDPR

SEQ ID NO: 6475 - protein, 84 aa, Mycobacterium avium
RREAQAQAAKAAAETSEADEHAADDEPAETDDEVSDSVEATDADDTETTQAQTKEAAKEAEPNEEAAEETAEDAESESKARSRR

SEQ ID NO: 6476 - protein, 5 aa, Mycobacterium avium
RRERQ

SEQ ID NO: 6477 - protein, 21 aa, Mycobacterium avium
RRGGPRTVDAPGGAGHEHSHR

SEQ ID NO: 6478 - protein, 16 aa, Mycobacterium avium
RRGRARSVTGIGAAGG

SEQ ID NO: 6479 - protein, 10 aa, Mycobacterium avium
RRGRRTGAQH

SEQ ID NO: 6480 - protein, 5 aa, Mycobacterium avium
RRITG

SEQ ID NO: 6481 - protein, 10 aa, Mycobacterium avium
RRNPGSSGIA

SEQ ID NO: 6482 - protein, 4 aa, Mycobacterium avium
RRPA

SEQ ID NO: 6483 - protein, 12 aa, Mycobacterium avium
RRQSGTHALPPD

SEQ ID NO: 6484 - protein, 7 aa, Mycobacterium avium
RRRASDG

SEQ ID NO: 6485 - protein, 6 aa, Mycobacterium avium
RRREDE

SEQ ID NO: 6486 - protein, 12 aa, Mycobacterium avium
RRRGRSRRRKSW

SEQ ID NO: 6487 - protein, 6 aa, Mycobacterium avium
RRRRRG

SEQ ID NO: 6488 - protein, 10 aa, Mycobacterium avium
RRRRSRAGTI

SEQ ID NO: 6489 - protein, 10 aa, Mycobacterium avium
RRSKRTAGAA

SEQ ID NO: 6490 - protein, 8 aa, Mycobacterium avium
RRSRGGGT

SEQ ID NO: 6491 - protein, 5 aa, Mycobacterium avium
RRTTA

SEQ ID NO: 6492 - protein, 22 aa, Mycobacterium avium
RSAEPVGATPRAAHSARPPLRT

SEQ ID NO: 6493 - protein, 10 aa, Mycobacterium avium
RSDPPETTRG

SEQ ID NO: 6494 - protein, 8 aa, Mycobacterium avium
RSESAVKA

SEQ ID NO: 6495 - protein, 9 aa, Mycobacterium avium
RSFGQGREE

SEQ ID NO: 6496 - protein, 7 aa, Mycobacterium avium
RSGGAER

SEQ ID NO: 6497 - protein, 9 aa, Mycobacterium avium
RSGPPRGRR

SEQ ID NO: 6498 - protein, 9 aa, Mycobacterium avium
RSGSDRPAG

SEQ ID NO: 6499 - protein, 11 aa, Mycobacterium avium
RSHDEGLSATG

SEQ ID NO: 6500 - protein, 12 aa, Mycobacterium avium
RSKGPAAARNTG

SEQ ID NO: 6501 - protein, 15 aa, Mycobacterium avium
RSLSPPGPPPTQGGA

SEQ ID NO: 6502 - protein, 32 aa, Mycobacterium avium
RSPAPAVPDEPAENPAPQPHSESLARAAERGL

SEQ ID NO: 6503 - protein, 20 aa, Mycobacterium avium
RSQAASAPTADEIPPFSTEK

SEQ ID NO: 6504 - protein, 6 aa, Mycobacterium avium
RSQIDP

SEQ ID NO: 6505 - protein, 13 aa, Mycobacterium avium
RSSSEPAPKADRH

SEQ ID NO: 6506 - protein, 9 aa, Mycobacterium avium
RSTGTPQST

SEQ ID NO: 6507 - protein, 11 aa, Mycobacterium avium
RTAPPPPPARL

SEQ ID NO: 6508 - protein, 9 aa, Mycobacterium avium
RTASPAHAP

SEQ ID NO: 6509 - protein, 5 aa, Mycobacterium avium
RTDTM

SEQ ID NO: 6510 - protein, 6 aa, Mycobacterium avium
RTFSPL

SEQ ID NO: 6511 - protein, 23 aa, Mycobacterium avium
RTGPQPPPPPAEQPAELGDPAHT

SEQ ID NO: 6512 - protein, 16 aa, Mycobacterium avium
RTGRSHARESSEGPDQ

SEQ ID NO: 6513 - protein, 19 aa, Mycobacterium avium
RTGYDSQQTEQPVGGDRPH

SEQ ID NO: 6514 - protein, 5 aa, Mycobacterium avium
RTIDE

SEQ ID NO: 6515 - protein, 6 aa, Mycobacterium avium
RTLGGG

SEQ ID NO: 6516 - protein, 4 aa, Mycobacterium avium
RTNY

SEQ ID NO: 6517 - protein, 6 aa, Mycobacterium avium
RTPAER

SEQ ID NO: 6518 - protein, 14 aa, Mycobacterium avium
RTPDTPPGSLGPLP

SEQ ID NO: 6519 - protein, 7 aa, Mycobacterium avium
RTPEGDQ

SEQ ID NO: 6520 - protein, 11 aa, Mycobacterium avium
RTPSHTEESAW

SEQ ID NO: 6521 - protein, 9 aa, Mycobacterium avium
RTPTGLRDV

SEQ ID NO: 6522 - protein, 11 aa, Mycobacterium avium
RTPTPAPTPPS

SEQ ID NO: 6523 - protein, 11 aa, Mycobacterium avium
RTQAAAQRAAA

SEQ ID NO: 6524 - protein, 4 aa, Mycobacterium avium
RTTG

SEQ ID NO: 6525 - protein, 7 aa, Mycobacterium avium
RTTTPYT

SEQ ID NO: 6526 - protein, 4 aa, Mycobacterium avium
RTWT

SEQ ID NO: 6527 - protein, 12 aa, Mycobacterium avium
RVANPNVQGRPR

SEQ ID NO: 6528 - protein, 27 aa, Mycobacterium avium
RVPPPEPEPVGPPPTQPATLAPPYRPG

SEQ ID NO: 6529 - protein, 6 aa, Mycobacterium avium
RVRPDH

SEQ ID NO: 6530 - protein, 4 aa, Mycobacterium avium
RWPG

SEQ ID NO: 6531 - protein, 7 aa, Mycobacterium avium
RYGPRAP

SEQ ID NO: 6532 - protein, 6 aa, Mycobacterium avium
RYHPDT

SEQ ID NO: 6533 - protein, 6 aa, Mycobacterium avium
RYPGMA

SEQ ID NO: 6534 - protein, 4 aa, Mycobacterium avium
RYSH

SEQ ID NO: 6535 - protein, 12 aa, Mycobacterium avium
SAAAGQAERLGA

SEQ ID NO: 6536 - protein, 6 aa, Mycobacterium avium
SAAETL

SEQ ID NO: 6537 - protein, 7 aa, Mycobacterium avium
SAAHTAP

SEQ ID NO: 6538 - protein, 18 aa, Mycobacterium avium
SAARHAAPEPTDDDDEHH

SEQ ID NO: 6539 - protein, 10 aa, Mycobacterium avium
SAARRAATGL

SEQ ID NO: 6540 - protein, 8 aa, Mycobacterium avium
SAATLPKE

SEQ ID NO: 6541 - protein, 6 aa, Mycobacterium avium
SADGDP

SEQ ID NO: 6542 - protein, 8 aa, Mycobacterium avium
SADKAKSF

SEQ ID NO: 6543 - protein, 12 aa, Mycobacterium avium
SAESLKETLRGQ

SEQ ID NO: 6544 - protein, 10 aa, Mycobacterium avium
SAESLPTRPE

SEQ ID NO: 6545 - protein, 7 aa, Mycobacterium avium
SAESRER

SEQ ID NO: 6546 - protein, 15 aa, Mycobacterium avium
SAETGAPPPAPRAAP

SEQ ID NO: 6547 - protein, 5 aa, Mycobacterium avium
SAGYS

SEQ ID NO: 6548 - protein, 4 aa, Mycobacterium avium
SAIT

SEQ ID NO: 6549 - protein, 17 aa, Mycobacterium avium
SAITADLGSRTMREETD

SEQ ID NO: 6550 - protein, 36 aa, Mycobacterium avium
SALAAAPRTAPAPSIVKPGGEANNLAANAAQNSSGD

SEQ ID NO: 6551 - protein, 9 aa, Mycobacterium avium
SAMGTANGI

SEQ ID NO: 6552 - protein, 12 aa, Mycobacterium avium
SANDATCGSAPC

SEQ ID NO: 6553 - protein, 14 aa, Mycobacterium avium
SAPENPSRQRISPR

SEQ ID NO: 6554 - protein, 15 aa, Mycobacterium avium
SAPRPAAARRAAKDF

SEQ ID NO: 6555 - protein, 13 aa, Mycobacterium avium
SAPSNQGQEAANR

SEQ ID NO: 6556 - protein, 8 aa, Mycobacterium avium
SAPYRADS

SEQ ID NO: 6557 - protein, 25 aa, Mycobacterium avium
SASDGDDAPAGPDRSAAAPARSRPR

SEQ ID NO: 6558 - protein, 13 aa, Mycobacterium avium
SASGTTDSERPRL

SEQ ID NO: 6559 - protein, 15 aa, Mycobacterium avium
SASPLGRDLAEQSTV

SEQ ID NO: 6560 - protein, 15 aa, Mycobacterium avium
SASTTSNTITDNQRS

SEQ ID NO: 6561 - protein, 5 aa, Mycobacterium avium
SATAG

SEQ ID NO: 6562 - protein, 17 aa, Mycobacterium avium
SATKPGAKVDARSERWR

SEQ ID NO: 6563 - protein, 9 aa, Mycobacterium avium
SATNQPTDV

SEQ ID NO: 6564 - protein, 10 aa, Mycobacterium avium
SATTDEKLTQ

SEQ ID NO: 6565 - protein, 4 aa, Mycobacterium avium
SAVG

SEQ ID NO: 6566 - protein, 5 aa, Mycobacterium avium
SAVHP

SEQ ID NO: 6567 - protein, 4 aa, Mycobacterium avium
SDAA

SEQ ID NO: 6568 - protein, 6 aa, Mycobacterium avium
SDAPTY

SEQ ID NO: 6569 - protein, 20 aa, Mycobacterium avium
SDASQDDSGNEDHDPKIDNP

SEQ ID NO: 6570 - protein, 9 aa, Mycobacterium avium
SDDGGPERF

SEQ ID NO: 6571 - protein, 10 aa, Mycobacterium avium
SDEELEPVTG

SEQ ID NO: 6572 - protein, 8 aa, Mycobacterium avium
SDEMNEEV

SEQ ID NO: 6573 - protein, 5 aa, Mycobacterium avium
SDERK

SEQ ID NO: 6574 - protein, 6 aa, Mycobacterium avium
SDRGAV

SEQ ID NO: 6575 - protein, 27 aa, Mycobacterium avium
SDSALDDDLDEDLDDDHADAATLTDED

SEQ ID NO: 6576 - protein, 25 aa, Mycobacterium avium
SDSPDGPAQLPGTPTHPGTGQATAT

SEQ ID NO: 6577 - protein, 10 aa, Mycobacterium avium
SDTIGKRDEQ

SEQ ID NO: 6578 - protein, 9 aa, Mycobacterium avium
SEADPAAGR

SEQ ID NO: 6579 - protein, 7 aa, Mycobacterium avium
SEAESRA

SEQ ID NO: 6580 - protein, 6 aa, Mycobacterium avium
SEGSVR

SEQ ID NO: 6581 - protein, 4 aa, Mycobacterium avium
SEIH

SEQ ID NO: 6582 - protein, 31 aa, Mycobacterium avium
SEPTQAARYGGGYGEYGGYEDRPPPEPPTPW

SEQ ID NO: 6583 - protein, 4 aa, Mycobacterium avium
SERG

SEQ ID NO: 6584 - protein, 5 aa, Mycobacterium avium
SESAQ

SEQ ID NO: 6585 - protein, 6 aa, Mycobacterium avium
SESHMR

SEQ ID NO: 6586 - protein, 9 aa, Mycobacterium avium
SESTIRQAR

SEQ ID NO: 6587 - protein, 7 aa, Mycobacterium avium
SFPPIEP

SEQ ID NO: 6588 - protein, 8 aa, Mycobacterium avium
SFRDPAHK

SEQ ID NO: 6589 - protein, 5 aa, Mycobacterium avium
SFSSD

SEQ ID NO: 6590 - protein, 16 aa, Mycobacterium avium
SFTSRTPVNDNPDQVQ

SEQ ID NO: 6591 - protein, 21 aa, Mycobacterium avium
SGAAQGSYAAASTDNLWLTRP

SEQ ID NO: 6592 - protein, 4 aa, Mycobacterium avium
SGAP

SEQ ID NO: 6593 - protein, 20 aa, Mycobacterium avium
SGARAEVKRQTGADQIKPQT

SEQ ID NO: 6594 - protein, 7 aa, Mycobacterium avium
SGIGEAR

SEQ ID NO: 6595 - protein, 13 aa, Mycobacterium avium
SGLQQQGVPAAVA

SEQ ID NO: 6596 - protein, 9 aa, Mycobacterium avium
SGLRGATKE

SEQ ID NO: 6597 - protein, 15 aa, Mycobacterium avium
SGNDTLKTVTDQRRD

SEQ ID NO: 6598 - protein, 6 aa, Mycobacterium avium
SGNVDA

SEQ ID NO: 6599 - protein, 8 aa, Mycobacterium avium
SGQTATRW

SEQ ID NO: 6600 - protein, 16 aa, Mycobacterium avium
SGRAPSGALAAGGPST

SEQ ID NO: 6601 - protein, 6 aa, Mycobacterium avium
SGSPLP

SEQ ID NO: 6602 - protein, 8 aa, Mycobacterium avium
SGSPQPGI

SEQ ID NO: 6603 - protein, 9 aa, Mycobacterium avium
SGTGALGAA

SEQ ID NO: 6604 - protein, 21 aa, Mycobacterium avium
SGTTGAHAHGHSASDSVGANM

SEQ ID NO: 6605 - protein, 16 aa, Mycobacterium avium
SGTTGKPKGVPRAPQL

SEQ ID NO: 6606 - protein, 5 aa, Mycobacterium avium
SGVPA

SEQ ID NO: 6607 - protein, 21 aa, Mycobacterium avium
SGVRSGLAPAERDSSGNPVEP

SEQ ID NO: 6608 - protein, 7 aa, Mycobacterium avium
SGVSWTD

SEQ ID NO: 6609 - protein, 11 aa, Mycobacterium avium
SHASPSTGSAL

SEQ ID NO: 6610 - protein, 9 aa, Mycobacterium avium
SHPASPAKR

SEQ ID NO: 6611 - protein, 5 aa, Mycobacterium avium
SHSGR

SEQ ID NO: 6612 - protein, 12 aa, Mycobacterium avium
SHTAGGDEPPRE

SEQ ID NO: 6613 - protein, 42 aa, Mycobacterium avium
SHVPTTASAPAPTMAGSAGGGPVGGGPGVGFGPTATDGIGAG

SEQ ID NO: 6614 - protein, 5 aa, Mycobacterium avium
SIRDT

SEQ ID NO: 6615 - protein, 9 aa, Mycobacterium avium
SITAKEHPL

SEQ ID NO: 6616 - protein, 10 aa, Mycobacterium avium
SKGTRSDKIR

SEQ ID NO: 6617 - protein, 7 aa, Mycobacterium avium
SKTGKTT

SEQ ID NO: 6618 - protein, 5 aa, Mycobacterium avium
SKVTY

SEQ ID NO: 6619 - protein, 7 aa, Mycobacterium avium
SLEGGKQ

SEQ ID NO: 6620 - protein, 5 aa, Mycobacterium avium
SLGDN

SEQ ID NO: 6621 - protein, 7 aa, Mycobacterium avium
SLGVEKP

SEQ ID NO: 6622 - protein, 10 aa, Mycobacterium avium
SLRDDADLRD

SEQ ID NO: 6623 - protein, 6 aa, Mycobacterium avium
SLTPDR

SEQ ID NO: 6624 - protein, 12 aa, Mycobacterium avium
SMAGREPPAPAP

SEQ ID NO: 6625 - protein, 8 aa, Mycobacterium avium
SNKPPTLP

SEQ ID NO: 6626 - protein, 5 aa, Mycobacterium avium
SNPDE

SEQ ID NO: 6627 - protein, 8 aa, Mycobacterium avium
SNPRQARA

SEQ ID NO: 6628 - protein, 4 aa, Mycobacterium avium
SNRR

SEQ ID NO: 6629 - protein, 20 aa, Mycobacterium avium
SNVAATSSVATGSDDPAWQS

SEQ ID NO: 6630 - protein, 8 aa, Mycobacterium avium
SPANTVRG

SEQ ID NO: 6631 - protein, 8 aa, Mycobacterium avium
SPARRSQE

SEQ ID NO: 6632 - protein, 14 aa, Mycobacterium avium
SPDFGPLSDPARRA

SEQ ID NO: 6633 - protein, 5 aa, Mycobacterium avium
SPDLD

SEQ ID NO: 6634 - protein, 6 aa, Mycobacterium avium
SPDTLD

SEQ ID NO: 6635 - protein, 14 aa, Mycobacterium avium
SPDVPTTHEPPTYA

SEQ ID NO: 6636 - protein, 7 aa, Mycobacterium avium
SPEARRR

SEQ ID NO: 6637 - protein, 5 aa, Mycobacterium avium
SPEEA

SEQ ID NO: 6638 - protein, 7 aa, Mycobacterium avium
SPGEQQR

SEQ ID NO: 6639 - protein, 21 aa, Mycobacterium avium
SPGPLAADRRSADNRDCPSRN

SEQ ID NO: 6640 - protein, 11 aa, Mycobacterium avium
SPGPQSPRDSH

SEQ ID NO: 6641 - protein, 12 aa, Mycobacterium avium
SPGRGGPVTAAG

SEQ ID NO: 6642 - protein, 6 aa, Mycobacterium avium
SPGSTP

SEQ ID NO: 6643 - protein, 6 aa, Mycobacterium avium
SPHRSN

SEQ ID NO: 6644 - protein, 4 aa, Mycobacterium avium
SPQT

SEQ ID NO: 6645 - protein, 7 aa, Mycobacterium avium
SPQTAQT

SEQ ID NO: 6646 - protein, 4 aa, Mycobacterium avium
SPTV

SEQ ID NO: 6647 - protein, 19 aa, Mycobacterium avium
SPVRSTGAKSDAAFNRAAS

SEQ ID NO: 6648 - protein, 4 aa, Mycobacterium avium
SQAF

SEQ ID NO: 6649 - protein, 28 aa, Mycobacterium avium
SQDADTSDEPVPYTGRDATGEYASEARR

SEQ ID NO: 6650 - protein, 7 aa, Mycobacterium avium
SQDEARA

SEQ ID NO: 6651 - protein, 36 aa, Mycobacterium avium
SQGAAPSAAATTRIATGGPGADHEPPTTEIPPLAGS

SEQ ID NO: 6652 - protein, 6 aa, Mycobacterium avium
SQLAGR

SEQ ID NO: 6653 - protein, 6 aa, Mycobacterium avium
SQLTPG

SEQ ID NO: 6654 - protein, 40 aa, Mycobacterium avium
SQQPPTGELPPPGFPPDRPEGFEQPGNVDPFDQEAEPTPW

SEQ ID NO: 6655 - protein, 8 aa, Mycobacterium avium
SQRLPGAA

SEQ ID NO: 6656 - protein, 13 aa, Mycobacterium avium
SQSEPPDSRNGLA

SEQ ID NO: 6657 - protein, 5 aa, Mycobacterium avium
SQTGH

SEQ ID NO: 6658 - protein, 8 aa, Mycobacterium avium
SRAAPEDT

SEQ ID NO: 6659 - protein, 9 aa, Mycobacterium avium
SRAPSVHNT

SEQ ID NO: 6660 - protein, 5 aa, Mycobacterium avium
SRDDT

SEQ ID NO: 6661 - protein, 8 aa, Mycobacterium avium
SRGKGTTA

SEQ ID NO: 6662 - protein, 6 aa, Mycobacterium avium
SRGTDV

SEQ ID NO: 6663 - protein, 10 aa, Mycobacterium avium
SRHGNVGDYP

SEQ ID NO: 6664 - protein, 6 aa, Mycobacterium avium
SRRPLQ

SEQ ID NO: 6665 - protein, 4 aa, Mycobacterium avium
SRRR

SEQ ID NO: 6666 - protein, 9 aa, Mycobacterium avium
SRRRRAANS

SEQ ID NO: 6667 - protein, 4 aa, Mycobacterium avium
SRRS

SEQ ID NO: 6668 - protein, 22 aa, Mycobacterium avium
SRSAQEQLDEQAAELRRSNTEL

SEQ ID NO: 6669 - protein, 6 aa, Mycobacterium avium
SRTSLT

SEQ ID NO: 6670 - protein, 14 aa, Mycobacterium avium
SRVPPIPRPPADTV

SEQ ID NO: 6671 - protein, 5 aa, Mycobacterium avium
SRWRP

SEQ ID NO: 6672 - protein, 16 aa, Mycobacterium avium
SSAAARTDSGRPKVSA

SEQ ID NO: 6673 - protein, 4 aa, Mycobacterium avium
SSAV

SEQ ID NO: 6674 - protein, 9 aa, Mycobacterium avium
SSGPGPAPL

SEQ ID NO: 6675 - protein, 9 aa, Mycobacterium avium
SSGPGPASL

SEQ ID NO: 6676 - protein, 9 aa, Mycobacterium avium
SSGPGPGPL

SEQ ID NO: 6677 - protein, 11 aa, Mycobacterium avium
SSLADETPEGR

SEQ ID NO: 6678 - protein, 8 aa, Mycobacterium avium
SSLAPRER

SEQ ID NO: 6679 - protein, 5 aa, Mycobacterium avium
SSLTD

SEQ ID NO: 6680 - protein, 5 aa, Mycobacterium avium
SSPLG

SEQ ID NO: 6681 - protein, 9 aa, Mycobacterium avium
SSPSAKLAS

SEQ ID NO: 6682 - protein, 5 aa, Mycobacterium avium
SSRHL

SEQ ID NO: 6683 - protein, 10 aa, Mycobacterium avium
SSRIQGPAAE

SEQ ID NO: 6684 - protein, 9 aa, Mycobacterium avium
SSRPAPRTT

SEQ ID NO: 6685 - protein, 5 aa, Mycobacterium avium
SSSFS

SEQ ID NO: 6686 - protein, 20 aa, Mycobacterium avium
SSTMEPGKPITATDSSSVTV

SEQ ID NO: 6687 - protein, 12 aa, Mycobacterium avium
STDSAAVAAQQE

SEQ ID NO: 6688 - protein, 11 aa, Mycobacterium avium
STDSASPDQGW

SEQ ID NO: 6689 - protein, 5 aa, Mycobacterium avium
STEYA

SEQ ID NO: 6690 - protein, 6 aa, Mycobacterium avium
STGADT

SEQ ID NO: 6691 - protein, 11 aa, Mycobacterium avium
STGGGANLPAV

SEQ ID NO: 6692 - protein, 4 aa, Mycobacterium avium
STLS

SEQ ID NO: 6693 - protein, 5 aa, Mycobacterium avium
STPIR

SEQ ID NO: 6694 - protein, 60 aa, Mycobacterium avium
STPSGPMTGAAQGQPPGTQRISQPQQPASSSFRQPVQSPTGAQPSHPPSGPTRYPSSGLQ

SEQ ID NO: 6695 - protein, 47 aa, Mycobacterium avium
STQVPASTEPTPTSPAPGGPAPSTGPATRSATPTSTPPPSRPADPNA

SEQ ID NO: 6696 - protein, 6 aa, Mycobacterium avium
STRAGT

SEQ ID NO: 6697 - protein, 21 aa, Mycobacterium avium
STRPEPGAIDRSGGYTASSGI

SEQ ID NO: 6698 - protein, 12 aa, Mycobacterium avium
STRQQPGPRAHR

SEQ ID NO: 6699 - protein, 7 aa, Mycobacterium avium
STRTQWD

SEQ ID NO: 6700 - protein, 4 aa, Mycobacterium avium
STYD

SEQ ID NO: 6701 - protein, 10 aa, Mycobacterium avium
SVAENTSDAQ

SEQ ID NO: 6702 - protein, 6 aa, Mycobacterium avium
SVDGRA

SEQ ID NO: 6703 - protein, 12 aa, Mycobacterium avium
SVDQERQAAKEA

SEQ ID NO: 6704 - protein, 22 aa, Mycobacterium avium
SVPAAQAAEQQSDDDVQGAVQK

SEQ ID NO: 6705 - protein, 22 aa, Mycobacterium avium
SVPSEQPPAAPPDAPPARRRRR

SEQ ID NO: 6706 - protein, 10 aa, Mycobacterium avium
SVSGNGNRIA

SEQ ID NO: 6707 - protein, 9 aa, Mycobacterium avium
SVTARRQDA

SEQ ID NO: 6708 - protein, 4 aa, Mycobacterium avium
SVTT

SEQ ID NO: 6709 - protein, 6 aa, Mycobacterium avium
SWDGPA

SEQ ID NO: 6710 - protein, 12 aa, Mycobacterium avium
SYASTGSSTPAF

SEQ ID NO: 6711 - protein, 6 aa, Mycobacterium avium
SYSQLG

SEQ ID NO: 6712 - protein, 4 aa, Mycobacterium avium
TAAD

SEQ ID NO: 6713 - protein, 4 aa, Mycobacterium avium
TAAG

SEQ ID NO: 6714 - protein, 13 aa, Mycobacterium avium
TAAGGGPQDEGAK

SEQ ID NO: 6715 - protein, 16 aa, Mycobacterium avium
TAAQHRATAESCAAER

SEQ ID NO: 6716 - protein, 8 aa, Mycobacterium avium
TAATPSGP

SEQ ID NO: 6717 - protein, 6 aa, Mycobacterium avium
TADAAA

SEQ ID NO: 6718 - protein, 7 aa, Mycobacterium avium
TADGRKT

SEQ ID NO: 6719 - protein, 17 aa, Mycobacterium avium
TADSGPGRRGPAGGSDL

SEQ ID NO: 6720 - protein, 70 aa, Mycobacterium avium
TAEENPAADQNEATVAAAGDDRENGDAATESEAAKTSDAAPADGAEDSHSAETVETAGAAPAAGRRTKRL

SEQ ID NO: 6721 - protein, 12 aa, Mycobacterium avium
TAGKSLSDSASG

SEQ ID NO: 6722 - protein, 7 aa, Mycobacterium avium
TAGNAGA

SEQ ID NO: 6723 - protein, 6 aa, Mycobacterium avium
TAGSRE

SEQ ID NO: 6724 - protein, 10 aa, Mycobacterium avium
TAGVAADRRA

SEQ ID NO: 6725 - protein, 6 aa, Mycobacterium avium
TAKSPV

SEQ ID NO: 6726 - protein, 4 aa, Mycobacterium avium
TALQ

SEQ ID NO: 6727 - protein, 142 aa, Mycobacterium avium
TAPAPRPKYDPYAQYGQYGQYGQYGQQPYYGQPGGQPGGQPGGQQHGQQHSPQGYGSQYGGYGQGGAPTGGFGAQPSPQSGPQQSAQQQGPSTPPTGFPSFSPPPNVGGGSDSGSATANYSEQAGGQQSYGQEPSSPSGPTP

SEQ ID NO: 6728 - protein, 15 aa, Mycobacterium avium
TAPAPTCPAGRGRRA

SEQ ID NO: 6729 - protein, 14 aa, Mycobacterium avium
TAPLSADDADAFTE

SEQ ID NO: 6730 - protein, 13 aa, Mycobacterium avium
TAQNDPSTVRGAR

SEQ ID NO: 6731 - protein, 21 aa, Mycobacterium avium
TAQTGGAPLPGATQAGLSSPI

SEQ ID NO: 6732 - protein, 12 aa, Mycobacterium avium
TARAPARGVDNQ

SEQ ID NO: 6733 - protein, 12 aa, Mycobacterium avium
TARGPGHPSPVP

SEQ ID NO: 6734 - protein, 14 aa, Mycobacterium avium
TARPPAELAAQRDE

SEQ ID NO: 6735 - protein, 7 aa, Mycobacterium avium
TARQTGG

SEQ ID NO: 6736 - protein, 6 aa, Mycobacterium avium
TASDYL

SEQ ID NO: 6737 - protein, 6 aa, Mycobacterium avium
TASLAT

SEQ ID NO: 6738 - protein, 5 aa, Mycobacterium avium
TASTF

SEQ ID NO: 6739 - protein, 5 aa, Mycobacterium avium
TATAD

SEQ ID NO: 6740 - protein, 10 aa, Mycobacterium avium
TATAKGLSRP

SEQ ID NO: 6741 - protein, 5 aa, Mycobacterium avium
TATGE

SEQ ID NO: 6742 - protein, 8 aa, Mycobacterium avium
TATGGNTL

SEQ ID NO: 6743 - protein, 4 aa, Mycobacterium avium
TDAG

SEQ ID NO: 6744 - protein, 7 aa, Mycobacterium avium
TDAQGRN

SEQ ID NO: 6745 - protein, 19 aa, Mycobacterium avium
TDEDAGPGSGEDALPPDDV

SEQ ID NO: 6746 - protein, 23 aa, Mycobacterium avium
TDEDYTDADYTDGDYGDEPYDYA

SEQ ID NO: 6747 - protein, 8 aa, Mycobacterium avium
TDGADTQL

SEQ ID NO: 6748 - protein, 11 aa, Mycobacterium avium
TDGCSDRSCPN

SEQ ID NO: 6749 - protein, 7 aa, Mycobacterium avium
TDNAPIA

SEQ ID NO: 6750 - protein, 17 aa, Mycobacterium avium
TDPAGKPLGGGFPDPNL

SEQ ID NO: 6751 - protein, 6 aa, Mycobacterium avium
TEAVPQ

SEQ ID NO: 6752 - protein, 4 aa, Mycobacterium avium
TEDD

SEQ ID NO: 6753 - protein, 6 aa, Mycobacterium avium
TEDTPH

SEQ ID NO: 6754 - protein, 6 aa, Mycobacterium avium
TENKDV

SEQ ID NO: 6755 - protein, 15 aa, Mycobacterium avium
TEPNTTVAHGDSDTV

SEQ ID NO: 6756 - protein, 9 aa, Mycobacterium avium
TESDVEKSE

SEQ ID NO: 6757 - protein, 5 aa, Mycobacterium avium
TETMP

SEQ ID NO: 6758 - protein, 9 aa, Mycobacterium avium
TFESEDGRA

SEQ ID NO: 6759 - protein, 10 aa, Mycobacterium avium
TFPDHTASTA

SEQ ID NO: 6760 - protein, 9 aa, Mycobacterium avium
TGAQAAGAA

SEQ ID NO: 6761 - protein, 14 aa, Mycobacterium avium
TGAYRATRVGSQAY

SEQ ID NO: 6762 - protein, 22 aa, Mycobacterium avium
TGDEPAQQQTAPDGTRTGAQTA

SEQ ID NO: 6763 - protein, 12 aa, Mycobacterium avium
TGDFAKQYEKNA

SEQ ID NO: 6764 - protein, 5 aa, Mycobacterium avium
TGDGL

SEQ ID NO: 6765 - protein, 10 aa, Mycobacterium avium
TGDVATTNTA

SEQ ID NO: 6766 - protein, 6 aa, Mycobacterium avium
TGEAAA

SEQ ID NO: 6767 - protein, 10 aa, Mycobacterium avium
TGGGPAGRTD

SEQ ID NO: 6768 - protein, 40 aa, Mycobacterium avium
TGHGESPSDRIGLSNPDSGTTAGRARGARPHHGPRRWRAA

SEQ ID NO: 6769 - protein, 11 aa, Mycobacterium avium
TGHPQGGGSEA

SEQ ID NO: 6770 - protein, 11 aa, Mycobacterium avium
TGPFGGPGFPA

SEQ ID NO: 6771 - protein, 8 aa, Mycobacterium avium
TGRPVSPG

SEQ ID NO: 6772 - protein, 17 aa, Mycobacterium avium
TGRRDEPQVEAEMPGAA

SEQ ID NO: 6773 - protein, 10 aa, Mycobacterium avium
TGSGTIVGRT

SEQ ID NO: 6774 - protein, 7 aa, Mycobacterium avium
TGTLTEN

SEQ ID NO: 6775 - protein, 7 aa, Mycobacterium avium
TGTVTTG

SEQ ID NO: 6776 - protein, 5 aa, Mycobacterium avium
THDPA

SEQ ID NO: 6777 - protein, 16 aa, Mycobacterium avium
TIAARGPARRRVPGPT

SEQ ID NO: 6778 - protein, 10 aa, Mycobacterium avium
TIAGEGAHAR

SEQ ID NO: 6779 - protein, 10 aa, Mycobacterium avium
TISAAASRTL

SEQ ID NO: 6780 - protein, 11 aa, Mycobacterium avium
TKGGPAGVANS

SEQ ID NO: 6781 - protein, 8 aa, Mycobacterium avium
TKSSAQLR

SEQ ID NO: 6782 - protein, 6 aa, Mycobacterium avium
TLGNGG

SEQ ID NO: 6783 - protein, 5 aa, Mycobacterium avium
TLGPR

SEQ ID NO: 6784 - protein, 17 aa, Mycobacterium avium
TLPGAASEPTEPAVPHT

SEQ ID NO: 6785 - protein, 9 aa, Mycobacterium avium
TMSDEAGAY

SEQ ID NO: 6786 - protein, 20 aa, Mycobacterium avium
TNGANTGATFSEGAAKTAIQ

SEQ ID NO: 6787 - protein, 6 aa, Mycobacterium avium
TNTAAQ

SEQ ID NO: 6788 - protein, 8 aa, Mycobacterium avium
TNTIGTES

SEQ ID NO: 6789 - protein, 9 aa, Mycobacterium avium
TPADETVRE

SEQ ID NO: 6790 - protein, 7 aa, Mycobacterium avium
TPALEQD

SEQ ID NO: 6791 - protein, 12 aa, Mycobacterium avium
TPERPDDAQNPL

SEQ ID NO: 6792 - protein, 4 aa, Mycobacterium avium
TPFP

SEQ ID NO: 6793 - protein, 5 aa, Mycobacterium avium
TPHAL

SEQ ID NO: 6794 - protein, 13 aa, Mycobacterium avium
TPKAPKTWKDMLP

SEQ ID NO: 6795 - protein, 8 aa, Mycobacterium avium
TPKNPSPW

SEQ ID NO: 6796 - protein, 33 aa, Mycobacterium avium
TPKPADGVPPPPLNSKLPDEAPQPPKPAPPAAE

SEQ ID NO: 6797 - protein, 10 aa, Mycobacterium avium
TPNQPGTDYD

SEQ ID NO: 6798 - protein, 17 aa, Mycobacterium avium
TPNTEPVQLPQRAAAPP

SEQ ID NO: 6799 - protein, 9 aa, Mycobacterium avium
TPQRADGSI

SEQ ID NO: 6800 - protein, 20 aa, Mycobacterium avium
TPRTSRRYSPRLDPETVGQI

SEQ ID NO: 6801 - protein, 9 aa, Mycobacterium avium
TPTAGTGDF

SEQ ID NO: 6802 - protein, 12 aa, Mycobacterium avium
TQAGTVERRAGA

SEQ ID NO: 6803 - protein, 13 aa, Mycobacterium avium
TQDPVYAGSGYSA

SEQ ID NO: 6804 - protein, 8 aa, Mycobacterium avium
TQEGADGW

SEQ ID NO: 6805 - protein, 5 aa, Mycobacterium avium
TQNST

SEQ ID NO: 6806 - protein, 5 aa, Mycobacterium avium
TQPGA

SEQ ID NO: 6807 - protein, 9 aa, Mycobacterium avium
TQPKLADTQ

SEQ ID NO: 6808 - protein, 5 aa, Mycobacterium avium
TQSGF

SEQ ID NO: 6809 - protein, 6 aa, Mycobacterium avium
TQSIES

SEQ ID NO: 6810 - protein, 5 aa, Mycobacterium avium
TQTAT

SEQ ID NO: 6811 - protein, 5 aa, Mycobacterium avium
TRAAA

SEQ ID NO: 6812 - protein, 6 aa, Mycobacterium avium
TRAARA

SEQ ID NO: 6813 - protein, 15 aa, Mycobacterium avium
TRAGADELVQVAWSP

SEQ ID NO: 6814 - protein, 4 aa, Mycobacterium avium
TRAP

SEQ ID NO: 6815 - protein, 15 aa, Mycobacterium avium
TRDGTTTTTPIGGAP

SEQ ID NO: 6816 - protein, 11 aa, Mycobacterium avium
TRDTKSGHAAE

SEQ ID NO: 6817 - protein, 9 aa, Mycobacterium avium
TREAPPQPV

SEQ ID NO: 6818 - protein, 10 aa, Mycobacterium avium
TREGAADAGL

SEQ ID NO: 6819 - protein, 7 aa, Mycobacterium avium
TRESDGS

SEQ ID NO: 6820 - protein, 6 aa, Mycobacterium avium
TRGGAA

SEQ ID NO: 6821 - protein, 12 aa, Mycobacterium avium
TRGGKPFTGAGY

SEQ ID NO: 6822 - protein, 30 aa, Mycobacterium avium
TRGPEEWPQPEPPAHVGAEPDDDEDDYEYQ

SEQ ID NO: 6823 - protein, 9 aa, Mycobacterium avium
TRGSTRTPL

SEQ ID NO: 6824 - protein, 6 aa, Mycobacterium avium
TRKLGE

SEQ ID NO: 6825 - protein, 23 aa, Mycobacterium avium
TRPLATELDNRKAEVNNDVEQLG

SEQ ID NO: 6826 - protein, 55 aa, Mycobacterium avium
TRPQRPTGKRSRQRTAGDADAEPSDEAEVSAPEKAEKAKRKKAAKPKKSADTRAN

SEQ ID NO: 6827 - protein, 12 aa, Mycobacterium avium
TRQNGRNQAYNH

SEQ ID NO: 6828 - protein, 5 aa, Mycobacterium avium
TRTQV

SEQ ID NO: 6829 - protein, 14 aa, Mycobacterium avium
TRVSGDGGNLSAGE

SEQ ID NO: 6830 - protein, 6 aa, Mycobacterium avium
TSAAAG

SEQ ID NO: 6831 - protein, 4 aa, Mycobacterium avium
TSAF

SEQ ID NO: 6832 - protein, 15 aa, Mycobacterium avium
TSAKFSPRTPGGDPL

SEQ ID NO: 6833 - protein, 6 aa, Mycobacterium avium
TSALDE

SEQ ID NO: 6834 - protein, 8 aa, Mycobacterium avium
TSALGQRD

SEQ ID NO: 6835 - protein, 8 aa, Mycobacterium avium
TSDGSIPD

SEQ ID NO: 6836 - protein, 6 aa, Mycobacterium avium
TSFSNA

SEQ ID NO: 6837 - protein, 7 aa, Mycobacterium avium
TSGPGEL

SEQ ID NO: 6838 - protein, 14 aa, Mycobacterium avium
TSGPLPDQTDRATV

SEQ ID NO: 6839 - protein, 7 aa, Mycobacterium avium
TSGRGDL

SEQ ID NO: 6840 - protein, 8 aa, Mycobacterium avium
TSPDYPGD

SEQ ID NO: 6841 - protein, 16 aa, Mycobacterium avium
TSPPNPAGLPPTPGIP

SEQ ID NO: 6842 - protein, 7 aa, Mycobacterium avium
TSRADAL

SEQ ID NO: 6843 - protein, 8 aa, Mycobacterium avium
TSRDEIGE

SEQ ID NO: 6844 - protein, 15 aa, Mycobacterium avium
TSTITKTLSARDQSL

SEQ ID NO: 6845 - protein, 13 aa, Mycobacterium avium
TTARTLTRQQGDL

SEQ ID NO: 6846 - protein, 8 aa, Mycobacterium avium
TTGSLPAG

SEQ ID NO: 6847 - protein, 5 aa, Mycobacterium avium
TTHDG

SEQ ID NO: 6848 - protein, 13 aa, Mycobacterium avium
TTPDGKTVDDAGW

SEQ ID NO: 6849 - protein, 6 aa, Mycobacterium avium
TTPPVP

SEQ ID NO: 6850 - protein, 8 aa, Mycobacterium avium
TTQTTQVT

SEQ ID NO: 6851 - protein, 4 aa, Mycobacterium avium
TVET

SEQ ID NO: 6852 - protein, 7 aa, Mycobacterium avium
TVINPGT

SEQ ID NO: 6853 - protein, 4 aa, Mycobacterium avium
TVPA

SEQ ID NO: 6854 - protein, 7 aa, Mycobacterium avium
TVPAPNH

SEQ ID NO: 6855 - protein, 6 aa, Mycobacterium avium
TVQPGA

SEQ ID NO: 6856 - protein, 6 aa, Mycobacterium avium
TVTPAG

SEQ ID NO: 6857 - protein, 8 aa, Mycobacterium avium
TYPGADRP

SEQ ID NO: 6858 - protein, 28 aa, Mycobacterium avium
VAAGSTPAPKPPPGPGAAKAKPKTSDAV

SEQ ID NO: 6859 - protein, 42 aa, Mycobacterium avium
VAAKPGRRPGNSAAAPHPGAANYPAGDTGDRRTRRPPPMPSA

SEQ ID NO: 6860 - protein, 9 aa, Mycobacterium avium
VAASRPANW

SEQ ID NO: 6861 - protein, 5 aa, Mycobacterium avium
VAEGG

SEQ ID NO: 6862 - protein, 9 aa, Mycobacterium avium
VAERGGTRR

SEQ ID NO: 6863 - protein, 12 aa, Mycobacterium avium
VAGDGGTADPFE

SEQ ID NO: 6864 - protein, 14 aa, Mycobacterium avium
VAGGKRSGSATLGT

SEQ ID NO: 6865 - protein, 7 aa, Mycobacterium avium
VANATDL

SEQ ID NO: 6866 - protein, 5 aa, Mycobacterium avium
VAPRD

SEQ ID NO: 6867 - protein, 5 aa, Mycobacterium avium
VAPRR

SEQ ID NO: 6868 - protein, 4 aa, Mycobacterium avium
VASA

SEQ ID NO: 6869 - protein, 10 aa, Mycobacterium avium
VASAPDDRAL

SEQ ID NO: 6870 - protein, 10 aa, Mycobacterium avium
VASGQGAGTL

SEQ ID NO: 6871 - protein, 5 aa, Mycobacterium avium
VATPG

SEQ ID NO: 6872 - protein, 19 aa, Mycobacterium avium
VDDPAGGPFNRAPDAPPGW

SEQ ID NO: 6873 - protein, 9 aa, Mycobacterium avium
VDDPSSALR

SEQ ID NO: 6874 - protein, 22 aa, Mycobacterium avium
VDDSATDDAEPRPERTRERLSG

SEQ ID NO: 6875 - protein, 8 aa, Mycobacterium avium
VDDTRDVR

SEQ ID NO: 6876 - protein, 32 aa, Mycobacterium avium
VDEDPDDYPEFPSRRPAPSGSQESPASAPSLR

SEQ ID NO: 6877 - protein, 11 aa, Mycobacterium avium
VDPAPSPRRRR

SEQ ID NO: 6878 - protein, 4 aa, Mycobacterium avium
VDQA

SEQ ID NO: 6879 - protein, 10 aa, Mycobacterium avium
VDSPRPAGEV

SEQ ID NO: 6880 - protein, 20 aa, Mycobacterium avium
VDSRNPNATLPAAAPSMAPS

SEQ ID NO: 6881 - protein, 13 aa, Mycobacterium avium
VDSSDAVSAAGAG

SEQ ID NO: 6882 - protein, 4 aa, Mycobacterium avium
VDVT

SEQ ID NO: 6883 - protein, 7 aa, Mycobacterium avium
VEGISQP

SEQ ID NO: 6884 - protein, 8 aa, Mycobacterium avium
VEPPPAVA

SEQ ID NO: 6885 - protein, 15 aa, Mycobacterium avium
VESDGSPDGEEPEHH

SEQ ID NO: 6886 - protein, 36 aa, Mycobacterium avium
VETSPPAPDGPPPSPGVPSAGRPGEAPPDVPGTPVP

SEQ ID NO: 6887 - protein, 9 aa, Mycobacterium avium
VGAQPPTKL

SEQ ID NO: 6888 - protein, 13 aa, Mycobacterium avium
VGDDAKVSNVVFV

SEQ ID NO: 6889 - protein, 5 aa, Mycobacterium avium
VGGSM

SEQ ID NO: 6890 - protein, 10 aa, Mycobacterium avium
VGSGDNLKKV

SEQ ID NO: 6891 - protein, 4 aa, Mycobacterium avium
VGTG

SEQ ID NO: 6892 - protein, 14 aa, Mycobacterium avium
VIQSSPAAPPVPDG

SEQ ID NO: 6893 - protein, 6 aa, Mycobacterium avium
VKSQGD

SEQ ID NO: 6894 - protein, 12 aa, Mycobacterium avium
VLSDSGRKAITT

SEQ ID NO: 6895 - protein, 11 aa, Mycobacterium avium
VLTDPDRAAVS

SEQ ID NO: 6896 - protein, 10 aa, Mycobacterium avium
VNADGAPSAF

SEQ ID NO: 6897 - protein, 11 aa, Mycobacterium avium
VNDPGLSNTAL

SEQ ID NO: 6898 - protein, 4 aa, Mycobacterium avium
VNEG

SEQ ID NO: 6899 - protein, 12 aa, Mycobacterium avium
VNGGKPPSSPVT

SEQ ID NO: 6900 - protein, 17 aa, Mycobacterium avium
VNGTRYQCTGSPEQVAD

SEQ ID NO: 6901 - protein, 6 aa, Mycobacterium avium
VNPPKG

SEQ ID NO: 6902 - protein, 23 aa, Mycobacterium avium
VNPPPAPQSTDTPHNSVPPPPRV

SEQ ID NO: 6903 - protein, 5 aa, Mycobacterium avium
VNQSR

SEQ ID NO: 6904 - protein, 16 aa, Mycobacterium avium
VPAGPEGVNGEFDTPI

SEQ ID NO: 6905 - protein, 15 aa, Mycobacterium avium
VPAPGQLPAPLPPEV

SEQ ID NO: 6906 - protein, 15 aa, Mycobacterium avium
VPAPPAEPQPRRQRR

SEQ ID NO: 6907 - protein, 8 aa, Mycobacterium avium
VPDDERIG

SEQ ID NO: 6908 - protein, 8 aa, Mycobacterium avium
VPDPTVGD

SEQ ID NO: 6909 - protein, 19 aa, Mycobacterium avium
VPEVAEPETADDAAYADAD

SEQ ID NO: 6910 - protein, 9 aa, Mycobacterium avium
VPGATGDRV

SEQ ID NO: 6911 - protein, 30 aa, Mycobacterium avium
VPGGAHGAAAEPDDEPGLNGRSPAPRRPQH

SEQ ID NO: 6912 - protein, 8 aa, Mycobacterium avium
VPGGVGPG

SEQ ID NO: 6913 - protein, 10 aa, Mycobacterium avium
VPGPPPESPI

SEQ ID NO: 6914 - protein, 5 aa, Mycobacterium avium
VPGPV

SEQ ID NO: 6915 - protein, 43 aa, Mycobacterium avium
VPIPPPPPGPGVAPGPVAPTPAPVSAPAPNAGGPAAPADFGGG

SEQ ID NO: 6916 - protein, 21 aa, Mycobacterium avium
VPPDRADDLGSAVAPDTSKPV

SEQ ID NO: 6917 - protein, 43 aa, Mycobacterium avium
VPQKQAPATPQYPSNEYPQYPQYPGNEYPQYPGNSQNPYYGPG

SEQ ID NO: 6918 - protein, 46 aa, Mycobacterium avium
VPTPTELPPPPPPPPAPAAPDQVDGAAPQAAPSAFAGKASKPAPSV

SEQ ID NO: 6919 - protein, 11 aa, Mycobacterium avium
VQDKRSDQALA

SEQ ID NO: 6920 - protein, 6 aa, Mycobacterium avium
VQHAPD

SEQ ID NO: 6921 - protein, 13 aa, Mycobacterium avium
VQPSEGGRRRRRE

SEQ ID NO: 6922 - protein, 7 aa, Mycobacterium avium
VQSQTTM

SEQ ID NO: 6923 - protein, 13 aa, Mycobacterium avium
VRATAQKLGPPAG

SEQ ID NO: 6924 - protein, 24 aa, Mycobacterium avium
VREAEAAPALAEAARKQGMIPTRD

SEQ ID NO: 6925 - protein, 20 aa, Mycobacterium avium
VREKPQEPQSRPPSVDVQPR

SEQ ID NO: 6926 - protein, 5 aa, Mycobacterium avium
VRGGA

SEQ ID NO: 6927 - protein, 9 aa, Mycobacterium avium
VRGNAADHL

SEQ ID NO: 6928 - protein, 6 aa, Mycobacterium avium
VRGSGA

SEQ ID NO: 6929 - protein, 5 aa, Mycobacterium avium
VRRGD

SEQ ID NO: 6930 - protein, 6 aa, Mycobacterium avium
VRRGDA

SEQ ID NO: 6931 - protein, 11 aa, Mycobacterium avium
VRRGSGDEFAG

SEQ ID NO: 6932 - protein, 8 aa, Mycobacterium avium
VRSATEDK

SEQ ID NO: 6933 - protein, 5 aa, Mycobacterium avium
VRSDN

SEQ ID NO: 6934 - protein, 43 aa, Mycobacterium avium
VSAAAGLGGPRPLPAPPAQFDDPDDTLGPPPVGERPPRGPAGR

SEQ ID NO: 6935 - protein, 15 aa, Mycobacterium avium
VSDGTDTQLADTAQA

SEQ ID NO: 6936 - protein, 11 aa, Mycobacterium avium
VSENVGAKPQT

SEQ ID NO: 6937 - protein, 15 aa, Mycobacterium avium
VSEPAPGGHGAHSTG

SEQ ID NO: 6938 - protein, 10 aa, Mycobacterium avium
VSGAGTTKSL

SEQ ID NO: 6939 - protein, 4 aa, Mycobacterium avium
VSGD

SEQ ID NO: 6940 - protein, 9 aa, Mycobacterium avium
VSGKDNTVT

SEQ ID NO: 6941 - protein, 12 aa, Mycobacterium avium
VSKPLNSASQAA

SEQ ID NO: 6942 - protein, 12 aa, Mycobacterium avium
VSLGTDDDAPGL

SEQ ID NO: 6943 - protein, 14 aa, Mycobacterium avium
VSNTVRPDGRVDRS

SEQ ID NO: 6944 - protein, 6 aa, Mycobacterium avium
VSPPAA

SEQ ID NO: 6945 - protein, 11 aa, Mycobacterium avium
VSPPPLKSRRQ

SEQ ID NO: 6946 - protein, 17 aa, Mycobacterium avium
VSPSPPGNSRPRDPNRP

SEQ ID NO: 6947 - protein, 7 aa, Mycobacterium avium
VSQDQPD

SEQ ID NO: 6948 - protein, 4 aa, Mycobacterium avium
VSRP

SEQ ID NO: 6949 - protein, 6 aa, Mycobacterium avium
VSRRGD

SEQ ID NO: 6950 - protein, 16 aa, Mycobacterium avium
VSTAGDEVTNPQKTMP

SEQ ID NO: 6951 - protein, 19 aa, Mycobacterium avium
VSTASPRSSASPSGGPDRP

SEQ ID NO: 6952 - protein, 8 aa, Mycobacterium avium
VSTPRSYL

SEQ ID NO: 6953 - protein, 7 aa, Mycobacterium avium
VSTSADL

SEQ ID NO: 6954 - protein, 14 aa, Mycobacterium avium
VSVPTRAPVSTSPL

SEQ ID NO: 6955 - protein, 15 aa, Mycobacterium avium
VTAPGVSLPETQAAR

SEQ ID NO: 6956 - protein, 7 aa, Mycobacterium avium
VTEEAND

SEQ ID NO: 6957 - protein, 15 aa, Mycobacterium avium
VTGADDAATASAPDR

SEQ ID NO: 6958 - protein, 5 aa, Mycobacterium avium
VTGED

SEQ ID NO: 6959 - protein, 10 aa, Mycobacterium avium
VTGTKAPGDI

SEQ ID NO: 6960 - protein, 15 aa, Mycobacterium avium
VTPAGGGKATTIPLS

SEQ ID NO: 6961 - protein, 5 aa, Mycobacterium avium
VTPHP

SEQ ID NO: 6962 - protein, 5 aa, Mycobacterium avium
VTPKS

SEQ ID NO: 6963 - protein, 18 aa, Mycobacterium avium
VTSPSTPATTSTPDVPRA

SEQ ID NO: 6964 - protein, 7 aa, Mycobacterium avium
VTSQNPF

SEQ ID NO: 6965 - protein, 8 aa, Mycobacterium avium
VTTTSPPV

SEQ ID NO: 6966 - protein, 4 aa, Mycobacterium avium
VTVG

SEQ ID NO: 6967 - protein, 12 aa, Mycobacterium avium
VVNAGSGNVVRQ

SEQ ID NO: 6968 - protein, 5 aa, Mycobacterium avium
VVPPS

SEQ ID NO: 6969 - protein, 12 aa, Mycobacterium avium
VYSRDGHSDYGN

SEQ ID NO: 6970 - protein, 7 aa, Mycobacterium avium
WADPASG

SEQ ID NO: 6971 - protein, 10 aa, Mycobacterium avium
WGGSRYPWGS

SEQ ID NO: 6972 - protein, 15 aa, Mycobacterium avium
WGPDRREIAAGPSNI

SEQ ID NO: 6973 - protein, 7 aa, Mycobacterium avium
WGPPAKP

SEQ ID NO: 6974 - protein, 5 aa, Mycobacterium avium
WNSDD

SEQ ID NO: 6975 - protein, 13 aa, Mycobacterium avium
WPAEPRVDNGPTA

SEQ ID NO: 6976 - protein, 8 aa, Mycobacterium avium
WPQGGQLN

SEQ ID NO: 6977 - protein, 10 aa, Mycobacterium avium
WQGVSGESYV

SEQ ID NO: 6978 - protein, 16 aa, Mycobacterium avium
WQTDPGPLRGKGTRAP

SEQ ID NO: 6979 - protein, 12 aa, Mycobacterium avium
WRAGGARFDPAR

SEQ ID NO: 6980 - protein, 10 aa, Mycobacterium avium
WRGPYGTRPV

SEQ ID NO: 6981 - protein, 6 aa, Mycobacterium avium
WRQGGD

SEQ ID NO: 6982 - protein, 15 aa, Mycobacterium avium
WSDTGTDAAVPPPRR

SEQ ID NO: 6983 - protein, 8 aa, Mycobacterium avium
WSHPEPSA

SEQ ID NO: 6984 - protein, 17 aa, Mycobacterium avium
WSSTPARQVTASAEPMA

SEQ ID NO: 6985 - protein, 9 aa, Mycobacterium avium
WSTGEPTVQ

SEQ ID NO: 6986 - protein, 9 aa, Mycobacterium avium
WTDPTGAAA

SEQ ID NO: 6987 - protein, 6 aa, Mycobacterium avium
WTPGTD

SEQ ID NO: 6988 - protein, 14 aa, Mycobacterium avium
YAATDDDPATAWTA

SEQ ID NO: 6989 - protein, 12 aa, Mycobacterium avium
YAEAQEAANNAK

SEQ ID NO: 6990 - protein, 6 aa, Mycobacterium avium
YAESAD

SEQ ID NO: 6991 - protein, 17 aa, Mycobacterium avium
YATEKAAVSAPASYDPQ

SEQ ID NO: 6992 - protein, 19 aa, Mycobacterium avium
YATPATRRSITRRNAADGA

SEQ ID NO: 6993 - protein, 19 aa, Mycobacterium avium
YDARPYMPASAPANTGYTA

SEQ ID NO: 6994 - protein, 7 aa, Mycobacterium avium
YERESTD

SEQ ID NO: 6995 - protein, 4 aa, Mycobacterium avium
YETP

SEQ ID NO: 6996 - protein, 11 aa, Mycobacterium avium
YGDEPTPTQEE

SEQ ID NO: 6997 - protein, 8 aa, Mycobacterium avium
YGSEHGDP

SEQ ID NO: 6998 - protein, 15 aa, Mycobacterium avium
YGTPRRPSSSADYPE

SEQ ID NO: 6999 - protein, 20 aa, Mycobacterium avium
YHPPTDLAPPPGTQIGPDGN

SEQ ID NO: 7000 - protein, 19 aa, Mycobacterium avium
YHSGTPSISNSGGSNVVGR

SEQ ID NO: 7001 - protein, 4 aa, Mycobacterium avium
YLAG

SEQ ID NO: 7002 - protein, 5 aa, Mycobacterium avium
YLAGP

SEQ ID NO: 7003 - protein, 7 aa, Mycobacterium avium
YLPPNNP

SEQ ID NO: 7004 - protein, 11 aa, Mycobacterium avium
YNDTHGHSAGD

SEQ ID NO: 7005 - protein, 18 aa, Mycobacterium avium
YPPFGPPEGAEGKATAQD

SEQ ID NO: 7006 - protein, 10 aa, Mycobacterium avium
YPPQAITSRN

SEQ ID NO: 7007 - protein, 9 aa, Mycobacterium avium
YPTAAARAG

SEQ ID NO: 7008 - protein, 7 aa, Mycobacterium avium
YPTYAEA

SEQ ID NO: 7009 - protein, 11 aa, Mycobacterium avium
YQQGTGPAAAV

SEQ ID NO: 7010 - protein, 5 aa, Mycobacterium avium
YQSGA

SEQ ID NO: 7011 - protein, 5 aa, Mycobacterium avium
YRDEA

SEQ ID NO: 7012 - protein, 7 aa, Mycobacterium avium
YREDEYP

SEQ ID NO: 7013 - protein, 12 aa, Mycobacterium avium
YREGEQTIAQEH

SEQ ID NO: 7014 - protein, 5 aa, Mycobacterium avium
YRGST

SEQ ID NO: 7015 - protein, 4 aa, Mycobacterium avium
YRTN

SEQ ID NO: 7016 - protein, 7 aa, Mycobacterium avium
YSTGNGV

SEQ ID NO: 7017 - protein, 5 aa, Mycobacterium avium
YYGQF

SEQ ID NO: 7018 - protein, 14 aa, Mycobacterium avium
AAAAAPPITAPTTV

SEQ ID NO: 7019 - protein, 8 aa, Mycobacterium avium
AAAAPYRA

SEQ ID NO: 7020 - protein, 8 aa, Mycobacterium avium
AAAAPYRT

SEQ ID NO: 7021 - protein, 12 aa, Mycobacterium avium
AAAAVPSAPAQL

SEQ ID NO: 7022 - protein, 17 aa, Mycobacterium avium
AAADPGTSGARTPGSRG

SEQ ID NO: 7023 - protein, 13 aa, Mycobacterium avium
AAAEPGPATMSRR

SEQ ID NO: 7024 - protein, 9 aa, Mycobacterium avium
AAAEPPTRE

SEQ ID NO: 7025 - protein, 11 aa, Mycobacterium avium
AAAERSRNERA

SEQ ID NO: 7026 - protein, 7 aa, Mycobacterium avium
AAAGAAA

SEQ ID NO: 7027 - protein, 12 aa, Mycobacterium avium
AAAGATSLAGAK

SEQ ID NO: 7028 - protein, 22 aa, Mycobacterium avium
AAAGEQQSGGQSAEPDDGADRQ

SEQ ID NO: 7029 - protein, 22 aa, Mycobacterium avium
AAAGEQQTGGQSAEPDDGADRQ

SEQ ID NO: 7030 - protein, 6 aa, Mycobacterium avium
AAAGSI

SEQ ID NO: 7031 - protein, 25 aa, Mycobacterium avium
AAAGTSGDDAAEDVEQRATKSARGR

SEQ ID NO: 7032 - protein, 5 aa, Mycobacterium avium
AAAGW

SEQ ID NO: 7033 - protein, 5 aa, Mycobacterium avium
AAAHG

SEQ ID NO: 7034 - protein, 6 aa, Mycobacterium avium
AAAHGN

SEQ ID NO: 7035 - protein, 17 aa, Mycobacterium avium
AAAHRRPRGGRGRGQRP

SEQ ID NO: 7036 - protein, 25 aa, Mycobacterium avium
AAAIGPDARSRSVASPPHRRRGPGR

SEQ ID NO: 7037 - protein, 8 aa, Mycobacterium avium
AAAPDGSV

SEQ ID NO: 7038 - protein, 7 aa, Mycobacterium avium
AAAPGEK

SEQ ID NO: 7039 - protein, 10 aa, Mycobacterium avium
AAAPPGQAAA

SEQ ID NO: 7040 - protein, 9 aa, Mycobacterium avium
AAAPTAATA

SEQ ID NO: 7041 - protein, 24 aa, Mycobacterium avium
AAARDAATRAVEGARASAPDDPLG

SEQ ID NO: 7042 - protein, 19 aa, Mycobacterium avium
AAASEQEQTVAPDPTVNWE

SEQ ID NO: 7043 - protein, 12 aa, Mycobacterium avium
AAASRGSARPEH

SEQ ID NO: 7044 - protein, 6 aa, Mycobacterium avium
AADAAE

SEQ ID NO: 7045 - protein, 10 aa, Mycobacterium avium
AADASAARAI

SEQ ID NO: 7046 - protein, 11 aa, Mycobacterium avium
AADASAARAIE

SEQ ID NO: 7047 - protein, 7 aa, Mycobacterium avium
AADGTPV

SEQ ID NO: 7048 - protein, 12 aa, Mycobacterium avium
AADLSDAQRSRL

SEQ ID NO: 7049 - protein, 12 aa, Mycobacterium avium
AADLSDAQRTRL

SEQ ID NO: 7050 - protein, 12 aa, Mycobacterium avium
AADLSGAQRSRL

SEQ ID NO: 7051 - protein, 13 aa, Mycobacterium avium
AADPKSDEFTGIA

SEQ ID NO: 7052 - protein, 8 aa, Mycobacterium avium
AAEDTSGA

SEQ ID NO: 7053 - protein, 39 aa, Mycobacterium avium
AAEGVDESPGDAGEREGDEGDPGERGSGDAGAAGERRPG

SEQ ID NO: 7054 - protein, 12 aa, Mycobacterium avium
AAENSANSAADQ

SEQ ID NO: 7055 - protein, 10 aa, Mycobacterium avium
AAERPGHSYS

SEQ ID NO: 7056 - protein, 43 aa, Mycobacterium avium
AAGAAVPDVAGSERPPAAAGAAAEEPAEQEEEQPAGLRPTTRQ

SEQ ID NO: 7057 - protein, 43 aa, Mycobacterium avium
AAGAAVPDVAGSERPPAAAGVAAEEPAEQEEEQPAGLRPTTRQ

SEQ ID NO: 7058 - protein, 45 aa, Mycobacterium avium
AAGARCPTSPAASARRRPPASRPRSPPSKKKNNRRVCGPPPVRPS

SEQ ID NO: 7059 - protein, 6 aa, Mycobacterium avium
AAGASS

SEQ ID NO: 7060 - protein, 21 aa, Mycobacterium avium
AAGDAAGEATGDAIGDAVEPV

SEQ ID NO: 7061 - protein, 7 aa, Mycobacterium avium
AAGESVA

SEQ ID NO: 7062 - protein, 11 aa, Mycobacterium avium
AAGGDGPGEVQ

SEQ ID NO: 7063 - protein, 7 aa, Mycobacterium avium
AAGGGRG

SEQ ID NO: 7064 - protein, 7 aa, Mycobacterium avium
AAGGLRP

SEQ ID NO: 7065 - protein, 36 aa, Mycobacterium avium
AAGGNGAAPASPPQVATAATSSPSPHDAARRPPRGI

SEQ ID NO: 7066 - protein, 8 aa, Mycobacterium avium
AAGGPDSA

SEQ ID NO: 7067 - protein, 22 aa, Mycobacterium avium
AAGGPGGPLGAKQGGPTPVGAD

SEQ ID NO: 7068 - protein, 39 aa, Mycobacterium avium
AAGGVDESPGDAGEREGDEGDPGERGPGDAGDAGERRPG

SEQ ID NO: 7069 - protein, 9 aa, Mycobacterium avium
AAGKPAAVA

SEQ ID NO: 7070 - protein, 17 aa, Mycobacterium avium
AAGLPGATVPVPDGTAG

SEQ ID NO: 7071 - protein, 12 aa, Mycobacterium avium
AAGNSANSAADQ

SEQ ID NO: 7072 - protein, 19 aa, Mycobacterium avium
AAGNTGGAGQCPPQRPDAT

SEQ ID NO: 7073 - protein, 13 aa, Mycobacterium avium
AAGPPKGPAAPPV

SEQ ID NO: 7074 - protein, 5 aa, Mycobacterium avium
AAGPT

SEQ ID NO: 7075 - protein, 5 aa, Mycobacterium avium
AAGRG

SEQ ID NO: 7076 - protein, 12 aa, Mycobacterium avium
AAGRRDKARAYA

SEQ ID NO: 7077 - protein, 9 aa, Mycobacterium avium
AAGRSDAAA

SEQ ID NO: 7078 - protein, 13 aa, Mycobacterium avium
AAGRTSAAMASTA

SEQ ID NO: 7079 - protein, 8 aa, Mycobacterium avium
AAGSGESG

SEQ ID NO: 7080 - protein, 5 aa, Mycobacterium avium
AAGTT

SEQ ID NO: 7081 - protein, 5 aa, Mycobacterium avium
AAGYD

SEQ ID NO: 7082 - protein, 7 aa, Mycobacterium avium
AAHQAGV

SEQ ID NO: 7083 - protein, 11 aa, Mycobacterium avium
AAINPGNSGGA

SEQ ID NO: 7084 - protein, 22 aa, Mycobacterium avium
AALAPGAVEKPSAPTPQPRAAR

SEQ ID NO: 7085 - protein, 12 aa, Mycobacterium avium
AALDAANETAVS

SEQ ID NO: 7086 - protein, 7 aa, Mycobacterium avium
AALEPDG

SEQ ID NO: 7087 - protein, 4 aa, Mycobacterium avium
AANA

SEQ ID NO: 7088 - protein, 8 aa, Mycobacterium avium
AANARTRL

SEQ ID NO: 7089 - protein, 20 aa, Mycobacterium avium
AANGSGDRQPMADTSRPDHL

SEQ ID NO: 7090 - protein, 11 aa, Mycobacterium avium
AANPAGAKRIA

SEQ ID NO: 7091 - protein, 32 aa, Mycobacterium avium
AAPAEEGGRHDGTQQPAARGTRNAGDASTPPV

SEQ ID NO: 7092 - protein, 32 aa, Mycobacterium avium
AAPAEEGGRHDGTQQPAARGTRNTGDASTPPV

SEQ ID NO: 7093 - protein, 8 aa, Mycobacterium avium
AAPAPVAT

SEQ ID NO: 7094 - protein, 21 aa, Mycobacterium avium
AAPAPVATVPAPTIAGAPAGV

SEQ ID NO: 7095 - protein, 12 aa, Mycobacterium avium
AAPDRARPMPGT

SEQ ID NO: 7096 - protein, 4 aa, Mycobacterium avium
AAPG

SEQ ID NO: 7097 - protein, 5 aa, Mycobacterium avium
AAPGV

SEQ ID NO: 7098 - protein, 14 aa, Mycobacterium avium
AAPGVSLPETQAAR

SEQ ID NO: 7099 - protein, 15 aa, Mycobacterium avium
AAPKNPSAQRLKSGD

SEQ ID NO: 7100 - protein, 11 aa, Mycobacterium avium
AAPPAPPGLPP

SEQ ID NO: 7101 - protein, 17 aa, Mycobacterium avium
AAPPPAPARDSRAPDVA

SEQ ID NO: 7102 - protein, 8 aa, Mycobacterium avium
AAPPTLTP

SEQ ID NO: 7103 - protein, 29 aa, Mycobacterium avium
AAPQAQPEERPEPQPGPEEAAEAAGGAVA

SEQ ID NO: 7104 - protein, 63 aa, Mycobacterium avium
AAPQAQPEERPEPQPGPEEAAEAAGGAVDAGVAGTRPRSGRHAAADEEDASENGLAGPDGRPT

SEQ ID NO: 7105 - protein, 29 aa, Mycobacterium avium
AAPQAQPEERPEPQPGPEEVAEAAGGAVA

SEQ ID NO: 7106 - protein, 9 aa, Mycobacterium avium
AAPRAAPQD

SEQ ID NO: 7107 - protein, 7 aa, Mycobacterium avium
AAPRAVP

SEQ ID NO: 7108 - protein, 13 aa, Mycobacterium avium
AAPRESAAGVPVA

SEQ ID NO: 7109 - protein, 22 aa, Mycobacterium avium
AAPRPTPDSLPVQDAGDGSAWS

SEQ ID NO: 7110 - protein, 27 aa, Mycobacterium avium
AAPTGSGRVYAPGPDFGRPAAPTDNKR

SEQ ID NO: 7111 - protein, 33 aa, Mycobacterium avium
AAPVATAPAPAPAATATTVAGAPPAAPAPVAPA

SEQ ID NO: 7112 - protein, 20 aa, Mycobacterium avium
AAPYPTASSTTTRRRIGKPA

SEQ ID NO: 7113 - protein, 27 aa, Mycobacterium avium
AAQADSTQRQPEAAPVPAARGNWRTQA

SEQ ID NO: 7114 - protein, 58 aa, Mycobacterium avium
AAQPQREHHRPRPGAAPARATGPGAAEDHAAAAAGRAAPDRTTAPGPAAHRRPRSRPF

SEQ ID NO: 7115 - protein, 11 aa, Mycobacterium avium
AAQSLSGLGEK

SEQ ID NO: 7116 - protein, 8 aa, Mycobacterium avium
AARAGGKR

SEQ ID NO: 7117 - protein, 7 aa, Mycobacterium avium
AARAGGP

SEQ ID NO: 7118 - protein, 23 aa, Mycobacterium avium
AARDAATRAVEGARAGAPDDPLG

SEQ ID NO: 7119 - protein, 26 aa, Mycobacterium avium
AARDAATRAVEGARAGAPDDPLGAFG

SEQ ID NO: 7120 - protein, 7 aa, Mycobacterium avium
AARSELP

SEQ ID NO: 7121 - protein, 7 aa, Mycobacterium avium
AARTTAS

SEQ ID NO: 7122 - protein, 6 aa, Mycobacterium avium
AARTWT

SEQ ID NO: 7123 - protein, 7 aa, Mycobacterium avium
AASAIAS

SEQ ID NO: 7124 - protein, 7 aa, Mycobacterium avium
AASATAE

SEQ ID NO: 7125 - protein, 9 aa, Mycobacterium avium
AASRPANRA

SEQ ID NO: 7126 - protein, 6 aa, Mycobacterium avium
AASSPI

SEQ ID NO: 7127 - protein, 5 aa, Mycobacterium avium
AASTL

SEQ ID NO: 7128 - protein, 11 aa, Mycobacterium avium
AATAGAATADR

SEQ ID NO: 7129 - protein, 19 aa, Mycobacterium avium
AATATQEGNQWKISSLQQV

SEQ ID NO: 7130 - protein, 10 aa, Mycobacterium avium
AATDPRGPYE

SEQ ID NO: 7131 - protein, 11 aa, Mycobacterium avium
AATDPRGPYEH

SEQ ID NO: 7132 - protein, 12 aa, Mycobacterium avium
AATDPRGPYEQR

SEQ ID NO: 7133 - protein, 10 aa, Mycobacterium avium
AATGGPPPSL

SEQ ID NO: 7134 - protein, 18 aa, Mycobacterium avium
AATGRTPNLYRPAGGLSN

SEQ ID NO: 7135 - protein, 10 aa, Mycobacterium avium
AATPRPPSGQ

SEQ ID NO: 7136 - protein, 6 aa, Mycobacterium avium
AATSAA

SEQ ID NO: 7137 - protein, 11 aa, Mycobacterium avium
AAVGSKAAAGA

SEQ ID NO: 7138 - protein, 4 aa, Mycobacterium avium
ACKA

SEQ ID NO: 7139 - protein, 11 aa, Mycobacterium avium
ADAARAVKTYP

SEQ ID NO: 7140 - protein, 16 aa, Mycobacterium avium
ADAGRQVESGAHGVAG

SEQ ID NO: 7141 - protein, 46 aa, Mycobacterium avium
ADAPPPPTVGAAPTMGTASSPGAAPMPASPEAAATPGAPPTPPPTI

SEQ ID NO: 7142 - protein, 50 aa, Mycobacterium avium
ADARRAANAGVRRREAAAPENVEAPAVAQPEEESTQRRRHRAAAKQLGRG

SEQ ID NO: 7143 - protein, 9 aa, Mycobacterium avium
ADASGAGAA

SEQ ID NO: 7144 - protein, 9 aa, Mycobacterium avium
ADATPAAAA

SEQ ID NO: 7145 - protein, 29 aa, Mycobacterium avium
ADDVEQPPDDDRKTTADRTESQPKTAARQ

SEQ ID NO: 7146 - protein, 10 aa, Mycobacterium avium
ADGAGGRTHS

SEQ ID NO: 7147 - protein, 11 aa, Mycobacterium avium
ADGHTDAGGAR

SEQ ID NO: 7148 - protein, 19 aa, Mycobacterium avium
ADGLDTSPSVSHPASPAKR

SEQ ID NO: 7149 - protein, 6 aa, Mycobacterium avium
ADGTPV

SEQ ID NO: 7150 - protein, 10 aa, Mycobacterium avium
ADGYSRSGAG

SEQ ID NO: 7151 - protein, 21 aa, Mycobacterium avium
ADIRASDTDPQPTSSRGEPSI

SEQ ID NO: 7152 - protein, 21 aa, Mycobacterium avium
ADIRESDTDPQPTSSRGKPSI

SEQ ID NO: 7153 - protein, 8 aa, Mycobacterium avium
ADPAAPGE

SEQ ID NO: 7154 - protein, 9 aa, Mycobacterium avium
ADPAQQSAT

SEQ ID NO: 7155 - protein, 6 aa, Mycobacterium avium
ADPASG

SEQ ID NO: 7156 - protein, 7 aa, Mycobacterium avium
ADPGREA

SEQ ID NO: 7157 - protein, 26 aa, Mycobacterium avium
ADPPSPRAFEPTSELTSELTSEPARD

SEQ ID NO: 7158 - protein, 6 aa, Mycobacterium avium
ADPTSD

SEQ ID NO: 7159 - protein, 8 aa, Mycobacterium avium
ADQGVANS

SEQ ID NO: 7160 - protein, 11 aa, Mycobacterium avium
ADQSSAGERGV

SEQ ID NO: 7161 - protein, 12 aa, Mycobacterium avium
ADQVRARTRAAA

SEQ ID NO: 7162 - protein, 6 aa, Mycobacterium avium
ADRANW

SEQ ID NO: 7163 - protein, 5 aa, Mycobacterium avium
ADRDA

SEQ ID NO: 7164 - protein, 19 aa, Mycobacterium avium
ADRGADCGYGEPYQTPDGT

SEQ ID NO: 7165 - protein, 26 aa, Mycobacterium avium
ADRQAQPQTRAPRASGPMRQRQNGFG

SEQ ID NO: 7166 - protein, 9 aa, Mycobacterium avium
ADRRDAAKA

SEQ ID NO: 7167 - protein, 5 aa, Mycobacterium avium
ADRST

SEQ ID NO: 7168 - protein, 10 aa, Mycobacterium avium
ADSASPDQGW

SEQ ID NO: 7169 - protein, 21 aa, Mycobacterium avium
ADSSEPAHQQGPALPPGPVYG

SEQ ID NO: 7170 - protein, 6 aa, Mycobacterium avium
ADSSGP

SEQ ID NO: 7171 - protein, 5 aa, Mycobacterium avium
ADTKH

SEQ ID NO: 7172 - protein, 4 aa, Mycobacterium avium
ADTN

SEQ ID NO: 7173 - protein, 21 aa, Mycobacterium avium
ADTRESDTDPQPTSSRGKPSI

SEQ ID NO: 7174 - protein, 15 aa, Mycobacterium avium
ADVSSGRRAAPPDWP

SEQ ID NO: 7175 - protein, 12 aa, Mycobacterium avium
ADYRPTAQPGYP

SEQ ID NO: 7176 - protein, 7 aa, Mycobacterium avium
ADYTVGE

SEQ ID NO: 7177 - protein, 10 aa, Mycobacterium avium
AEAAKKGEDV

SEQ ID NO: 7178 - protein, 7 aa, Mycobacterium avium
AEAEGRF

SEQ ID NO: 7179 - protein, 5 aa, Mycobacterium avium
AEAST

SEQ ID NO: 7180 - protein, 10 aa, Mycobacterium avium
AEATADEHRR

SEQ ID NO: 7181 - protein, 6 aa, Mycobacterium avium
AEEVPP

SEQ ID NO: 7182 - protein, 6 aa, Mycobacterium avium
AEGEDK

SEQ ID NO: 7183 - protein, 5 aa, Mycobacterium avium
AEGGT

SEQ ID NO: 7184 - protein, 10 aa, Mycobacterium avium
AEGKQRPNVF

SEQ ID NO: 7185 - protein, 6 aa, Mycobacterium avium
AEGVDE

SEQ ID NO: 7186 - protein, 5 aa, Mycobacterium avium
AEHAG

SEQ ID NO: 7187 - protein, 11 aa, Mycobacterium avium
AEIDQAPTPRT

SEQ ID NO: 7188 - protein, 10 aa, Mycobacterium avium
AEIKSTTAFG

SEQ ID NO: 7189 - protein, 13 aa, Mycobacterium avium
AEIPDDYWRSLVH

SEQ ID NO: 7190 - protein, 11 aa, Mycobacterium avium
AELGDKPPPEA

SEQ ID NO: 7191 - protein, 8 aa, Mycobacterium avium
AELPEAAR

SEQ ID NO: 7192 - protein, 10 aa, Mycobacterium avium
AEPAPRRPRG

SEQ ID NO: 7193 - protein, 9 aa, Mycobacterium avium
AEQAPDVAK

SEQ ID NO: 7194 - protein, 4 aa, Mycobacterium avium
AERF

SEQ ID NO: 7195 - protein, 10 aa, Mycobacterium avium
AERGRAATHA

SEQ ID NO: 7196 - protein, 14 aa, Mycobacterium avium
AERRRKPATGAFPA

SEQ ID NO: 7197 - protein, 12 aa, Mycobacterium avium
AESIDKGQWDQA

SEQ ID NO: 7198 - protein, 9 aa, Mycobacterium avium
AESLPTRPE

SEQ ID NO: 7199 - protein, 6 aa, Mycobacterium avium
AETGRP

SEQ ID NO: 7200 - protein, 19 aa, Mycobacterium avium
AETIRSDARPTGPSREEFS

SEQ ID NO: 7201 - protein, 8 aa, Mycobacterium avium
AFGEQGSK

SEQ ID NO: 7202 - protein, 9 aa, Mycobacterium avium
AFPGGSVDR

SEQ ID NO: 7203 - protein, 7 aa, Mycobacterium avium
AFSAPSA

SEQ ID NO: 7204 - protein, 6 aa, Mycobacterium avium
AFSSKW

SEQ ID NO: 7205 - protein, 8 aa, Mycobacterium avium
AGAAATAG

SEQ ID NO: 7206 - protein, 13 aa, Mycobacterium avium
AGAALGQTVTLTL

SEQ ID NO: 7207 - protein, 5 aa, Mycobacterium avium
AGADD

SEQ ID NO: 7208 - protein, 11 aa, Mycobacterium avium
AGAGGPTARAA

SEQ ID NO: 7209 - protein, 6 aa, Mycobacterium avium
AGAHGR

SEQ ID NO: 7210 - protein, 61 aa, Mycobacterium avium
AGAKPANADKPNSAQSKPGSPAPQAPAPPGPEGPAPAVPPAQGQNPETPTPTAAVQPPPVL

SEQ ID NO: 7211 - protein, 53 aa, Mycobacterium avium
AGAKRPGAKKAAPKAEAPKAEAEAAKAEAEPAPKAEPAKQTNGDDAPSQPPVK

SEQ ID NO: 7212 - protein, 64 aa, Mycobacterium avium
AGAKRPGAKKAAPKAEAPKAEAEAAKAEAPKPEAPKAEAESKPEPAKPSNGEGGSSKPSQPPVK

SEQ ID NO: 7213 - protein, 56 aa, Mycobacterium avium
AGAKRPGAKKAAPKAEAPKAEAPKAEAPKAEAEPAPKAEPAKQTNGDDAPSQPPVK

SEQ ID NO: 7214 - protein, 48 aa, Mycobacterium avium
AGAKRPGAKKSAPAAQAPKTEAPKTEAKTEAAGEAKTGAPPAPAAPVK

SEQ ID NO: 7215 - protein, 8 aa, Mycobacterium avium
AGAPETRV

SEQ ID NO: 7216 - protein, 5 aa, Mycobacterium avium
AGASA

SEQ ID NO: 7217 - protein, 6 aa, Mycobacterium avium
AGASAV

SEQ ID NO: 7218 - protein, 7 aa, Mycobacterium avium
AGASSID

SEQ ID NO: 7219 - protein, 4 aa, Mycobacterium avium
AGAT

SEQ ID NO: 7220 - protein, 5 aa, Mycobacterium avium
AGATV

SEQ ID NO: 7221 - protein, 6 aa, Mycobacterium avium
AGDPEL

SEQ ID NO: 7222 - protein, 5 aa, Mycobacterium avium
AGDPG

SEQ ID NO: 7223 - protein, 9 aa, Mycobacterium avium
AGDQPPTIL

SEQ ID NO: 7224 - protein, 33 aa, Mycobacterium avium
AGDSGPTGSFAGGTSCESNPLTDLSRPSDPRNW

SEQ ID NO: 7225 - protein, 6 aa, Mycobacterium avium
AGDVTG

SEQ ID NO: 7226 - protein, 5 aa, Mycobacterium avium
AGEAA

SEQ ID NO: 7227 - protein, 22 aa, Mycobacterium avium
AGEAPSAPRETPSAPGETPRSG

SEQ ID NO: 7228 - protein, 9 aa, Mycobacterium avium
AGEAVSSGE

SEQ ID NO: 7229 - protein, 15 aa, Mycobacterium avium
AGEEIPQTKEETRKR

SEQ ID NO: 7230 - protein, 22 aa, Mycobacterium avium
AGETPSAPGETPSAPGETPRSG

SEQ ID NO: 7231 - protein, 29 aa, Mycobacterium avium
AGETPSAPRETSLAAGETPSAPRETPRSG

SEQ ID NO: 7232 - protein, 12 aa, Mycobacterium avium
AGFSSDDRDRVS

SEQ ID NO: 7233 - protein, 6 aa, Mycobacterium avium
AGGADR

SEQ ID NO: 7234 - protein, 38 aa, Mycobacterium avium
AGGAKRPGAKKSAPAAEAKNEAPAEAKTEAPAAPAKGL

SEQ ID NO: 7235 - protein, 11 aa, Mycobacterium avium
AGGALTANGKL

SEQ ID NO: 7236 - protein, 6 aa, Mycobacterium avium
AGGANL

SEQ ID NO: 7237 - protein, 8 aa, Mycobacterium avium
AGGGTEDV

SEQ ID NO: 7238 - protein, 8 aa, Mycobacterium avium
AGGGTFTS

SEQ ID NO: 7239 - protein, 38 aa, Mycobacterium avium
AGGNRGSDHEPVQPGGSAADADRPQDRSARAARSARPG

SEQ ID NO: 7240 - protein, 11 aa, Mycobacterium avium
AGGNSSQRTTV

SEQ ID NO: 7241 - protein, 9 aa, Mycobacterium avium
AGGRPESAA

SEQ ID NO: 7242 - protein, 11 aa, Mycobacterium avium
AGGSPSGAARA

SEQ ID NO: 7243 - protein, 6 aa, Mycobacterium avium
AGHGPA

SEQ ID NO: 7244 - protein, 4 aa, Mycobacterium avium
AGHS

SEQ ID NO: 7245 - protein, 14 aa, Mycobacterium avium
AGHTTASDEPKPAE

SEQ ID NO: 7246 - protein, 9 aa, Mycobacterium avium
AGKKPEEYG

SEQ ID NO: 7247 - protein, 11 aa, Mycobacterium avium
AGLESQSGSEA

SEQ ID NO: 7248 - protein, 16 aa, Mycobacterium avium
AGLPTATIGGEATVGE

SEQ ID NO: 7249 - protein, 15 aa, Mycobacterium avium
AGLSGQSARSTAEQL

SEQ ID NO: 7250 - protein, 6 aa, Mycobacterium avium
AGNTGA

SEQ ID NO: 7251 - protein, 18 aa, Mycobacterium avium
AGNTGGAGQCPPQQPDAT

SEQ ID NO: 7252 - protein, 18 aa, Mycobacterium avium
AGNTGGPGQCPPQRPDAT

SEQ ID NO: 7253 - protein, 4 aa, Mycobacterium avium
AGPA

SEQ ID NO: 7254 - protein, 7 aa, Mycobacterium avium
AGPGGRA

SEQ ID NO: 7255 - protein, 7 aa, Mycobacterium avium
AGPGLRE

SEQ ID NO: 7256 - protein, 15 aa, Mycobacterium avium
AGPPATGANDPCAAS

SEQ ID NO: 7257 - protein, 9 aa, Mycobacterium avium
AGPTDTYPT

SEQ ID NO: 7258 - protein, 9 aa, Mycobacterium avium
AGPTQTYPS

SEQ ID NO: 7259 - protein, 25 aa, Mycobacterium avium
AGQAVPDQAASPETAAAATPRRHGG

SEQ ID NO: 7260 - protein, 25 aa, Mycobacterium avium
AGQAVPDQAASQETAAAATPRRHGG

SEQ ID NO: 7261 - protein, 27 aa, Mycobacterium avium
AGQAVRDQATSPETAAAATSRRHGGAL

SEQ ID NO: 7262 - protein, 31 aa, Mycobacterium avium
AGRAGDQPGRPGGDRGGVSGSAENGFRPNDS

SEQ ID NO: 7263 - protein, 62 aa, Mycobacterium avium
AGRPGDAPPDVPGTPVPLPTQAPPGARTENLAPAGPVPPPSTFAPGAAAGSAGTPRAGQPVA

SEQ ID NO: 7264 - protein, 61 aa, Mycobacterium avium
AGRPGDAPPDVPGTPVPLPTQAPPGARTENLAPAGPVPPPSTFAPGLPPGPPAPPGPGNQL

SEQ ID NO: 7265 - protein, 11 aa, Mycobacterium avium
AGRQGSQSVPG

SEQ ID NO: 7266 - protein, 64 aa, Mycobacterium avium
AGRRPPRPSQSPPPGRASPAAIPSSPTTRAAAVSSGRTAAPRRTRPATGGHRPPPARRTFSSGQ

SEQ ID NO: 7267 - protein, 8 aa, Mycobacterium avium
AGRSTEKL

SEQ ID NO: 7268 - protein, 7 aa, Mycobacterium avium
AGSPPQE

SEQ ID NO: 7269 - protein, 15 aa, Mycobacterium avium
AGSPVTIDGDAGAAR

SEQ ID NO: 7270 - protein, 10 aa, Mycobacterium avium
AGSRLGYQDS

SEQ ID NO: 7271 - protein, 17 aa, Mycobacterium avium
AGSSLGATVAGSQPAAV

SEQ ID NO: 7272 - protein, 9 aa, Mycobacterium avium
AGSVDGPLR

SEQ ID NO: 7273 - protein, 13 aa, Mycobacterium avium
AGSWEGESAEQYA

SEQ ID NO: 7274 - protein, 27 aa, Mycobacterium avium
AGTARKDAAGAAAGLTTLPGAELGGPT

SEQ ID NO: 7275 - protein, 8 aa, Mycobacterium avium
AGTDSTGR

SEQ ID NO: 7276 - protein, 8 aa, Mycobacterium avium
AGTGAAAD

SEQ ID NO: 7277 - protein, 6 aa, Mycobacterium avium
AGTPAK

SEQ ID NO: 7278 - protein, 12 aa, Mycobacterium avium
AGTRAPGVAAAG

SEQ ID NO: 7279 - protein, 13 aa, Mycobacterium avium
AGTRYTDGGGKAV

SEQ ID NO: 7280 - protein, 7 aa, Mycobacterium avium
AGVGSPG

SEQ ID NO: 7281 - protein, 20 aa, Mycobacterium avium
AGVRPGDGIASDPEDPSQAV

SEQ ID NO: 7282 - protein, 10 aa, Mycobacterium avium
AGVSTNPRAL

SEQ ID NO: 7283 - protein, 4 aa, Mycobacterium avium
AGYA

SEQ ID NO: 7284 - protein, 7 aa, Mycobacterium avium
AGYGGDP

SEQ ID NO: 7285 - protein, 8 aa, Mycobacterium avium
AHAGSQPL

SEQ ID NO: 7286 - protein, 7 aa, Mycobacterium avium
AHGGGAG

SEQ ID NO: 7287 - protein, 7 aa, Mycobacterium avium
AHGGGAS

SEQ ID NO: 7288 - protein, 15 aa, Mycobacterium avium
AHGQRNAVRQRATRS

SEQ ID NO: 7289 - protein, 8 aa, Mycobacterium avium
AHPDAPGE

SEQ ID NO: 7290 - protein, 9 aa, Mycobacterium avium
AHPERGRPV

SEQ ID NO: 7291 - protein, 8 aa, Mycobacterium avium
AHPETNQA

SEQ ID NO: 7292 - protein, 8 aa, Mycobacterium avium
AHPITAAT

SEQ ID NO: 7293 - protein, 12 aa, Mycobacterium avium
AHPRPAGGPSHH

SEQ ID NO: 7294 - protein, 4 aa, Mycobacterium avium
AHQS

SEQ ID NO: 7295 - protein, 7 aa, Mycobacterium avium
AHSGNSP

SEQ ID NO: 7296 - protein, 10 aa, Mycobacterium avium
AHYDPKSAVG

SEQ ID NO: 7297 - protein, 6 aa, Mycobacterium avium
AIGEPL

SEQ ID NO: 7298 - protein, 6 aa, Mycobacterium avium
AIGEPV

SEQ ID NO: 7299 - protein, 12 aa, Mycobacterium avium
AIKTQTAVPPLP

SEQ ID NO: 7300 - protein, 10 aa, Mycobacterium avium
AIRARNSDVS

SEQ ID NO: 7301 - protein, 6 aa, Mycobacterium avium
AISGRS

SEQ ID NO: 7302 - protein, 6 aa, Mycobacterium avium
AKADPL

SEQ ID NO: 7303 - protein, 47 aa, Mycobacterium avium
AKASEAAAAARLEADRNANGGNGSHANQGGNRQGPTQPDYGAPAGWR

SEQ ID NO: 7304 - protein, 61 aa, Mycobacterium avium
AKASEAAAAARLEADRNVNGGNGSHANQGGNRQGPTQPDYGAPAGWRAPGWPPQQSQQPNY

SEQ ID NO: 7305 - protein, 6 aa, Mycobacterium avium
AKEQLS

SEQ ID NO: 7306 - protein, 22 aa, Mycobacterium avium
AKGDQPLVTASGGPVYGSGLPS

SEQ ID NO: 7307 - protein, 15 aa, Mycobacterium avium
AKGPQDYANIPPTRF

SEQ ID NO: 7308 - protein, 4 aa, Mycobacterium avium
AKIP

SEQ ID NO: 7309 - protein, 9 aa, Mycobacterium avium
AKLADGRLD

SEQ ID NO: 7310 - protein, 11 aa, Mycobacterium avium
AKLATDSRQNL

SEQ ID NO: 7311 - protein, 6 aa, Mycobacterium avium
AKLTNT

SEQ ID NO: 7312 - protein, 10 aa, Mycobacterium avium
AKNPDNRYQT

SEQ ID NO: 7313 - protein, 6 aa, Mycobacterium avium
AKPAAV

SEQ ID NO: 7314 - protein, 6 aa, Mycobacterium avium
AKPFPV

SEQ ID NO: 7315 - protein, 7 aa, Mycobacterium avium
AKPLTRD

SEQ ID NO: 7316 - protein, 20 aa, Mycobacterium avium
AKPSGGRKRGEAGRGGPPPS

SEQ ID NO: 7317 - protein, 33 aa, Mycobacterium avium
AKQLPTAPDSTPVFPTPPLPAKALAAASKEKAR

SEQ ID NO: 7318 - protein, 7 aa, Mycobacterium avium
AKRAGTA

SEQ ID NO: 7319 - protein, 4 aa, Mycobacterium avium
AKRI

SEQ ID NO: 7320 - protein, 7 aa, Mycobacterium avium
AKRQELK

SEQ ID NO: 7321 - protein, 5 aa, Mycobacterium avium
ALASN

SEQ ID NO: 7322 - protein, 16 aa, Mycobacterium avium
ALDGGAGNVDQRSGSA

SEQ ID NO: 7323 - protein, 16 aa, Mycobacterium avium
ALDGGAGNVNKRSGSA

SEQ ID NO: 7324 - protein, 49 aa, Mycobacterium avium
ALDSRGPASGRQQRAGLGGRPPVGPPPPPPRRGWSGGPGGPGGRGSGPW

SEQ ID NO: 7325 - protein, 5 aa, Mycobacterium avium
ALEDQ

SEQ ID NO: 7326 - protein, 9 aa, Mycobacterium avium
ALGDPRRGH

SEQ ID NO: 7327 - protein, 7 aa, Mycobacterium avium
ALGGGPP

SEQ ID NO: 7328 - protein, 19 aa, Mycobacterium avium
ALKGTPNESFPKPAEVGGY

SEQ ID NO: 7329 - protein, 8 aa, Mycobacterium avium
ALPAKDRA

SEQ ID NO: 7330 - protein, 14 aa, Mycobacterium avium
ALPRRRSGRIRRDA

SEQ ID NO: 7331 - protein, 5 aa, Mycobacterium avium
ALPTD

SEQ ID NO: 7332 - protein, 41 aa, Mycobacterium avium
ALPVGARGSAAENNDEQPAEDDDVDTEAVAKGGDEQDSYEY

SEQ ID NO: 7333 - protein, 15 aa, Mycobacterium avium
ALRPSAAAPSVTSVS

SEQ ID NO: 7334 - protein, 10 aa, Mycobacterium avium
ALTPRPVGPR

SEQ ID NO: 7335 - protein, 7 aa, Mycobacterium avium
ALTTGTR

SEQ ID NO: 7336 - protein, 10 aa, Mycobacterium avium
AMDKAAKTWN

SEQ ID NO: 7337 - protein, 23 aa, Mycobacterium avium
AMGTRRGDEAATTDDGTETPEAI

SEQ ID NO: 7338 - protein, 8 aa, Mycobacterium avium
ANAAATAW

SEQ ID NO: 7339 - protein, 14 aa, Mycobacterium avium
ANAPKTWQGMLLSS

SEQ ID NO: 7340 - protein, 5 aa, Mycobacterium avium
ANDIQ

SEQ ID NO: 7341 - protein, 16 aa, Mycobacterium avium
ANDVNAKDSEMKRVCG

SEQ ID NO: 7342 - protein, 6 aa, Mycobacterium avium
ANEEAA

SEQ ID NO: 7343 - protein, 7 aa, Mycobacterium avium
ANKATTV

SEQ ID NO: 7344 - protein, 4 aa, Mycobacterium avium
ANLT

SEQ ID NO: 7345 - protein, 6 aa, Mycobacterium avium
ANMTGS

SEQ ID NO: 7346 - protein, 7 aa, Mycobacterium avium
ANPDDTL

SEQ ID NO: 7347 - protein, 6 aa, Mycobacterium avium
ANQLSG

SEQ ID NO: 7348 - protein, 21 aa, Mycobacterium avium
ANRDDRPISSGAADDIKPFNP

SEQ ID NO: 7349 - protein, 6 aa, Mycobacterium avium
ANRDNI

SEQ ID NO: 7350 - protein, 7 aa, Mycobacterium avium
ANSERRT

SEQ ID NO: 7351 - protein, 12 aa, Mycobacterium avium
ANTARPNTSLAQ

SEQ ID NO: 7352 - protein, 9 aa, Mycobacterium avium
ANVRPSPNQ

SEQ ID NO: 7353 - protein, 9 aa, Mycobacterium avium
ANVSAGSQY

SEQ ID NO: 7354 - protein, 9 aa, Mycobacterium avium
APADGSDAL

SEQ ID NO: 7355 - protein, 7 aa, Mycobacterium avium
APAELAP

SEQ ID NO: 7356 - protein, 11 aa, Mycobacterium avium
APAERQRELQD

SEQ ID NO: 7357 - protein, 4 aa, Mycobacterium avium
APAI

SEQ ID NO: 7358 - protein, 13 aa, Mycobacterium avium
APANTSAETTHAA

SEQ ID NO: 7359 - protein, 17 aa, Mycobacterium avium
APAPDTDRSESQRRGTM

SEQ ID NO: 7360 - protein, 38 aa, Mycobacterium avium
APAPPAGGPPGGPEPGGGVPPGPGGGVPPGGPQAPPPP

SEQ ID NO: 7361 - protein, 37 aa, Mycobacterium avium
APAPPPGTGASPPPHPAAPPAPPPQHPQRPRDGSQDT

SEQ ID NO: 7362 - protein, 48 aa, Mycobacterium avium
APARPTPQYQPRPVEQPAPPPAAAPAPAAPPPAPAPPPAAPPVPHQPP

SEQ ID NO: 7363 - protein, 48 aa, Mycobacterium avium
APARPTPQYQPRPVEQPAPPPAAAPAPAAPPPVPAPPPAAPPVPHQPP

SEQ ID NO: 7364 - protein, 21 aa, Mycobacterium avium
APARSPSTPRPAPAHDAYADS

SEQ ID NO: 7365 - protein, 9 aa, Mycobacterium avium
APDAPAAQV

SEQ ID NO: 7366 - protein, 8 aa, Mycobacterium avium
APDARLGE

SEQ ID NO: 7367 - protein, 9 aa, Mycobacterium avium
APDNCAPGR

SEQ ID NO: 7368 - protein, 5 aa, Mycobacterium avium
APDNL

SEQ ID NO: 7369 - protein, 42 aa, Mycobacterium avium
APDNPPPPSAAPSPPPAAPVPAAPPPQAPVSPAPSPHSGDHE

SEQ ID NO: 7370 - protein, 27 aa, Mycobacterium avium
APDPSLAPAKRDGAADRLAGNAAAAGM

SEQ ID NO: 7371 - protein, 4 aa, Mycobacterium avium
APEF

SEQ ID NO: 7372 - protein, 6 aa, Mycobacterium avium
APESLN

SEQ ID NO: 7373 - protein, 5 aa, Mycobacterium avium
APFNS

SEQ ID NO: 7374 - protein, 4 aa, Mycobacterium avium
APGA

SEQ ID NO: 7375 - protein, 5 aa, Mycobacterium avium
APGFG

SEQ ID NO: 7376 - protein, 14 aa, Mycobacterium avium
APGGPVPARSGPEA

SEQ ID NO: 7377 - protein, 5 aa, Mycobacterium avium
APGQI

SEQ ID NO: 7378 - protein, 78 aa, Mycobacterium avium
APGSEPPAGPAPAPPPPAAATPPPPAAPAPSGPAAGAPPPPRLAPPPAAEHTPRHGGEPEPADPRRARDASGTGGQSV

SEQ ID NO: 7379 - protein, 78 aa, Mycobacterium avium
APGSEPPAGPAPAPPPPAAATPPPPAAPAPSGPAAGASPPPRLAPPPAAEHTPRHGGEPEPADPRRARDASGTGGQSV

SEQ ID NO: 7380 - protein, 8 aa, Mycobacterium avium
APGSTGIE

SEQ ID NO: 7381 - protein, 9 aa, Mycobacterium avium
APGSTGIEE

SEQ ID NO: 7382 - protein, 10 aa, Mycobacterium avium
APGSTGIEEA

SEQ ID NO: 7383 - protein, 6 aa, Mycobacterium avium
APGTGY

SEQ ID NO: 7384 - protein, 7 aa, Mycobacterium avium
APGVGKT

SEQ ID NO: 7385 - protein, 14 aa, Mycobacterium avium
APIKPGDSGGPMVN

SEQ ID NO: 7386 - protein, 6 aa, Mycobacterium avium
APKATV

SEQ ID NO: 7387 - protein, 7 aa, Mycobacterium avium
APKRTST

SEQ ID NO: 7388 - protein, 6 aa, Mycobacterium avium
APLPAV

SEQ ID NO: 7389 - protein, 68 aa, Mycobacterium avium
APLPPPLPRTAGRAGRQSGGNTRARARHHGSGQRYASLGANSGANQAASSRAGQRQPRRARALEGQRY

SEQ ID NO: 7390 - protein, 23 aa, Mycobacterium avium
APLPQPVNGAQPGAAPVASPGAP

SEQ ID NO: 7391 - protein, 23 aa, Mycobacterium avium
APLPQPVNGAQPGPAPVATPGAP

SEQ ID NO: 7392 - protein, 6 aa, Mycobacterium avium
APLPTV

SEQ ID NO: 7393 - protein, 22 aa, Mycobacterium avium
APLSSTPAQVAAATARALAKGR

SEQ ID NO: 7394 - protein, 12 aa, Mycobacterium avium
APNTPPLPGDVS

SEQ ID NO: 7395 - protein, 10 aa, Mycobacterium avium
APPPPGAPPE

SEQ ID NO: 7396 - protein, 11 aa, Mycobacterium avium
APPPPPGAPPE

SEQ ID NO: 7397 - protein, 7 aa, Mycobacterium avium
APPVTRK

SEQ ID NO: 7398 - protein, 9 aa, Mycobacterium avium
APQPPPAPR

SEQ ID NO: 7399 - protein, 5 aa, Mycobacterium avium
APQRR

SEQ ID NO: 7400 - protein, 6 aa, Mycobacterium avium
APQRRT

SEQ ID NO: 7401 - protein, 12 aa, Mycobacterium avium
APRESAAGVPAA

SEQ ID NO: 7402 - protein, 12 aa, Mycobacterium avium
APRESAAGVPVA

SEQ ID NO: 7403 - protein, 10 aa, Mycobacterium avium
APRKRSNPQM

SEQ ID NO: 7404 - protein, 115 aa, Mycobacterium avium
APRPPHDPTHPAAPEPSRPARPAPAEPRPAQEPAASTTRIPARPNQPTEAQTTRFAAPGAPGRQRPPEPRPATPQRPPAQAAPPSGDQTRAIPVPGNRPDDGDSDADAAEPTTAL

SEQ ID NO: 7405 - protein, 17 aa, Mycobacterium avium
APRSRMDPRVRNDESVR

SEQ ID NO: 7406 - protein, 13 aa, Mycobacterium avium
APSKSYGGSPAWN

SEQ ID NO: 7407 - protein, 44 aa, Mycobacterium avium
APSPPPAPAPAPSPAPAPAPTSAAAPAAAAPGAPPPTPSGPPVA

SEQ ID NO: 7408 - protein, 5 aa, Mycobacterium avium
APSQR

SEQ ID NO: 7409 - protein, 6 aa, Mycobacterium avium
APSRRK

SEQ ID NO: 7410 - protein, 38 aa, Mycobacterium avium
APTAADEPDVAEASPDQSEQTDKAAEGEGGPPRPRKRR

SEQ ID NO: 7411 - protein, 5 aa, Mycobacterium avium
APTAE

SEQ ID NO: 7412 - protein, 7 aa, Mycobacterium avium
APTATLG

SEQ ID NO: 7413 - protein, 18 aa, Mycobacterium avium
APTLPPTDSSWTPEQLAT

SEQ ID NO: 7414 - protein, 13 aa, Mycobacterium avium
APWAPPAALPGNR

SEQ ID NO: 7415 - protein, 15 aa, Mycobacterium avium
AQARPATASAKTPGV

SEQ ID NO: 7416 - protein, 10 aa, Mycobacterium avium
AQDAAASSLT

SEQ ID NO: 7417 - protein, 16 aa, Mycobacterium avium
AQDAAQQNRNLNERVK

SEQ ID NO: 7418 - protein, 10 aa, Mycobacterium avium
AQGAADAKER

SEQ ID NO: 7419 - protein, 110 aa, Mycobacterium avium
AQHDHHGDHHGDQTHGDKPNDDATSAPHTQPAPWEPPAGSAPPPYPPPGYPADYPPGYPPPYPPPAPSPVPPPPPGYGPPPPPGYGPPGYPGGYYPGPDYGGYPPQPPLL

SEQ ID NO: 7420 - protein, 8 aa, Mycobacterium avium
AQLGRDPR

SEQ ID NO: 7421 - protein, 14 aa, Mycobacterium avium
AQLSSLADETPEGR

SEQ ID NO: 7422 - protein, 4 aa, Mycobacterium avium
AQLT

SEQ ID NO: 7423 - protein, 14 aa, Mycobacterium avium
AQLTSQLGERDQAI

SEQ ID NO: 7424 - protein, 63 aa, Mycobacterium avium
AQNKSDKSVTTPAPTLSTTPAPPPPSVTAEPAPPPADIPVPSTSDTNPPAETETPMTTTPRAT

SEQ ID NO: 7425 - protein, 17 aa, Mycobacterium avium
AQPPPGTTPDKFPQKPQ

SEQ ID NO: 7426 - protein, 6 aa, Mycobacterium avium
AQPQKV

SEQ ID NO: 7427 - protein, 10 aa, Mycobacterium avium
AQQESEPTKP

SEQ ID NO: 7428 - protein, 5 aa, Mycobacterium avium
AQQPR

SEQ ID NO: 7429 - protein, 34 aa, Mycobacterium avium
AQQQAPAGQPAPAGQPATGQPSAPVAAPPGPSIA

SEQ ID NO: 7430 - protein, 14 aa, Mycobacterium avium
AQREASITKSFNPP

SEQ ID NO: 7431 - protein, 6 aa, Mycobacterium avium
AQRRRA

SEQ ID NO: 7432 - protein, 37 aa, Mycobacterium avium
AQRVTDENGTRDMRDGRAASVTHKKMSDQDVCQSGTA

SEQ ID NO: 7433 - protein, 9 aa, Mycobacterium avium
AQSSTSDPH

SEQ ID NO: 7434 - protein, 4 aa, Mycobacterium avium
AQTQ

SEQ ID NO: 7435 - protein, 5 aa, Mycobacterium avium
AQTQH

SEQ ID NO: 7436 - protein, 13 aa, Mycobacterium avium
AQTSPAGAPAQRQ

SEQ ID NO: 7437 - protein, 8 aa, Mycobacterium avium
ARAAASAE

SEQ ID NO: 7438 - protein, 25 aa, Mycobacterium avium
ARAALASGAVEKPSAPTTQPRAARR

SEQ ID NO: 7439 - protein, 6 aa, Mycobacterium avium
ARADGK

SEQ ID NO: 7440 - protein, 18 aa, Mycobacterium avium
ARADPADWQDPRQQRRRN

SEQ ID NO: 7441 - protein, 16 aa, Mycobacterium avium
ARADTGSGGERISPQR

SEQ ID NO: 7442 - protein, 9 aa, Mycobacterium avium
ARAEAARER

SEQ ID NO: 7443 - protein, 6 aa, Mycobacterium avium
ARAGLD

SEQ ID NO: 7444 - protein, 8 aa, Mycobacterium avium
ARDGQAPC

SEQ ID NO: 7445 - protein, 8 aa, Mycobacterium avium
ARDPEAVR

SEQ ID NO: 7446 - protein, 10 aa, Mycobacterium avium
ARDTSIPRPV

SEQ ID NO: 7447 - protein, 27 aa, Mycobacterium avium
ARGEAASMSAGAGRDVRPTDRPKAASQ

SEQ ID NO: 7448 - protein, 9 aa, Mycobacterium avium
ARKAARIGV

SEQ ID NO: 7449 - protein, 9 aa, Mycobacterium avium
ARKQDISNG

SEQ ID NO: 7450 - protein, 17 aa, Mycobacterium avium
ARNRGNPASQADANSTG

SEQ ID NO: 7451 - protein, 14 aa, Mycobacterium avium
ARPAPGAHRTRDSL

SEQ ID NO: 7452 - protein, 22 aa, Mycobacterium avium
ARPATERAPHTPATPPDVGWSG

SEQ ID NO: 7453 - protein, 8 aa, Mycobacterium avium
ARPEGSTK

SEQ ID NO: 7454 - protein, 10 aa, Mycobacterium avium
ARPGDRPSRS

SEQ ID NO: 7455 - protein, 5 aa, Mycobacterium avium
ARPHA

SEQ ID NO: 7456 - protein, 16 aa, Mycobacterium avium
ARPKNPTTSNRCSTTR

SEQ ID NO: 7457 - protein, 9 aa, Mycobacterium avium
ARPPLSGTV

SEQ ID NO: 7458 - protein, 5 aa, Mycobacterium avium
ARPPV

SEQ ID NO: 7459 - protein, 4 aa, Mycobacterium avium
ARPR

SEQ ID NO: 7460 - protein, 7 aa, Mycobacterium avium
ARPRTLP

SEQ ID NO: 7461 - protein, 10 aa, Mycobacterium avium
ARQAGESRED

SEQ ID NO: 7462 - protein, 5 aa, Mycobacterium avium
ARQAR

SEQ ID NO: 7463 - protein, 7 aa, Mycobacterium avium
ARQLPSD

SEQ ID NO: 7464 - protein, 6 aa, Mycobacterium avium
ARQPNE

SEQ ID NO: 7465 - protein, 14 aa, Mycobacterium avium
ARRADSTAAEAHSA

SEQ ID NO: 7466 - protein, 30 aa, Mycobacterium avium
ARRAEKQPAAPAAEAPQSVQDKLADRYGRR

SEQ ID NO: 7467 - protein, 30 aa, Mycobacterium avium
ARRAERQPAAPAPEAPQSVQDKLADRYGRR

SEQ ID NO: 7468 - protein, 9 aa, Mycobacterium avium
ARRASRPFP

SEQ ID NO: 7469 - protein, 4 aa, Mycobacterium avium
ARRL

SEQ ID NO: 7470 - protein, 8 aa, Mycobacterium avium
ARRTPGRA

SEQ ID NO: 7471 - protein, 7 aa, Mycobacterium avium
ARSAGYP

SEQ ID NO: 7472 - protein, 7 aa, Mycobacterium avium
ARSGLDD

SEQ ID NO: 7473 - protein, 9 aa, Mycobacterium avium
ARSPEGRGL

SEQ ID NO: 7474 - protein, 7 aa, Mycobacterium avium
ARSPRIP

SEQ ID NO: 7475 - protein, 8 aa, Mycobacterium avium
ARSPRNGM

SEQ ID NO: 7476 - protein, 7 aa, Mycobacterium avium
ARTAALG

SEQ ID NO: 7477 - protein, 5 aa, Mycobacterium avium
ARTLG

SEQ ID NO: 7478 - protein, 9 aa, Mycobacterium avium
ARTPGPFQG

SEQ ID NO: 7479 - protein, 9 aa, Mycobacterium avium
ARTPPPPGL

SEQ ID NO: 7480 - protein, 10 aa, Mycobacterium avium
ARTTASRLSP

SEQ ID NO: 7481 - protein, 7 aa, Mycobacterium avium
ARYPDQQ

SEQ ID NO: 7482 - protein, 17 aa, Mycobacterium avium
ASAGIGRATAKEFGRRG

SEQ ID NO: 7483 - protein, 4 aa, Mycobacterium avium
ASAH

SEQ ID NO: 7484 - protein, 8 aa, Mycobacterium avium
ASANGALA

SEQ ID NO: 7485 - protein, 9 aa, Mycobacterium avium
ASASSGRPL

SEQ ID NO: 7486 - protein, 8 aa, Mycobacterium avium
ASASSRRP

SEQ ID NO: 7487 - protein, 11 aa, Mycobacterium avium
ASDEELEPVTG

SEQ ID NO: 7488 - protein, 12 aa, Mycobacterium avium
ASDEYKNTASSM

SEQ ID NO: 7489 - protein, 12 aa, Mycobacterium avium
ASDPKSARSSAL

SEQ ID NO: 7490 - protein, 12 aa, Mycobacterium avium
ASDPKSARSSAM

SEQ ID NO: 7491 - protein, 12 aa, Mycobacterium avium
ASDQYKNTASSM

SEQ ID NO: 7492 - protein, 6 aa, Mycobacterium avium
ASESAK

SEQ ID NO: 7493 - protein, 6 aa, Mycobacterium avium
ASFATT

SEQ ID NO: 7494 - protein, 7 aa, Mycobacterium avium
ASGARAL

SEQ ID NO: 7495 - protein, 4 aa, Mycobacterium avium
ASGF

SEQ ID NO: 7496 - protein, 5 aa, Mycobacterium avium
ASGFN

SEQ ID NO: 7497 - protein, 8 aa, Mycobacterium avium
ASGGPFRG

SEQ ID NO: 7498 - protein, 5 aa, Mycobacterium avium
ASGLP

SEQ ID NO: 7499 - protein, 16 aa, Mycobacterium avium
ASGRPTLGSASAVQRA

SEQ ID NO: 7500 - protein, 6 aa, Mycobacterium avium
ASHEEN

SEQ ID NO: 7501 - protein, 5 aa, Mycobacterium avium
ASIGL

SEQ ID NO: 7502 - protein, 5 aa, Mycobacterium avium
ASIPG

SEQ ID NO: 7503 - protein, 6 aa, Mycobacterium avium
ASLPRG

SEQ ID NO: 7504 - protein, 7 aa, Mycobacterium avium
ASNNTKL

SEQ ID NO: 7505 - protein, 9 aa, Mycobacterium avium
ASPANTVRG

SEQ ID NO: 7506 - protein, 8 aa, Mycobacterium avium
ASPDYPGD

SEQ ID NO: 7507 - protein, 4 aa, Mycobacterium avium
ASPV

SEQ ID NO: 7508 - protein, 17 aa, Mycobacterium avium
ASQPPGWSEIPWANWIF

SEQ ID NO: 7509 - protein, 9 aa, Mycobacterium avium
ASRAEGTRA

SEQ ID NO: 7510 - protein, 6 aa, Mycobacterium avium
ASRDAA

SEQ ID NO: 7511 - protein, 4 aa, Mycobacterium avium
ASRL

SEQ ID NO: 7512 - protein, 9 aa, Mycobacterium avium
ASTSFPSGH

SEQ ID NO: 7513 - protein, 8 aa, Mycobacterium avium
ATAGAASL

SEQ ID NO: 7514 - protein, 4 aa, Mycobacterium avium
ATAH

SEQ ID NO: 7515 - protein, 8 aa, Mycobacterium avium
ATANGALA

SEQ ID NO: 7516 - protein, 51 aa, Mycobacterium avium
ATAPAPTFPAGRGAGRRCSNSPASGTNMPAARRGPEPRCTTSASPCTRATG

SEQ ID NO: 7517 - protein, 5 aa, Mycobacterium avium
ATAPD

SEQ ID NO: 7518 - protein, 8 aa, Mycobacterium avium
ATAPEVDT

SEQ ID NO: 7519 - protein, 5 aa, Mycobacterium avium
ATAPG

SEQ ID NO: 7520 - protein, 11 aa, Mycobacterium avium
ATAQSAVAPGT

SEQ ID NO: 7521 - protein, 11 aa, Mycobacterium avium
ATARDPADRYA

SEQ ID NO: 7522 - protein, 5 aa, Mycobacterium avium
ATARQ

SEQ ID NO: 7523 - protein, 13 aa, Mycobacterium avium
ATASADPENEARI

SEQ ID NO: 7524 - protein, 4 aa, Mycobacterium avium
ATAT

SEQ ID NO: 7525 - protein, 6 aa, Mycobacterium avium
ATATAD

SEQ ID NO: 7526 - protein, 10 aa, Mycobacterium avium
ATDDRPAGTA

SEQ ID NO: 7527 - protein, 10 aa, Mycobacterium avium
ATDTNANDRA

SEQ ID NO: 7528 - protein, 5 aa, Mycobacterium avium
ATDTT

SEQ ID NO: 7529 - protein, 5 aa, Mycobacterium avium
ATDVT

SEQ ID NO: 7530 - protein, 7 aa, Mycobacterium avium
ATEDTPH

SEQ ID NO: 7531 - protein, 20 aa, Mycobacterium avium
ATEPPRPAGSVPRPTGPGRL

SEQ ID NO: 7532 - protein, 48 aa, Mycobacterium avium
ATESSASGKNCRPAADATAAAAAAPAPAAADRQTRRRRRNTPSRVDRG

SEQ ID NO: 7533 - protein, 48 aa, Mycobacterium avium
ATESSVSGKNCRPAADATAAAAAAPAPTAADRQTLRRRRNAPSRVDRG

SEQ ID NO: 7534 - protein, 8 aa, Mycobacterium avium
ATGAGKGS

SEQ ID NO: 7535 - protein, 7 aa, Mycobacterium avium
ATGANAL

SEQ ID NO: 7536 - protein, 14 aa, Mycobacterium avium
ATGDFAKQYEKNAN

SEQ ID NO: 7537 - protein, 7 aa, Mycobacterium avium
ATGGNTL

SEQ ID NO: 7538 - protein, 15 aa, Mycobacterium avium
ATGGPAGVGEAVGRS

SEQ ID NO: 7539 - protein, 10 aa, Mycobacterium avium
ATGGRAQPDD

SEQ ID NO: 7540 - protein, 21 aa, Mycobacterium avium
ATGGTVEVRDTAEPAARRRNS

SEQ ID NO: 7541 - protein, 5 aa, Mycobacterium avium
ATGPG

SEQ ID NO: 7542 - protein, 20 aa, Mycobacterium avium
ATGPPLYNPDPSLADPNPPL

SEQ ID NO: 7543 - protein, 9 aa, Mycobacterium avium
ATGRGREDH

SEQ ID NO: 7544 - protein, 7 aa, Mycobacterium avium
ATGTASV

SEQ ID NO: 7545 - protein, 5 aa, Mycobacterium avium
ATGTF

SEQ ID NO: 7546 - protein, 14 aa, Mycobacterium avium
ATGVANRNTKQDYN

SEQ ID NO: 7547 - protein, 26 aa, Mycobacterium avium
ATHTDATPEEPATQPDALRDADTEEI

SEQ ID NO: 7548 - protein, 8 aa, Mycobacterium avium
ATNGGGFY

SEQ ID NO: 7549 - protein, 17 aa, Mycobacterium avium
ATNLGGHEDVRTTTAAP

SEQ ID NO: 7550 - protein, 21 aa, Mycobacterium avium
ATPADLRAAPDTAGRPAEGTE

SEQ ID NO: 7551 - protein, 6 aa, Mycobacterium avium
ATPAGT

SEQ ID NO: 7552 - protein, 19 aa, Mycobacterium avium
ATPGVVSATESGRSPSGLT

SEQ ID NO: 7553 - protein, 7 aa, Mycobacterium avium
ATPLRDD

SEQ ID NO: 7554 - protein, 10 aa, Mycobacterium avium
ATPPSNVPAI

SEQ ID NO: 7555 - protein, 8 aa, Mycobacterium avium
ATPRGVGG

SEQ ID NO: 7556 - protein, 10 aa, Mycobacterium avium
ATPSGTGPWP

SEQ ID NO: 7557 - protein, 28 aa, Mycobacterium avium
ATQAAQTGAPPADQVSADGSARGQFNDD

SEQ ID NO: 7558 - protein, 28 aa, Mycobacterium avium
ATQAAQTGAPPSDQVSADGSARGQFNDD

SEQ ID NO: 7559 - protein, 6 aa, Mycobacterium avium
ATQNST

SEQ ID NO: 7560 - protein, 12 aa, Mycobacterium avium
ATRDTKSGHAAK

SEQ ID NO: 7561 - protein, 9 aa, Mycobacterium avium
ATRQTGGVA

SEQ ID NO: 7562 - protein, 11 aa, Mycobacterium avium
ATRQTGGVAVT

SEQ ID NO: 7563 - protein, 5 aa, Mycobacterium avium
ATSAA

SEQ ID NO: 7564 - protein, 10 aa, Mycobacterium avium
ATSGAPPGAA

SEQ ID NO: 7565 - protein, 8 aa, Mycobacterium avium
ATSGGGSL

SEQ ID NO: 7566 - protein, 12 aa, Mycobacterium avium
ATSHDVDPDGAV

SEQ ID NO: 7567 - protein, 17 aa, Mycobacterium avium
ATSHGALGQAPRVIVLT

SEQ ID NO: 7568 - protein, 17 aa, Mycobacterium avium
ATSHGALGQAPSVIVLT

SEQ ID NO: 7569 - protein, 9 aa, Mycobacterium avium
ATSLASGGR

SEQ ID NO: 7570 - protein, 10 aa, Mycobacterium avium
ATSSVDTRTE

SEQ ID NO: 7571 - protein, 4 aa, Mycobacterium avium
ATVA

SEQ ID NO: 7572 - protein, 6 aa, Mycobacterium avium
ATVEED

SEQ ID NO: 7573 - protein, 14 aa, Mycobacterium avium
ATVGPRAAHPGAQL

SEQ ID NO: 7574 - protein, 11 aa, Mycobacterium avium
ATVPEGSPAEI

SEQ ID NO: 7575 - protein, 19 aa, Mycobacterium avium
AVAQDAAALPPGGQPVRGV

SEQ ID NO: 7576 - protein, 14 aa, Mycobacterium avium
AVASTPQAEPAPQI

SEQ ID NO: 7577 - protein, 14 aa, Mycobacterium avium
AVASTPQAGPAPQI

SEQ ID NO: 7578 - protein, 28 aa, Mycobacterium avium
AVDASAQDGAVPVPAGPEGVNGEFDTPI

SEQ ID NO: 7579 - protein, 11 aa, Mycobacterium avium
AVDGAQTPAAP

SEQ ID NO: 7580 - protein, 13 aa, Mycobacterium avium
AVDQTGPAAAQQR

SEQ ID NO: 7581 - protein, 20 aa, Mycobacterium avium
AVESPKPKPQLPSDSATLRE

SEQ ID NO: 7582 - protein, 6 aa, Mycobacterium avium
AVGAGT

SEQ ID NO: 7583 - protein, 16 aa, Mycobacterium avium
AVGDSHPRRDLDSPTV

SEQ ID NO: 7584 - protein, 17 aa, Mycobacterium avium
AVGRPEPVEDKQPIPRA

SEQ ID NO: 7585 - protein, 8 aa, Mycobacterium avium
AVHESSSR

SEQ ID NO: 7586 - protein, 19 aa, Mycobacterium avium
AVKGEPRNRGYPQPNSRGR

SEQ ID NO: 7587 - protein, 8 aa, Mycobacterium avium
AVPAGGAE

SEQ ID NO: 7588 - protein, 8 aa, Mycobacterium avium
AVPAGGGE

SEQ ID NO: 7589 - protein, 23 aa, Mycobacterium avium
AVPAGTAAAPVPGTPAGDEATGW

SEQ ID NO: 7590 - protein, 23 aa, Mycobacterium avium
AVPAGTAAAPVPGTPGGDEATGW

SEQ ID NO: 7591 - protein, 7 aa, Mycobacterium avium
AVPAPNH

SEQ ID NO: 7592 - protein, 16 aa, Mycobacterium avium
AVPGSRRQWERDPHDP

SEQ ID NO: 7593 - protein, 24 aa, Mycobacterium avium
AVPPASPAMPTGPATGRPPGLTPG

SEQ ID NO: 7594 - protein, 8 aa, Mycobacterium avium
AVPPPSTV

SEQ ID NO: 7595 - protein, 10 aa, Mycobacterium avium
AVPPTTPAPT

SEQ ID NO: 7596 - protein, 11 aa, Mycobacterium avium
AVPPTTPAPTI

SEQ ID NO: 7597 - protein, 10 aa, Mycobacterium avium
AVPRGPSRLG

SEQ ID NO: 7598 - protein, 10 aa, Mycobacterium avium
AVREEAPVTQ

SEQ ID NO: 7599 - protein, 28 aa, Mycobacterium avium
AVSAPGGTFTGGTRVGPPAGATGLGDGS

SEQ ID NO: 7600 - protein, 27 aa, Mycobacterium avium
AVSAPGGTFTGGTRVGPPAGATGLGDS

SEQ ID NO: 7601 - protein, 5 aa, Mycobacterium avium
AVSTQ

SEQ ID NO: 7602 - protein, 12 aa, Mycobacterium avium
AVTEASEKAPMS

SEQ ID NO: 7603 - protein, 5 aa, Mycobacterium avium
AVTGD

SEQ ID NO: 7604 - protein, 4 aa, Mycobacterium avium
AVYS

SEQ ID NO: 7605 - protein, 11 aa, Mycobacterium avium
AWPPSARARPR

SEQ ID NO: 7606 - protein, 20 aa, Mycobacterium avium
AWTGQPEPLAPSASAETSVR

SEQ ID NO: 7607 - protein, 11 aa, Mycobacterium avium
AWTSPSAAAAQ

SEQ ID NO: 7608 - protein, 14 aa, Mycobacterium avium
AYGSYGVTNNPTGL

SEQ ID NO: 7609 - protein, 5 aa, Mycobacterium avium
AYSPR

SEQ ID NO: 7610 - protein, 15 aa, Mycobacterium avium
AYTGGPALADGASIG

SEQ ID NO: 7611 - protein, 6 aa, Mycobacterium avium
AYTNAG

SEQ ID NO: 7612 - protein, 7 aa, Mycobacterium avium
AYTNAGE

SEQ ID NO: 7613 - protein, 16 aa, Mycobacterium avium
CAADGSVVDAGRAVAG

SEQ ID NO: 7614 - protein, 17 aa, Mycobacterium avium
CAAPGPTSNSPVGVGTS

SEQ ID NO: 7615 - protein, 14 aa, Mycobacterium avium
CAGPGDARGADRMS

SEQ ID NO: 7616 - protein, 6 aa, Mycobacterium avium
CAPPVP

SEQ ID NO: 7617 - protein, 9 aa, Mycobacterium avium
CEPPRPRSE

SEQ ID NO: 7618 - protein, 11 aa, Mycobacterium avium
CETRPGKRAPT

SEQ ID NO: 7619 - protein, 17 aa, Mycobacterium avium
CGPDTPRACPDGTRFDD

SEQ ID NO: 7620 - protein, 17 aa, Mycobacterium avium
CGPDTPRSCPDGTLFDD

SEQ ID NO: 7621 - protein, 39 aa, Mycobacterium avium
CGPSAGCRPAPGRSARATTTSPSRSPRATRSVNSPPLST

SEQ ID NO: 7622 - protein, 15 aa, Mycobacterium avium
CIPGPNGTTVPKDGS

SEQ ID NO: 7623 - protein, 10 aa, Mycobacterium avium
CNRPGEPSKV

SEQ ID NO: 7624 - protein, 5 aa, Mycobacterium avium
CSHGK

SEQ ID NO: 7625 - protein, 16 aa, Mycobacterium avium
CTRPGGPAGATQQETI

SEQ ID NO: 7626 - protein, 31 aa, Mycobacterium avium
CTSSGCAATGTRLDDATHQAAGGPDGDQTDT

SEQ ID NO: 7627 - protein, 19 aa, Mycobacterium avium
DAADSVAAPPEPAAGRRMT

SEQ ID NO: 7628 - protein, 19 aa, Mycobacterium avium
DAADSVAAPPEPAAGRRVT

SEQ ID NO: 7629 - protein, 12 aa, Mycobacterium avium
DAAGGDWPARAR

SEQ ID NO: 7630 - protein, 7 aa, Mycobacterium avium
DAAPVTQ

SEQ ID NO: 7631 - protein, 36 aa, Mycobacterium avium
DAARAARDRAQAAAQPGAAPAQPLTPSQDGKAAPGV

SEQ ID NO: 7632 - protein, 7 aa, Mycobacterium avium
DADFGAR

SEQ ID NO: 7633 - protein, 11 aa, Mycobacterium avium
DADSSCSATRA

SEQ ID NO: 7634 - protein, 17 aa, Mycobacterium avium
DADYDDAEEAAPAKLSR

SEQ ID NO: 7635 - protein, 17 aa, Mycobacterium avium
DADYDDGEEAAPAKLSR

SEQ ID NO: 7636 - protein, 43 aa, Mycobacterium avium
DAGATFTAPAAPATATARAAARPEPRADATATAAVPPANPAPM

SEQ ID NO: 7637 - protein, 44 aa, Mycobacterium avium
DAGATFTAPAAPATATARAAARPEPREDVTATAAVPPANPAPME

SEQ ID NO: 7638 - protein, 45 aa, Mycobacterium avium
DAGATFTAPAAPATATARAAARPEPREDVTATAAVPPANPAPMEA

SEQ ID NO: 7639 - protein, 8 aa, Mycobacterium avium
DAGIDPRT

SEQ ID NO: 7640 - protein, 9 aa, Mycobacterium avium
DAGRSRAHR

SEQ ID NO: 7641 - protein, 5 aa, Mycobacterium avium
DAGSL

SEQ ID NO: 7642 - protein, 6 aa, Mycobacterium avium
DAHRRR

SEQ ID NO: 7643 - protein, 14 aa, Mycobacterium avium
DALDPGSGPARGGR

SEQ ID NO: 7644 - protein, 13 aa, Mycobacterium avium
DALGSSAKSVQGA

SEQ ID NO: 7645 - protein, 14 aa, Mycobacterium avium
DALPATGAAEGGFN

SEQ ID NO: 7646 - protein, 10 aa, Mycobacterium avium
DANPKVAGDM

SEQ ID NO: 7647 - protein, 10 aa, Mycobacterium avium
DAPPARRRRR

SEQ ID NO: 7648 - protein, 16 aa, Mycobacterium avium
DAPRAPMMPATWDGSK

SEQ ID NO: 7649 - protein, 6 aa, Mycobacterium avium
DAPRHD

SEQ ID NO: 7650 - protein, 7 aa, Mycobacterium avium
DAPRSRG

SEQ ID NO: 7651 - protein, 12 aa, Mycobacterium avium
DAQPTAAITAAA

SEQ ID NO: 7652 - protein, 6 aa, Mycobacterium avium
DARTEE

SEQ ID NO: 7653 - protein, 24 aa, Mycobacterium avium
DASVDDAAEPDAEDPAPAKKLRSP

SEQ ID NO: 7654 - protein, 15 aa, Mycobacterium avium
DATAAQIEQAAREAQ

SEQ ID NO: 7655 - protein, 8 aa, Mycobacterium avium
DATARPDV

SEQ ID NO: 7656 - protein, 8 aa, Mycobacterium avium
DATARPGV

SEQ ID NO: 7657 - protein, 4 aa, Mycobacterium avium
DATE

SEQ ID NO: 7658 - protein, 5 aa, Mycobacterium avium
DATGI

SEQ ID NO: 7659 - protein, 7 aa, Mycobacterium avium
DATPELR

SEQ ID NO: 7660 - protein, 8 aa, Mycobacterium avium
DATPELRG

SEQ ID NO: 7661 - protein, 13 aa, Mycobacterium avium
DAVGSRAKSVQGA

SEQ ID NO: 7662 - protein, 25 aa, Mycobacterium avium
DDAAAQPEPEPAAWAPDDDAQAALQ

SEQ ID NO: 7663 - protein, 13 aa, Mycobacterium avium
DDAATPGPPATGR

SEQ ID NO: 7664 - protein, 7 aa, Mycobacterium avium
DDADNAA

SEQ ID NO: 7665 - protein, 8 aa, Mycobacterium avium
DDAIPAAE

SEQ ID NO: 7666 - protein, 4 aa, Mycobacterium avium
DDAP

SEQ ID NO: 7667 - protein, 8 aa, Mycobacterium avium
DDARRDGD

SEQ ID NO: 7668 - protein, 5 aa, Mycobacterium avium
DDDMR

SEQ ID NO: 7669 - protein, 7 aa, Mycobacterium avium
DDDPATV

SEQ ID NO: 7670 - protein, 7 aa, Mycobacterium avium
DDEAGPR

SEQ ID NO: 7671 - protein, 10 aa, Mycobacterium avium
DDEETTRRAR

SEQ ID NO: 7672 - protein, 94 aa, Mycobacterium avium
DDEPDDQPGATDTVDTAAPAQPVAESAEPVAEDEPKTPYWSEPEPRWPKSPPQPKRAPGPERSAYPRPLPEPGPSANGTGRRSSGAEDMSPDPM

SEQ ID NO: 7673 - protein, 6 aa, Mycobacterium avium
DDFDQA

SEQ ID NO: 7674 - protein, 6 aa, Mycobacterium avium
DDGGAA

SEQ ID NO: 7675 - protein, 11 aa, Mycobacterium avium
DDGMPETPAQR

SEQ ID NO: 7676 - protein, 4 aa, Mycobacterium avium
DDGR

SEQ ID NO: 7677 - protein, 11 aa, Mycobacterium avium
DDGSGIPESER

SEQ ID NO: 7678 - protein, 11 aa, Mycobacterium avium
DDLPRGGTGKV

SEQ ID NO: 7679 - protein, 11 aa, Mycobacterium avium
DDLTRPSGAPV

SEQ ID NO: 7680 - protein, 12 aa, Mycobacterium avium
DDLTRPSGAPVS

SEQ ID NO: 7681 - protein, 15 aa, Mycobacterium avium
DDQKFTPKDMPANAA

SEQ ID NO: 7682 - protein, 8 aa, Mycobacterium avium
DDQRAGAH

SEQ ID NO: 7683 - protein, 6 aa, Mycobacterium avium
DDQYDH

SEQ ID NO: 7684 - protein, 5 aa, Mycobacterium avium
DDRGV

SEQ ID NO: 7685 - protein, 8 aa, Mycobacterium avium
DDRPINSA

SEQ ID NO: 7686 - protein, 16 aa, Mycobacterium avium
DDRQGQPATTASNQGY

SEQ ID NO: 7687 - protein, 25 aa, Mycobacterium avium
DDRTRAAASGPICPDPSAHRADRVA

SEQ ID NO: 7688 - protein, 35 aa, Mycobacterium avium
DDSSGLEEPAAEGDEADEEAPAPMPRNASRRRRFD

SEQ ID NO: 7689 - protein, 12 aa, Mycobacterium avium
DDYTPEEFAPGE

SEQ ID NO: 7690 - protein, 6 aa, Mycobacterium avium
DEAEYA

SEQ ID NO: 7691 - protein, 29 aa, Mycobacterium avium
DEAPYAAAKTPPHAPTGQPGGTEREYPDK

SEQ ID NO: 7692 - protein, 21 aa, Mycobacterium avium
DEATNAPPALMSSTEPTATTR

SEQ ID NO: 7693 - protein, 9 aa, Mycobacterium avium
DEGLTKDPA

SEQ ID NO: 7694 - protein, 6 aa, Mycobacterium avium
DELAAR

SEQ ID NO: 7695 - protein, 11 aa, Mycobacterium avium
DELGDSGQARD

SEQ ID NO: 7696 - protein, 8 aa, Mycobacterium avium
DEPAPDLP

SEQ ID NO: 7697 - protein, 6 aa, Mycobacterium avium
DEPDVQ

SEQ ID NO: 7698 - protein, 4 aa, Mycobacterium avium
DERG

SEQ ID NO: 7699 - protein, 11 aa, Mycobacterium avium
DESAITGESAP

SEQ ID NO: 7700 - protein, 13 aa, Mycobacterium avium
DETADATFTSTRP

SEQ ID NO: 7701 - protein, 11 aa, Mycobacterium avium
DETASRRYGAD

SEQ ID NO: 7702 - protein, 16 aa, Mycobacterium avium
DETDETADATFTSTRP

SEQ ID NO: 7703 - protein, 19 aa, Mycobacterium avium
DETVAGASHGAGGDETEVV

SEQ ID NO: 7704 - protein, 18 aa, Mycobacterium avium
DETYTGEVSTQKFSGGQV

SEQ ID NO: 7705 - protein, 7 aa, Mycobacterium avium
DFDGRTG

SEQ ID NO: 7706 - protein, 6 aa, Mycobacterium avium
DFPDGP

SEQ ID NO: 7707 - protein, 6 aa, Mycobacterium avium
DFPSGG

SEQ ID NO: 7708 - protein, 6 aa, Mycobacterium avium
DGAAGT

SEQ ID NO: 7709 - protein, 12 aa, Mycobacterium avium
DGADGGPARRNP

SEQ ID NO: 7710 - protein, 8 aa, Mycobacterium avium
DGAGARIQ

SEQ ID NO: 7711 - protein, 12 aa, Mycobacterium avium
DGAGKPPRATRP

SEQ ID NO: 7712 - protein, 7 aa, Mycobacterium avium
DGARKRV

SEQ ID NO: 7713 - protein, 10 aa, Mycobacterium avium
DGAVLGPADL

SEQ ID NO: 7714 - protein, 6 aa, Mycobacterium avium
DGEGGG

SEQ ID NO: 7715 - protein, 16 aa, Mycobacterium avium
DGGERTANITLAEGPP

SEQ ID NO: 7716 - protein, 8 aa, Mycobacterium avium
DGGQPTID

SEQ ID NO: 7717 - protein, 8 aa, Mycobacterium avium
DGKARAGV

SEQ ID NO: 7718 - protein, 8 aa, Mycobacterium avium
DGPLPPRR

SEQ ID NO: 7719 - protein, 7 aa, Mycobacterium avium
DGPRRFR

SEQ ID NO: 7720 - protein, 7 aa, Mycobacterium avium
DGQAYGD

SEQ ID NO: 7721 - protein, 55 aa, Mycobacterium avium
DGQAYGDRAISPDLAEGPVEPPPPYPPPLPPPAYPPPYPPPYPPPPGPPPDTTAT

SEQ ID NO: 7722 - protein, 11 aa, Mycobacterium avium
DGSEAAQLPGA

SEQ ID NO: 7723 - protein, 12 aa, Mycobacterium avium
DGSIDKTSTVAT

SEQ ID NO: 7724 - protein, 8 aa, Mycobacterium avium
DHPPSARC

SEQ ID NO: 7725 - protein, 6 aa, Mycobacterium avium
DISPEA

SEQ ID NO: 7726 - protein, 7 aa, Mycobacterium avium
DKAAPTI

SEQ ID NO: 7727 - protein, 5 aa, Mycobacterium avium
DKPQT

SEQ ID NO: 7728 - protein, 6 aa, Mycobacterium avium
DKPYVP

SEQ ID NO: 7729 - protein, 17 aa, Mycobacterium avium
DKTRSAAEEALKNTPLE

SEQ ID NO: 7730 - protein, 9 aa, Mycobacterium avium
DKVSGAAGA

SEQ ID NO: 7731 - protein, 7 aa, Mycobacterium avium
DLASHGP

SEQ ID NO: 7732 - protein, 9 aa, Mycobacterium avium
DLDGSKRGP

SEQ ID NO: 7733 - protein, 10 aa, Mycobacterium avium
DLDGSKRGPL

SEQ ID NO: 7734 - protein, 6 aa, Mycobacterium avium
DLEGPD

SEQ ID NO: 7735 - protein, 6 aa, Mycobacterium avium
DLENPD

SEQ ID NO: 7736 - protein, 7 aa, Mycobacterium avium
DLGSSST

SEQ ID NO: 7737 - protein, 6 aa, Mycobacterium avium
DLPGDT

SEQ ID NO: 7738 - protein, 6 aa, Mycobacterium avium
DLPPEG

SEQ ID NO: 7739 - protein, 20 aa, Mycobacterium avium
DLPPGPGQGPMTGPPNPTQW

SEQ ID NO: 7740 - protein, 7 aa, Mycobacterium avium
DLPTGEV

SEQ ID NO: 7741 - protein, 4 aa, Mycobacterium avium
DLRR

SEQ ID NO: 7742 - protein, 4 aa, Mycobacterium avium
DLRS

SEQ ID NO: 7743 - protein, 20 aa, Mycobacterium avium
DLSAGDAQGSSETSVDTAPR

SEQ ID NO: 7744 - protein, 24 aa, Mycobacterium avium
DLSAGDAQGSSETSVDTAPRRVSP

SEQ ID NO: 7745 - protein, 8 aa, Mycobacterium avium
DLTNEYGP

SEQ ID NO: 7746 - protein, 16 aa, Mycobacterium avium
DLTTDTAGTNTTALNQ

SEQ ID NO: 7747 - protein, 7 aa, Mycobacterium avium
DMPDDRD

SEQ ID NO: 7748 - protein, 5 aa, Mycobacterium avium
DNDAK

SEQ ID NO: 7749 - protein, 10 aa, Mycobacterium avium
DNESKLGPTL

SEQ ID NO: 7750 - protein, 6 aa, Mycobacterium avium
DNGISD

SEQ ID NO: 7751 - protein, 9 aa, Mycobacterium avium
DNGKELPQG

SEQ ID NO: 7752 - protein, 13 aa, Mycobacterium avium
DNPVRDRGRTQME

SEQ ID NO: 7753 - protein, 8 aa, Mycobacterium avium
DNRADDSV

SEQ ID NO: 7754 - protein, 9 aa, Mycobacterium avium
DPADINAGR

SEQ ID NO: 7755 - protein, 7 aa, Mycobacterium avium
DPAGGTG

SEQ ID NO: 7756 - protein, 9 aa, Mycobacterium avium
DPAKGTVNG

SEQ ID NO: 7757 - protein, 5 aa, Mycobacterium avium
DPAQD

SEQ ID NO: 7758 - protein, 8 aa, Mycobacterium avium
DPDATRKT

SEQ ID NO: 7759 - protein, 21 aa, Mycobacterium avium
DPDWGGPAGPESSASDRGAGA

SEQ ID NO: 7760 - protein, 9 aa, Mycobacterium avium
DPEPGDDEL

SEQ ID NO: 7761 - protein, 14 aa, Mycobacterium avium
DPEPSTTASQLGAP

SEQ ID NO: 7762 - protein, 71 aa, Mycobacterium avium
DPGHSAPRPPNPPAAPPVPPGRPTAPDPTVPTQSATQRMPAAAPPPVPPPPPPVPPPAPPAPAPEPPKGPG

SEQ ID NO: 7763 - protein, 5 aa, Mycobacterium avium
DPGKV

SEQ ID NO: 7764 - protein, 5 aa, Mycobacterium avium
DPHDG

SEQ ID NO: 7765 - protein, 7 aa, Mycobacterium avium
DPHDPAS

SEQ ID NO: 7766 - protein, 4 aa, Mycobacterium avium
DPPA

SEQ ID NO: 7767 - protein, 9 aa, Mycobacterium avium
DPPSDESFL

SEQ ID NO: 7768 - protein, 12 aa, Mycobacterium avium
DPPVTASVGTAT

SEQ ID NO: 7769 - protein, 8 aa, Mycobacterium avium
DPQATDDD

SEQ ID NO: 7770 - protein, 8 aa, Mycobacterium avium
DPQPPTGA

SEQ ID NO: 7771 - protein, 15 aa, Mycobacterium avium
DPQQPARQAGRRRPG

SEQ ID NO: 7772 - protein, 6 aa, Mycobacterium avium
DPRHGP

SEQ ID NO: 7773 - protein, 4 aa, Mycobacterium avium
DPRV

SEQ ID NO: 7774 - protein, 6 aa, Mycobacterium avium
DPRVPP

SEQ ID NO: 7775 - protein, 10 aa, Mycobacterium avium
DPSSTEATPE

SEQ ID NO: 7776 - protein, 6 aa, Mycobacterium avium
DPTEEP

SEQ ID NO: 7777 - protein, 15 aa, Mycobacterium avium
DPTYADPAQSMLPPS

SEQ ID NO: 7778 - protein, 6 aa, Mycobacterium avium
DPVEGS

SEQ ID NO: 7779 - protein, 12 aa, Mycobacterium avium
DPYQAPEGYPIK

SEQ ID NO: 7780 - protein, 15 aa, Mycobacterium avium
DQARGLGDAAEHTPE

SEQ ID NO: 7781 - protein, 4 aa, Mycobacterium avium
DQAV

SEQ ID NO: 7782 - protein, 7 aa, Mycobacterium avium
DQGTTAS

SEQ ID NO: 7783 - protein, 7 aa, Mycobacterium avium
DQLGADE

SEQ ID NO: 7784 - protein, 7 aa, Mycobacterium avium
DQRGYRP

SEQ ID NO: 7785 - protein, 19 aa, Mycobacterium avium
DQRLDERASRTADSAPAVV

SEQ ID NO: 7786 - protein, 8 aa, Mycobacterium avium
DQRPEVGT

SEQ ID NO: 7787 - protein, 9 aa, Mycobacterium avium
DQRVGDAAA

SEQ ID NO: 7788 - protein, 17 aa, Mycobacterium avium
DRAADQTRAQIATQGPK

SEQ ID NO: 7789 - protein, 8 aa, Mycobacterium avium
DRAPDSVA

SEQ ID NO: 7790 - protein, 15 aa, Mycobacterium avium
DRASRPSTMAKVVDH

SEQ ID NO: 7791 - protein, 4 aa, Mycobacterium avium
DRDG

SEQ ID NO: 7792 - protein, 5 aa, Mycobacterium avium
DRDGE

SEQ ID NO: 7793 - protein, 5 aa, Mycobacterium avium
DRDGT

SEQ ID NO: 7794 - protein, 7 aa, Mycobacterium avium
DRDPIGD

SEQ ID NO: 7795 - protein, 38 aa, Mycobacterium avium
DREHRDADTPAALAGPRQRADLPPCPAAGTGPGPAALR

SEQ ID NO: 7796 - protein, 6 aa, Mycobacterium avium
DRGAQR

SEQ ID NO: 7797 - protein, 5 aa, Mycobacterium avium
DRGAV

SEQ ID NO: 7798 - protein, 4 aa, Mycobacterium avium
DRGC

SEQ ID NO: 7799 - protein, 13 aa, Mycobacterium avium
DRGGIPADPAERI

SEQ ID NO: 7800 - protein, 5 aa, Mycobacterium avium
DRGRR

SEQ ID NO: 7801 - protein, 45 aa, Mycobacterium avium
DRKRTGPQPAPKSAPKSRPAPRKGAKPAGRKPTRNAGRNATRNAG

SEQ ID NO: 7802 - protein, 28 aa, Mycobacterium avium
DRNAEPALPADNDVGPNPTTLPSVNGSD

SEQ ID NO: 7803 - protein, 9 aa, Mycobacterium avium
DRNHDDPRL

SEQ ID NO: 7804 - protein, 10 aa, Mycobacterium avium
DRQAAPPPWS

SEQ ID NO: 7805 - protein, 10 aa, Mycobacterium avium
DRRATDPADA

SEQ ID NO: 7806 - protein, 8 aa, Mycobacterium avium
DRRPPSRR

SEQ ID NO: 7807 - protein, 12 aa, Mycobacterium avium
DRTADDDRANAL

SEQ ID NO: 7808 - protein, 7 aa, Mycobacterium avium
DRTGPIG

SEQ ID NO: 7809 - protein, 8 aa, Mycobacterium avium
DRTGPKGN

SEQ ID NO: 7810 - protein, 4 aa, Mycobacterium avium
DRTQ

SEQ ID NO: 7811 - protein, 6 aa, Mycobacterium avium
DRVRPG

SEQ ID NO: 7812 - protein, 4 aa, Mycobacterium avium
DSAM

SEQ ID NO: 7813 - protein, 8 aa, Mycobacterium avium
DSASGLYE

SEQ ID NO: 7814 - protein, 8 aa, Mycobacterium avium
DSGAHSAA

SEQ ID NO: 7815 - protein, 31 aa, Mycobacterium avium
DSGPTGSFAGGTSCESNPLTDLSRPSDPRNW

SEQ ID NO: 7816 - protein, 7 aa, Mycobacterium avium
DSKSALP

SEQ ID NO: 7817 - protein, 6 aa, Mycobacterium avium
DSLRAE

SEQ ID NO: 7818 - protein, 8 aa, Mycobacterium avium
DSNKVDEN

SEQ ID NO: 7819 - protein, 5 aa, Mycobacterium avium
DSNSA

SEQ ID NO: 7820 - protein, 16 aa, Mycobacterium avium
DSQSVGAVPSGHTGGT

SEQ ID NO: 7821 - protein, 7 aa, Mycobacterium avium
DSRSPDI

SEQ ID NO: 7822 - protein, 6 aa, Mycobacterium avium
DSRWRP

SEQ ID NO: 7823 - protein, 6 aa, Mycobacterium avium
DSSRHL

SEQ ID NO: 7824 - protein, 7 aa, Mycobacterium avium
DSTPEGF

SEQ ID NO: 7825 - protein, 13 aa, Mycobacterium avium
DSVAQGNDRRTDL

SEQ ID NO: 7826 - protein, 14 aa, Mycobacterium avium
DSVGADARSRLDEA

SEQ ID NO: 7827 - protein, 19 aa, Mycobacterium avium
DTAAETEPADDAAGDDVEN

SEQ ID NO: 7828 - protein, 20 aa, Mycobacterium avium
DTAAETEPADDAAGDDVENA

SEQ ID NO: 7829 - protein, 10 aa, Mycobacterium avium
DTDEGGMSDN

SEQ ID NO: 7830 - protein, 6 aa, Mycobacterium avium
DTGSPY

SEQ ID NO: 7831 - protein, 10 aa, Mycobacterium avium
DTGTSFGGMG

SEQ ID NO: 7832 - protein, 9 aa, Mycobacterium avium
DTHGHAAGD

SEQ ID NO: 7833 - protein, 7 aa, Mycobacterium avium
DTLPADQ

SEQ ID NO: 7834 - protein, 12 aa, Mycobacterium avium
DTPTSHRNTQPG

SEQ ID NO: 7835 - protein, 4 aa, Mycobacterium avium
DTRL

SEQ ID NO: 7836 - protein, 15 aa, Mycobacterium avium
DTRRGSIGPEARTRL

SEQ ID NO: 7837 - protein, 8 aa, Mycobacterium avium
DTSPKIPA

SEQ ID NO: 7838 - protein, 6 aa, Mycobacterium avium
DTTATT

SEQ ID NO: 7839 - protein, 8 aa, Mycobacterium avium
DTVSKGDC

SEQ ID NO: 7840 - protein, 8 aa, Mycobacterium avium
DTYADASP

SEQ ID NO: 7841 - protein, 10 aa, Mycobacterium avium
DVAERGGTRR

SEQ ID NO: 7842 - protein, 9 aa, Mycobacterium avium
DVRDDRDIA

SEQ ID NO: 7843 - protein, 15 aa, Mycobacterium avium
DYPAAEADYTDYTDA

SEQ ID NO: 7844 - protein, 27 aa, Mycobacterium avium
DYPNDGDSDQQSADAADTAAGEPRRRR

SEQ ID NO: 7845 - protein, 23 aa, Mycobacterium avium
EAAATPGAPPTPPPTIVGPETSF

SEQ ID NO: 7846 - protein, 15 aa, Mycobacterium avium
EAAATQDDRPQPPID

SEQ ID NO: 7847 - protein, 17 aa, Mycobacterium avium
EAADEEPRLAEPALGPV

SEQ ID NO: 7848 - protein, 13 aa, Mycobacterium avium
EADGAGPPDRPAR

SEQ ID NO: 7849 - protein, 8 aa, Mycobacterium avium
EADRTAGT

SEQ ID NO: 7850 - protein, 30 aa, Mycobacterium avium
EADTEPDERAAADIAPQPNSSLTSERGAGR

SEQ ID NO: 7851 - protein, 31 aa, Mycobacterium avium
EADTEPDERAAADIAPQPNSSLTSERGAGRL

SEQ ID NO: 7852 - protein, 44 aa, Mycobacterium avium
EAEAASRAITQAPQPRVECDPGPQQLPSSPPPNDAVEQDRSTPL

SEQ ID NO: 7853 - protein, 4 aa, Mycobacterium avium
EAEN

SEQ ID NO: 7854 - protein, 10 aa, Mycobacterium avium
EAGRTKAPVD

SEQ ID NO: 7855 - protein, 4 aa, Mycobacterium avium
EAGV

SEQ ID NO: 7856 - protein, 8 aa, Mycobacterium avium
EAHGNPNN

SEQ ID NO: 7857 - protein, 4 aa, Mycobacterium avium
EAND

SEQ ID NO: 7858 - protein, 21 aa, Mycobacterium avium
EAPGPAPLGGDAVPAKRPPAW

SEQ ID NO: 7859 - protein, 6 aa, Mycobacterium avium
EAPPEL

SEQ ID NO: 7860 - protein, 25 aa, Mycobacterium avium
EAPPLTAPGIPNAGAPAPFTAPAPI

SEQ ID NO: 7861 - protein, 18 aa, Mycobacterium avium
EAPSTTAAPARRIPGESG

SEQ ID NO: 7862 - protein, 15 aa, Mycobacterium avium
EAQAGSWEGESAAQY

SEQ ID NO: 7863 - protein, 6 aa, Mycobacterium avium
EARAGD

SEQ ID NO: 7864 - protein, 11 aa, Mycobacterium avium
EAREAGEDRAT

SEQ ID NO: 7865 - protein, 7 aa, Mycobacterium avium
EARGDTH

SEQ ID NO: 7866 - protein, 11 aa, Mycobacterium avium
EARGVGEDREK

SEQ ID NO: 7867 - protein, 12 aa, Mycobacterium avium
EARQAGESREEA

SEQ ID NO: 7868 - protein, 5 aa, Mycobacterium avium
EARTT

SEQ ID NO: 7869 - protein, 6 aa, Mycobacterium avium
EATHAG

SEQ ID NO: 7870 - protein, 5 aa, Mycobacterium avium
EATQT

SEQ ID NO: 7871 - protein, 6 aa, Mycobacterium avium
EAVRQQ

SEQ ID NO: 7872 - protein, 19 aa, Mycobacterium avium
EAVSGGRFGRATDGAAGRL

SEQ ID NO: 7873 - protein, 7 aa, Mycobacterium avium
EAYPDTF

SEQ ID NO: 7874 - protein, 5 aa, Mycobacterium avium
ECGAQ

SEQ ID NO: 7875 - protein, 25 aa, Mycobacterium avium
ECRAGGAPGSAAGQAPETAERETNF

SEQ ID NO: 7876 - protein, 28 aa, Mycobacterium avium
ECRAGGMPETAERAAGGAPETAERETNF

SEQ ID NO: 7877 - protein, 12 aa, Mycobacterium avium
ECTTSEHGREIS

SEQ ID NO: 7878 - protein, 7 aa, Mycobacterium avium
EDADTRV

SEQ ID NO: 7879 - protein, 8 aa, Mycobacterium avium
EDAGQVPS

SEQ ID NO: 7880 - protein, 16 aa, Mycobacterium avium
EDEAGLEPAPAAGRSW

SEQ ID NO: 7881 - protein, 12 aa, Mycobacterium avium
EDETPGDTERRR

SEQ ID NO: 7882 - protein, 7 aa, Mycobacterium avium
EDGTVDE

SEQ ID NO: 7883 - protein, 4 aa, Mycobacterium avium
EDLN

SEQ ID NO: 7884 - protein, 6 aa, Mycobacterium avium
EDPGAV

SEQ ID NO: 7885 - protein, 35 aa, Mycobacterium avium
EDPGPSAPPPVPPPPPPAPPPAPPAPAPEPPKGPG

SEQ ID NO: 7886 - protein, 22 aa, Mycobacterium avium
EDPKFASSVRGGRFRAPTARRR

SEQ ID NO: 7887 - protein, 4 aa, Mycobacterium avium
EDRT

SEQ ID NO: 7888 - protein, 5 aa, Mycobacterium avium
EDSEP

SEQ ID NO: 7889 - protein, 4 aa, Mycobacterium avium
EDSG

SEQ ID NO: 7890 - protein, 4 aa, Mycobacterium avium
EDSR

SEQ ID NO: 7891 - protein, 14 aa, Mycobacterium avium
EEEPPRPRDTAAVT

SEQ ID NO: 7892 - protein, 6 aa, Mycobacterium avium
EELSSG

SEQ ID NO: 7893 - protein, 8 aa, Mycobacterium avium
EENPNLQR

SEQ ID NO: 7894 - protein, 15 aa, Mycobacterium avium
EEPEPAPQQPETKRR

SEQ ID NO: 7895 - protein, 8 aa, Mycobacterium avium
EESDGDRL

SEQ ID NO: 7896 - protein, 17 aa, Mycobacterium avium
EESKRGFRASSLAPRER

SEQ ID NO: 7897 - protein, 4 aa, Mycobacterium avium
EETE

SEQ ID NO: 7898 - protein, 5 aa, Mycobacterium avium
EEVPP

SEQ ID NO: 7899 - protein, 6 aa, Mycobacterium avium
EEVPPV

SEQ ID NO: 7900 - protein, 6 aa, Mycobacterium avium
EGAGNI

SEQ ID NO: 7901 - protein, 14 aa, Mycobacterium avium
EGARRGVGSPAVVA

SEQ ID NO: 7902 - protein, 13 aa, Mycobacterium avium
EGEPEAVDAGDDM

SEQ ID NO: 7903 - protein, 4 aa, Mycobacterium avium
EGGP

SEQ ID NO: 7904 - protein, 10 aa, Mycobacterium avium
EGGPAAAEAR

SEQ ID NO: 7905 - protein, 6 aa, Mycobacterium avium
EGHGVG

SEQ ID NO: 7906 - protein, 13 aa, Mycobacterium avium
EGPDNGLSLQGSA

SEQ ID NO: 7907 - protein, 14 aa, Mycobacterium avium
EGPDNGLSLQGSTG

SEQ ID NO: 7908 - protein, 5 aa, Mycobacterium avium
EGPRH

SEQ ID NO: 7909 - protein, 8 aa, Mycobacterium avium
EGQTGDTA

SEQ ID NO: 7910 - protein, 11 aa, Mycobacterium avium
EGTRSPDGRLY

SEQ ID NO: 7911 - protein, 9 aa, Mycobacterium avium
EGVAPPASV

SEQ ID NO: 7912 - protein, 8 aa, Mycobacterium avium
EHAARRAG

SEQ ID NO: 7913 - protein, 7 aa, Mycobacterium avium
EHADTRV

SEQ ID NO: 7914 - protein, 6 aa, Mycobacterium avium
EHGEGR

SEQ ID NO: 7915 - protein, 10 aa, Mycobacterium avium
EHPDSGGALA

SEQ ID NO: 7916 - protein, 15 aa, Mycobacterium avium
EHTGDVSAPLNVKSG

SEQ ID NO: 7917 - protein, 5 aa, Mycobacterium avium
EILSR

SEQ ID NO: 7918 - protein, 7 aa, Mycobacterium avium
EIPRPET

SEQ ID NO: 7919 - protein, 14 aa, Mycobacterium avium
EKPSAPTPQPRAAR

SEQ ID NO: 7920 - protein, 22 aa, Mycobacterium avium
EKSDAARQLDTAEGDDQDQGRV

SEQ ID NO: 7921 - protein, 22 aa, Mycobacterium avium
EKSDAATQLDTDEGDDQDQGRV

SEQ ID NO: 7922 - protein, 7 aa, Mycobacterium avium
EKVPDDE

SEQ ID NO: 7923 - protein, 4 aa, Mycobacterium avium
EKVT

SEQ ID NO: 7924 - protein, 4 aa, Mycobacterium avium
ELDG

SEQ ID NO: 7925 - protein, 8 aa, Mycobacterium avium
ELGASGGL

SEQ ID NO: 7926 - protein, 34 aa, Mycobacterium avium
ELGEPGIQPGGSPAEDAGGAKTEKPASRSEDGDR

SEQ ID NO: 7927 - protein, 24 aa, Mycobacterium avium
ELGHPADGSVDQVPELRESRSAVY

SEQ ID NO: 7928 - protein, 31 aa, Mycobacterium avium
ELGLNGPSSSTSAPQTTTSAAAGSVVKPTRA

SEQ ID NO: 7929 - protein, 7 aa, Mycobacterium avium
ELGLPDE

SEQ ID NO: 7930 - protein, 6 aa, Mycobacterium avium
ELHGGS

SEQ ID NO: 7931 - protein, 4 aa, Mycobacterium avium
ELPE

SEQ ID NO: 7932 - protein, 8 aa, Mycobacterium avium
ELQRTGGL

SEQ ID NO: 7933 - protein, 12 aa, Mycobacterium avium
ELTGDSTLSRQT

SEQ ID NO: 7934 - protein, 5 aa, Mycobacterium avium
ELTPR

SEQ ID NO: 7935 - protein, 17 aa, Mycobacterium avium
EMPGQPAGGGEDSAGPV

SEQ ID NO: 7936 - protein, 8 aa, Mycobacterium avium
ENHRNSRY

SEQ ID NO: 7937 - protein, 5 aa, Mycobacterium avium
ENVYP

SEQ ID NO: 7938 - protein, 9 aa, Mycobacterium avium
EPAGLPARL

SEQ ID NO: 7939 - protein, 16 aa, Mycobacterium avium
EPAPGGPVPARSGPEA

SEQ ID NO: 7940 - protein, 28 aa, Mycobacterium avium
EPEEPPDAPPEEKPAAPGPAGRDAGGVG

SEQ ID NO: 7941 - protein, 30 aa, Mycobacterium avium
EPEEPPDAPPEEKPTAPGPAGRDAGGGGRV

SEQ ID NO: 7942 - protein, 26 aa, Mycobacterium avium
EPEEPPEEKPAAPGPAGRDAGGSGRV

SEQ ID NO: 7943 - protein, 36 aa, Mycobacterium avium
EPEPEAQQRAGQPRRPQPAPAPPADVRRRDPVESRR

SEQ ID NO: 7944 - protein, 20 aa, Mycobacterium avium
EPERKGRSGRKTGAGAPRPK

SEQ ID NO: 7945 - protein, 10 aa, Mycobacterium avium
EPETIAPQGG

SEQ ID NO: 7946 - protein, 13 aa, Mycobacterium avium
EPGAEPNAAPANC

SEQ ID NO: 7947 - protein, 11 aa, Mycobacterium avium
EPGERHERSAH

SEQ ID NO: 7948 - protein, 4 aa, Mycobacterium avium
EPGL

SEQ ID NO: 7949 - protein, 8 aa, Mycobacterium avium
EPNQAEMQ

SEQ ID NO: 7950 - protein, 6 aa, Mycobacterium avium
EPPAVA

SEQ ID NO: 7951 - protein, 5 aa, Mycobacterium avium
EPPGP

SEQ ID NO: 7952 - protein, 21 aa, Mycobacterium avium
EPSGPSAAKVRTRTVTARGAP

SEQ ID NO: 7953 - protein, 10 aa, Mycobacterium avium
EPTAGLNAAQ

SEQ ID NO: 7954 - protein, 11 aa, Mycobacterium avium
EPTAGLNAAQQ

SEQ ID NO: 7955 - protein, 6 aa, Mycobacterium avium
EPTRGR

SEQ ID NO: 7956 - protein, 9 aa, Mycobacterium avium
EPTSGLDPA

SEQ ID NO: 7957 - protein, 14 aa, Mycobacterium avium
EPTTGAVSDIEQAT

SEQ ID NO: 7958 - protein, 4 aa, Mycobacterium avium
EPYP

SEQ ID NO: 7959 - protein, 31 aa, Mycobacterium avium
EQAPAPPPVQASAPQPKISVPEPVAAPKPLS

SEQ ID NO: 7960 - protein, 35 aa, Mycobacterium avium
EQAPAPPPVQASAPQPKISVPEPVAAPKPLSPPVA

SEQ ID NO: 7961 - protein, 4 aa, Mycobacterium avium
EQGT

SEQ ID NO: 7962 - protein, 10 aa, Mycobacterium avium
EQRAVPGPGA

SEQ ID NO: 7963 - protein, 29 aa, Mycobacterium avium
EQTNPTRPTRRPVPPRRPARPPSTPPEER

SEQ ID NO: 7964 - protein, 14 aa, Mycobacterium avium
ERAENTGRAGELVS

SEQ ID NO: 7965 - protein, 5 aa, Mycobacterium avium
ERAQN

SEQ ID NO: 7966 - protein, 11 aa, Mycobacterium avium
ERDAEAHAAPL

SEQ ID NO: 7967 - protein, 8 aa, Mycobacterium avium
ERDSPTWS

SEQ ID NO: 7968 - protein, 18 aa, Mycobacterium avium
ERRAQQAAQAAQRAETAT

SEQ ID NO: 7969 - protein, 10 aa, Mycobacterium avium
ERRHRKQPPL

SEQ ID NO: 7970 - protein, 7 aa, Mycobacterium avium
ERSDAIA

SEQ ID NO: 7971 - protein, 5 aa, Mycobacterium avium
ERSDE

SEQ ID NO: 7972 - protein, 12 aa, Mycobacterium avium
ERSRTAESGKPL

SEQ ID NO: 7973 - protein, 10 aa, Mycobacterium avium
ERTDTSSGAG

SEQ ID NO: 7974 - protein, 6 aa, Mycobacterium avium
ERWSAN

SEQ ID NO: 7975 - protein, 13 aa, Mycobacterium avium
ESEDARAGGTKTQ

SEQ ID NO: 7976 - protein, 10 aa, Mycobacterium avium
ESFEPQYESL

SEQ ID NO: 7977 - protein, 5 aa, Mycobacterium avium
ESGAS

SEQ ID NO: 7978 - protein, 17 aa, Mycobacterium avium
ESGEPAGAGEVGEIQAR

SEQ ID NO: 7979 - protein, 22 aa, Mycobacterium avium
ESGVRSGLAPAERDSSGNPVEP

SEQ ID NO: 7980 - protein, 4 aa, Mycobacterium avium
ESNS

SEQ ID NO: 7981 - protein, 13 aa, Mycobacterium avium
ESPEGQASSLESI

SEQ ID NO: 7982 - protein, 7 aa, Mycobacterium avium
ESQRRQR

SEQ ID NO: 7983 - protein, 7 aa, Mycobacterium avium
ESVSSGP

SEQ ID NO: 7984 - protein, 25 aa, Mycobacterium avium
ESWAAPADPSAPSDSTASTTTTTTT

SEQ ID NO: 7985 - protein, 5 aa, Mycobacterium avium
ESYTS

SEQ ID NO: 7986 - protein, 8 aa, Mycobacterium avium
ETATGFTR

SEQ ID NO: 7987 - protein, 22 aa, Mycobacterium avium
ETSHDRRAAARARRERAELDAD

SEQ ID NO: 7988 - protein, 5 aa, Mycobacterium avium
EVAAK

SEQ ID NO: 7989 - protein, 6 aa, Mycobacterium avium
EVRPEA

SEQ ID NO: 7990 - protein, 10 aa, Mycobacterium avium
EVVNGNGEKI

SEQ ID NO: 7991 - protein, 5 aa, Mycobacterium avium
EYGIE

SEQ ID NO: 7992 - protein, 5 aa, Mycobacterium avium
EYPAA

SEQ ID NO: 7993 - protein, 18 aa, Mycobacterium avium
FANTSTTAYVTGPPATFA

SEQ ID NO: 7994 - protein, 30 aa, Mycobacterium avium
FDAASTPTPEVDAEDEVAKAEARAAAARER

SEQ ID NO: 7995 - protein, 30 aa, Mycobacterium avium
FDAASTPTPEVDAEDEVAKAEARAEAARER

SEQ ID NO: 7996 - protein, 5 aa, Mycobacterium avium
FDPEA

SEQ ID NO: 7997 - protein, 11 aa, Mycobacterium avium
FDPRRAGDRDR

SEQ ID NO: 7998 - protein, 37 aa, Mycobacterium avium
FEAGRDAAFADAGSHNAAANYEAANYDGGYDAGGDIG

SEQ ID NO: 7999 - protein, 47 aa, Mycobacterium avium
FEAGRDAAFADAGSHNAAANYEAANYEAANYDGANYDGGYDAGGDIG

SEQ ID NO: 8000 - protein, 46 aa, Mycobacterium avium
FEAGRDAAFADAGSHNAANYDAANYEAANYDGANYDGGYDAGGDIG

SEQ ID NO: 8001 - protein, 4 aa, Mycobacterium avium
FEPG

SEQ ID NO: 8002 - protein, 7 aa, Mycobacterium avium
FGAPRPG

SEQ ID NO: 8003 - protein, 9 aa, Mycobacterium avium
FGDEETTSA

SEQ ID NO: 8004 - protein, 57 aa, Mycobacterium avium
FGPVEGTPLPPGAAPAGTPPGPPAPGSLNQPPTAPDVAAAPAAPSAFDSNSSGVSPS

SEQ ID NO: 8005 - protein, 5 aa, Mycobacterium avium
FGRQN

SEQ ID NO: 8006 - protein, 5 aa, Mycobacterium avium
FGSTS

SEQ ID NO: 8007 - protein, 6 aa, Mycobacterium avium
FGTATR

SEQ ID NO: 8008 - protein, 4 aa, Mycobacterium avium
FKAP

SEQ ID NO: 8009 - protein, 5 aa, Mycobacterium avium
FPDGP

SEQ ID NO: 8010 - protein, 9 aa, Mycobacterium avium
FPDGSPSYQ

SEQ ID NO: 8011 - protein, 9 aa, Mycobacterium avium
FPGSPVTRT

SEQ ID NO: 8012 - protein, 7 aa, Mycobacterium avium
FPNNTES

SEQ ID NO: 8013 - protein, 13 aa, Mycobacterium avium
FPPPPGSAAPTAV

SEQ ID NO: 8014 - protein, 12 aa, Mycobacterium avium
FRPEERDPQITQ

SEQ ID NO: 8015 - protein, 14 aa, Mycobacterium avium
FSADADGYTRSEGG

SEQ ID NO: 8016 - protein, 57 aa, Mycobacterium avium
FSDDDDAADTGTQSWAPDFDDDAEDDDTEAAEPAAERGPEPEPEPEPAGFAGPVPPV

SEQ ID NO: 8017 - protein, 5 aa, Mycobacterium avium
FSQDP

SEQ ID NO: 8018 - protein, 5 aa, Mycobacterium avium
FSSPG

SEQ ID NO: 8019 - protein, 9 aa, Mycobacterium avium
FSTADAPDR

SEQ ID NO: 8020 - protein, 5 aa, Mycobacterium avium
FTTAG

SEQ ID NO: 8021 - protein, 4 aa, Mycobacterium avium
FYSN

SEQ ID NO: 8022 - protein, 4 aa, Mycobacterium avium
GAAA

SEQ ID NO: 8023 - protein, 9 aa, Mycobacterium avium
GAAAELDDR

SEQ ID NO: 8024 - protein, 9 aa, Mycobacterium avium
GAAAGAAGG

SEQ ID NO: 8025 - protein, 10 aa, Mycobacterium avium
GAAALDPSTT

SEQ ID NO: 8026 - protein, 37 aa, Mycobacterium avium
GAAAPGQPREPHTERRTRSRTPGRTQGRPPAESWEYD

SEQ ID NO: 8027 - protein, 37 aa, Mycobacterium avium
GAAAPGQPREPHTERRTRSRTPGRTQGRPPTESWEYD

SEQ ID NO: 8028 - protein, 5 aa, Mycobacterium avium
GAADR

SEQ ID NO: 8029 - protein, 6 aa, Mycobacterium avium
GAAGRL

SEQ ID NO: 8030 - protein, 20 aa, Mycobacterium avium
GAAQGSYAAASTDSLWLTRP

SEQ ID NO: 8031 - protein, 8 aa, Mycobacterium avium
GAASATRM

SEQ ID NO: 8032 - protein, 14 aa, Mycobacterium avium
GAATKSDAARPAGL

SEQ ID NO: 8033 - protein, 14 aa, Mycobacterium avium
GAATKSEAARPAGL

SEQ ID NO: 8034 - protein, 8 aa, Mycobacterium avium
GAATVEVT

SEQ ID NO: 8035 - protein, 4 aa, Mycobacterium avium
GAAV

SEQ ID NO: 8036 - protein, 9 aa, Mycobacterium avium
GADAASSEI

SEQ ID NO: 8037 - protein, 8 aa, Mycobacterium avium
GADDDFST

SEQ ID NO: 8038 - protein, 7 aa, Mycobacterium avium
GADDYTD

SEQ ID NO: 8039 - protein, 19 aa, Mycobacterium avium
GADGNPIGPADAGRNRARE

SEQ ID NO: 8040 - protein, 8 aa, Mycobacterium avium
GADNGTGS

SEQ ID NO: 8041 - protein, 37 aa, Mycobacterium avium
GADPEEANRRFREQREAQQRPHKSDRADEPEDLGEPV

SEQ ID NO: 8042 - protein, 6 aa, Mycobacterium avium
GADPRV

SEQ ID NO: 8043 - protein, 12 aa, Mycobacterium avium
GADRADQLRTDV

SEQ ID NO: 8044 - protein, 4 aa, Mycobacterium avium
GAEN

SEQ ID NO: 8045 - protein, 14 aa, Mycobacterium avium
GAEQRDQRDATPLV

SEQ ID NO: 8046 - protein, 4 aa, Mycobacterium avium
GAET

SEQ ID NO: 8047 - protein, 15 aa, Mycobacterium avium
GAEWGADSAERAEQV

SEQ ID NO: 8048 - protein, 5 aa, Mycobacterium avium
GAFPP

SEQ ID NO: 8049 - protein, 12 aa, Mycobacterium avium
GAGAAEQRSTHW

SEQ ID NO: 8050 - protein, 5 aa, Mycobacterium avium
GAGDA

SEQ ID NO: 8051 - protein, 7 aa, Mycobacterium avium
GAGDRFD

SEQ ID NO: 8052 - protein, 7 aa, Mycobacterium avium
GAGFGRA

SEQ ID NO: 8053 - protein, 54 aa, Mycobacterium avium
GAGGHGSARGGQRAADRRRRPADGRAGGARRRDRPPAPPRQRRAGGGAADHRGH

SEQ ID NO: 8054 - protein, 5 aa, Mycobacterium avium
GAGGT

SEQ ID NO: 8055 - protein, 9 aa, Mycobacterium avium
GAGIGDGIA

SEQ ID NO: 8056 - protein, 4 aa, Mycobacterium avium
GAGL

SEQ ID NO: 8057 - protein, 8 aa, Mycobacterium avium
GAGNAEQF

SEQ ID NO: 8058 - protein, 53 aa, Mycobacterium avium
GAGSQPRSAKPNSPTVRDAANAASEPPATAAPAQLSQPGPPAQISSATANDTL

SEQ ID NO: 8059 - protein, 8 aa, Mycobacterium avium
GAHIPEDK

SEQ ID NO: 8060 - protein, 9 aa, Mycobacterium avium
GAKRAGGRW

SEQ ID NO: 8061 - protein, 47 aa, Mycobacterium avium
GAKRPGAKKSAPAAQAPKTEAPKTEAKTEAASEAKTEAPAAPAAPVK

SEQ ID NO: 8062 - protein, 52 aa, Mycobacterium avium
GAKRPGAKKSAPAAQAPKTEAPKTEAPKTEAKTEAAGEAKTEAPAAPAAPVK

SEQ ID NO: 8063 - protein, 15 aa, Mycobacterium avium
GAMTPESRSAYPGEK

SEQ ID NO: 8064 - protein, 7 aa, Mycobacterium avium
GAPGSFV

SEQ ID NO: 8065 - protein, 19 aa, Mycobacterium avium
GAPLADAATDLRGTISERR

SEQ ID NO: 8066 - protein, 6 aa, Mycobacterium avium
GAPLGL

SEQ ID NO: 8067 - protein, 6 aa, Mycobacterium avium
GAPNPY

SEQ ID NO: 8068 - protein, 15 aa, Mycobacterium avium
GAPPSGEPPAGSGVA

SEQ ID NO: 8069 - protein, 20 aa, Mycobacterium avium
GAPRPQEADYAADTDGRPGI

SEQ ID NO: 8070 - protein, 5 aa, Mycobacterium avium
GAPVT

SEQ ID NO: 8071 - protein, 8 aa, Mycobacterium avium
GAQPGGVG

SEQ ID NO: 8072 - protein, 7 aa, Mycobacterium avium
GAQWDED

SEQ ID NO: 8073 - protein, 21 aa, Mycobacterium avium
GAQYASGAAPTAAAAVETPTE

SEQ ID NO: 8074 - protein, 7 aa, Mycobacterium avium
GAQYPGQ

SEQ ID NO: 8075 - protein, 19 aa, Mycobacterium avium
GARAEVKRQTGADQIKPQT

SEQ ID NO: 8076 - protein, 19 aa, Mycobacterium avium
GARDAGAECDRIPDATPGV

SEQ ID NO: 8077 - protein, 8 aa, Mycobacterium avium
GARTRGGY

SEQ ID NO: 8078 - protein, 23 aa, Mycobacterium avium
GASAPVTVTPSESPVSLGSGTQG

SEQ ID NO: 8079 - protein, 30 aa, Mycobacterium avium
GASGPAAAREPYETRGATDEDPVQVVQNGE

SEQ ID NO: 8080 - protein, 7 aa, Mycobacterium avium
GASPRGI

SEQ ID NO: 8081 - protein, 6 aa, Mycobacterium avium
GASRWR

SEQ ID NO: 8082 - protein, 9 aa, Mycobacterium avium
GASSAGAQA

SEQ ID NO: 8083 - protein, 5 aa, Mycobacterium avium
GATGE

SEQ ID NO: 8084 - protein, 16 aa, Mycobacterium avium
GATGEFKDTYTKASAQ

SEQ ID NO: 8085 - protein, 9 aa, Mycobacterium avium
GATGTSGAE

SEQ ID NO: 8086 - protein, 4 aa, Mycobacterium avium
GATP

SEQ ID NO: 8087 - protein, 10 aa, Mycobacterium avium
GATSLAGAAS

SEQ ID NO: 8088 - protein, 8 aa, Mycobacterium avium
GAYTKAAP

SEQ ID NO: 8089 - protein, 13 aa, Mycobacterium avium
GCSPRWASPRSSS

SEQ ID NO: 8090 - protein, 21 aa, Mycobacterium avium
GDADNPGTAGQAIDGDPSTAW

SEQ ID NO: 8091 - protein, 14 aa, Mycobacterium avium
GDDHPGAAYRLRRD

SEQ ID NO: 8092 - protein, 16 aa, Mycobacterium avium
GDDPARGLQQPGGAGQ

SEQ ID NO: 8093 - protein, 8 aa, Mycobacterium avium
GDEDAHTL

SEQ ID NO: 8094 - protein, 7 aa, Mycobacterium avium
GDEPASY

SEQ ID NO: 8095 - protein, 7 aa, Mycobacterium avium
GDEPLKR

SEQ ID NO: 8096 - protein, 13 aa, Mycobacterium avium
GDGARRQAGGEVH

SEQ ID NO: 8097 - protein, 6 aa, Mycobacterium avium
GDHASV

SEQ ID NO: 8098 - protein, 11 aa, Mycobacterium avium
GDLQGGSTITQ

SEQ ID NO: 8099 - protein, 11 aa, Mycobacterium avium
GDPIGDPRAWP

SEQ ID NO: 8100 - protein, 13 aa, Mycobacterium avium
GDPYTRKAGCAAR

SEQ ID NO: 8101 - protein, 15 aa, Mycobacterium avium
GDQYNPATNATVTGT

SEQ ID NO: 8102 - protein, 4 aa, Mycobacterium avium
GDRA

SEQ ID NO: 8103 - protein, 7 aa, Mycobacterium avium
GDRAAAR

SEQ ID NO: 8104 - protein, 5 aa, Mycobacterium avium
GDRDA

SEQ ID NO: 8105 - protein, 5 aa, Mycobacterium avium
GDREA

SEQ ID NO: 8106 - protein, 5 aa, Mycobacterium avium
GDRGR

SEQ ID NO: 8107 - protein, 6 aa, Mycobacterium avium
GDRGRA

SEQ ID NO: 8108 - protein, 11 aa, Mycobacterium avium
GDRPGDQHPAH

SEQ ID NO: 8109 - protein, 8 aa, Mycobacterium avium
GDRWQPGC

SEQ ID NO: 8110 - protein, 5 aa, Mycobacterium avium
GDSGV

SEQ ID NO: 8111 - protein, 8 aa, Mycobacterium avium
GDTQGDTA

SEQ ID NO: 8112 - protein, 8 aa, Mycobacterium avium
GDTSAGEM

SEQ ID NO: 8113 - protein, 4 aa, Mycobacterium avium
GDTT

SEQ ID NO: 8114 - protein, 24 aa, Mycobacterium avium
GDWAPSADGAAAGADGTEGRNSTD

SEQ ID NO: 8115 - protein, 9 aa, Mycobacterium avium
GDWSSDSES

SEQ ID NO: 8116 - protein, 9 aa, Mycobacterium avium
GECNRGQQE

SEQ ID NO: 8117 - protein, 37 aa, Mycobacterium avium
GECRAGGTAGGAAGGAPETAERAAGGAPGSAERETNF

SEQ ID NO: 8118 - protein, 12 aa, Mycobacterium avium
GEDAELSGGERQ

SEQ ID NO: 8119 - protein, 8 aa, Mycobacterium avium
GEDPAVDE

SEQ ID NO: 8120 - protein, 6 aa, Mycobacterium avium
GEGPDL

SEQ ID NO: 8121 - protein, 16 aa, Mycobacterium avium
GEGSPVTVDGDAGAAR

SEQ ID NO: 8122 - protein, 6 aa, Mycobacterium avium
GEKDQT

SEQ ID NO: 8123 - protein, 12 aa, Mycobacterium avium
GENGDGATVDED

SEQ ID NO: 8124 - protein, 8 aa, Mycobacterium avium
GENISAKE

SEQ ID NO: 8125 - protein, 25 aa, Mycobacterium avium
GEPGDPTHDATKPWPRSRRTVDAGT

SEQ ID NO: 8126 - protein, 12 aa, Mycobacterium avium
GEPWPPPAPEPA

SEQ ID NO: 8127 - protein, 10 aa, Mycobacterium avium
GEQEKGASPL

SEQ ID NO: 8128 - protein, 9 aa, Mycobacterium avium
GEQRKENDR

SEQ ID NO: 8129 - protein, 6 aa, Mycobacterium avium
GERSGW

SEQ ID NO: 8130 - protein, 5 aa, Mycobacterium avium
GERTG

SEQ ID NO: 8131 - protein, 7 aa, Mycobacterium avium
GERTGVA

SEQ ID NO: 8132 - protein, 6 aa, Mycobacterium avium
GERTGW

SEQ ID NO: 8133 - protein, 109 aa, Mycobacterium avium
GESAQHDHHGDQAHGDKPNDDATSAPHAQPAPWEPPAGSVPPPYPPPGYPADYPPGYPPPYPPPAPSPVPPPPPGYGPPPPPGYGPPGYPGGYYPGPDYGGYPPQPPLL

SEQ ID NO: 8134 - protein, 118 aa, Mycobacterium avium
GESAQHDHHGDQAHGDKPNDDATSAPHAQPAPWEPPAGSVPPPYPPPGYPADYPPGYPPPYPPPAPSPVPPPPPGYGPPPPPGYGPPGYPGGYYPGPDYGGYPPQPPLLGGQPGTNGL

SEQ ID NO: 8135 - protein, 9 aa, Mycobacterium avium
GETPLEATG

SEQ ID NO: 8136 - protein, 5 aa, Mycobacterium avium
GEVGG

SEQ ID NO: 8137 - protein, 4 aa, Mycobacterium avium
GFDP

SEQ ID NO: 8138 - protein, 7 aa, Mycobacterium avium
GFGNTGA

SEQ ID NO: 8139 - protein, 16 aa, Mycobacterium avium
GFRGPAPAAGTPDEAA

SEQ ID NO: 8140 - protein, 11 aa, Mycobacterium avium
GFRPPTAVGHT

SEQ ID NO: 8141 - protein, 4 aa, Mycobacterium avium
GGAG

SEQ ID NO: 8142 - protein, 6 aa, Mycobacterium avium
GGAGGL

SEQ ID NO: 8143 - protein, 12 aa, Mycobacterium avium
GGAGLGLRSGGP

SEQ ID NO: 8144 - protein, 5 aa, Mycobacterium avium
GGARP

SEQ ID NO: 8145 - protein, 4 aa, Mycobacterium avium
GGGL

SEQ ID NO: 8146 - protein, 7 aa, Mycobacterium avium
GGGLNKN

SEQ ID NO: 8147 - protein, 7 aa, Mycobacterium avium
GGGPRSC

SEQ ID NO: 8148 - protein, 9 aa, Mycobacterium avium
GGGSPATAA

SEQ ID NO: 8149 - protein, 8 aa, Mycobacterium avium
GGHPAGQA

SEQ ID NO: 8150 - protein, 6 aa, Mycobacterium avium
GGHPSA

SEQ ID NO: 8151 - protein, 4 aa, Mycobacterium avium
GGHV

SEQ ID NO: 8152 - protein, 7 aa, Mycobacterium avium
GGLEPGN

SEQ ID NO: 8153 - protein, 6 aa, Mycobacterium avium
GGLGPE

SEQ ID NO: 8154 - protein, 14 aa, Mycobacterium avium
GGLPDQADKPETVR

SEQ ID NO: 8155 - protein, 4 aa, Mycobacterium avium
GGMG

SEQ ID NO: 8156 - protein, 8 aa, Mycobacterium avium
GGMSTPDN

SEQ ID NO: 8157 - protein, 7 aa, Mycobacterium avium
GGNERKA

SEQ ID NO: 8158 - protein, 7 aa, Mycobacterium avium
GGNGKCR

SEQ ID NO: 8159 - protein, 13 aa, Mycobacterium avium
GGPASAPATIPVS

SEQ ID NO: 8160 - protein, 7 aa, Mycobacterium avium
GGPAVGG

SEQ ID NO: 8161 - protein, 6 aa, Mycobacterium avium
GGPAYP

SEQ ID NO: 8162 - protein, 31 aa, Mycobacterium avium
GGPDTAPPPPGVTAAGPPNAYDESNPPSPPW

SEQ ID NO: 8163 - protein, 6 aa, Mycobacterium avium
GGPGDT

SEQ ID NO: 8164 - protein, 5 aa, Mycobacterium avium
GGPHA

SEQ ID NO: 8165 - protein, 7 aa, Mycobacterium avium
GGPQAVA

SEQ ID NO: 8166 - protein, 7 aa, Mycobacterium avium
GGPRSQR

SEQ ID NO: 8167 - protein, 7 aa, Mycobacterium avium
GGPTQYG

SEQ ID NO: 8168 - protein, 4 aa, Mycobacterium avium
GGPV

SEQ ID NO: 8169 - protein, 14 aa, Mycobacterium avium
GGPVGVGEASGRAI

SEQ ID NO: 8170 - protein, 9 aa, Mycobacterium avium
GGRGDGWRS

SEQ ID NO: 8171 - protein, 5 aa, Mycobacterium avium
GGRSR

SEQ ID NO: 8172 - protein, 84 aa, Mycobacterium avium
GGSDRRGARDGAARRGRRPAADAGAARRARGGRASAPARESRAPKPGPQTSPVARPAERSARPRNTSQAKARAKARKAKAPKVV

SEQ ID NO: 8173 - protein, 84 aa, Mycobacterium avium
GGSDRRGARDGSARRGRRPAADAGAARRARGGPASAPTRESRAPKPGPQTSPVARPAERSARPKNTSQAKARAKARKAKAPKVV

SEQ ID NO: 8174 - protein, 8 aa, Mycobacterium avium
GGSGTSAT

SEQ ID NO: 8175 - protein, 9 aa, Mycobacterium avium
GGSPDTFPG

SEQ ID NO: 8176 - protein, 6 aa, Mycobacterium avium
GGSQAD

SEQ ID NO: 8177 - protein, 16 aa, Mycobacterium avium
GGSRRGGGGLDADRGR

SEQ ID NO: 8178 - protein, 8 aa, Mycobacterium avium
GGSSLTRT

SEQ ID NO: 8179 - protein, 4 aa, Mycobacterium avium
GGST

SEQ ID NO: 8180 - protein, 8 aa, Mycobacterium avium
GGSTVPAA

SEQ ID NO: 8181 - protein, 14 aa, Mycobacterium avium
GGTAATYKDMHDGS

SEQ ID NO: 8182 - protein, 23 aa, Mycobacterium avium
GGTFTGGTRVGPPAGATGLGDGS

SEQ ID NO: 8183 - protein, 5 aa, Mycobacterium avium
GGTGH

SEQ ID NO: 8184 - protein, 9 aa, Mycobacterium avium
GGVSPGGDH

SEQ ID NO: 8185 - protein, 7 aa, Mycobacterium avium
GHATGRD

SEQ ID NO: 8186 - protein, 10 aa, Mycobacterium avium
GHDATPASDV

SEQ ID NO: 8187 - protein, 4 aa, Mycobacterium avium
GHET

SEQ ID NO: 8188 - protein, 5 aa, Mycobacterium avium
GHETL

SEQ ID NO: 8189 - protein, 5 aa, Mycobacterium avium
GHGPA

SEQ ID NO: 8190 - protein, 13 aa, Mycobacterium avium
GHRATADSAPAVV

SEQ ID NO: 8191 - protein, 7 aa, Mycobacterium avium
GHVRPGV

SEQ ID NO: 8192 - protein, 5 aa, Mycobacterium avium
GIAAG

SEQ ID NO: 8193 - protein, 43 aa, Mycobacterium avium
GIADDEVAPADEPDVAEASPNQSEQTDKAAEGEGEPPRPRKRR

SEQ ID NO: 8194 - protein, 43 aa, Mycobacterium avium
GIADDEVAPADEPDVAEDSPDQSEQTDKAAEGEGEPPRPRKRR

SEQ ID NO: 8195 - protein, 8 aa, Mycobacterium avium
GIGGAAAT

SEQ ID NO: 8196 - protein, 6 aa, Mycobacterium avium
GIGQAG

SEQ ID NO: 8197 - protein, 8 aa, Mycobacterium avium
GIGSPGSR

SEQ ID NO: 8198 - protein, 15 aa, Mycobacterium avium
GIPDTAAAGESAGGR

SEQ ID NO: 8199 - protein, 8 aa, Mycobacterium avium
GISGEPLS

SEQ ID NO: 8200 - protein, 13 aa, Mycobacterium avium
GITPSDDPLPAAR

SEQ ID NO: 8201 - protein, 5 aa, Mycobacterium avium
GIYPG

SEQ ID NO: 8202 - protein, 6 aa, Mycobacterium avium
GIYPGE

SEQ ID NO: 8203 - protein, 74 aa, Mycobacterium avium
GKDTTKTAEPADDDGAAAETGAVPDCAPEAADEQDQQATDEPTKTSQKASQKASKKESKKAPKDKPTDGSSHSR

SEQ ID NO: 8204 - protein, 10 aa, Mycobacterium avium
GKEVDRSPDD

SEQ ID NO: 8205 - protein, 5 aa, Mycobacterium avium
GKFPY

SEQ ID NO: 8206 - protein, 7 aa, Mycobacterium avium
GKGRLDD

SEQ ID NO: 8207 - protein, 5 aa, Mycobacterium avium
GKPFD

SEQ ID NO: 8208 - protein, 26 aa, Mycobacterium avium
GKPGWPDPSDFTRGYDGGVADAHTAT

SEQ ID NO: 8209 - protein, 26 aa, Mycobacterium avium
GKPLPGLGARGGNRTGGPRAGRRRPL

SEQ ID NO: 8210 - protein, 24 aa, Mycobacterium avium
GKPLPGSGPAVETEREARALADDV

SEQ ID NO: 8211 - protein, 24 aa, Mycobacterium avium
GKPLPGSGPAVETEREARALANDV

SEQ ID NO: 8212 - protein, 9 aa, Mycobacterium avium
GKRPFSGDG

SEQ ID NO: 8213 - protein, 20 aa, Mycobacterium avium
GKSAGETNRDLASETGLTES

SEQ ID NO: 8214 - protein, 7 aa, Mycobacterium avium
GKSAGGI

SEQ ID NO: 8215 - protein, 13 aa, Mycobacterium avium
GKSDNNGEQRIPK

SEQ ID NO: 8216 - protein, 13 aa, Mycobacterium avium
GKTVTGQPVGASL

SEQ ID NO: 8217 - protein, 17 aa, Mycobacterium avium
GLADGHPLDESAEQQRR

SEQ ID NO: 8218 - protein, 17 aa, Mycobacterium avium
GLADGHPVDESAEQQRR

SEQ ID NO: 8219 - protein, 5 aa, Mycobacterium avium
GLEGG

SEQ ID NO: 8220 - protein, 4 aa, Mycobacterium avium
GLGG

SEQ ID NO: 8221 - protein, 5 aa, Mycobacterium avium
GLGGR

SEQ ID NO: 8222 - protein, 14 aa, Mycobacterium avium
GLGNGQPDTVPAAS

SEQ ID NO: 8223 - protein, 15 aa, Mycobacterium avium
GLGPPKAVTLSGGTW

SEQ ID NO: 8224 - protein, 7 aa, Mycobacterium avium
GLGSARR

SEQ ID NO: 8225 - protein, 4 aa, Mycobacterium avium
GLLP

SEQ ID NO: 8226 - protein, 8 aa, Mycobacterium avium
GLNTDQLS

SEQ ID NO: 8227 - protein, 15 aa, Mycobacterium avium
GLPQRGPGSLAPMGP

SEQ ID NO: 8228 - protein, 6 aa, Mycobacterium avium
GLQTGS

SEQ ID NO: 8229 - protein, 12 aa, Mycobacterium avium
GLTEPRAAAGDG

SEQ ID NO: 8230 - protein, 13 aa, Mycobacterium avium
GMGPATETYLAGP

SEQ ID NO: 8231 - protein, 25 aa, Mycobacterium avium
GMHPVTGKRGLPVDPSAAPRPAMTP

SEQ ID NO: 8232 - protein, 15 aa, Mycobacterium avium
GMPGPPEPQKRSRAG

SEQ ID NO: 8233 - protein, 6 aa, Mycobacterium avium
GMRGGF

SEQ ID NO: 8234 - protein, 26 aa, Mycobacterium avium
GMTPAPLSSTPAQVAAATARALAKGR

SEQ ID NO: 8235 - protein, 15 aa, Mycobacterium avium
GNATRVNPGPDPIPA

SEQ ID NO: 8236 - protein, 10 aa, Mycobacterium avium
GNDDDTEAEH

SEQ ID NO: 8237 - protein, 10 aa, Mycobacterium avium
GNGPGTKIRD

SEQ ID NO: 8238 - protein, 6 aa, Mycobacterium avium
GNGQTY

SEQ ID NO: 8239 - protein, 5 aa, Mycobacterium avium
GNLGG

SEQ ID NO: 8240 - protein, 10 aa, Mycobacterium avium
GNPGGGGDHQ

SEQ ID NO: 8241 - protein, 11 aa, Mycobacterium avium
GNQGESLANES

SEQ ID NO: 8242 - protein, 11 aa, Mycobacterium avium
GNTSAGGGGTI

SEQ ID NO: 8243 - protein, 5 aa, Mycobacterium avium
GPAAR

SEQ ID NO: 8244 - protein, 4 aa, Mycobacterium avium
GPAL

SEQ ID NO: 8245 - protein, 6 aa, Mycobacterium avium
GPAPID

SEQ ID NO: 8246 - protein, 6 aa, Mycobacterium avium
GPAPVD

SEQ ID NO: 8247 - protein, 14 aa, Mycobacterium avium
GPDFGPLSDPARRA

SEQ ID NO: 8248 - protein, 9 aa, Mycobacterium avium
GPEPGDDEL

SEQ ID NO: 8249 - protein, 6 aa, Mycobacterium avium
GPETSL

SEQ ID NO: 8250 - protein, 23 aa, Mycobacterium avium
GPFEGTGSAPDDAGDGSAWSAAN

SEQ ID NO: 8251 - protein, 56 aa, Mycobacterium avium
GPGAGAAATNIQPTEGGAPAASPPANAPAPAVAPGSAPPVAAPPVPDGSVTLSPAK

SEQ ID NO: 8252 - protein, 11 aa, Mycobacterium avium
GPGERHERSAH

SEQ ID NO: 8253 - protein, 5 aa, Mycobacterium avium
GPGFE

SEQ ID NO: 8254 - protein, 48 aa, Mycobacterium avium
GPGGPGGPGSFGGPGGPGGQGGQTGPGTSTAPAAPSPVRPSGLAPNQL

SEQ ID NO: 8255 - protein, 48 aa, Mycobacterium avium
GPGGPGGPGSFGGPGGPGGQGGQTGPGTSTAPATPSPVRPSGLAPNQL

SEQ ID NO: 8256 - protein, 12 aa, Mycobacterium avium
GPIAGQPRQPAA

SEQ ID NO: 8257 - protein, 13 aa, Mycobacterium avium
GPIAGQPRQPAAP

SEQ ID NO: 8258 - protein, 27 aa, Mycobacterium avium
GPKGADGKPSKQAISDSQVSETWGDQI

SEQ ID NO: 8259 - protein, 5 aa, Mycobacterium avium
GPNIA

SEQ ID NO: 8260 - protein, 6 aa, Mycobacterium avium
GPPEDR

SEQ ID NO: 8261 - protein, 12 aa, Mycobacterium avium
GPPGGLPALDPD

SEQ ID NO: 8262 - protein, 6 aa, Mycobacterium avium
GPPKTV

SEQ ID NO: 8263 - protein, 23 aa, Mycobacterium avium
GPPPTYPPPGYPPAPAFGPPPGY

SEQ ID NO: 8264 - protein, 8 aa, Mycobacterium avium
GPPSQTDY

SEQ ID NO: 8265 - protein, 7 aa, Mycobacterium avium
GPSAARN

SEQ ID NO: 8266 - protein, 33 aa, Mycobacterium avium
GPSLTRRRAGTPARAEGPRREPGPGRGRGPDPL

SEQ ID NO: 8267 - protein, 8 aa, Mycobacterium avium
GPSPARNA

SEQ ID NO: 8268 - protein, 5 aa, Mycobacterium avium
GPSPY

SEQ ID NO: 8269 - protein, 18 aa, Mycobacterium avium
GPSVHPPVGSRPPSYPWQ

SEQ ID NO: 8270 - protein, 5 aa, Mycobacterium avium
GPTAQ

SEQ ID NO: 8271 - protein, 6 aa, Mycobacterium avium
GPTGIA

SEQ ID NO: 8272 - protein, 10 aa, Mycobacterium avium
GPTPQQPVGP

SEQ ID NO: 8273 - protein, 6 aa, Mycobacterium avium
GPVDPA

SEQ ID NO: 8274 - protein, 22 aa, Mycobacterium avium
GPVTASAGLRTSLDGDTDQYQA

SEQ ID NO: 8275 - protein, 4 aa, Mycobacterium avium
GPYP

SEQ ID NO: 8276 - protein, 4 aa, Mycobacterium avium
GPYR

SEQ ID NO: 8277 - protein, 7 aa, Mycobacterium avium
GQAQNQA

SEQ ID NO: 8278 - protein, 4 aa, Mycobacterium avium
GQIG

SEQ ID NO: 8279 - protein, 5 aa, Mycobacterium avium
GQIRV

SEQ ID NO: 8280 - protein, 10 aa, Mycobacterium avium
GQNADGVTVE

SEQ ID NO: 8281 - protein, 34 aa, Mycobacterium avium
GQPDRADLDRPDPPDARHAAQADLADPRVEQEHR

SEQ ID NO: 8282 - protein, 34 aa, Mycobacterium avium
GQPDRADLDRPDPPDARHAAQPDLADPRVEQEHR

SEQ ID NO: 8283 - protein, 34 aa, Mycobacterium avium
GQPDRADLDRPDPPDARHADPHDLADPRVEQEHR

SEQ ID NO: 8284 - protein, 8 aa, Mycobacterium avium
GQPSQTDY

SEQ ID NO: 8285 - protein, 4 aa, Mycobacterium avium
GQQW

SEQ ID NO: 8286 - protein, 15 aa, Mycobacterium avium
GQREPNLASSPATPP

SEQ ID NO: 8287 - protein, 11 aa, Mycobacterium avium
GQRPSPSERTS

SEQ ID NO: 8288 - protein, 14 aa, Mycobacterium avium
GQRVTAGDGDGGWP

SEQ ID NO: 8289 - protein, 9 aa, Mycobacterium avium
GQSASEAGR

SEQ ID NO: 8290 - protein, 16 aa, Mycobacterium avium
GQSECATGDTASPTTV

SEQ ID NO: 8291 - protein, 10 aa, Mycobacterium avium
GQTLGGRTRP

SEQ ID NO: 8292 - protein, 20 aa, Mycobacterium avium
GRAAATQEDIARQQHSQRDR

SEQ ID NO: 8293 - protein, 14 aa, Mycobacterium avium
GRAATDPGDQAAAA

SEQ ID NO: 8294 - protein, 6 aa, Mycobacterium avium
GRAITA

SEQ ID NO: 8295 - protein, 5 aa, Mycobacterium avium
GRAPR

SEQ ID NO: 8296 - protein, 5 aa, Mycobacterium avium
GRASW

SEQ ID NO: 8297 - protein, 8 aa, Mycobacterium avium
GRDDGAPD

SEQ ID NO: 8298 - protein, 6 aa, Mycobacterium avium
GREGGD

SEQ ID NO: 8299 - protein, 17 aa, Mycobacterium avium
GRGAERESKHDADDLGD

SEQ ID NO: 8300 - protein, 4 aa, Mycobacterium avium
GRGG

SEQ ID NO: 8301 - protein, 36 aa, Mycobacterium avium
GRGPRPRKPAAPDQSSHRRPVTYPEQRNSSPPGVNA

SEQ ID NO: 8302 - protein, 11 aa, Mycobacterium avium
GRGRGSGANDF

SEQ ID NO: 8303 - protein, 11 aa, Mycobacterium avium
GRHGDGTPLET

SEQ ID NO: 8304 - protein, 7 aa, Mycobacterium avium
GRHRSER

SEQ ID NO: 8305 - protein, 10 aa, Mycobacterium avium
GRIDGADATE

SEQ ID NO: 8306 - protein, 12 aa, Mycobacterium avium
GRLDGHTAAPAD

SEQ ID NO: 8307 - protein, 5 aa, Mycobacterium avium
GRLTT

SEQ ID NO: 8308 - protein, 16 aa, Mycobacterium avium
GRPDSSGARAATLPSR

SEQ ID NO: 8309 - protein, 10 aa, Mycobacterium avium
GRPGPIPSYD

SEQ ID NO: 8310 - protein, 14 aa, Mycobacterium avium
GRPPSVQVGAYGRR

SEQ ID NO: 8311 - protein, 7 aa, Mycobacterium avium
GRPQPEL

SEQ ID NO: 8312 - protein, 7 aa, Mycobacterium avium
GRPTRRD

SEQ ID NO: 8313 - protein, 7 aa, Mycobacterium avium
GRQQNPA

SEQ ID NO: 8314 - protein, 9 aa, Mycobacterium avium
GRQQPNIAA

SEQ ID NO: 8315 - protein, 9 aa, Mycobacterium avium
GRQSEEGSG

SEQ ID NO: 8316 - protein, 12 aa, Mycobacterium avium
GRRAATPARRPD

SEQ ID NO: 8317 - protein, 15 aa, Mycobacterium avium
GRRGAVTVGTAGEVA

SEQ ID NO: 8318 - protein, 44 aa, Mycobacterium avium
GRRQDGAHDEPPVHEPRGSVSAPPPGYPVGPPPAYGPQSHYGTQ

SEQ ID NO: 8319 - protein, 45 aa, Mycobacterium avium
GRRQDGAHDEPPVHEPRGSVSAPPPGYPVGPPPAYGSQSHYGTQY

SEQ ID NO: 8320 - protein, 16 aa, Mycobacterium avium
GRRVEPQVESEMPGAA

SEQ ID NO: 8321 - protein, 6 aa, Mycobacterium avium
GRSPLV

SEQ ID NO: 8322 - protein, 6 aa, Mycobacterium avium
GRSRDD

SEQ ID NO: 8323 - protein, 10 aa, Mycobacterium avium
GRSSGPDRRI

SEQ ID NO: 8324 - protein, 21 aa, Mycobacterium avium
GRTAAGRVGVDPTAADPAGWP

SEQ ID NO: 8325 - protein, 8 aa, Mycobacterium avium
GRTNYRNP

SEQ ID NO: 8326 - protein, 9 aa, Mycobacterium avium
GRTNYRNPE

SEQ ID NO: 8327 - protein, 8 aa, Mycobacterium avium
GRTRRPPR

SEQ ID NO: 8328 - protein, 9 aa, Mycobacterium avium
GRVEPDQDT

SEQ ID NO: 8329 - protein, 9 aa, Mycobacterium avium
GSADDLPQE

SEQ ID NO: 8330 - protein, 9 aa, Mycobacterium avium
GSAGPGEKA

SEQ ID NO: 8331 - protein, 8 aa, Mycobacterium avium
GSAGPVTR

SEQ ID NO: 8332 - protein, 4 aa, Mycobacterium avium
GSEA

SEQ ID NO: 8333 - protein, 7 aa, Mycobacterium avium
GSERSQL

SEQ ID NO: 8334 - protein, 5 aa, Mycobacterium avium
GSFGS

SEQ ID NO: 8335 - protein, 8 aa, Mycobacterium avium
GSGQLGNF

SEQ ID NO: 8336 - protein, 4 aa, Mycobacterium avium
GSKA

SEQ ID NO: 8337 - protein, 6 aa, Mycobacterium avium
GSKVTY

SEQ ID NO: 8338 - protein, 7 aa, Mycobacterium avium
GSKVTYN

SEQ ID NO: 8339 - protein, 9 aa, Mycobacterium avium
GSLEPRRTT

SEQ ID NO: 8340 - protein, 9 aa, Mycobacterium avium
GSLPEDSRY

SEQ ID NO: 8341 - protein, 5 aa, Mycobacterium avium
GSRIS

SEQ ID NO: 8342 - protein, 10 aa, Mycobacterium avium
GSRVGTVESS

SEQ ID NO: 8343 - protein, 4 aa, Mycobacterium avium
GSST

SEQ ID NO: 8344 - protein, 11 aa, Mycobacterium avium
GSTAARSGSGL

SEQ ID NO: 8345 - protein, 13 aa, Mycobacterium avium
GSTGTSSGSNGLG

SEQ ID NO: 8346 - protein, 9 aa, Mycobacterium avium
GSVPAPPGI

SEQ ID NO: 8347 - protein, 9 aa, Mycobacterium avium
GSVQERAAQ

SEQ ID NO: 8348 - protein, 11 aa, Mycobacterium avium
GSWEGESAEQY

SEQ ID NO: 8349 - protein, 16 aa, Mycobacterium avium
GTAANRAAAAPAGLSA

SEQ ID NO: 8350 - protein, 10 aa, Mycobacterium avium
GTADEDITDQ

SEQ ID NO: 8351 - protein, 4 aa, Mycobacterium avium
GTAQ

SEQ ID NO: 8352 - protein, 5 aa, Mycobacterium avium
GTARA

SEQ ID NO: 8353 - protein, 4 aa, Mycobacterium avium
GTAS

SEQ ID NO: 8354 - protein, 14 aa, Mycobacterium avium
GTASSPGAAPMPAL

SEQ ID NO: 8355 - protein, 6 aa, Mycobacterium avium
GTASTF

SEQ ID NO: 8356 - protein, 4 aa, Mycobacterium avium
GTAT

SEQ ID NO: 8357 - protein, 18 aa, Mycobacterium avium
GTDSGNGKAADPESLTSD

SEQ ID NO: 8358 - protein, 5 aa, Mycobacterium avium
GTGLS

SEQ ID NO: 8359 - protein, 8 aa, Mycobacterium avium
GTGPGLRE

SEQ ID NO: 8360 - protein, 5 aa, Mycobacterium avium
GTGTV

SEQ ID NO: 8361 - protein, 12 aa, Mycobacterium avium
GTGVGTSGSACE

SEQ ID NO: 8362 - protein, 9 aa, Mycobacterium avium
GTHRAGGLP

SEQ ID NO: 8363 - protein, 8 aa, Mycobacterium avium
GTKGKTAV

SEQ ID NO: 8364 - protein, 5 aa, Mycobacterium avium
GTKSK

SEQ ID NO: 8365 - protein, 4 aa, Mycobacterium avium
GTLA

SEQ ID NO: 8366 - protein, 12 aa, Mycobacterium avium
GTLGDPTAAESV

SEQ ID NO: 8367 - protein, 6 aa, Mycobacterium avium
GTLTEN

SEQ ID NO: 8368 - protein, 15 aa, Mycobacterium avium
GTLTYDGADPERKKA

SEQ ID NO: 8369 - protein, 9 aa, Mycobacterium avium
GTPGAPGLD

SEQ ID NO: 8370 - protein, 6 aa, Mycobacterium avium
GTPGVA

SEQ ID NO: 8371 - protein, 4 aa, Mycobacterium avium
GTPL

SEQ ID NO: 8372 - protein, 7 aa, Mycobacterium avium
GTSARVA

SEQ ID NO: 8373 - protein, 8 aa, Mycobacterium avium
GTSETPRL

SEQ ID NO: 8374 - protein, 7 aa, Mycobacterium avium
GTTGRPK

SEQ ID NO: 8375 - protein, 5 aa, Mycobacterium avium
GTVNG

SEQ ID NO: 8376 - protein, 8 aa, Mycobacterium avium
GTVTPAGD

SEQ ID NO: 8377 - protein, 33 aa, Mycobacterium avium
GVAGTRPRSGRHAAADEEDASENGLAGPDGRPP

SEQ ID NO: 8378 - protein, 33 aa, Mycobacterium avium
GVAGTRPRSGRHAAADEEDASENGLAGPDGRPT

SEQ ID NO: 8379 - protein, 19 aa, Mycobacterium avium
GVASATMSDAMPGTATGPA

SEQ ID NO: 8380 - protein, 8 aa, Mycobacterium avium
GVGDPHID

SEQ ID NO: 8381 - protein, 5 aa, Mycobacterium avium
GVGPV

SEQ ID NO: 8382 - protein, 19 aa, Mycobacterium avium
GVKAGESGDIEEAPDVVPA

SEQ ID NO: 8383 - protein, 17 aa, Mycobacterium avium
GVPAPPPPPKAPPSETV

SEQ ID NO: 8384 - protein, 14 aa, Mycobacterium avium
GVPGPGPETSTANE

SEQ ID NO: 8385 - protein, 4 aa, Mycobacterium avium
GVQN

SEQ ID NO: 8386 - protein, 5 aa, Mycobacterium avium
GVQNT

SEQ ID NO: 8387 - protein, 10 aa, Mycobacterium avium
GVRGNAADHL

SEQ ID NO: 8388 - protein, 16 aa, Mycobacterium avium
GVRPGPRLPNVEPGGD

SEQ ID NO: 8389 - protein, 34 aa, Mycobacterium avium
GVTGDATAMAPAAGDATAMAPAAGLTGDETTVVP

SEQ ID NO: 8390 - protein, 24 aa, Mycobacterium avium
GVTGDATAMAPAAGLTGDETTVVP

SEQ ID NO: 8391 - protein, 4 aa, Mycobacterium avium
GVTP

SEQ ID NO: 8392 - protein, 5 aa, Mycobacterium avium
GVYSD

SEQ ID NO: 8393 - protein, 19 aa, Mycobacterium avium
GWGDPTSSAKSSSDGPVPV

SEQ ID NO: 8394 - protein, 6 aa, Mycobacterium avium
GWNQSD

SEQ ID NO: 8395 - protein, 5 aa, Mycobacterium avium
GWPRG

SEQ ID NO: 8396 - protein, 9 aa, Mycobacterium avium
GYADGTGDL

SEQ ID NO: 8397 - protein, 5 aa, Mycobacterium avium
GYEPE

SEQ ID NO: 8398 - protein, 4 aa, Mycobacterium avium
GYGM

SEQ ID NO: 8399 - protein, 13 aa, Mycobacterium avium
GYPPQQPAAQAPN

SEQ ID NO: 8400 - protein, 23 aa, Mycobacterium avium
GYQTSYDNRPYLPTSTKANIGYD

SEQ ID NO: 8401 - protein, 9 aa, Mycobacterium avium
GYRRSGGGF

SEQ ID NO: 8402 - protein, 13 aa, Mycobacterium avium
GYSFPSGHATGTA

SEQ ID NO: 8403 - protein, 23 aa, Mycobacterium avium
HAAAGEQQTGGQSAEPDDGADRQ

SEQ ID NO: 8404 - protein, 5 aa, Mycobacterium avium
HAEGS

SEQ ID NO: 8405 - protein, 6 aa, Mycobacterium avium
HAETRV

SEQ ID NO: 8406 - protein, 7 aa, Mycobacterium avium
HAGQAGG

SEQ ID NO: 8407 - protein, 6 aa, Mycobacterium avium
HAPERW

SEQ ID NO: 8408 - protein, 4 aa, Mycobacterium avium
HAPR

SEQ ID NO: 8409 - protein, 5 aa, Mycobacterium avium
HAQAT

SEQ ID NO: 8410 - protein, 16 aa, Mycobacterium avium
HARHRTGAAAAAGRRA

SEQ ID NO: 8411 - protein, 11 aa, Mycobacterium avium
HARRSAAALPA

SEQ ID NO: 8412 - protein, 8 aa, Mycobacterium avium
HDEEGVPR

SEQ ID NO: 8413 - protein, 9 aa, Mycobacterium avium
HDEGLSATG

SEQ ID NO: 8414 - protein, 4 aa, Mycobacterium avium
HDKN

SEQ ID NO: 8415 - protein, 7 aa, Mycobacterium avium
HDQPPWT

SEQ ID NO: 8416 - protein, 6 aa, Mycobacterium avium
HDRPPR

SEQ ID NO: 8417 - protein, 11 aa, Mycobacterium avium
HDTTGALTNRS

SEQ ID NO: 8418 - protein, 6 aa, Mycobacterium avium
HESRSR

SEQ ID NO: 8419 - protein, 6 aa, Mycobacterium avium
HESSSD

SEQ ID NO: 8420 - protein, 10 aa, Mycobacterium avium
HGDHPGYELE

SEQ ID NO: 8421 - protein, 6 aa, Mycobacterium avium
HGGTGH

SEQ ID NO: 8422 - protein, 5 aa, Mycobacterium avium
HGPIG

SEQ ID NO: 8423 - protein, 5 aa, Mycobacterium avium
HGPRA

SEQ ID NO: 8424 - protein, 23 aa, Mycobacterium avium
HGPRGAAPKTPGSPAPGRPAPPL

SEQ ID NO: 8425 - protein, 23 aa, Mycobacterium avium
HGSHGATPKTPGSPAPGRTAPPL

SEQ ID NO: 8426 - protein, 23 aa, Mycobacterium avium
HGSRGAAPKTPGSPAPGRPAPPL

SEQ ID NO: 8427 - protein, 15 aa, Mycobacterium avium
HHHGQPPAVAPVNPN

SEQ ID NO: 8428 - protein, 12 aa, Mycobacterium avium
HHTGPDFGKASP

SEQ ID NO: 8429 - protein, 4 aa, Mycobacterium avium
HKPR

SEQ ID NO: 8430 - protein, 16 aa, Mycobacterium avium
HLSSSAASEHGAGPLG

SEQ ID NO: 8431 - protein, 6 aa, Mycobacterium avium
HLTPDD

SEQ ID NO: 8432 - protein, 6 aa, Mycobacterium avium
HNEPPT

SEQ ID NO: 8433 - protein, 14 aa, Mycobacterium avium
HNGDDKDVDMEDTW

SEQ ID NO: 8434 - protein, 10 aa, Mycobacterium avium
HNTGSSTPGR

SEQ ID NO: 8435 - protein, 9 aa, Mycobacterium avium
HPAAPTGDG

SEQ ID NO: 8436 - protein, 9 aa, Mycobacterium avium
HPEAPSPVS

SEQ ID NO: 8437 - protein, 10 aa, Mycobacterium avium
HPEDDAESFD

SEQ ID NO: 8438 - protein, 5 aa, Mycobacterium avium
HPETA

SEQ ID NO: 8439 - protein, 4 aa, Mycobacterium avium
HPGD

SEQ ID NO: 8440 - protein, 4 aa, Mycobacterium avium
HPGW

SEQ ID NO: 8441 - protein, 5 aa, Mycobacterium avium
HPKRG

SEQ ID NO: 8442 - protein, 5 aa, Mycobacterium avium
HPLGD

SEQ ID NO: 8443 - protein, 8 aa, Mycobacterium avium
HPPAPAAW

SEQ ID NO: 8444 - protein, 90 aa, Mycobacterium avium
HPPAPAAWSAQPAPPVAAPPPPAGRTPNWAAPPRRPQPAPRPGPPGQTMYGGRPPGGYPPAAPPPPPVAPAPAAPHTQMAPAASKPPEVA

SEQ ID NO: 8445 - protein, 69 aa, Mycobacterium avium
HPPGQHRAGGPHPAGRGATAPARRGGQAGDGPGRCDRARQRGVDAGHRGPVAGQRRRASGATRLSARRG

SEQ ID NO: 8446 - protein, 11 aa, Mycobacterium avium
HPRPAGGPSHH

SEQ ID NO: 8447 - protein, 5 aa, Mycobacterium avium
HPTGA

SEQ ID NO: 8448 - protein, 9 aa, Mycobacterium avium
HPTSAKADQ

SEQ ID NO: 8449 - protein, 22 aa, Mycobacterium avium
HPVTGKRGLPVDPSTVPRPAMT

SEQ ID NO: 8450 - protein, 40 aa, Mycobacterium avium
HQAQHQARRGKSTQPPDSPVEPETPAEPESPDEPESPSAQ

SEQ ID NO: 8451 - protein, 54 aa, Mycobacterium avium
HQAQHQARRGKSTQPPDSPVEPETPAEPESPTNLKAQARKRNSDVPGTSPTRYL

SEQ ID NO: 8452 - protein, 40 aa, Mycobacterium avium
HQAQHQARRGKSTQQPDSPAEPETPTEPESPDEPESPSAQ

SEQ ID NO: 8453 - protein, 19 aa, Mycobacterium avium
HQPQPDRGAAAPPRGPVAG

SEQ ID NO: 8454 - protein, 14 aa, Mycobacterium avium
HQPRRDRRQRRSGG

SEQ ID NO: 8455 - protein, 5 aa, Mycobacterium avium
HRDTR

SEQ ID NO: 8456 - protein, 5 aa, Mycobacterium avium
HRGRA

SEQ ID NO: 8457 - protein, 13 aa, Mycobacterium avium
HRGSSGSARRHPL

SEQ ID NO: 8458 - protein, 8 aa, Mycobacterium avium
HRHSESPA

SEQ ID NO: 8459 - protein, 12 aa, Mycobacterium avium
HRQGGQLSSREV

SEQ ID NO: 8460 - protein, 21 aa, Mycobacterium avium
HRRPAARSELPAQAAGGRGVV

SEQ ID NO: 8461 - protein, 5 aa, Mycobacterium avium
HRTNH

SEQ ID NO: 8462 - protein, 9 aa, Mycobacterium avium
HSGHDGAAR

SEQ ID NO: 8463 - protein, 8 aa, Mycobacterium avium
HSQAPAPV

SEQ ID NO: 8464 - protein, 4 aa, Mycobacterium avium
HSQG

SEQ ID NO: 8465 - protein, 7 aa, Mycobacterium avium
HSRGGGT

SEQ ID NO: 8466 - protein, 9 aa, Mycobacterium avium
HTPPPPGVK

SEQ ID NO: 8467 - protein, 7 aa, Mycobacterium avium
HTPTPAD

SEQ ID NO: 8468 - protein, 11 aa, Mycobacterium avium
HTVARRTAGEL

SEQ ID NO: 8469 - protein, 12 aa, Mycobacterium avium
HVPEQVPGSTLR

SEQ ID NO: 8470 - protein, 5 aa, Mycobacterium avium
HVTTE

SEQ ID NO: 8471 - protein, 6 aa, Mycobacterium avium
HVVSGS

SEQ ID NO: 8472 - protein, 10 aa, Mycobacterium avium
HYASGASGEF

SEQ ID NO: 8473 - protein, 25 aa, Mycobacterium avium
HYGPPPTYPPPGYPPAPAFGPPPGY

SEQ ID NO: 8474 - protein, 12 aa, Mycobacterium avium
IAAGDRNRGEGQ

SEQ ID NO: 8475 - protein, 7 aa, Mycobacterium avium
IAATGPE

SEQ ID NO: 8476 - protein, 24 aa, Mycobacterium avium
IAEQAGEQTDEAETDEAEDGGELL

SEQ ID NO: 8477 - protein, 18 aa, Mycobacterium avium
IAGRPARPGHAHPPAGRN

SEQ ID NO: 8478 - protein, 6 aa, Mycobacterium avium
IAPEQT

SEQ ID NO: 8479 - protein, 5 aa, Mycobacterium avium
IAPGA

SEQ ID NO: 8480 - protein, 9 aa, Mycobacterium avium
IAPNQDAQA

SEQ ID NO: 8481 - protein, 47 aa, Mycobacterium avium
IAPNTGPNTVGAQATAGPRPEVAETTPPPGQPPEAPAAVGPTGKPWP

SEQ ID NO: 8482 - protein, 6 aa, Mycobacterium avium
IAPSKP

SEQ ID NO: 8483 - protein, 8 aa, Mycobacterium avium
IAQTDPKK

SEQ ID NO: 8484 - protein, 14 aa, Mycobacterium avium
IARNRRAAAEQTRP

SEQ ID NO: 8485 - protein, 5 aa, Mycobacterium avium
IDADT

SEQ ID NO: 8486 - protein, 4 aa, Mycobacterium avium
IDDS

SEQ ID NO: 8487 - protein, 5 aa, Mycobacterium avium
IDHPG

SEQ ID NO: 8488 - protein, 13 aa, Mycobacterium avium
IDQRRADSGAFDR

SEQ ID NO: 8489 - protein, 11 aa, Mycobacterium avium
IDTNGDNPAFA

SEQ ID NO: 8490 - protein, 9 aa, Mycobacterium avium
IEAGSTGRK

SEQ ID NO: 8491 - protein, 10 aa, Mycobacterium avium
IEDRADPGTL

SEQ ID NO: 8492 - protein, 11 aa, Mycobacterium avium
IEEAKKHADTV

SEQ ID NO: 8493 - protein, 9 aa, Mycobacterium avium
IEENPANKQ

SEQ ID NO: 8494 - protein, 10 aa, Mycobacterium avium
IGGPRRKGRI

SEQ ID NO: 8495 - protein, 5 aa, Mycobacterium avium
IGGQE

SEQ ID NO: 8496 - protein, 5 aa, Mycobacterium avium
IGGRG

SEQ ID NO: 8497 - protein, 18 aa, Mycobacterium avium
IGNGRAKGYQVAGDDGLA

SEQ ID NO: 8498 - protein, 6 aa, Mycobacterium avium
IGPATA

SEQ ID NO: 8499 - protein, 11 aa, Mycobacterium avium
IGPEPDSAQDA

SEQ ID NO: 8500 - protein, 4 aa, Mycobacterium avium
IGRD

SEQ ID NO: 8501 - protein, 6 aa, Mycobacterium avium
IKSLSD

SEQ ID NO: 8502 - protein, 9 aa, Mycobacterium avium
INDQTDDLN

SEQ ID NO: 8503 - protein, 5 aa, Mycobacterium avium
INSPG

SEQ ID NO: 8504 - protein, 8 aa, Mycobacterium avium
INSRGESL

SEQ ID NO: 8505 - protein, 4 aa, Mycobacterium avium
IPHD

SEQ ID NO: 8506 - protein, 6 aa, Mycobacterium avium
IPKDKL

SEQ ID NO: 8507 - protein, 5 aa, Mycobacterium avium
IPNAA

SEQ ID NO: 8508 - protein, 20 aa, Mycobacterium avium
IPSQGARQARDASARPPRGA

SEQ ID NO: 8509 - protein, 4 aa, Mycobacterium avium
IPVA

SEQ ID NO: 8510 - protein, 8 aa, Mycobacterium avium
IQAGPGIR

SEQ ID NO: 8511 - protein, 5 aa, Mycobacterium avium
IQRQT

SEQ ID NO: 8512 - protein, 6 aa, Mycobacterium avium
IQRQTQ

SEQ ID NO: 8513 - protein, 7 aa, Mycobacterium avium
IQSASTG

SEQ ID NO: 8514 - protein, 11 aa, Mycobacterium avium
IQSGPRIPQSQ

SEQ ID NO: 8515 - protein, 20 aa, Mycobacterium avium
IRGPASRLSRPLTEDEPVPS

SEQ ID NO: 8516 - protein, 11 aa, Mycobacterium avium
IRSGAGSNTVH

SEQ ID NO: 8517 - protein, 7 aa, Mycobacterium avium
IRSGGSF

SEQ ID NO: 8518 - protein, 12 aa, Mycobacterium avium
IRTQAAAQRAAA

SEQ ID NO: 8519 - protein, 14 aa, Mycobacterium avium
ISAPEEDELAGPPR

SEQ ID NO: 8520 - protein, 10 aa, Mycobacterium avium
ISQAEPTARA

SEQ ID NO: 8521 - protein, 13 aa, Mycobacterium avium
ISTNDATCGSAPC

SEQ ID NO: 8522 - protein, 11 aa, Mycobacterium avium
ITAPSSGRVTV

SEQ ID NO: 8523 - protein, 20 aa, Mycobacterium avium
ITARGGTGQISADPSRPKRN

SEQ ID NO: 8524 - protein, 6 aa, Mycobacterium avium
ITETGT

SEQ ID NO: 8525 - protein, 4 aa, Mycobacterium avium
ITGE

SEQ ID NO: 8526 - protein, 23 aa, Mycobacterium avium
ITGNPGDHPCGSPGAASSGPGCY

SEQ ID NO: 8527 - protein, 4 aa, Mycobacterium avium
ITPD

SEQ ID NO: 8528 - protein, 4 aa, Mycobacterium avium
ITPG

SEQ ID NO: 8529 - protein, 5 aa, Mycobacterium avium
ITRGQ

SEQ ID NO: 8530 - protein, 10 aa, Mycobacterium avium
ITRPAGQRLD

SEQ ID NO: 8531 - protein, 9 aa, Mycobacterium avium
ITSGESVSN

SEQ ID NO: 8532 - protein, 14 aa, Mycobacterium avium
ITSRDNASDESRRQ

SEQ ID NO: 8533 - protein, 6 aa, Mycobacterium avium
ITTPGP

SEQ ID NO: 8534 - protein, 7 aa, Mycobacterium avium
ITTPGPV

SEQ ID NO: 8535 - protein, 9 aa, Mycobacterium avium
KAAGEQAQQ

SEQ ID NO: 8536 - protein, 4 aa, Mycobacterium avium
KAAP

SEQ ID NO: 8537 - protein, 6 aa, Mycobacterium avium
KADAGL

SEQ ID NO: 8538 - protein, 22 aa, Mycobacterium avium
KADAGRRGSGAGRRRATRPVAG

SEQ ID NO: 8539 - protein, 19 aa, Mycobacterium avium
KAGGDTSPLGARKGDVYPV

SEQ ID NO: 8540 - protein, 4 aa, Mycobacterium avium
KAGL

SEQ ID NO: 8541 - protein, 11 aa, Mycobacterium avium
KAGNATLDNPV

SEQ ID NO: 8542 - protein, 4 aa, Mycobacterium avium
KAPE

SEQ ID NO: 8543 - protein, 5 aa, Mycobacterium avium
KAQQP

SEQ ID NO: 8544 - protein, 12 aa, Mycobacterium avium
KAQSKSVGTITE

SEQ ID NO: 8545 - protein, 58 aa, Mycobacterium avium
KASLPEKGTAAKEAEKRAAQAPKATATVEAPAKETTKEPAEAAPKAEAAPAAPAAPVK

SEQ ID NO: 8546 - protein, 58 aa, Mycobacterium avium
KATLPEKGTAAKEAEKQAAQAPKATATVEAPAKETTKEPAEAAPKAEAAPAAPAAPVK

SEQ ID NO: 8547 - protein, 58 aa, Mycobacterium avium
KATLPEKGTAAKEAEKRAAQAPKATATVEAPAKETTKEPAEAAPKAEAAPAAPAAPVK

SEQ ID NO: 8548 - protein, 13 aa, Mycobacterium avium
KAVGPAAPKSTLA

SEQ ID NO: 8549 - protein, 19 aa, Mycobacterium avium
KDERSADGVRAQTFCIVKS

SEQ ID NO: 8550 - protein, 7 aa, Mycobacterium avium
KDTGPAA

SEQ ID NO: 8551 - protein, 5 aa, Mycobacterium avium
KEAEE

SEQ ID NO: 8552 - protein, 74 aa, Mycobacterium avium
KEDEAKKQEAIQRRAANAPAPGAKPKRNLKAGAGNGVDADAAQPDAGATEGQAGGGSDAPSRTPRPGARPKKRK

SEQ ID NO: 8553 - protein, 14 aa, Mycobacterium avium
KEPPPPLPAELPPN

SEQ ID NO: 8554 - protein, 6 aa, Mycobacterium avium
KEYDSD

SEQ ID NO: 8555 - protein, 7 aa, Mycobacterium avium
KFQPPSA

SEQ ID NO: 8556 - protein, 8 aa, Mycobacterium avium
KGAPVRPA

SEQ ID NO: 8557 - protein, 14 aa, Mycobacterium avium
KGAQTPPAAQNPAD

SEQ ID NO: 8558 - protein, 6 aa, Mycobacterium avium
KGDGDQ

SEQ ID NO: 8559 - protein, 39 aa, Mycobacterium avium
KGDPNATYSGQDVPQYRPGEEPPGQVPPPSPPGPAPPPI

SEQ ID NO: 8560 - protein, 8 aa, Mycobacterium avium
KGEAGADS

SEQ ID NO: 8561 - protein, 9 aa, Mycobacterium avium
KGEAGADSF

SEQ ID NO: 8562 - protein, 10 aa, Mycobacterium avium
KGEPMSPAEV

SEQ ID NO: 8563 - protein, 66 aa, Mycobacterium avium
KGETPNGDGSAERAGVRRATPPAPGGRAPEAGDGPPWQRGSTRPQQPPPRQNEPPTEKRPGGGAEA

SEQ ID NO: 8564 - protein, 6 aa, Mycobacterium avium
KGGMEL

SEQ ID NO: 8565 - protein, 8 aa, Mycobacterium avium
KGGPYLAR

SEQ ID NO: 8566 - protein, 8 aa, Mycobacterium avium
KGKPGGVR

SEQ ID NO: 8567 - protein, 6 aa, Mycobacterium avium
KGKTGL

SEQ ID NO: 8568 - protein, 16 aa, Mycobacterium avium
KGLSATGSFTSTGAGA

SEQ ID NO: 8569 - protein, 30 aa, Mycobacterium avium
KGPEVTDRPMESAASSAGPGTGSGAPRPVA

SEQ ID NO: 8570 - protein, 19 aa, Mycobacterium avium
KGQPPQQPTNEERPADKAT

SEQ ID NO: 8571 - protein, 4 aa, Mycobacterium avium
KGVP

SEQ ID NO: 8572 - protein, 31 aa, Mycobacterium avium
KHPDDRYGSAGALGRAAKRALAPDPATSAGI

SEQ ID NO: 8573 - protein, 10 aa, Mycobacterium avium
KIDGRDGSIH

SEQ ID NO: 8574 - protein, 4 aa, Mycobacterium avium
KIGP

SEQ ID NO: 8575 - protein, 9 aa, Mycobacterium avium
KIPASSPVR

SEQ ID NO: 8576 - protein, 7 aa, Mycobacterium avium
KIQAAGA

SEQ ID NO: 8577 - protein, 99 aa, Mycobacterium avium
KKAAQKARGQAAKSPATSPAKTPAKSPAKRPAKKSAAKKTAATSAAKTRAKKTAAEPKSRTTPAAPNPEAAASHNGEVSPSRAADPIGADPPEAPPRGR

SEQ ID NO: 8578 - protein, 99 aa, Mycobacterium avium
KKAAQKARGRAAKSPATSPAKPPAKSPAKRPAKKSAAKKTAATSAAKTRAKKTVVEPKSRTTPAAPNPEVAASHNGEVSPSRAADPIGAEPPEAPPRGR

SEQ ID NO: 8579 - protein, 95 aa, Mycobacterium avium
KKAAQKARSRAAKSPATSPAKTPAKSPAKRPAKKSAAKKTAATAAAKTRAKKTAAKPNPAAPNPEAAASHNGEVSPSRATDPIGADPPEAPPRGR

SEQ ID NO: 8580 - protein, 15 aa, Mycobacterium avium
KKAGPTGAGDTVRVT

SEQ ID NO: 8581 - protein, 7 aa, Mycobacterium avium
KKLDPRS

SEQ ID NO: 8582 - protein, 7 aa, Mycobacterium avium
KKQDDVE

SEQ ID NO: 8583 - protein, 5 aa, Mycobacterium avium
KLAGA

SEQ ID NO: 8584 - protein, 8 aa, Mycobacterium avium
KLKGESKM

SEQ ID NO: 8585 - protein, 6 aa, Mycobacterium avium
KLPPSI

SEQ ID NO: 8586 - protein, 14 aa, Mycobacterium avium
KNAAKEAIKGTPLE

SEQ ID NO: 8587 - protein, 6 aa, Mycobacterium avium
KNAGLS

SEQ ID NO: 8588 - protein, 7 aa, Mycobacterium avium
KNPWNPL

SEQ ID NO: 8589 - protein, 10 aa, Mycobacterium avium
KPAKAASSSV

SEQ ID NO: 8590 - protein, 4 aa, Mycobacterium avium
KPCS

SEQ ID NO: 8591 - protein, 21 aa, Mycobacterium avium
KPDTAAETEPADDAGDDVENA

SEQ ID NO: 8592 - protein, 5 aa, Mycobacterium avium
KPEIF

SEQ ID NO: 8593 - protein, 9 aa, Mycobacterium avium
KPGDLRTNQ

SEQ ID NO: 8594 - protein, 9 aa, Mycobacterium avium
KPGDPASAP

SEQ ID NO: 8595 - protein, 10 aa, Mycobacterium avium
KPGDPASAPV

SEQ ID NO: 8596 - protein, 9 aa, Mycobacterium avium
KPGDSASAP

SEQ ID NO: 8597 - protein, 8 aa, Mycobacterium avium
KPGKRAPT

SEQ ID NO: 8598 - protein, 4 aa, Mycobacterium avium
KPGL

SEQ ID NO: 8599 - protein, 14 aa, Mycobacterium avium
KPLLDSQTQSADSV

SEQ ID NO: 8600 - protein, 5 aa, Mycobacterium avium
KPMSP

SEQ ID NO: 8601 - protein, 5 aa, Mycobacterium avium
KPPIR

SEQ ID NO: 8602 - protein, 6 aa, Mycobacterium avium
KPPPAG

SEQ ID NO: 8603 - protein, 8 aa, Mycobacterium avium
KPPQMPWP

SEQ ID NO: 8604 - protein, 4 aa, Mycobacterium avium
KPVP

SEQ ID NO: 8605 - protein, 13 aa, Mycobacterium avium
KPVSSTGKPDPQK

SEQ ID NO: 8606 - protein, 6 aa, Mycobacterium avium
KQKWPE

SEQ ID NO: 8607 - protein, 32 aa, Mycobacterium avium
KQLPTAPDSTPVFPTPPLPAKALAAASKEKAR

SEQ ID NO: 8608 - protein, 18 aa, Mycobacterium avium
KQRSARFGSAGELARAAS

SEQ ID NO: 8609 - protein, 17 aa, Mycobacterium avium
KQSAKAAERSADEAARA

SEQ ID NO: 8610 - protein, 7 aa, Mycobacterium avium
KRAGASA

SEQ ID NO: 8611 - protein, 6 aa, Mycobacterium avium
KREGGQ

SEQ ID NO: 8612 - protein, 13 aa, Mycobacterium avium
KRGTHDPPARPWR

SEQ ID NO: 8613 - protein, 14 aa, Mycobacterium avium
KRPGTPAAELDGQI

SEQ ID NO: 8614 - protein, 7 aa, Mycobacterium avium
KRPLESY

SEQ ID NO: 8615 - protein, 4 aa, Mycobacterium avium
KRRG

SEQ ID NO: 8616 - protein, 7 aa, Mycobacterium avium
KRRGATT

SEQ ID NO: 8617 - protein, 8 aa, Mycobacterium avium
KRTTADEL

SEQ ID NO: 8618 - protein, 26 aa, Mycobacterium avium
KRTTVSVDESGHVQRTKGAPASPTAN

SEQ ID NO: 8619 - protein, 8 aa, Mycobacterium avium
KRVPEGTQ

SEQ ID NO: 8620 - protein, 8 aa, Mycobacterium avium
KSAAGQRA

SEQ ID NO: 8621 - protein, 6 aa, Mycobacterium avium
KSAVHP

SEQ ID NO: 8622 - protein, 13 aa, Mycobacterium avium
KSGTSKDKAAEAA

SEQ ID NO: 8623 - protein, 6 aa, Mycobacterium avium
KSIRDT

SEQ ID NO: 8624 - protein, 5 aa, Mycobacterium avium
KSLSD

SEQ ID NO: 8625 - protein, 15 aa, Mycobacterium avium
KSSTPESIPTTDRNT

SEQ ID NO: 8626 - protein, 13 aa, Mycobacterium avium
KSVRRSAPDSGAV

SEQ ID NO: 8627 - protein, 13 aa, Mycobacterium avium
KSVRRSVPDSGAV

SEQ ID NO: 8628 - protein, 23 aa, Mycobacterium avium
KTAADNRKAAEQFEAAQADYEEA

SEQ ID NO: 8629 - protein, 15 aa, Mycobacterium avium
KTAAEEALKGTPLEN

SEQ ID NO: 8630 - protein, 12 aa, Mycobacterium avium
KTLTPEEIAKEQ

SEQ ID NO: 8631 - protein, 16 aa, Mycobacterium avium
KTSSFSNDVAGKNKAI

SEQ ID NO: 8632 - protein, 16 aa, Mycobacterium avium
KVPEAGTARVDVGGPT

SEQ ID NO: 8633 - protein, 6 aa, Mycobacterium avium
KYGPQS

SEQ ID NO: 8634 - protein, 9 aa, Mycobacterium avium
KYGSEHGDP

SEQ ID NO: 8635 - protein, 13 aa, Mycobacterium avium
LAAASRSSARPEH

SEQ ID NO: 8636 - protein, 12 aa, Mycobacterium avium
LAAPRPPTRSTV

SEQ ID NO: 8637 - protein, 5 aa, Mycobacterium avium
LAASG

SEQ ID NO: 8638 - protein, 6 aa, Mycobacterium avium
LAASPA

SEQ ID NO: 8639 - protein, 21 aa, Mycobacterium avium
LAATGARTGLGGDSRAPVVPE

SEQ ID NO: 8640 - protein, 21 aa, Mycobacterium avium
LAATGARTGLGGGSPAPVVPE

SEQ ID NO: 8641 - protein, 13 aa, Mycobacterium avium
LADGKDPQMPWPT

SEQ ID NO: 8642 - protein, 7 aa, Mycobacterium avium
LAEQSTV

SEQ ID NO: 8643 - protein, 8 aa, Mycobacterium avium
LAGGAPTI

SEQ ID NO: 8644 - protein, 24 aa, Mycobacterium avium
LAGGRPSAAKTGTTQLGDTTSNKD

SEQ ID NO: 8645 - protein, 11 aa, Mycobacterium avium
LAGPPSTPLRR

SEQ ID NO: 8646 - protein, 8 aa, Mycobacterium avium
LAGTEPST

SEQ ID NO: 8647 - protein, 11 aa, Mycobacterium avium
LAPASAAPSGL

SEQ ID NO: 8648 - protein, 21 aa, Mycobacterium avium
LAPDQKPGRVTAAAREAEGAP

SEQ ID NO: 8649 - protein, 10 aa, Mycobacterium avium
LAPDTSRSAR

SEQ ID NO: 8650 - protein, 5 aa, Mycobacterium avium
LAPGG

SEQ ID NO: 8651 - protein, 5 aa, Mycobacterium avium
LAPGT

SEQ ID NO: 8652 - protein, 6 aa, Mycobacterium avium
LAPIDP

SEQ ID NO: 8653 - protein, 79 aa, Mycobacterium avium
LAPPVAAPPPPAGRTPNWAAPPRRPQPAPRPGPPGQTMYGGRPPGGYPPAAPPPPPVAPAPAAPHTQMAPAASKPPEVA

SEQ ID NO: 8654 - protein, 17 aa, Mycobacterium avium
LAPQSDGTLRGTETETV

SEQ ID NO: 8655 - protein, 4 aa, Mycobacterium avium
LAPS

SEQ ID NO: 8656 - protein, 15 aa, Mycobacterium avium
LAQGDTGHPAPGSPD

SEQ ID NO: 8657 - protein, 8 aa, Mycobacterium avium
LAQTDPKK

SEQ ID NO: 8658 - protein, 11 aa, Mycobacterium avium
LAQTQQAVDGL

SEQ ID NO: 8659 - protein, 11 aa, Mycobacterium avium
LASPGPLPTGA

SEQ ID NO: 8660 - protein, 9 aa, Mycobacterium avium
LATGAAAGT

SEQ ID NO: 8661 - protein, 8 aa, Mycobacterium avium
LDADTAAK

SEQ ID NO: 8662 - protein, 12 aa, Mycobacterium avium
LDATAEEPEPAF

SEQ ID NO: 8663 - protein, 6 aa, Mycobacterium avium
LDDDGN

SEQ ID NO: 8664 - protein, 6 aa, Mycobacterium avium
LDDEGQ

SEQ ID NO: 8665 - protein, 5 aa, Mycobacterium avium
LDEEE

SEQ ID NO: 8666 - protein, 10 aa, Mycobacterium avium
LDEPNSSSIR

SEQ ID NO: 8667 - protein, 7 aa, Mycobacterium avium
LDERDGQ

SEQ ID NO: 8668 - protein, 8 aa, Mycobacterium avium
LDGQDPDM

SEQ ID NO: 8669 - protein, 6 aa, Mycobacterium avium
LDPDEP

SEQ ID NO: 8670 - protein, 8 aa, Mycobacterium avium
LDQGTTAS

SEQ ID NO: 8671 - protein, 5 aa, Mycobacterium avium
LDRFP

SEQ ID NO: 8672 - protein, 27 aa, Mycobacterium avium
LDSARTGSATLAAGATQLSDGINQATD

SEQ ID NO: 8673 - protein, 9 aa, Mycobacterium avium
LEGRGGGGV

SEQ ID NO: 8674 - protein, 10 aa, Mycobacterium avium
LEPSATTNAV

SEQ ID NO: 8675 - protein, 6 aa, Mycobacterium avium
LEQGTN

SEQ ID NO: 8676 - protein, 7 aa, Mycobacterium avium
LERDTKH

SEQ ID NO: 8677 - protein, 12 aa, Mycobacterium avium
LERGTELGGQER

SEQ ID NO: 8678 - protein, 4 aa, Mycobacterium avium
LERP

SEQ ID NO: 8679 - protein, 8 aa, Mycobacterium avium
LGADGRLP

SEQ ID NO: 8680 - protein, 8 aa, Mycobacterium avium
LGAGVASA

SEQ ID NO: 8681 - protein, 5 aa, Mycobacterium avium
LGDET

SEQ ID NO: 8682 - protein, 10 aa, Mycobacterium avium
LGDSGTIARL

SEQ ID NO: 8683 - protein, 10 aa, Mycobacterium avium
LGENSVTGIG

SEQ ID NO: 8684 - protein, 7 aa, Mycobacterium avium
LGERTEA

SEQ ID NO: 8685 - protein, 10 aa, Mycobacterium avium
LGERTKGRDW

SEQ ID NO: 8686 - protein, 8 aa, Mycobacterium avium
LGERTLTP

SEQ ID NO: 8687 - protein, 15 aa, Mycobacterium avium
LGGTAERHSEPGAGA

SEQ ID NO: 8688 - protein, 6 aa, Mycobacterium avium
LGHPAG

SEQ ID NO: 8689 - protein, 11 aa, Mycobacterium avium
LGKQQISPQGT

SEQ ID NO: 8690 - protein, 9 aa, Mycobacterium avium
LGLSGTVTT

SEQ ID NO: 8691 - protein, 8 aa, Mycobacterium avium
LGNGKADY

SEQ ID NO: 8692 - protein, 7 aa, Mycobacterium avium
LGNPENL

SEQ ID NO: 8693 - protein, 10 aa, Mycobacterium avium
LGPGHPSPVP

SEQ ID NO: 8694 - protein, 8 aa, Mycobacterium avium
LGPSGRNR

SEQ ID NO: 8695 - protein, 5 aa, Mycobacterium avium
LGPTG

SEQ ID NO: 8696 - protein, 13 aa, Mycobacterium avium
LGQGNSEIPAPRP

SEQ ID NO: 8697 - protein, 4 aa, Mycobacterium avium
LGRA

SEQ ID NO: 8698 - protein, 28 aa, Mycobacterium avium
LGRRRRARRAARRRAAQANAAAPTTRIP

SEQ ID NO: 8699 - protein, 28 aa, Mycobacterium avium
LGRRRRARRSARRRAAQANAAAPTTRIP

SEQ ID NO: 8700 - protein, 6 aa, Mycobacterium avium
LGRSPS

SEQ ID NO: 8701 - protein, 4 aa, Mycobacterium avium
LGSD

SEQ ID NO: 8702 - protein, 17 aa, Mycobacterium avium
LGSNPDADEPSGSTDET

SEQ ID NO: 8703 - protein, 12 aa, Mycobacterium avium
LGSRVGSVESSS

SEQ ID NO: 8704 - protein, 7 aa, Mycobacterium avium
LGTPGVS

SEQ ID NO: 8705 - protein, 6 aa, Mycobacterium avium
LGTPTA

SEQ ID NO: 8706 - protein, 4 aa, Mycobacterium avium
LHPD

SEQ ID NO: 8707 - protein, 54 aa, Mycobacterium avium
LHPDSDGDTTEESAQRRRTRRSGSSSRTRRTARSTRSSASSSRTRSRHARPPLD

SEQ ID NO: 8708 - protein, 176 aa, Mycobacterium avium
LHPDSDGDTTEESAQRRRTRRSGSSSRTRRTARSTRSSASSSRTRSRHARPPLDDAAEPAERPERPRRAARRSAAARNYDTAGRNYDAAEPPRRTRRRPRPDADPELRGQPPREPRREPRPRRSPYERPVPRSSRFDGYDPPSGPENLGRYDTPEPPYEPRRRRPASTGANGTHHP

SEQ ID NO: 8709 - protein, 181 aa, Mycobacterium avium
LHPDSDGDTTEESAQRRRTRRSGSSSRTRRTARSTRSSASSSRTRSRHARPPLDDAAEPAERPERQRRATRRSAASARNYDTAGRNYDAAEPPRRTRRRPRPDADPELRGQTPREPRREPRPRRSPYERPVPRSSRFDGYDPPSGPENLGRYDSRYDTPEPPYEPRRRRPASTGANGTHHP

SEQ ID NO: 8710 - protein, 7 aa, Mycobacterium avium
LKDNQHN

SEQ ID NO: 8711 - protein, 21 aa, Mycobacterium avium
LKKGGAEAPGGEAARIPETAA

SEQ ID NO: 8712 - protein, 4 aa, Mycobacterium avium
LNGG

SEQ ID NO: 8713 - protein, 23 aa, Mycobacterium avium
LPAAPPPAAPPLPEAPPIPAAPP

SEQ ID NO: 8714 - protein, 8 aa, Mycobacterium avium
LPAATTLP

SEQ ID NO: 8715 - protein, 8 aa, Mycobacterium avium
LPAERESG

SEQ ID NO: 8716 - protein, 21 aa, Mycobacterium avium
LPAGISKAQAVAAARSRGQNT

SEQ ID NO: 8717 - protein, 5 aa, Mycobacterium avium
LPAGQ

SEQ ID NO: 8718 - protein, 17 aa, Mycobacterium avium
LPAGTGKWSPDSGETVA

SEQ ID NO: 8719 - protein, 13 aa, Mycobacterium avium
LPANATAKIGQTS

SEQ ID NO: 8720 - protein, 7 aa, Mycobacterium avium
LPAPTTL

SEQ ID NO: 8721 - protein, 5 aa, Mycobacterium avium
LPAQA

SEQ ID NO: 8722 - protein, 10 aa, Mycobacterium avium
LPARSGHKQV

SEQ ID NO: 8723 - protein, 8 aa, Mycobacterium avium
LPDPRSAR

SEQ ID NO: 8724 - protein, 4 aa, Mycobacterium avium
LPDS

SEQ ID NO: 8725 - protein, 11 aa, Mycobacterium avium
LPEDQQTAIRG

SEQ ID NO: 8726 - protein, 18 aa, Mycobacterium avium
LPEETPQEAPAAPRNSSP

SEQ ID NO: 8727 - protein, 38 aa, Mycobacterium avium
LPEETPQEAPAAPRNSSPSRPLAPAGRAELPPRRAQQD

SEQ ID NO: 8728 - protein, 35 aa, Mycobacterium avium
LPEPETPAAPAAEAPAPEAPESPEAPAPEAPAPEI

SEQ ID NO: 8729 - protein, 24 aa, Mycobacterium avium
LPEPPRRPRMPGSPPTGPLPPVPA

SEQ ID NO: 8730 - protein, 5 aa, Mycobacterium avium
LPETV

SEQ ID NO: 8731 - protein, 78 aa, Mycobacterium avium
LPFPGAGSTPGGSGGGHLPTPGAGTPGGGLGGFGGGHAPAPGGGLGGGGGHAPAPGGGLGGFGGGHSGGGLGGLGGGH

SEQ ID NO: 8732 - protein, 11 aa, Mycobacterium avium
LPGGSGRATPV

SEQ ID NO: 8733 - protein, 9 aa, Mycobacterium avium
LPGPHYETP

SEQ ID NO: 8734 - protein, 10 aa, Mycobacterium avium
LPGPKPLGVP

SEQ ID NO: 8735 - protein, 9 aa, Mycobacterium avium
LPGQPASEV

SEQ ID NO: 8736 - protein, 6 aa, Mycobacterium avium
LPGTPV

SEQ ID NO: 8737 - protein, 4 aa, Mycobacterium avium
LPND

SEQ ID NO: 8738 - protein, 9 aa, Mycobacterium avium
LPNVEPGGD

SEQ ID NO: 8739 - protein, 13 aa, Mycobacterium avium
LPPAGSAPPPAVR

SEQ ID NO: 8740 - protein, 6 aa, Mycobacterium avium
LPPDTP

SEQ ID NO: 8741 - protein, 5 aa, Mycobacterium avium
LPPGA

SEQ ID NO: 8742 - protein, 6 aa, Mycobacterium avium
LPPGAR

SEQ ID NO: 8743 - protein, 5 aa, Mycobacterium avium
LPPGG

SEQ ID NO: 8744 - protein, 22 aa, Mycobacterium avium
LPPGGDPHAPGMAPPPGEPKSP

SEQ ID NO: 8745 - protein, 24 aa, Mycobacterium avium
LPPGGDPHAPGMAPPPGEPKSPRG

SEQ ID NO: 8746 - protein, 22 aa, Mycobacterium avium
LPPGGDPHTPGMAPPPGEPKSP

SEQ ID NO: 8747 - protein, 21 aa, Mycobacterium avium
LPPGGPGGGPGAGTPKTTVTF

SEQ ID NO: 8748 - protein, 18 aa, Mycobacterium avium
LPPGWKPGSQAAAPPKLP

SEQ ID NO: 8749 - protein, 4 aa, Mycobacterium avium
LPPM

SEQ ID NO: 8750 - protein, 11 aa, Mycobacterium avium
LPPPGSAARPA

SEQ ID NO: 8751 - protein, 113 aa, Mycobacterium avium
LPPPPPKPIKAKKPKKRRLRRKKAGEEAETAETAEAEEAEAEEADETEAAQTVTAETEAAEEAGETEAAEDTAEAEKPAATEPEAETPVAEDSDESRAKLRNRRPTGKGTHRM

SEQ ID NO: 8752 - protein, 8 aa, Mycobacterium avium
LPQPPEGS

SEQ ID NO: 8753 - protein, 14 aa, Mycobacterium avium
LPQRGPGSLAPMGP

SEQ ID NO: 8754 - protein, 8 aa, Mycobacterium avium
LPSERESG

SEQ ID NO: 8755 - protein, 4 aa, Mycobacterium avium
LPSP

SEQ ID NO: 8756 - protein, 8 aa, Mycobacterium avium
LPTDPGAG

SEQ ID NO: 8757 - protein, 4 aa, Mycobacterium avium
LPTQ

SEQ ID NO: 8758 - protein, 5 aa, Mycobacterium avium
LPTQD

SEQ ID NO: 8759 - protein, 7 aa, Mycobacterium avium
LQDGRRR

SEQ ID NO: 8760 - protein, 4 aa, Mycobacterium avium
LQPD

SEQ ID NO: 8761 - protein, 39 aa, Mycobacterium avium
LQQPPATVTYTPTPTSTPTPPPPPPPVTTTTTTTTTPPF

SEQ ID NO: 8762 - protein, 5 aa, Mycobacterium avium
LQRGQ

SEQ ID NO: 8763 - protein, 6 aa, Mycobacterium avium
LQRGQE

SEQ ID NO: 8764 - protein, 10 aa, Mycobacterium avium
LQRSSRDVTT

SEQ ID NO: 8765 - protein, 12 aa, Mycobacterium avium
LRAANGGSLDNP

SEQ ID NO: 8766 - protein, 6 aa, Mycobacterium avium
LRADAA

SEQ ID NO: 8767 - protein, 37 aa, Mycobacterium avium
LRDADSALAAGHPATAAAHAESARRHSAALPAGSPAS

SEQ ID NO: 8768 - protein, 25 aa, Mycobacterium avium
LRGPRPLDPPPAPPKPGPDAFSGVA

SEQ ID NO: 8769 - protein, 26 aa, Mycobacterium avium
LRGPRPLDPPPPTPPKPGPDAFSGVA

SEQ ID NO: 8770 - protein, 7 aa, Mycobacterium avium
LRPGAAL

SEQ ID NO: 8771 - protein, 19 aa, Mycobacterium avium
LRPNQTPHSRRARRRQQAR

SEQ ID NO: 8772 - protein, 7 aa, Mycobacterium avium
LRQRTDA

SEQ ID NO: 8773 - protein, 14 aa, Mycobacterium avium
LSAAAAANTKHDIA

SEQ ID NO: 8774 - protein, 17 aa, Mycobacterium avium
LSAEDARKAVADLIDAH

SEQ ID NO: 8775 - protein, 14 aa, Mycobacterium avium
LSAPGAAALDPSTT

SEQ ID NO: 8776 - protein, 53 aa, Mycobacterium avium
LSARGSASSRARRKSEEPAPDDLDAPAAAAAAAAGSKKARARRRRRGTATDRA

SEQ ID NO: 8777 - protein, 53 aa, Mycobacterium avium
LSARGSASSRSRRKSEEPAPDDLDAPAAAAAAAAGSKKARARRRRRGTATDRA

SEQ ID NO: 8778 - protein, 20 aa, Mycobacterium avium
LSASPDGVQVGPRAGYAKGQ

SEQ ID NO: 8779 - protein, 6 aa, Mycobacterium avium
LSDKDS

SEQ ID NO: 8780 - protein, 8 aa, Mycobacterium avium
LSDPVSDD

SEQ ID NO: 8781 - protein, 13 aa, Mycobacterium avium
LSEDGKGGPPNNG

SEQ ID NO: 8782 - protein, 10 aa, Mycobacterium avium
LSERADGPIT

SEQ ID NO: 8783 - protein, 25 aa, Mycobacterium avium
LSGGGYQNLATSASPDLATAVNAFL

SEQ ID NO: 8784 - protein, 16 aa, Mycobacterium avium
LSGNDTLKTVTDQRRD

SEQ ID NO: 8785 - protein, 38 aa, Mycobacterium avium
LSPAPPPGTGASPPPHPAAPPAPPPQHPQRPRDGSQDT

SEQ ID NO: 8786 - protein, 7 aa, Mycobacterium avium
LSPDAVS

SEQ ID NO: 8787 - protein, 32 aa, Mycobacterium avium
LSPDDVTGGGALSDCSDGSAELQRCGPAPALT

SEQ ID NO: 8788 - protein, 8 aa, Mycobacterium avium
LSPEARRR

SEQ ID NO: 8789 - protein, 6 aa, Mycobacterium avium
LSPGAT

SEQ ID NO: 8790 - protein, 9 aa, Mycobacterium avium
LSPPTGPSV

SEQ ID NO: 8791 - protein, 18 aa, Mycobacterium avium
LSPRPATAPAGGPEPGEA

SEQ ID NO: 8792 - protein, 18 aa, Mycobacterium avium
LSPRPATATAGGPEPGEA

SEQ ID NO: 8793 - protein, 7 aa, Mycobacterium avium
LSQYTRG

SEQ ID NO: 8794 - protein, 8 aa, Mycobacterium avium
LSSEAVTK

SEQ ID NO: 8795 - protein, 6 aa, Mycobacterium avium
LSSPIG

SEQ ID NO: 8796 - protein, 7 aa, Mycobacterium avium
LSSPIGE

SEQ ID NO: 8797 - protein, 8 aa, Mycobacterium avium
LSSSATVA

SEQ ID NO: 8798 - protein, 8 aa, Mycobacterium avium
LSSSATVG

SEQ ID NO: 8799 - protein, 5 aa, Mycobacterium avium
LSTTT

SEQ ID NO: 8800 - protein, 5 aa, Mycobacterium avium
LTASQ

SEQ ID NO: 8801 - protein, 16 aa, Mycobacterium avium
LTDAPVDGLDDAGQRL

SEQ ID NO: 8802 - protein, 13 aa, Mycobacterium avium
LTENNSELPAPRP

SEQ ID NO: 8803 - protein, 5 aa, Mycobacterium avium
LTGDP

SEQ ID NO: 8804 - protein, 6 aa, Mycobacterium avium
LTGDPK

SEQ ID NO: 8805 - protein, 11 aa, Mycobacterium avium
LTGDSTLSRQT

SEQ ID NO: 8806 - protein, 11 aa, Mycobacterium avium
LTGESTLSRQT

SEQ ID NO: 8807 - protein, 30 aa, Mycobacterium avium
LTGTSFRSDPDLRRGRAAGPPSPRRPPGAV

SEQ ID NO: 8808 - protein, 7 aa, Mycobacterium avium
LTPGQRR

SEQ ID NO: 8809 - protein, 12 aa, Mycobacterium avium
LTPNDPRFQPGF

SEQ ID NO: 8810 - protein, 21 aa, Mycobacterium avium
LTRDGSSEGPGVPMMPSTWDR

SEQ ID NO: 8811 - protein, 14 aa, Mycobacterium avium
LTRQDSSTLPPTTE

SEQ ID NO: 8812 - protein, 9 aa, Mycobacterium avium
LTSDDESEW

SEQ ID NO: 8813 - protein, 18 aa, Mycobacterium avium
LTSSGARDALTSTAQTQL

SEQ ID NO: 8814 - protein, 6 aa, Mycobacterium avium
LVGSAT

SEQ ID NO: 8815 - protein, 13 aa, Mycobacterium avium
MAEREPELRKQAG

SEQ ID NO: 8816 - protein, 12 aa, Mycobacterium avium
MAEREPELRRQA

SEQ ID NO: 8817 - protein, 4 aa, Mycobacterium avium
MAPI

SEQ ID NO: 8818 - protein, 11 aa, Mycobacterium avium
MAQGSSAADDN

SEQ ID NO: 8819 - protein, 12 aa, Mycobacterium avium
MDSNNKDATAMG

SEQ ID NO: 8820 - protein, 9 aa, Mycobacterium avium
MGHKKDSLE

SEQ ID NO: 8821 - protein, 9 aa, Mycobacterium avium
MGQETGGAE

SEQ ID NO: 8822 - protein, 23 aa, Mycobacterium avium
MHPVTGKRGLPVDPSTVPRPAMT

SEQ ID NO: 8823 - protein, 112 aa, Mycobacterium avium
MPAQSGEPKPAPRQPAQPAPGQPAPGQPAPAPGQPAPAPGQPAPGQPVPAPAQPGAAPAQPRPYPQDPPPSPSPAPAPAPAPGPAPAPAPAPSPGEAPPGEQPAPPDPRKDL

SEQ ID NO: 8824 - protein, 113 aa, Mycobacterium avium
MPAQSGEPKPAPRQPAQPAPGQPAPGQPAPGQPAPGQPAPGQPAPGQPAPAPAQPGAAPAQPRPYPQDPPPSPSPAPAPAPAPGPAPAPAPAPAPGEAPPGEQPAPPDPRKDL

SEQ ID NO: 8825 - protein, 9 aa, Mycobacterium avium
MPGTATGPA

SEQ ID NO: 8826 - protein, 30 aa, Mycobacterium avium
MPPRPQQPAPLRRERPRYQEPPGPTEPRFE

SEQ ID NO: 8827 - protein, 30 aa, Mycobacterium avium
MPPRPQQPAPPRRERPRYQEPPGPTEPRFE

SEQ ID NO: 8828 - protein, 10 aa, Mycobacterium avium
MPTSSTPVDL

SEQ ID NO: 8829 - protein, 8 aa, Mycobacterium avium
MQGQQVGP

SEQ ID NO: 8830 - protein, 6 aa, Mycobacterium avium
MQSPMP

SEQ ID NO: 8831 - protein, 25 aa, Mycobacterium avium
MRESGAATPAGLTALGGGSFGGGSK

SEQ ID NO: 8832 - protein, 12 aa, Mycobacterium avium
MSGGSGMSGGNP

SEQ ID NO: 8833 - protein, 15 aa, Mycobacterium avium
MSGSAASPSEQARQL

SEQ ID NO: 8834 - protein, 11 aa, Mycobacterium avium
MSLGSSPLAPV

SEQ ID NO: 8835 - protein, 8 aa, Mycobacterium avium
MSPPGATW

SEQ ID NO: 8836 - protein, 7 aa, Mycobacterium avium
NAAAHGN

SEQ ID NO: 8837 - protein, 12 aa, Mycobacterium avium
NAAGGAVSTQAG

SEQ ID NO: 8838 - protein, 12 aa, Mycobacterium avium
NAARCGAGDADR

SEQ ID NO: 8839 - protein, 33 aa, Mycobacterium avium
NAASTLAAEAQSLANGDVQAARRAYPRGGGGDM

SEQ ID NO: 8840 - protein, 7 aa, Mycobacterium avium
NADRLND

SEQ ID NO: 8841 - protein, 11 aa, Mycobacterium avium
NAFSTDPSNLA

SEQ ID NO: 8842 - protein, 7 aa, Mycobacterium avium
NAGLGEV

SEQ ID NO: 8843 - protein, 9 aa, Mycobacterium avium
NAGPGTNGS

SEQ ID NO: 8844 - protein, 12 aa, Mycobacterium avium
NAPQRVTAGPAG

SEQ ID NO: 8845 - protein, 9 aa, Mycobacterium avium
NASDVSQRR

SEQ ID NO: 8846 - protein, 13 aa, Mycobacterium avium
NASPTAAAPAPPV

SEQ ID NO: 8847 - protein, 5 aa, Mycobacterium avium
NATEA

SEQ ID NO: 8848 - protein, 4 aa, Mycobacterium avium
NAVD

SEQ ID NO: 8849 - protein, 5 aa, Mycobacterium avium
NAYDR

SEQ ID NO: 8850 - protein, 13 aa, Mycobacterium avium
NAYEYEHGSREAA

SEQ ID NO: 8851 - protein, 4 aa, Mycobacterium avium
NCDS

SEQ ID NO: 8852 - protein, 4 aa, Mycobacterium avium
NCGS

SEQ ID NO: 8853 - protein, 10 aa, Mycobacterium avium
NDEAAEAERM

SEQ ID NO: 8854 - protein, 8 aa, Mycobacterium avium
NDGEPASF

SEQ ID NO: 8855 - protein, 4 aa, Mycobacterium avium
NDLQ

SEQ ID NO: 8856 - protein, 9 aa, Mycobacterium avium
NDNAPGLTH

SEQ ID NO: 8857 - protein, 6 aa, Mycobacterium avium
NDPNMP

SEQ ID NO: 8858 - protein, 4 aa, Mycobacterium avium
NDRI

SEQ ID NO: 8859 - protein, 7 aa, Mycobacterium avium
NDTADEI

SEQ ID NO: 8860 - protein, 7 aa, Mycobacterium avium
NEAASGR

SEQ ID NO: 8861 - protein, 14 aa, Mycobacterium avium
NEAEHSAAGQNKTV

SEQ ID NO: 8862 - protein, 7 aa, Mycobacterium avium
NEEGRPR

SEQ ID NO: 8863 - protein, 17 aa, Mycobacterium avium
NESPPDRSGDTEPPERA

SEQ ID NO: 8864 - protein, 5 aa, Mycobacterium avium
NFGPE

SEQ ID NO: 8865 - protein, 6 aa, Mycobacterium avium
NFTPKT

SEQ ID NO: 8866 - protein, 4 aa, Mycobacterium avium
NGAT

SEQ ID NO: 8867 - protein, 7 aa, Mycobacterium avium
NGESAKH

SEQ ID NO: 8868 - protein, 18 aa, Mycobacterium avium
NGGDDETGSRHRHRAASP

SEQ ID NO: 8869 - protein, 4 aa, Mycobacterium avium
NGGG

SEQ ID NO: 8870 - protein, 10 aa, Mycobacterium avium
NGHPDAGPAE

SEQ ID NO: 8871 - protein, 7 aa, Mycobacterium avium
NGIGIPE

SEQ ID NO: 8872 - protein, 8 aa, Mycobacterium avium
NGKGGQPV

SEQ ID NO: 8873 - protein, 23 aa, Mycobacterium avium
NGLHGGSAGLADMSGAADDMRAG

SEQ ID NO: 8874 - protein, 14 aa, Mycobacterium avium
NGNVVSDGPAPLDQ

SEQ ID NO: 8875 - protein, 6 aa, Mycobacterium avium
NGPTHS

SEQ ID NO: 8876 - protein, 7 aa, Mycobacterium avium
NGQIGDK

SEQ ID NO: 8877 - protein, 12 aa, Mycobacterium avium
NGTPDYGAPARL

SEQ ID NO: 8878 - protein, 13 aa, Mycobacterium avium
NGTPDYGAPARLD

SEQ ID NO: 8879 - protein, 10 aa, Mycobacterium avium
NIGKPDGPRI

SEQ ID NO: 8880 - protein, 4 aa, Mycobacterium avium
NINP

SEQ ID NO: 8881 - protein, 10 aa, Mycobacterium avium
NKGTRSDKIR

SEQ ID NO: 8882 - protein, 21 aa, Mycobacterium avium
NKQDSAGREGGETARQRARKK

SEQ ID NO: 8883 - protein, 12 aa, Mycobacterium avium
NLQGNSGRKLGD

SEQ ID NO: 8884 - protein, 5 aa, Mycobacterium avium
NMTGS

SEQ ID NO: 8885 - protein, 5 aa, Mycobacterium avium
NNAAA

SEQ ID NO: 8886 - protein, 6 aa, Mycobacterium avium
NNCGSV

SEQ ID NO: 8887 - protein, 4 aa, Mycobacterium avium
NNGR

SEQ ID NO: 8888 - protein, 82 aa, Mycobacterium avium
NNPPPPGPPGPPGPPGPPGPPGAPGAPGAVGPPGGPGAVGPPGGPGAVGPPGGPGAPGAPGPVGPPGGPGAPGAPGPAGPPG

SEQ ID NO: 8889 - protein, 91 aa, Mycobacterium avium
NNPPPPGPPGPPGPPGPPGPPGAPGAPGAVGPPGGPGAVGPPGGPGAVGPPGGPGAVGPPGGPGAPGAPGPVGPPGGPGAPGAPGPAGPPG

SEQ ID NO: 8890 - protein, 15 aa, Mycobacterium avium
NNWPAEPRVDNGPTA

SEQ ID NO: 8891 - protein, 4 aa, Mycobacterium avium
NNYI

SEQ ID NO: 8892 - protein, 19 aa, Mycobacterium avium
NPEAEASGIDEAEHAESGY

SEQ ID NO: 8893 - protein, 16 aa, Mycobacterium avium
NPGGTGGSGAAGGGSQ

SEQ ID NO: 8894 - protein, 16 aa, Mycobacterium avium
NPGKMTSQRPPRSTGR

SEQ ID NO: 8895 - protein, 8 aa, Mycobacterium avium
NPLKGRPV

SEQ ID NO: 8896 - protein, 25 aa, Mycobacterium avium
NPPPKSTGPAGSTASAPAQLGEQVS

SEQ ID NO: 8897 - protein, 6 aa, Mycobacterium avium
NPPVNA

SEQ ID NO: 8898 - protein, 93 aa, Mycobacterium avium
NPPYNPPYTPPYNPTTPYTPPTTTYEPPTTTYQPPTTTYQPPTTTYQPPTTTYQPPTTTHEPPTTTYQPPSTRATTEAPLPTHTQQTVPPTHS

SEQ ID NO: 8899 - protein, 5 aa, Mycobacterium avium
NPQDV

SEQ ID NO: 8900 - protein, 15 aa, Mycobacterium avium
NPQHNSPDRATQDGN

SEQ ID NO: 8901 - protein, 34 aa, Mycobacterium avium
NPVPTYETEPPPSGTEPARLPSTPTSAPQDATQQ

SEQ ID NO: 8902 - protein, 4 aa, Mycobacterium avium
NQGD

SEQ ID NO: 8903 - protein, 4 aa, Mycobacterium avium
NQSR

SEQ ID NO: 8904 - protein, 4 aa, Mycobacterium avium
NQVD

SEQ ID NO: 8905 - protein, 11 aa, Mycobacterium avium
NRDNLSKALPG

SEQ ID NO: 8906 - protein, 6 aa, Mycobacterium avium
NRDPLT

SEQ ID NO: 8907 - protein, 5 aa, Mycobacterium avium
NRDSV

SEQ ID NO: 8908 - protein, 5 aa, Mycobacterium avium
NRDTL

SEQ ID NO: 8909 - protein, 8 aa, Mycobacterium avium
NRDTLKPA

SEQ ID NO: 8910 - protein, 5 aa, Mycobacterium avium
NRHRA

SEQ ID NO: 8911 - protein, 10 aa, Mycobacterium avium
NRPGPIPSYD

SEQ ID NO: 8912 - protein, 8 aa, Mycobacterium avium
NRTAPPLP

SEQ ID NO: 8913 - protein, 7 aa, Mycobacterium avium
NRYDADT

SEQ ID NO: 8914 - protein, 9 aa, Mycobacterium avium
NSAATLPKE

SEQ ID NO: 8915 - protein, 10 aa, Mycobacterium avium
NSAMGTANGI

SEQ ID NO: 8916 - protein, 4 aa, Mycobacterium avium
NSDD

SEQ ID NO: 8917 - protein, 4 aa, Mycobacterium avium
NSDG

SEQ ID NO: 8918 - protein, 11 aa, Mycobacterium avium
NSDVPPRDAAE

SEQ ID NO: 8919 - protein, 10 aa, Mycobacterium avium
NSEEGGMDDN

SEQ ID NO: 8920 - protein, 4 aa, Mycobacterium avium
NSGF

SEQ ID NO: 8921 - protein, 5 aa, Mycobacterium avium
NSIAP

SEQ ID NO: 8922 - protein, 9 aa, Mycobacterium avium
NSPGSPGPL

SEQ ID NO: 8923 - protein, 4 aa, Mycobacterium avium
NSPT

SEQ ID NO: 8924 - protein, 15 aa, Mycobacterium avium
NSPTLVAGQTLIAPV

SEQ ID NO: 8925 - protein, 5 aa, Mycobacterium avium
NTAPT

SEQ ID NO: 8926 - protein, 6 aa, Mycobacterium avium
NTAPTA

SEQ ID NO: 8927 - protein, 11 aa, Mycobacterium avium
NTDKGRAAADR

SEQ ID NO: 8928 - protein, 4 aa, Mycobacterium avium
NTEW

SEQ ID NO: 8929 - protein, 4 aa, Mycobacterium avium
NTGG

SEQ ID NO: 8930 - protein, 13 aa, Mycobacterium avium
NTGPAAAAGIAPG

SEQ ID NO: 8931 - protein, 8 aa, Mycobacterium avium
NTGTDTAE

SEQ ID NO: 8932 - protein, 6 aa, Mycobacterium avium
NTGYDA

SEQ ID NO: 8933 - protein, 7 aa, Mycobacterium avium
NTLDEPE

SEQ ID NO: 8934 - protein, 11 aa, Mycobacterium avium
NTPDGKPLDPA

SEQ ID NO: 8935 - protein, 33 aa, Mycobacterium avium
NVPAAQAITPPSVDPGMVPPDGPPRPDQPMRRA

SEQ ID NO: 8936 - protein, 10 aa, Mycobacterium avium
NVPGATGDRV

SEQ ID NO: 8937 - protein, 8 aa, Mycobacterium avium
NYADDEKF

SEQ ID NO: 8938 - protein, 11 aa, Mycobacterium avium
NYTGTELPPTT

SEQ ID NO: 8939 - protein, 11 aa, Mycobacterium avium
PAAAGAQRSPA

SEQ ID NO: 8940 - protein, 22 aa, Mycobacterium avium
PAAALDGRGSFQDTSGANGSLD

SEQ ID NO: 8941 - protein, 15 aa, Mycobacterium avium
PAAASEPTEPAVPHT

SEQ ID NO: 8942 - protein, 14 aa, Mycobacterium avium
PAADTESRGGTAVA

SEQ ID NO: 8943 - protein, 21 aa, Mycobacterium avium
PAAGGGVLPDRPGRHPAAGRG

SEQ ID NO: 8944 - protein, 7 aa, Mycobacterium avium
PAAMARP

SEQ ID NO: 8945 - protein, 38 aa, Mycobacterium avium
PAAPPPAASIAPTPAAPPAPLSPAPASTPSPSPSAGKH

SEQ ID NO: 8946 - protein, 36 aa, Mycobacterium avium
PAAPPPAASIAPTPAAPPAPLSPAPASTPSPSPSVG

SEQ ID NO: 8947 - protein, 36 aa, Mycobacterium avium
PAAPPPAASIAPTPAAPPAPLSPAPVSTPSPSPSVG

SEQ ID NO: 8948 - protein, 9 aa, Mycobacterium avium
PADAGAAKA

SEQ ID NO: 8949 - protein, 7 aa, Mycobacterium avium
PADHVSP

SEQ ID NO: 8950 - protein, 7 aa, Mycobacterium avium
PADNSQR

SEQ ID NO: 8951 - protein, 8 aa, Mycobacterium avium
PADPATLL

SEQ ID NO: 8952 - protein, 7 aa, Mycobacterium avium
PADTDMP

SEQ ID NO: 8953 - protein, 5 aa, Mycobacterium avium
PAELR

SEQ ID NO: 8954 - protein, 9 aa, Mycobacterium avium
PAFTGEPAD

SEQ ID NO: 8955 - protein, 10 aa, Mycobacterium avium
PAGAQPPTKL

SEQ ID NO: 8956 - protein, 5 aa, Mycobacterium avium
PAGDL

SEQ ID NO: 8957 - protein, 9 aa, Mycobacterium avium
PAGLTPDNQ

SEQ ID NO: 8958 - protein, 7 aa, Mycobacterium avium
PAGSANL

SEQ ID NO: 8959 - protein, 8 aa, Mycobacterium avium
PAKGTVNG

SEQ ID NO: 8960 - protein, 27 aa, Mycobacterium avium
PAKKSDMRAGDDAERSDAEERRPTTVP

SEQ ID NO: 8961 - protein, 14 aa, Mycobacterium avium
PAKRRPARVVAEAT

SEQ ID NO: 8962 - protein, 14 aa, Mycobacterium avium
PAKRRPARVVAEET

SEQ ID NO: 8963 - protein, 4 aa, Mycobacterium avium
PALA

SEQ ID NO: 8964 - protein, 11 aa, Mycobacterium avium
PALGDSRSGPG

SEQ ID NO: 8965 - protein, 8 aa, Mycobacterium avium
PALPRDRG

SEQ ID NO: 8966 - protein, 5 aa, Mycobacterium avium
PAMGK

SEQ ID NO: 8967 - protein, 20 aa, Mycobacterium avium
PAMRDAEPAPTATQTPSVRD

SEQ ID NO: 8968 - protein, 6 aa, Mycobacterium avium
PANVGY

SEQ ID NO: 8969 - protein, 15 aa, Mycobacterium avium
PAPARNQPFDSRRAT

SEQ ID NO: 8970 - protein, 7 aa, Mycobacterium avium
PAPATVT

SEQ ID NO: 8971 - protein, 25 aa, Mycobacterium avium
PAPKPSAKSGKTLKSLKPPPRRQPH

SEQ ID NO: 8972 - protein, 63 aa, Mycobacterium avium
PAPPPPSSEAPPPPATTTTAPPEPSTTTTTTTPPPSSTTTTSAAPTTTAQPSTTSAASTTTRV

SEQ ID NO: 8973 - protein, 12 aa, Mycobacterium avium
PAPQRAPDGEPV

SEQ ID NO: 8974 - protein, 51 aa, Mycobacterium avium
PAPRVPGTADPDDAPAPAPAPPPSPAPPGAVAPAAYGGNVGPVGSQRERDQ

SEQ ID NO: 8975 - protein, 57 aa, Mycobacterium avium
PAPRVPGTADPDDAPPPPPPSPAPPGPPPSPAPPGAVAPAAYGGNVGPVGSQRERDQ

SEQ ID NO: 8976 - protein, 52 aa, Mycobacterium avium
PAPRVPGTADPDDAPPPPPPSPPPSPAPPGPVAPAAYGGNVGPVGSQRERDQ

SEQ ID NO: 8977 - protein, 12 aa, Mycobacterium avium
PAPTIAGAPAGV

SEQ ID NO: 8978 - protein, 15 aa, Mycobacterium avium
PAPVTPPTKRPAARR

SEQ ID NO: 8979 - protein, 4 aa, Mycobacterium avium
PAQR

SEQ ID NO: 8980 - protein, 5 aa, Mycobacterium avium
PARCS

SEQ ID NO: 8981 - protein, 8 aa, Mycobacterium avium
PARPGPWK

SEQ ID NO: 8982 - protein, 6 aa, Mycobacterium avium
PARRPR

SEQ ID NO: 8983 - protein, 7 aa, Mycobacterium avium
PARRTGP

SEQ ID NO: 8984 - protein, 6 aa, Mycobacterium avium
PASLPA

SEQ ID NO: 8985 - protein, 4 aa, Mycobacterium avium
PASM

SEQ ID NO: 8986 - protein, 9 aa, Mycobacterium avium
PASPWATPP

SEQ ID NO: 8987 - protein, 39 aa, Mycobacterium avium
PASRPGKAGDSVRRRRAAKPSQTVTARKTARARHEPAAE

SEQ ID NO: 8988 - protein, 8 aa, Mycobacterium avium
PASSLRGE

SEQ ID NO: 8989 - protein, 12 aa, Mycobacterium avium
PATAQSAVAPGT

SEQ ID NO: 8990 - protein, 7 aa, Mycobacterium avium
PATGQLS

SEQ ID NO: 8991 - protein, 10 aa, Mycobacterium avium
PATGRTGRHT

SEQ ID NO: 8992 - protein, 9 aa, Mycobacterium avium
PATTPAGGL

SEQ ID NO: 8993 - protein, 9 aa, Mycobacterium avium
PATTPTGGL

SEQ ID NO: 8994 - protein, 6 aa, Mycobacterium avium
PAVTQG

SEQ ID NO: 8995 - protein, 8 aa, Mycobacterium avium
PAYQPPGA

SEQ ID NO: 8996 - protein, 5 aa, Mycobacterium avium
PCGYQ

SEQ ID NO: 8997 - protein, 6 aa, Mycobacterium avium
PCGYQK

SEQ ID NO: 8998 - protein, 16 aa, Mycobacterium avium
PCVPGPNGTTVPKDGS

SEQ ID NO: 8999 - protein, 4 aa, Mycobacterium avium
PDAA

SEQ ID NO: 9000 - protein, 5 aa, Mycobacterium avium
PDAGA

SEQ ID NO: 9001 - protein, 8 aa, Mycobacterium avium
PDDQGHRY

SEQ ID NO: 9002 - protein, 8 aa, Mycobacterium avium
PDERTGER

SEQ ID NO: 9003 - protein, 17 aa, Mycobacterium avium
PDETDETADATFTSTRP

SEQ ID NO: 9004 - protein, 9 aa, Mycobacterium avium
PDGARSPQA

SEQ ID NO: 9005 - protein, 4 aa, Mycobacterium avium
PDGR

SEQ ID NO: 9006 - protein, 8 aa, Mycobacterium avium
PDGSVAQT

SEQ ID NO: 9007 - protein, 10 aa, Mycobacterium avium
PDGYANTTIN

SEQ ID NO: 9008 - protein, 4 aa, Mycobacterium avium
PDIF

SEQ ID NO: 9009 - protein, 47 aa, Mycobacterium avium
PDLAEGPVEPPPPYPPPLPPPYPPPAYPPPYPPPYPPPPGPLPDTTA

SEQ ID NO: 9010 - protein, 7 aa, Mycobacterium avium
PDLEGPE

SEQ ID NO: 9011 - protein, 16 aa, Mycobacterium avium
PDPEAPEEGEHELPGL

SEQ ID NO: 9012 - protein, 6 aa, Mycobacterium avium
PDPLNG

SEQ ID NO: 9013 - protein, 6 aa, Mycobacterium avium
PDQVNK

SEQ ID NO: 9014 - protein, 11 aa, Mycobacterium avium
PDRAPAVSEPA

SEQ ID NO: 9015 - protein, 11 aa, Mycobacterium avium
PDRAPTVSEPA

SEQ ID NO: 9016 - protein, 7 aa, Mycobacterium avium
PDRGQDW

SEQ ID NO: 9017 - protein, 4 aa, Mycobacterium avium
PDRT

SEQ ID NO: 9018 - protein, 9 aa, Mycobacterium avium
PDSPLTPPR

SEQ ID NO: 9019 - protein, 4 aa, Mycobacterium avium
PDTD

SEQ ID NO: 9020 - protein, 5 aa, Mycobacterium avium
PDTGG

SEQ ID NO: 9021 - protein, 8 aa, Mycobacterium avium
PDVAAARG

SEQ ID NO: 9022 - protein, 44 aa, Mycobacterium avium
PDVQPGRRAAEPVRRDQPRPEARPDTLRRPPPGGRNGHQATNYQ

SEQ ID NO: 9023 - protein, 48 aa, Mycobacterium avium
PEDAPTQSSADADATESTEATEPSDQSGQAGPSEESAVPADGRGDEAT

SEQ ID NO: 9024 - protein, 5 aa, Mycobacterium avium
PEDTE

SEQ ID NO: 9025 - protein, 6 aa, Mycobacterium avium
PEERTQ

SEQ ID NO: 9026 - protein, 21 aa, Mycobacterium avium
PEGAEPEVTVESGVDSTGMSS

SEQ ID NO: 9027 - protein, 10 aa, Mycobacterium avium
PELAEPQDQQ

SEQ ID NO: 9028 - protein, 10 aa, Mycobacterium avium
PELAEPQDRQ

SEQ ID NO: 9029 - protein, 19 aa, Mycobacterium avium
PELPTPDEPVGLDPSSAAP

SEQ ID NO: 9030 - protein, 26 aa, Mycobacterium avium
PEPAGGKRRKDKRGGRRGAGDGSREM

SEQ ID NO: 9031 - protein, 69 aa, Mycobacterium avium
PEPPPGYGPPPGYGPPPGYGPPPGYGTPPPPPPGYGPPPGYGAPPPGYGPPPGYGPPPGFGGPPKPAFS

SEQ ID NO: 9032 - protein, 6 aa, Mycobacterium avium
PEQVPP

SEQ ID NO: 9033 - protein, 17 aa, Mycobacterium avium
PERPRPTPRPPDDPALR

SEQ ID NO: 9034 - protein, 50 aa, Mycobacterium avium
PESFDPQHPEPDQAADEGTDAVDAEDAPDADPGPDHANGSPRPPGSDDEP

SEQ ID NO: 9035 - protein, 7 aa, Mycobacterium avium
PESGSGE

SEQ ID NO: 9036 - protein, 7 aa, Mycobacterium avium
PEVAPGK

SEQ ID NO: 9037 - protein, 18 aa, Mycobacterium avium
PEWQTDPSPLRGKGTRAP

SEQ ID NO: 9038 - protein, 4 aa, Mycobacterium avium
PEYQ

SEQ ID NO: 9039 - protein, 7 aa, Mycobacterium avium
PGAATAL

SEQ ID NO: 9040 - protein, 50 aa, Mycobacterium avium
PGAEAGAATAAAVQSAAAAPATDSGSNLNHADTSSIQQQASTAAQSYPSW

SEQ ID NO: 9041 - protein, 4 aa, Mycobacterium avium
PGAT

SEQ ID NO: 9042 - protein, 13 aa, Mycobacterium avium
PGATVPVPDGTAG

SEQ ID NO: 9043 - protein, 4 aa, Mycobacterium avium
PGEN

SEQ ID NO: 9044 - protein, 19 aa, Mycobacterium avium
PGESAAAAGPVPRPEKPRL

SEQ ID NO: 9045 - protein, 20 aa, Mycobacterium avium
PGESAAAAGPVPRPEKPRLL

SEQ ID NO: 9046 - protein, 20 aa, Mycobacterium avium
PGESAAAAGPVRRPEKPRLL

SEQ ID NO: 9047 - protein, 8 aa, Mycobacterium avium
PGETEEDF

SEQ ID NO: 9048 - protein, 23 aa, Mycobacterium avium
PGGALDNDTECVNGGRGNAADHL

SEQ ID NO: 9049 - protein, 4 aa, Mycobacterium avium
PGGD

SEQ ID NO: 9050 - protein, 20 aa, Mycobacterium avium
PGGKTAFCGPPDQVEPALGT

SEQ ID NO: 9051 - protein, 10 aa, Mycobacterium avium
PGGVTLDGTG

SEQ ID NO: 9052 - protein, 9 aa, Mycobacterium avium
PGHGEPSAS

SEQ ID NO: 9053 - protein, 15 aa, Mycobacterium avium
PGKMTSQRPPRSTGR

SEQ ID NO: 9054 - protein, 28 aa, Mycobacterium avium
PGKRAATPRECRDPKPYVPAGTNPWYGD

SEQ ID NO: 9055 - protein, 6 aa, Mycobacterium avium
PGLAQG

SEQ ID NO: 9056 - protein, 5 aa, Mycobacterium avium
PGLGT

SEQ ID NO: 9057 - protein, 11 aa, Mycobacterium avium
PGNPLPAHRQP

SEQ ID NO: 9058 - protein, 5 aa, Mycobacterium avium
PGNVA

SEQ ID NO: 9059 - protein, 7 aa, Mycobacterium avium
PGQATKA

SEQ ID NO: 9060 - protein, 8 aa, Mycobacterium avium
PGQATKAV

SEQ ID NO: 9061 - protein, 8 aa, Mycobacterium avium
PGQSGEAL

SEQ ID NO: 9062 - protein, 40 aa, Mycobacterium avium
PGRDRRGDHRTGPTDPAAPAAAQGPEPGGAARPQTVGRPT

SEQ ID NO: 9063 - protein, 6 aa, Mycobacterium avium
PGSGLN

SEQ ID NO: 9064 - protein, 13 aa, Mycobacterium avium
PGSIPTTTSGKIR

SEQ ID NO: 9065 - protein, 9 aa, Mycobacterium avium
PGSLSPGSR

SEQ ID NO: 9066 - protein, 28 aa, Mycobacterium avium
PGSPARSRVGPASAPAGPPRTSPTPATE

SEQ ID NO: 9067 - protein, 14 aa, Mycobacterium avium
PGTDADRRPAPGRA

SEQ ID NO: 9068 - protein, 4 aa, Mycobacterium avium
PGTS

SEQ ID NO: 9069 - protein, 4 aa, Mycobacterium avium
PGTV

SEQ ID NO: 9070 - protein, 6 aa, Mycobacterium avium
PGVGPV

SEQ ID NO: 9071 - protein, 16 aa, Mycobacterium avium
PIDRTDADSAQAALTT

SEQ ID NO: 9072 - protein, 7 aa, Mycobacterium avium
PINGATS

SEQ ID NO: 9073 - protein, 6 aa, Mycobacterium avium
PIQRQT

SEQ ID NO: 9074 - protein, 16 aa, Mycobacterium avium
PIRYPSARDAAATSGL

SEQ ID NO: 9075 - protein, 5 aa, Mycobacterium avium
PISPT

SEQ ID NO: 9076 - protein, 4 aa, Mycobacterium avium
PKAR

SEQ ID NO: 9077 - protein, 10 aa, Mycobacterium avium
PKFSETPANV

SEQ ID NO: 9078 - protein, 15 aa, Mycobacterium avium
PKGREDPESLRGNQY

SEQ ID NO: 9079 - protein, 20 aa, Mycobacterium avium
PKKYREQSEFRPSEQPADPV

SEQ ID NO: 9080 - protein, 20 aa, Mycobacterium avium
PKKYREQSEFRPSEQSADPV

SEQ ID NO: 9081 - protein, 7 aa, Mycobacterium avium
PKNDAGK

SEQ ID NO: 9082 - protein, 10 aa, Mycobacterium avium
PKPEAGGQAK

SEQ ID NO: 9083 - protein, 15 aa, Mycobacterium avium
PKPGTGPSPAARERG

SEQ ID NO: 9084 - protein, 45 aa, Mycobacterium avium
PLADSARASEQGSAPPTGPGYPPAPAPWSYGGPVPGPPGQRPSGN

SEQ ID NO: 9085 - protein, 45 aa, Mycobacterium avium
PLADSARASEQGSAPSTGPGYPPAPAPWSYGGPVPGPPGQRPSGN

SEQ ID NO: 9086 - protein, 5 aa, Mycobacterium avium
PLGTP

SEQ ID NO: 9087 - protein, 24 aa, Mycobacterium avium
PLPAAPPPAAPPLPEAPPIPAAPP

SEQ ID NO: 9088 - protein, 40 aa, Mycobacterium avium
PLPAPPPGGPPPGPPAQPGQGAGQSAPLPGPAQPGEGGEG

SEQ ID NO: 9089 - protein, 9 aa, Mycobacterium avium
PLPAPRTTN

SEQ ID NO: 9090 - protein, 16 aa, Mycobacterium avium
PLPEPTHPGQATGADI

SEQ ID NO: 9091 - protein, 18 aa, Mycobacterium avium
PLSAEDARKAVADLIDAH

SEQ ID NO: 9092 - protein, 11 aa, Mycobacterium avium
PLSGDTQMTYN

SEQ ID NO: 9093 - protein, 10 aa, Mycobacterium avium
PLSPTSSAHE

SEQ ID NO: 9094 - protein, 35 aa, Mycobacterium avium
PMPPPPLHGPPGPPHGFPPPPPGEAFPTLPPPSPR

SEQ ID NO: 9095 - protein, 35 aa, Mycobacterium avium
PMPPPPLHGPPGPPHGFPPPPPGEAFPTPPPPSPR

SEQ ID NO: 9096 - protein, 9 aa, Mycobacterium avium
PMSPSLPAD

SEQ ID NO: 9097 - protein, 20 aa, Mycobacterium avium
PNAAAGQAPQSLPQHSPSAR

SEQ ID NO: 9098 - protein, 21 aa, Mycobacterium avium
PNAAAGQAPQSLPQHSPSARV

SEQ ID NO: 9099 - protein, 17 aa, Mycobacterium avium
PNKQAKITNHTDVTGAA

SEQ ID NO: 9100 - protein, 7 aa, Mycobacterium avium
PNKVDSI

SEQ ID NO: 9101 - protein, 6 aa, Mycobacterium avium
PNKVNS

SEQ ID NO: 9102 - protein, 8 aa, Mycobacterium avium
PNRPAGPR

SEQ ID NO: 9103 - protein, 5 aa, Mycobacterium avium
PNRTA

SEQ ID NO: 9104 - protein, 20 aa, Mycobacterium avium
PNTAAGQAPQSLPQHSPSAR

SEQ ID NO: 9105 - protein, 15 aa, Mycobacterium avium
PPAAAPAQPAPATTG

SEQ ID NO: 9106 - protein, 4 aa, Mycobacterium avium
PPAE

SEQ ID NO: 9107 - protein, 12 aa, Mycobacterium avium
PPAHAVSPPAVE

SEQ ID NO: 9108 - protein, 22 aa, Mycobacterium avium
PPALPAVPTGPATGRPPGLTPG

SEQ ID NO: 9109 - protein, 5 aa, Mycobacterium avium
PPARY

SEQ ID NO: 9110 - protein, 6 aa, Mycobacterium avium
PPEGNR

SEQ ID NO: 9111 - protein, 4 aa, Mycobacterium avium
PPEV

SEQ ID NO: 9112 - protein, 54 aa, Mycobacterium avium
PPGMGTGSGMSASASSSAKRKAPEPDSAAAAAAAAARAAARSRRRRRATRHGHG

SEQ ID NO: 9113 - protein, 10 aa, Mycobacterium avium
PPGPTGTRMA

SEQ ID NO: 9114 - protein, 5 aa, Mycobacterium avium
PPGRS

SEQ ID NO: 9115 - protein, 6 aa, Mycobacterium avium
PPGRSA

SEQ ID NO: 9116 - protein, 4 aa, Mycobacterium avium
PPGV

SEQ ID NO: 9117 - protein, 39 aa, Mycobacterium avium
PPKRPGFDPRASRASDEWTPETGEEPDGGFDSEDATESV

SEQ ID NO: 9118 - protein, 12 aa, Mycobacterium avium
PPLPPGRSPEVS

SEQ ID NO: 9119 - protein, 46 aa, Mycobacterium avium
PPPAPPEGINPPPAGPGPEKPWGPPPGGQPQASGPAYATYDEKTGA

SEQ ID NO: 9120 - protein, 38 aa, Mycobacterium avium
PPPAPPEGINPPPASGAGEAVGAAARRAAAGQRPGVRH

SEQ ID NO: 9121 - protein, 4 aa, Mycobacterium avium
PPPC

SEQ ID NO: 9122 - protein, 58 aa, Mycobacterium avium
PPPPRQPKPPGQPPTRSFRRRDTQRSAVPPDAATRAVPQPGPPPRTQTGRTGGSGEFP

SEQ ID NO: 9123 - protein, 4 aa, Mycobacterium avium
PPQL

SEQ ID NO: 9124 - protein, 12 aa, Mycobacterium avium
PPTTNRSAVKAG

SEQ ID NO: 9125 - protein, 8 aa, Mycobacterium avium
PQGGGSEA

SEQ ID NO: 9126 - protein, 5 aa, Mycobacterium avium
PQGLG

SEQ ID NO: 9127 - protein, 9 aa, Mycobacterium avium
PQNGSFGSV

SEQ ID NO: 9128 - protein, 10 aa, Mycobacterium avium
PQSRERAAQA

SEQ ID NO: 9129 - protein, 4 aa, Mycobacterium avium
PQTL

SEQ ID NO: 9130 - protein, 5 aa, Mycobacterium avium
PRAGE

SEQ ID NO: 9131 - protein, 6 aa, Mycobacterium avium
PRAGER

SEQ ID NO: 9132 - protein, 8 aa, Mycobacterium avium
PREQTPRG

SEQ ID NO: 9133 - protein, 8 aa, Mycobacterium avium
PREQTSRG

SEQ ID NO: 9134 - protein, 12 aa, Mycobacterium avium
PRERTADSSTDD

SEQ ID NO: 9135 - protein, 17 aa, Mycobacterium avium
PRGALPSRSTLPGPGSV

SEQ ID NO: 9136 - protein, 5 aa, Mycobacterium avium
PRIPP

SEQ ID NO: 9137 - protein, 8 aa, Mycobacterium avium
PRLGTGFS

SEQ ID NO: 9138 - protein, 6 aa, Mycobacterium avium
PRLPAG

SEQ ID NO: 9139 - protein, 30 aa, Mycobacterium avium
PRLPGRPDLSGPAPTSLRQRRNRSGGSFTS

SEQ ID NO: 9140 - protein, 10 aa, Mycobacterium avium
PRLPRDGRTQ

SEQ ID NO: 9141 - protein, 10 aa, Mycobacterium avium
PRMPQARKDI

SEQ ID NO: 9142 - protein, 7 aa, Mycobacterium avium
PRNGETD

SEQ ID NO: 9143 - protein, 13 aa, Mycobacterium avium
PRPPVARIPARLR

SEQ ID NO: 9144 - protein, 6 aa, Mycobacterium avium
PRPTQV

SEQ ID NO: 9145 - protein, 7 aa, Mycobacterium avium
PRRPGRS

SEQ ID NO: 9146 - protein, 4 aa, Mycobacterium avium
PRRT

SEQ ID NO: 9147 - protein, 5 aa, Mycobacterium avium
PRRVD

SEQ ID NO: 9148 - protein, 8 aa, Mycobacterium avium
PRSESGPY

SEQ ID NO: 9149 - protein, 12 aa, Mycobacterium avium
PRSQPAADAREV

SEQ ID NO: 9150 - protein, 12 aa, Mycobacterium avium
PRTAPPRSVADG

SEQ ID NO: 9151 - protein, 8 aa, Mycobacterium avium
PRTASGKV

SEQ ID NO: 9152 - protein, 7 aa, Mycobacterium avium
PRTGRYV

SEQ ID NO: 9153 - protein, 4 aa, Mycobacterium avium
PRTM

SEQ ID NO: 9154 - protein, 48 aa, Mycobacterium avium
PRYQPPPAAAATPPPPETPPDPPREPQPEPQPEPQPQPQGRDWQPVGA

SEQ ID NO: 9155 - protein, 48 aa, Mycobacterium avium
PRYQPPPAAAATPPPPETPPEPPREPQPEPQPEPQPQPQGRDWQPVGA

SEQ ID NO: 9156 - protein, 6 aa, Mycobacterium avium
PSDPRD

SEQ ID NO: 9157 - protein, 5 aa, Mycobacterium avium
PSGYP

SEQ ID NO: 9158 - protein, 9 aa, Mycobacterium avium
PSPDPHSSA

SEQ ID NO: 9159 - protein, 4 aa, Mycobacterium avium
PSPL

SEQ ID NO: 9160 - protein, 6 aa, Mycobacterium avium
PSPQRT

SEQ ID NO: 9161 - protein, 6 aa, Mycobacterium avium
PSQSAL

SEQ ID NO: 9162 - protein, 11 aa, Mycobacterium avium
PSSLPSARESA

SEQ ID NO: 9163 - protein, 13 aa, Mycobacterium avium
PSTLDPAVDPKGA

SEQ ID NO: 9164 - protein, 31 aa, Mycobacterium avium
PSVATPAGAPASTVAAGSGAAAAPGPAAAAG

SEQ ID NO: 9165 - protein, 31 aa, Mycobacterium avium
PSVATPAGAPASTVAAGSGASAAPAPAAAAG

SEQ ID NO: 9166 - protein, 4 aa, Mycobacterium avium
PSVC

SEQ ID NO: 9167 - protein, 7 aa, Mycobacterium avium
PTAADSD

SEQ ID NO: 9168 - protein, 4 aa, Mycobacterium avium
PTAD

SEQ ID NO: 9169 - protein, 8 aa, Mycobacterium avium
PTAGTGDY

SEQ ID NO: 9170 - protein, 7 aa, Mycobacterium avium
PTARPFR

SEQ ID NO: 9171 - protein, 4 aa, Mycobacterium avium
PTAT

SEQ ID NO: 9172 - protein, 10 aa, Mycobacterium avium
PTDMRTGKGL

SEQ ID NO: 9173 - protein, 7 aa, Mycobacterium avium
PTDPGAG

SEQ ID NO: 9174 - protein, 11 aa, Mycobacterium avium
PTNQPASAALA

SEQ ID NO: 9175 - protein, 16 aa, Mycobacterium avium
PTPAGTEIHDNRSING

SEQ ID NO: 9176 - protein, 32 aa, Mycobacterium avium
PTPGGPPDPTDTALQGPLPPDRNPADPNPDKD

SEQ ID NO: 9177 - protein, 7 aa, Mycobacterium avium
PTPQHQA

SEQ ID NO: 9178 - protein, 8 aa, Mycobacterium avium
PTPQHQAT

SEQ ID NO: 9179 - protein, 13 aa, Mycobacterium avium
PTPSRRRARAAAG

SEQ ID NO: 9180 - protein, 4 aa, Mycobacterium avium
PTPV

SEQ ID NO: 9181 - protein, 5 aa, Mycobacterium avium
PTPVA

SEQ ID NO: 9182 - protein, 9 aa, Mycobacterium avium
PTQEGQEAG

SEQ ID NO: 9183 - protein, 10 aa, Mycobacterium avium
PTRAGRRQAL

SEQ ID NO: 9184 - protein, 48 aa, Mycobacterium avium
PTRPAPAAPAPAPAPEAPAPAPAAAPQAPAPAPEAPAPAPAAPAPAPV

SEQ ID NO: 9185 - protein, 14 aa, Mycobacterium avium
PTRPAPAAPAPAPV

SEQ ID NO: 9186 - protein, 6 aa, Mycobacterium avium
PTSSYR

SEQ ID NO: 9187 - protein, 4 aa, Mycobacterium avium
PTVA

SEQ ID NO: 9188 - protein, 12 aa, Mycobacterium avium
PVAGGNEKIGDL

SEQ ID NO: 9189 - protein, 17 aa, Mycobacterium avium
PVAQAAPCAGAGSNPVS

SEQ ID NO: 9190 - protein, 17 aa, Mycobacterium avium
PVGGPAGPSAADALGAG

SEQ ID NO: 9191 - protein, 15 aa, Mycobacterium avium
PVITESQTPYPGGGL

SEQ ID NO: 9192 - protein, 6 aa, Mycobacterium avium
PVNEAA

SEQ ID NO: 9193 - protein, 9 aa, Mycobacterium avium
PVNEPSAAV

SEQ ID NO: 9194 - protein, 10 aa, Mycobacterium avium
PVNPTTVKSA

SEQ ID NO: 9195 - protein, 13 aa, Mycobacterium avium
PVTRTQAVSGDGK

SEQ ID NO: 9196 - protein, 9 aa, Mycobacterium avium
PWAPPAALP

SEQ ID NO: 9197 - protein, 7 aa, Mycobacterium avium
PWPHSDA

SEQ ID NO: 9198 - protein, 19 aa, Mycobacterium avium
PYPATGPVSATDADQGGSK

SEQ ID NO: 9199 - protein, 7 aa, Mycobacterium avium
PYPNPTN

SEQ ID NO: 9200 - protein, 14 aa, Mycobacterium avium
QAADTFDDKGESFH

SEQ ID NO: 9201 - protein, 10 aa, Mycobacterium avium
QAAGDDKLSR

SEQ ID NO: 9202 - protein, 5 aa, Mycobacterium avium
QAAGQ

SEQ ID NO: 9203 - protein, 8 aa, Mycobacterium avium
QAAHGSTA

SEQ ID NO: 9204 - protein, 8 aa, Mycobacterium avium
QAASDGAA

SEQ ID NO: 9205 - protein, 6 aa, Mycobacterium avium
QADTDQ

SEQ ID NO: 9206 - protein, 9 aa, Mycobacterium avium
QAGAAGESM

SEQ ID NO: 9207 - protein, 10 aa, Mycobacterium avium
QAGGLYPGGN

SEQ ID NO: 9208 - protein, 4 aa, Mycobacterium avium
QAGM

SEQ ID NO: 9209 - protein, 9 aa, Mycobacterium avium
QAGPTADQV

SEQ ID NO: 9210 - protein, 12 aa, Mycobacterium avium
QALTDAKAEVQR

SEQ ID NO: 9211 - protein, 81 aa, Mycobacterium avium
QAPAQSPSTQSGSAAAPEMPPNNQHLPGQQPVVTQPPQAPPPPVDNGAPPPANPAPEAPPAAPPPPPPPAPEAPPGGPPPA

SEQ ID NO: 9212 - protein, 22 aa, Mycobacterium avium
QAPAQSPSTQSGSAAAPEMPRN

SEQ ID NO: 9213 - protein, 102 aa, Mycobacterium avium
QAPAYTPPAEYPQYQQPGEQAYPQPYPQQQGYAQPGQYGQYGQPGQYGQPGQYAQPGQYGQPGQYPQPGQYPQPGQYGQYGQPGQYPQQYQPYEQPGKKRPV

SEQ ID NO: 9214 - protein, 9 aa, Mycobacterium avium
QAPDDPEVR

SEQ ID NO: 9215 - protein, 44 aa, Mycobacterium avium
QAPSNAPVPQPAVPAPANPAPEAPSNPGVVPNPNPGWAPNPNPL

SEQ ID NO: 9216 - protein, 8 aa, Mycobacterium avium
QAQDGTLA

SEQ ID NO: 9217 - protein, 10 aa, Mycobacterium avium
QAQTADKTRR

SEQ ID NO: 9218 - protein, 9 aa, Mycobacterium avium
QARAETDAE

SEQ ID NO: 9219 - protein, 12 aa, Mycobacterium avium
QASKTLRSSADE

SEQ ID NO: 9220 - protein, 6 aa, Mycobacterium avium
QCKEND

SEQ ID NO: 9221 - protein, 7 aa, Mycobacterium avium
QDDKDAE

SEQ ID NO: 9222 - protein, 7 aa, Mycobacterium avium
QDEDQKV

SEQ ID NO: 9223 - protein, 7 aa, Mycobacterium avium
QDENETA

SEQ ID NO: 9224 - protein, 7 aa, Mycobacterium avium
QDEQDPV

SEQ ID NO: 9225 - protein, 9 aa, Mycobacterium avium
QDERPTEQK

SEQ ID NO: 9226 - protein, 15 aa, Mycobacterium avium
QDGGVAGASGPTRGK

SEQ ID NO: 9227 - protein, 6 aa, Mycobacterium avium
QDHPPS

SEQ ID NO: 9228 - protein, 17 aa, Mycobacterium avium
QDPAAAGMRARGQPAAL

SEQ ID NO: 9229 - protein, 9 aa, Mycobacterium avium
QDPAKDTLP

SEQ ID NO: 9230 - protein, 8 aa, Mycobacterium avium
QDSPISVR

SEQ ID NO: 9231 - protein, 8 aa, Mycobacterium avium
QDSPRAEA

SEQ ID NO: 9232 - protein, 8 aa, Mycobacterium avium
QDSPRAQA

SEQ ID NO: 9233 - protein, 9 aa, Mycobacterium avium
QDVSPGDRS

SEQ ID NO: 9234 - protein, 8 aa, Mycobacterium avium
QERAAAER

SEQ ID NO: 9235 - protein, 4 aa, Mycobacterium avium
QERG

SEQ ID NO: 9236 - protein, 4 aa, Mycobacterium avium
QFTG

SEQ ID NO: 9237 - protein, 16 aa, Mycobacterium avium
QGAGTYRAATGQTQDP

SEQ ID NO: 9238 - protein, 6 aa, Mycobacterium avium
QGDTRH

SEQ ID NO: 9239 - protein, 4 aa, Mycobacterium avium
QGGP

SEQ ID NO: 9240 - protein, 6 aa, Mycobacterium avium
QGGTTL

SEQ ID NO: 9241 - protein, 14 aa, Mycobacterium avium
QGLPPDDRAGIEDR

SEQ ID NO: 9242 - protein, 11 aa, Mycobacterium avium
QGLTRSRIEQT

SEQ ID NO: 9243 - protein, 10 aa, Mycobacterium avium
QGNTRPDLDP

SEQ ID NO: 9244 - protein, 21 aa, Mycobacterium avium
QGPNTEHPGVPLRGEKSGYDF

SEQ ID NO: 9245 - protein, 7 aa, Mycobacterium avium
QGQGGTI

SEQ ID NO: 9246 - protein, 5 aa, Mycobacterium avium
QGQTL

SEQ ID NO: 9247 - protein, 30 aa, Mycobacterium avium
QHGQQQPEDDQADDVPGPVVDPAPSPRRRR

SEQ ID NO: 9248 - protein, 64 aa, Mycobacterium avium
QHLPGQQPVVTQPPQAPPPPVDNGAPPPANPAPEAPPAPVPPPAAPPPPPPPAPEAPPGGPPPA

SEQ ID NO: 9249 - protein, 6 aa, Mycobacterium avium
QHQPAE

SEQ ID NO: 9250 - protein, 6 aa, Mycobacterium avium
QISESG

SEQ ID NO: 9251 - protein, 5 aa, Mycobacterium avium
QITSR

SEQ ID NO: 9252 - protein, 6 aa, Mycobacterium avium
QKDREA

SEQ ID NO: 9253 - protein, 9 aa, Mycobacterium avium
QKGQKSLFE

SEQ ID NO: 9254 - protein, 8 aa, Mycobacterium avium
QKQVTETA

SEQ ID NO: 9255 - protein, 8 aa, Mycobacterium avium
QLGDDYTE

SEQ ID NO: 9256 - protein, 4 aa, Mycobacterium avium
QLGK

SEQ ID NO: 9257 - protein, 5 aa, Mycobacterium avium
QLGPT

SEQ ID NO: 9258 - protein, 7 aa, Mycobacterium avium
QLGTDEA

SEQ ID NO: 9259 - protein, 8 aa, Mycobacterium avium
QLKTGDSV

SEQ ID NO: 9260 - protein, 6 aa, Mycobacterium avium
QLPGGV

SEQ ID NO: 9261 - protein, 5 aa, Mycobacterium avium
QLPGW

SEQ ID NO: 9262 - protein, 8 aa, Mycobacterium avium
QLQTQQDV

SEQ ID NO: 9263 - protein, 8 aa, Mycobacterium avium
QLRQGLSQ

SEQ ID NO: 9264 - protein, 8 aa, Mycobacterium avium
QNDISDRR

SEQ ID NO: 9265 - protein, 7 aa, Mycobacterium avium
QNPGRYQ

SEQ ID NO: 9266 - protein, 15 aa, Mycobacterium avium
QNSARATAGSDAATG

SEQ ID NO: 9267 - protein, 7 aa, Mycobacterium avium
QNSTAMG

SEQ ID NO: 9268 - protein, 49 aa, Mycobacterium avium
QPDIPADQPDIPADQPDIPADQPDRPRKADPRPADQKNGDAGTRRGPFD

SEQ ID NO: 9269 - protein, 35 aa, Mycobacterium avium
QPDIPADQPDRPRKADPRPADQKNGDAGTRRGPFD

SEQ ID NO: 9270 - protein, 48 aa, Mycobacterium avium
QPDIPADQPDRPRKADPRPADQKNGDVGTRRGPLDVPRERTADSSTDD

SEQ ID NO: 9271 - protein, 5 aa, Mycobacterium avium
QPGKH

SEQ ID NO: 9272 - protein, 6 aa, Mycobacterium avium
QPMRRA

SEQ ID NO: 9273 - protein, 10 aa, Mycobacterium avium
QPPPGTPPDK

SEQ ID NO: 9274 - protein, 16 aa, Mycobacterium avium
QPPPGTTPDKFPQKPQ

SEQ ID NO: 9275 - protein, 31 aa, Mycobacterium avium
QPPPPPGPVPGPGQPGAVPQPEAPPVPQPPA

SEQ ID NO: 9276 - protein, 21 aa, Mycobacterium avium
QPPPRRRAAGHSAVTERILRR

SEQ ID NO: 9277 - protein, 6 aa, Mycobacterium avium
QPSTSA

SEQ ID NO: 9278 - protein, 10 aa, Mycobacterium avium
QQAGPQSVNG

SEQ ID NO: 9279 - protein, 10 aa, Mycobacterium avium
QQAKNVSGAH

SEQ ID NO: 9280 - protein, 11 aa, Mycobacterium avium
QQAKNVSGAHN

SEQ ID NO: 9281 - protein, 63 aa, Mycobacterium avium
QQGVSHVPKSTTSTTTTATTTTTTTTTTTTTPSSTSPGSSAEQPPAQQPSQQPGGGQTQQPSH

SEQ ID NO: 9282 - protein, 64 aa, Mycobacterium avium
QQGVSHVPKSTTSTTTTTTTTTTPTTTTTTTTPSSTSPGSSAEQPPAQQPSQQPGGGQTQQPSH

SEQ ID NO: 9283 - protein, 62 aa, Mycobacterium avium
QQGVSHVPRSTTSTTTTTTTTTTPTTTTTTPSSTSPGSSAEQPPAQQPSQQPGGGQTQQPSH

SEQ ID NO: 9284 - protein, 20 aa, Mycobacterium avium
QQGWPPNIQPAPGPFTASPT

SEQ ID NO: 9285 - protein, 34 aa, Mycobacterium avium
QQQPGYPPAPNQTAPVPSHAGSSGYAQGQQPYQQ

SEQ ID NO: 9286 - protein, 22 aa, Mycobacterium avium
QRAAAPPPDERASELSAAPGAT

SEQ ID NO: 9287 - protein, 16 aa, Mycobacterium avium
QRAASYEDYPDSPNGD

SEQ ID NO: 9288 - protein, 6 aa, Mycobacterium avium
QRAPNN

SEQ ID NO: 9289 - protein, 12 aa, Mycobacterium avium
QRARRSAAALPA

SEQ ID NO: 9290 - protein, 15 aa, Mycobacterium avium
QRGMEAKGGPRGVAD

SEQ ID NO: 9291 - protein, 7 aa, Mycobacterium avium
QRGPSDY

SEQ ID NO: 9292 - protein, 12 aa, Mycobacterium avium
QRHDGASREIDR

SEQ ID NO: 9293 - protein, 18 aa, Mycobacterium avium
QRLDEQASRTADSAPAVV

SEQ ID NO: 9294 - protein, 7 aa, Mycobacterium avium
QRNPYAK

SEQ ID NO: 9295 - protein, 5 aa, Mycobacterium avium
QRPAT

SEQ ID NO: 9296 - protein, 63 aa, Mycobacterium avium
QRPRRSGAPKHPDASPAETEGDTHPAHDAAPDEDGDHAPPEDGGDDTGPPEGGRPHIGRHRGA

SEQ ID NO: 9297 - protein, 7 aa, Mycobacterium avium
QRRAGAE

SEQ ID NO: 9298 - protein, 9 aa, Mycobacterium avium
QRRAQVPAE

SEQ ID NO: 9299 - protein, 8 aa, Mycobacterium avium
QRRGTTPQ

SEQ ID NO: 9300 - protein, 8 aa, Mycobacterium avium
QRTTSAYQ

SEQ ID NO: 9301 - protein, 13 aa, Mycobacterium avium
QRVTAGDGDGGWP

SEQ ID NO: 9302 - protein, 6 aa, Mycobacterium avium
QSDNDD

SEQ ID NO: 9303 - protein, 8 aa, Mycobacterium avium
QSEPQRQA

SEQ ID NO: 9304 - protein, 7 aa, Mycobacterium avium
QSESHMR

SEQ ID NO: 9305 - protein, 6 aa, Mycobacterium avium
QSGSDR

SEQ ID NO: 9306 - protein, 24 aa, Mycobacterium avium
QSGTGRRIDEANPTTDGDRPSATI

SEQ ID NO: 9307 - protein, 9 aa, Mycobacterium avium
QSHQAQQQR

SEQ ID NO: 9308 - protein, 8 aa, Mycobacterium avium
QSLATDRY

SEQ ID NO: 9309 - protein, 9 aa, Mycobacterium avium
QSLPDTKGA

SEQ ID NO: 9310 - protein, 9 aa, Mycobacterium avium
QSPPSAGFA

SEQ ID NO: 9311 - protein, 4 aa, Mycobacterium avium
QSRA

SEQ ID NO: 9312 - protein, 9 aa, Mycobacterium avium
QSRPGAEHA

SEQ ID NO: 9313 - protein, 9 aa, Mycobacterium avium
QSWGRDPAT

SEQ ID NO: 9314 - protein, 5 aa, Mycobacterium avium
QTAET

SEQ ID NO: 9315 - protein, 13 aa, Mycobacterium avium
QTAGGGAGSPGAG

SEQ ID NO: 9316 - protein, 9 aa, Mycobacterium avium
QTARRAHNE

SEQ ID NO: 9317 - protein, 13 aa, Mycobacterium avium
QTASGGAGSPGAG

SEQ ID NO: 9318 - protein, 13 aa, Mycobacterium avium
QTDPDSGTDRPRF

SEQ ID NO: 9319 - protein, 4 aa, Mycobacterium avium
QTGR

SEQ ID NO: 9320 - protein, 11 aa, Mycobacterium avium
QTKGAGHTSQM

SEQ ID NO: 9321 - protein, 13 aa, Mycobacterium avium
QTKKRSTAAAGAT

SEQ ID NO: 9322 - protein, 7 aa, Mycobacterium avium
QTNAALQ

SEQ ID NO: 9323 - protein, 4 aa, Mycobacterium avium
QTNL

SEQ ID NO: 9324 - protein, 5 aa, Mycobacterium avium
QTPDD

SEQ ID NO: 9325 - protein, 6 aa, Mycobacterium avium
QTRDDP

SEQ ID NO: 9326 - protein, 11 aa, Mycobacterium avium
QVARDDARAEL

SEQ ID NO: 9327 - protein, 16 aa, Mycobacterium avium
QVDSPQRQPEAAPVPA

SEQ ID NO: 9328 - protein, 25 aa, Mycobacterium avium
QVDSPQRQPEAAPVPAARGNWRTQA

SEQ ID NO: 9329 - protein, 10 aa, Mycobacterium avium
QVKPGTVTRT

SEQ ID NO: 9330 - protein, 5 aa, Mycobacterium avium
QYQAG

SEQ ID NO: 9331 - protein, 5 aa, Mycobacterium avium
QYSLG

SEQ ID NO: 9332 - protein, 6 aa, Mycobacterium avium
QYSLGG

SEQ ID NO: 9333 - protein, 7 aa, Mycobacterium avium
RAADREV

SEQ ID NO: 9334 - protein, 14 aa, Mycobacterium avium
RAAEAAGRDPTSIG

SEQ ID NO: 9335 - protein, 23 aa, Mycobacterium avium
RAAGPACRTSRTGPLANGPQGST

SEQ ID NO: 9336 - protein, 28 aa, Mycobacterium avium
RAAPEETEPFEPEPVEPEPEPPGPASGL

SEQ ID NO: 9337 - protein, 31 aa, Mycobacterium avium
RAAPEETEPFEPEPVEPEPVGSEPPGPASGL

SEQ ID NO: 9338 - protein, 31 aa, Mycobacterium avium
RAAPEETEPIEPEPVEPEPVGSEPPGPASGL

SEQ ID NO: 9339 - protein, 13 aa, Mycobacterium avium
RAAPRTEPASPRW

SEQ ID NO: 9340 - protein, 5 aa, Mycobacterium avium
RAAQW

SEQ ID NO: 9341 - protein, 26 aa, Mycobacterium avium
RAARAGPGAHQPPGKPRADDPGAARL

SEQ ID NO: 9342 - protein, 14 aa, Mycobacterium avium
RAARPSTMAKVVDH

SEQ ID NO: 9343 - protein, 5 aa, Mycobacterium avium
RAATA

SEQ ID NO: 9344 - protein, 7 aa, Mycobacterium avium
RADGDEY

SEQ ID NO: 9345 - protein, 5 aa, Mycobacterium avium
RADGK

SEQ ID NO: 9346 - protein, 7 aa, Mycobacterium avium
RADPSPI

SEQ ID NO: 9347 - protein, 21 aa, Mycobacterium avium
RADTTHSQIEETSVPNRRRRK

SEQ ID NO: 9348 - protein, 8 aa, Mycobacterium avium
RAEAGGPE

SEQ ID NO: 9349 - protein, 12 aa, Mycobacterium avium
RAEASGLRGDGG

SEQ ID NO: 9350 - protein, 53 aa, Mycobacterium avium
RAEQDQPAQLRGQRAAGAADRHTLQPGRHRGAGGGGGDRNPHGLNTSAPPGRL

SEQ ID NO: 9351 - protein, 7 aa, Mycobacterium avium
RAETGVT

SEQ ID NO: 9352 - protein, 7 aa, Mycobacterium avium
RAGEPVK

SEQ ID NO: 9353 - protein, 67 aa, Mycobacterium avium
RAGGARASAESTADDAAEPPAGSGDEATEAERESRSSRPAPSKPAPGARPVRPTGARRPTGKRNVGR

SEQ ID NO: 9354 - protein, 67 aa, Mycobacterium avium
RAGGARASAESTADDAAETPAGSGDEATEAERESPSSRAAPSKPAPGARPVRPTGARRPTGKRNVGR

SEQ ID NO: 9355 - protein, 5 aa, Mycobacterium avium
RAGPR

SEQ ID NO: 9356 - protein, 10 aa, Mycobacterium avium
RAGPTVPHGP

SEQ ID NO: 9357 - protein, 5 aa, Mycobacterium avium
RAGQN

SEQ ID NO: 9358 - protein, 7 aa, Mycobacterium avium
RAIDSSN

SEQ ID NO: 9359 - protein, 13 aa, Mycobacterium avium
RAIEEGASLSGDV

SEQ ID NO: 9360 - protein, 12 aa, Mycobacterium avium
RAKQASNDTEAI

SEQ ID NO: 9361 - protein, 6 aa, Mycobacterium avium
RALAAT

SEQ ID NO: 9362 - protein, 12 aa, Mycobacterium avium
RALRQDRDVDDA

SEQ ID NO: 9363 - protein, 11 aa, Mycobacterium avium
RALTEDTGPLL

SEQ ID NO: 9364 - protein, 10 aa, Mycobacterium avium
RANATLSNTA

SEQ ID NO: 9365 - protein, 6 aa, Mycobacterium avium
RAPDEH

SEQ ID NO: 9366 - protein, 41 aa, Mycobacterium avium
RAPEAGDGPPWQRGSTRPQQPPPRQNEPPTEKRADGGGAEA

SEQ ID NO: 9367 - protein, 40 aa, Mycobacterium avium
RAPEAGDGPPWQRGSTRPQQPPPRQNEPPTEKRPGGGAEA

SEQ ID NO: 9368 - protein, 4 aa, Mycobacterium avium
RAPR

SEQ ID NO: 9369 - protein, 6 aa, Mycobacterium avium
RARGGA

SEQ ID NO: 9370 - protein, 10 aa, Mycobacterium avium
RARGQPAALA

SEQ ID NO: 9371 - protein, 11 aa, Mycobacterium avium
RARPGDRPSRS

SEQ ID NO: 9372 - protein, 14 aa, Mycobacterium avium
RARPQSAAPTIPPE

SEQ ID NO: 9373 - protein, 15 aa, Mycobacterium avium
RARPQSAAPTTPPEV

SEQ ID NO: 9374 - protein, 14 aa, Mycobacterium avium
RARRRARRGRAGSP

SEQ ID NO: 9375 - protein, 13 aa, Mycobacterium avium
RASAGPGNRNFAR

SEQ ID NO: 9376 - protein, 5 aa, Mycobacterium avium
RASDV

SEQ ID NO: 9377 - protein, 46 aa, Mycobacterium avium
RASEAAAAARLEADRNANGGNGSHANQGGNRQGPTQPDYGAPAGWR

SEQ ID NO: 9378 - protein, 14 aa, Mycobacterium avium
RASRPSTMAKVVDH

SEQ ID NO: 9379 - protein, 6 aa, Mycobacterium avium
RATESL

SEQ ID NO: 9380 - protein, 13 aa, Mycobacterium avium
RAVDHPDAPGPIT

SEQ ID NO: 9381 - protein, 19 aa, Mycobacterium avium
RAVPSNLDPPLAQAPANKA

SEQ ID NO: 9382 - protein, 4 aa, Mycobacterium avium
RAVT

SEQ ID NO: 9383 - protein, 18 aa, Mycobacterium avium
RCAPPGPISNSPVGVGTS

SEQ ID NO: 9384 - protein, 15 aa, Mycobacterium avium
RCGGNQTRHRPAQVS

SEQ ID NO: 9385 - protein, 6 aa, Mycobacterium avium
RCPDRP

SEQ ID NO: 9386 - protein, 6 aa, Mycobacterium avium
RDAADR

SEQ ID NO: 9387 - protein, 10 aa, Mycobacterium avium
RDDGKPPHPS

SEQ ID NO: 9388 - protein, 4 aa, Mycobacterium avium
RDEA

SEQ ID NO: 9389 - protein, 8 aa, Mycobacterium avium
RDETDVNP

SEQ ID NO: 9390 - protein, 26 aa, Mycobacterium avium
RDGGTDAFGPDDYGGDYDDDYDDDDA

SEQ ID NO: 9391 - protein, 19 aa, Mycobacterium avium
RDGLSEGPGVPMMPSTWDR

SEQ ID NO: 9392 - protein, 8 aa, Mycobacterium avium
RDGSTGPF

SEQ ID NO: 9393 - protein, 8 aa, Mycobacterium avium
RDGVAPGR

SEQ ID NO: 9394 - protein, 4 aa, Mycobacterium avium
RDHT

SEQ ID NO: 9395 - protein, 6 aa, Mycobacterium avium
RDLATE

SEQ ID NO: 9396 - protein, 11 aa, Mycobacterium avium
RDPAALDSAGL

SEQ ID NO: 9397 - protein, 5 aa, Mycobacterium avium
RDPHV

SEQ ID NO: 9398 - protein, 9 aa, Mycobacterium avium
RDREARRDK

SEQ ID NO: 9399 - protein, 7 aa, Mycobacterium avium
RDRPTAA

SEQ ID NO: 9400 - protein, 6 aa, Mycobacterium avium
RDSDRV

SEQ ID NO: 9401 - protein, 6 aa, Mycobacterium avium
RDSGGT

SEQ ID NO: 9402 - protein, 8 aa, Mycobacterium avium
RDTGDDLG

SEQ ID NO: 9403 - protein, 6 aa, Mycobacterium avium
RDVAGS

SEQ ID NO: 9404 - protein, 18 aa, Mycobacterium avium
REAGRRAPAAEPPARHPT

SEQ ID NO: 9405 - protein, 4 aa, Mycobacterium avium
REAP

SEQ ID NO: 9406 - protein, 4 aa, Mycobacterium avium
RECD

SEQ ID NO: 9407 - protein, 30 aa, Mycobacterium avium
RECDGAAAIGPDARSRTVASPAHRRRGPDR

SEQ ID NO: 9408 - protein, 30 aa, Mycobacterium avium
RECDGAAAIGPDARSRTVASPAHRRRGPGR

SEQ ID NO: 9409 - protein, 6 aa, Mycobacterium avium
REESTH

SEQ ID NO: 9410 - protein, 12 aa, Mycobacterium avium
REETARHGTRQG

SEQ ID NO: 9411 - protein, 8 aa, Mycobacterium avium
REHGDGRL

SEQ ID NO: 9412 - protein, 7 aa, Mycobacterium avium
REHGEGR

SEQ ID NO: 9413 - protein, 6 aa, Mycobacterium avium
REIGRS

SEQ ID NO: 9414 - protein, 7 aa, Mycobacterium avium
REIGRSS

SEQ ID NO: 9415 - protein, 7 aa, Mycobacterium avium
RELMGSD

SEQ ID NO: 9416 - protein, 9 aa, Mycobacterium avium
RENADNKLY

SEQ ID NO: 9417 - protein, 23 aa, Mycobacterium avium
REPEPTPAPQAAAEPTESPEPQA

SEQ ID NO: 9418 - protein, 6 aa, Mycobacterium avium
REPRRQ

SEQ ID NO: 9419 - protein, 15 aa, Mycobacterium avium
REPTSGTIERPGSVG

SEQ ID NO: 9420 - protein, 11 aa, Mycobacterium avium
RERAADSSADD

SEQ ID NO: 9421 - protein, 17 aa, Mycobacterium avium
REVRTQTAAFEDEPYDL

SEQ ID NO: 9422 - protein, 11 aa, Mycobacterium avium
RFGVDDTRDVR

SEQ ID NO: 9423 - protein, 10 aa, Mycobacterium avium
RGADGAAGGR

SEQ ID NO: 9424 - protein, 5 aa, Mycobacterium avium
RGAGQ

SEQ ID NO: 9425 - protein, 6 aa, Mycobacterium avium
RGAPRP

SEQ ID NO: 9426 - protein, 4 aa, Mycobacterium avium
RGDG

SEQ ID NO: 9427 - protein, 12 aa, Mycobacterium avium
RGDNARRPVPAA

SEQ ID NO: 9428 - protein, 6 aa, Mycobacterium avium
RGDPHG

SEQ ID NO: 9429 - protein, 49 aa, Mycobacterium avium
RGEAASINRPEPGPGSAPRKARDTAADVAADDDDTGPFSGRLLVADSSR

SEQ ID NO: 9430 - protein, 26 aa, Mycobacterium avium
RGEAASMSAGAGRDVRPTDRPKAASQ

SEQ ID NO: 9431 - protein, 26 aa, Mycobacterium avium
RGEAASMSAGAGRDVRPTDRPKAAYQ

SEQ ID NO: 9432 - protein, 24 aa, Mycobacterium avium
RGELQASDELSQAAETLSKNPASL

SEQ ID NO: 9433 - protein, 18 aa, Mycobacterium avium
RGGGTGRADENEGRGERC

SEQ ID NO: 9434 - protein, 5 aa, Mycobacterium avium
RGGKT

SEQ ID NO: 9435 - protein, 8 aa, Mycobacterium avium
RGGQGGDH

SEQ ID NO: 9436 - protein, 11 aa, Mycobacterium avium
RGGQGPSLKNG

SEQ ID NO: 9437 - protein, 8 aa, Mycobacterium avium
RGGTGDEV

SEQ ID NO: 9438 - protein, 6 aa, Mycobacterium avium
RGHTTV

SEQ ID NO: 9439 - protein, 11 aa, Mycobacterium avium
RGPKTPSSTGK

SEQ ID NO: 9440 - protein, 50 aa, Mycobacterium avium
RGPRQTIESVKETRTALTPGHDKAGGARALTESHGKHAKPGDGAAADPSG

SEQ ID NO: 9441 - protein, 11 aa, Mycobacterium avium
RGQADEIAPGV

SEQ ID NO: 9442 - protein, 35 aa, Mycobacterium avium
RGQRADRLPDPAAAAAPQVADQHHEDQRREPDQKP

SEQ ID NO: 9443 - protein, 21 aa, Mycobacterium avium
RGRATVDPEEPADMLTFGQEI

SEQ ID NO: 9444 - protein, 7 aa, Mycobacterium avium
RGRGDDD

SEQ ID NO: 9445 - protein, 9 aa, Mycobacterium avium
RGRPADRPA

SEQ ID NO: 9446 - protein, 6 aa, Mycobacterium avium
RGRQES

SEQ ID NO: 9447 - protein, 8 aa, Mycobacterium avium
RGRRALPA

SEQ ID NO: 9448 - protein, 5 aa, Mycobacterium avium
RGRRG

SEQ ID NO: 9449 - protein, 20 aa, Mycobacterium avium
RGRRRPARTPERESERLPAS

SEQ ID NO: 9450 - protein, 53 aa, Mycobacterium avium
RGSTASQSGSGPGIGAGGPAGPAARRDGRAGKQPAGRCPAGPAPARAQLMGIE

SEQ ID NO: 9451 - protein, 12 aa, Mycobacterium avium
RGSTASRSGSGL

SEQ ID NO: 9452 - protein, 5 aa, Mycobacterium avium
RGSYD

SEQ ID NO: 9453 - protein, 5 aa, Mycobacterium avium
RGTEF

SEQ ID NO: 9454 - protein, 23 aa, Mycobacterium avium
RGTGGAARSIGRARDIDPGHRRD

SEQ ID NO: 9455 - protein, 13 aa, Mycobacterium avium
RGTSGHRLPPGGR

SEQ ID NO: 9456 - protein, 13 aa, Mycobacterium avium
RGTSGRRLPPGGR

SEQ ID NO: 9457 - protein, 7 aa, Mycobacterium avium
RGVGPGD

SEQ ID NO: 9458 - protein, 7 aa, Mycobacterium avium
RGVTPAE

SEQ ID NO: 9459 - protein, 7 aa, Mycobacterium avium
RGWPKPL

SEQ ID NO: 9460 - protein, 9 aa, Mycobacterium avium
RGYRDPGAA

SEQ ID NO: 9461 - protein, 7 aa, Mycobacterium avium
RGYRDRG

SEQ ID NO: 9462 - protein, 7 aa, Mycobacterium avium
RGYSPVQ

SEQ ID NO: 9463 - protein, 13 aa, Mycobacterium avium
RHARRPPPTPRDR

SEQ ID NO: 9464 - protein, 10 aa, Mycobacterium avium
RHELSETRTA

SEQ ID NO: 9465 - protein, 7 aa, Mycobacterium avium
RHNKAAQ

SEQ ID NO: 9466 - protein, 7 aa, Mycobacterium avium
RHPGGAS

SEQ ID NO: 9467 - protein, 7 aa, Mycobacterium avium
RHRRPRL

SEQ ID NO: 9468 - protein, 12 aa, Mycobacterium avium
RHSSPNGSTNGE

SEQ ID NO: 9469 - protein, 6 aa, Mycobacterium avium
RHTPDI

SEQ ID NO: 9470 - protein, 49 aa, Mycobacterium avium
RHTTGRRRERRRPGTGARCHPPQGRGEAGHAGTVRRDAADGHPDGDDHR

SEQ ID NO: 9471 - protein, 6 aa, Mycobacterium avium
RIAEQG

SEQ ID NO: 9472 - protein, 9 aa, Mycobacterium avium
RIPASSPVR

SEQ ID NO: 9473 - protein, 8 aa, Mycobacterium avium
RITERGRH

SEQ ID NO: 9474 - protein, 8 aa, Mycobacterium avium
RKAGTAAG

SEQ ID NO: 9475 - protein, 21 aa, Mycobacterium avium
RKAPRDAAPAGDVGVNPVGKS

SEQ ID NO: 9476 - protein, 13 aa, Mycobacterium avium
RKEGQSGQAKMTQ

SEQ ID NO: 9477 - protein, 6 aa, Mycobacterium avium
RKENVQ

SEQ ID NO: 9478 - protein, 11 aa, Mycobacterium avium
RKEQQPEPRAV

SEQ ID NO: 9479 - protein, 8 aa, Mycobacterium avium
RKKAAAAE

SEQ ID NO: 9480 - protein, 10 aa, Mycobacterium avium
RKKATDTELP

SEQ ID NO: 9481 - protein, 5 aa, Mycobacterium avium
RKRLR

SEQ ID NO: 9482 - protein, 11 aa, Mycobacterium avium
RLAGGSGERQR

SEQ ID NO: 9483 - protein, 5 aa, Mycobacterium avium
RLERG

SEQ ID NO: 9484 - protein, 11 aa, Mycobacterium avium
RLPATTSNEYE

SEQ ID NO: 9485 - protein, 12 aa, Mycobacterium avium
RLPGDMNSPDET

SEQ ID NO: 9486 - protein, 6 aa, Mycobacterium avium
RLPGTL

SEQ ID NO: 9487 - protein, 8 aa, Mycobacterium avium
RLPVDNPA

SEQ ID NO: 9488 - protein, 7 aa, Mycobacterium avium
RLTDPDD

SEQ ID NO: 9489 - protein, 57 aa, Mycobacterium avium
RMTGRDARSSLPRSSAPDAGKLSVPSAADDRAELTQRDGPAELEPPDGPRQLPPAPP

SEQ ID NO: 9490 - protein, 55 aa, Mycobacterium avium
RMTGRDARSSLPRSSAPDAGKLSVPSAADDRAELTQRDGPAELEPPDGPRQLPPP

SEQ ID NO: 9491 - protein, 57 aa, Mycobacterium avium
RMTGRDTRSSLPRSSAPDAGKLSVPSAADDRAELTQRDGPAELQPPDGPRQLPPAPP

SEQ ID NO: 9492 - protein, 9 aa, Mycobacterium avium
RNAAADDTR

SEQ ID NO: 9493 - protein, 10 aa, Mycobacterium avium
RNANRKRHEE

SEQ ID NO: 9494 - protein, 20 aa, Mycobacterium avium
RNDGTYATPAQRPDRPSEEI

SEQ ID NO: 9495 - protein, 43 aa, Mycobacterium avium
RNEHKASTAAPSTSTSAPETTTPGQPSQVPPLPPFKPSADVGA

SEQ ID NO: 9496 - protein, 7 aa, Mycobacterium avium
RNPSDDV

SEQ ID NO: 9497 - protein, 12 aa, Mycobacterium avium
RNPVSNTGSAQH

SEQ ID NO: 9498 - protein, 15 aa, Mycobacterium avium
RNSEPAAAGKDPFVG

SEQ ID NO: 9499 - protein, 14 aa, Mycobacterium avium
RNSEPAAGKDPFVG

SEQ ID NO: 9500 - protein, 10 aa, Mycobacterium avium
RPAKRPPPET

SEQ ID NO: 9501 - protein, 8 aa, Mycobacterium avium
RPAPDELE

SEQ ID NO: 9502 - protein, 25 aa, Mycobacterium avium
RPARRPSGDQASTTGDSDTNRGASG

SEQ ID NO: 9503 - protein, 17 aa, Mycobacterium avium
RPASLDNPRSPRRRAGI

SEQ ID NO: 9504 - protein, 12 aa, Mycobacterium avium
RPDAYTAADKLT

SEQ ID NO: 9505 - protein, 22 aa, Mycobacterium avium
RPDTASTHPVTKPPTSTSGGQP

SEQ ID NO: 9506 - protein, 6 aa, Mycobacterium avium
RPDTGQ

SEQ ID NO: 9507 - protein, 12 aa, Mycobacterium avium
RPEIDRRPTPKT

SEQ ID NO: 9508 - protein, 5 aa, Mycobacterium avium
RPERD

SEQ ID NO: 9509 - protein, 8 aa, Mycobacterium avium
RPESTQPK

SEQ ID NO: 9510 - protein, 7 aa, Mycobacterium avium
RPGANDR

SEQ ID NO: 9511 - protein, 7 aa, Mycobacterium avium
RPGGFPP

SEQ ID NO: 9512 - protein, 8 aa, Mycobacterium avium
RPGGFPPA

SEQ ID NO: 9513 - protein, 9 aa, Mycobacterium avium
RPGPIPPYD

SEQ ID NO: 9514 - protein, 19 aa, Mycobacterium avium
RPGRHPGRPETGAAQSPTA

SEQ ID NO: 9515 - protein, 21 aa, Mycobacterium avium
RPKKYREQSEFRPSEQPADPV

SEQ ID NO: 9516 - protein, 42 aa, Mycobacterium avium
RPLPPAGHSTPAGESETDKAEAATDPAVPVAGDTANSRESAN

SEQ ID NO: 9517 - protein, 42 aa, Mycobacterium avium
RPLPPAGHSTPAGESETDQAEAATDPAVPVAGDTANSRESAN

SEQ ID NO: 9518 - protein, 10 aa, Mycobacterium avium
RPLRADDDEL

SEQ ID NO: 9519 - protein, 12 aa, Mycobacterium avium
RPPAELAAQRDE

SEQ ID NO: 9520 - protein, 6 aa, Mycobacterium avium
RPPNRK

SEQ ID NO: 9521 - protein, 23 aa, Mycobacterium avium
RPQNADGEPVSGADNREQTAKKS

SEQ ID NO: 9522 - protein, 23 aa, Mycobacterium avium
RPQSADGEPVSDADNREQTAKKS

SEQ ID NO: 9523 - protein, 23 aa, Mycobacterium avium
RPQSADGEPVSGADNREQTAKKS

SEQ ID NO: 9524 - protein, 37 aa, Mycobacterium avium
RPRTETPPEAPPKPPPKPKPKPEASIPPAASTGPADD

SEQ ID NO: 9525 - protein, 39 aa, Mycobacterium avium
RPRTETPPETPPEAPPKPAPKPKPEASIPPAASTGPADD

SEQ ID NO: 9526 - protein, 6 aa, Mycobacterium avium
RPRTLP

SEQ ID NO: 9527 - protein, 7 aa, Mycobacterium avium
RPSGRWG

SEQ ID NO: 9528 - protein, 5 aa, Mycobacterium avium
RPTDP

SEQ ID NO: 9529 - protein, 17 aa, Mycobacterium avium
RPTEVGLPDENPNLTEP

SEQ ID NO: 9530 - protein, 28 aa, Mycobacterium avium
RPTGGSSTASSTTSTTPSYTAEQTAAAH

SEQ ID NO: 9531 - protein, 28 aa, Mycobacterium avium
RPTGGSSTVSSTTSTTPSYTAEQTAAAH

SEQ ID NO: 9532 - protein, 28 aa, Mycobacterium avium
RPTGGSSTVSSTTTTTPSYTAEQTAAAH

SEQ ID NO: 9533 - protein, 5 aa, Mycobacterium avium
RPTGP

SEQ ID NO: 9534 - protein, 12 aa, Mycobacterium avium
RPTMPDGVRDRA

SEQ ID NO: 9535 - protein, 28 aa, Mycobacterium avium
RPTPPGRAGDAPGRRRGAARAGGRAGGD

SEQ ID NO: 9536 - protein, 6 aa, Mycobacterium avium
RPVDPT

SEQ ID NO: 9537 - protein, 14 aa, Mycobacterium avium
RPVSTTGESGNQNT

SEQ ID NO: 9538 - protein, 13 aa, Mycobacterium avium
RPWESRSSTARFR

SEQ ID NO: 9539 - protein, 8 aa, Mycobacterium avium
RQADPTLA

SEQ ID NO: 9540 - protein, 15 aa, Mycobacterium avium
RQAFRDSRGGVPDDG

SEQ ID NO: 9541 - protein, 8 aa, Mycobacterium avium
RQPDGGWG

SEQ ID NO: 9542 - protein, 11 aa, Mycobacterium avium
RQPGDVGLTPA

SEQ ID NO: 9543 - protein, 6 aa, Mycobacterium avium
RQPGEV

SEQ ID NO: 9544 - protein, 5 aa, Mycobacterium avium
RQPNL

SEQ ID NO: 9545 - protein, 6 aa, Mycobacterium avium
RQQNPA

SEQ ID NO: 9546 - protein, 8 aa, Mycobacterium avium
RQQNPAIA

SEQ ID NO: 9547 - protein, 6 aa, Mycobacterium avium
RQQPTL

SEQ ID NO: 9548 - protein, 9 aa, Mycobacterium avium
RQQTSQSRL

SEQ ID NO: 9549 - protein, 8 aa, Mycobacterium avium
RQRAQRAV

SEQ ID NO: 9550 - protein, 6 aa, Mycobacterium avium
RQRDDL

SEQ ID NO: 9551 - protein, 6 aa, Mycobacterium avium
RQSDAL

SEQ ID NO: 9552 - protein, 9 aa, Mycobacterium avium
RRADATGND

SEQ ID NO: 9553 - protein, 24 aa, Mycobacterium avium
RRADRTSTSAGAEPAGADTPDENR

SEQ ID NO: 9554 - protein, 24 aa, Mycobacterium avium
RRADRTSTSAGAEPAGPDTPDENR

SEQ ID NO: 9555 - protein, 24 aa, Mycobacterium avium
RRADRTSTSAGAEPVGPDTPDENR

SEQ ID NO: 9556 - protein, 9 aa, Mycobacterium avium
RRADTTGSD

SEQ ID NO: 9557 - protein, 18 aa, Mycobacterium avium
RRAEEPKSPSEVNVTRVL

SEQ ID NO: 9558 - protein, 16 aa, Mycobacterium avium
RRAEQAGRSPEHVPPG

SEQ ID NO: 9559 - protein, 19 aa, Mycobacterium avium
RRAGSPRPTWAKRTSRPAL

SEQ ID NO: 9560 - protein, 39 aa, Mycobacterium avium
RRAPGNAGKPAIRSGDQRGRSSQPFAGRRSSAAAANRKE

SEQ ID NO: 9561 - protein, 9 aa, Mycobacterium avium
RRAPTSDEL

SEQ ID NO: 9562 - protein, 16 aa, Mycobacterium avium
RREAFRDSRGGVPDDG

SEQ ID NO: 9563 - protein, 84 aa, Mycobacterium avium
RREAQAQAAKAAAETSEADEHAADDEAAETDDEVSDSVEATDADDTETTQAETKEAAKETEPKEEAAEETAEDAESESKARSRR

SEQ ID NO: 9564 - protein, 6 aa, Mycobacterium avium
RRERQL

SEQ ID NO: 9565 - protein, 4 aa, Mycobacterium avium
RRGG

SEQ ID NO: 9566 - protein, 5 aa, Mycobacterium avium
RRGGI

SEQ ID NO: 9567 - protein, 22 aa, Mycobacterium avium
RRGGPRESVATGDHGHEHSHQT

SEQ ID NO: 9568 - protein, 33 aa, Mycobacterium avium
RRGPASCDGAPVGVRASGRQSGPGGRADGRFGR

SEQ ID NO: 9569 - protein, 11 aa, Mycobacterium avium
RRGSSSPARTY

SEQ ID NO: 9570 - protein, 8 aa, Mycobacterium avium
RRHPDGTP

SEQ ID NO: 9571 - protein, 33 aa, Mycobacterium avium
RRHPRSVHPDPARPDRGRAGAGGDPLGSGPHGY

SEQ ID NO: 9572 - protein, 7 aa, Mycobacterium avium
RRNHGRS

SEQ ID NO: 9573 - protein, 26 aa, Mycobacterium avium
RRPVAPAGQGGGRPTELTPPPCRGPG

SEQ ID NO: 9574 - protein, 11 aa, Mycobacterium avium
RRPVDERAGRA

SEQ ID NO: 9575 - protein, 12 aa, Mycobacterium avium
RRQSGTRALPPD

SEQ ID NO: 9576 - protein, 24 aa, Mycobacterium avium
RRQVTATSIGDSHSRRDLESPTVT

SEQ ID NO: 9577 - protein, 5 aa, Mycobacterium avium
RRRGE

SEQ ID NO: 9578 - protein, 9 aa, Mycobacterium avium
RRRGKALSG

SEQ ID NO: 9579 - protein, 9 aa, Mycobacterium avium
RRRGKALSS

SEQ ID NO: 9580 - protein, 5 aa, Mycobacterium avium
RRRQA

SEQ ID NO: 9581 - protein, 7 aa, Mycobacterium avium
RRRRASD

SEQ ID NO: 9582 - protein, 7 aa, Mycobacterium avium
RRRSDPV

SEQ ID NO: 9583 - protein, 8 aa, Mycobacterium avium
RRSAGSPF

SEQ ID NO: 9584 - protein, 5 aa, Mycobacterium avium
RRSGS

SEQ ID NO: 9585 - protein, 14 aa, Mycobacterium avium
RRSKVRGARRGERV

SEQ ID NO: 9586 - protein, 9 aa, Mycobacterium avium
RRTDAAPGP

SEQ ID NO: 9587 - protein, 4 aa, Mycobacterium avium
RRTG

SEQ ID NO: 9588 - protein, 9 aa, Mycobacterium avium
RRTGAAPGP

SEQ ID NO: 9589 - protein, 6 aa, Mycobacterium avium
RRTGEK

SEQ ID NO: 9590 - protein, 8 aa, Mycobacterium avium
RRTGEKHR

SEQ ID NO: 9591 - protein, 14 aa, Mycobacterium avium
RRTPTTRTRSCRPW

SEQ ID NO: 9592 - protein, 18 aa, Mycobacterium avium
RRTRTSGNHSSTVSTSAA

SEQ ID NO: 9593 - protein, 10 aa, Mycobacterium avium
RRTVPDSGAV

SEQ ID NO: 9594 - protein, 8 aa, Mycobacterium avium
RRYTPAGG

SEQ ID NO: 9595 - protein, 9 aa, Mycobacterium avium
RRYTPPGGA

SEQ ID NO: 9596 - protein, 14 aa, Mycobacterium avium
RSAAEEALKNTPLE

SEQ ID NO: 9597 - protein, 15 aa, Mycobacterium avium
RSAAEEALKNTPLEN

SEQ ID NO: 9598 - protein, 23 aa, Mycobacterium avium
RSAEPVGATPRAAHSARPPLRPA

SEQ ID NO: 9599 - protein, 21 aa, Mycobacterium avium
RSAQEQLDEQAAELRRSNTEL

SEQ ID NO: 9600 - protein, 8 aa, Mycobacterium avium
RSARSKLQ

SEQ ID NO: 9601 - protein, 7 aa, Mycobacterium avium
RSATEDK

SEQ ID NO: 9602 - protein, 9 aa, Mycobacterium avium
RSDPAGDYA

SEQ ID NO: 9603 - protein, 9 aa, Mycobacterium avium
RSESAVKAL

SEQ ID NO: 9604 - protein, 9 aa, Mycobacterium avium
RSFGQDREE

SEQ ID NO: 9605 - protein, 6 aa, Mycobacterium avium
RSGARR

SEQ ID NO: 9606 - protein, 7 aa, Mycobacterium avium
RSGGPFA

SEQ ID NO: 9607 - protein, 10 aa, Mycobacterium avium
RSGKVTRKRE

SEQ ID NO: 9608 - protein, 16 aa, Mycobacterium avium
RSIGRARDIDPGHRRD

SEQ ID NO: 9609 - protein, 9 aa, Mycobacterium avium
RSKAPGDKI

SEQ ID NO: 9610 - protein, 8 aa, Mycobacterium avium
RSLGGSSN

SEQ ID NO: 9611 - protein, 15 aa, Mycobacterium avium
RSLSPAGPPPTQGGA

SEQ ID NO: 9612 - protein, 9 aa, Mycobacterium avium
RSPDCRTAN

SEQ ID NO: 9613 - protein, 5 aa, Mycobacterium avium
RSPLS

SEQ ID NO: 9614 - protein, 6 aa, Mycobacterium avium
RSPLSR

SEQ ID NO: 9615 - protein, 20 aa, Mycobacterium avium
RSQAASAPTADETPPFSTEK

SEQ ID NO: 9616 - protein, 7 aa, Mycobacterium avium
RSQIDPV

SEQ ID NO: 9617 - protein, 5 aa, Mycobacterium avium
RSQIN

SEQ ID NO: 9618 - protein, 7 aa, Mycobacterium avium
RSRPSAR

SEQ ID NO: 9619 - protein, 15 aa, Mycobacterium avium
RSRRGGGGLDADRGR

SEQ ID NO: 9620 - protein, 23 aa, Mycobacterium avium
RSRSGSASRSSAASDRCCGSSST

SEQ ID NO: 9621 - protein, 18 aa, Mycobacterium avium
RSSAPAPSVAAPTPAPTV

SEQ ID NO: 9622 - protein, 10 aa, Mycobacterium avium
RSSKVTRKRE

SEQ ID NO: 9623 - protein, 6 aa, Mycobacterium avium
RSSPLG

SEQ ID NO: 9624 - protein, 6 aa, Mycobacterium avium
RSSPPR

SEQ ID NO: 9625 - protein, 12 aa, Mycobacterium avium
RSTFAESADRTR

SEQ ID NO: 9626 - protein, 5 aa, Mycobacterium avium
RSTTL

SEQ ID NO: 9627 - protein, 17 aa, Mycobacterium avium
RSVRRPRSLRRGSRPVR

SEQ ID NO: 9628 - protein, 8 aa, Mycobacterium avium
RTAAAAGI

SEQ ID NO: 9629 - protein, 5 aa, Mycobacterium avium
RTAAD

SEQ ID NO: 9630 - protein, 8 aa, Mycobacterium avium
RTAALGGA

SEQ ID NO: 9631 - protein, 27 aa, Mycobacterium avium
RTAATRRQCRDTDGRTRRVAEDPRRSA

SEQ ID NO: 9632 - protein, 9 aa, Mycobacterium avium
RTANPQAED

SEQ ID NO: 9633 - protein, 12 aa, Mycobacterium avium
RTAPPSPPARLP

SEQ ID NO: 9634 - protein, 13 aa, Mycobacterium avium
RTARAPARGVDNQ

SEQ ID NO: 9635 - protein, 8 aa, Mycobacterium avium
RTASPAHA

SEQ ID NO: 9636 - protein, 8 aa, Mycobacterium avium
RTDPGART

SEQ ID NO: 9637 - protein, 5 aa, Mycobacterium avium
RTEPA

SEQ ID NO: 9638 - protein, 6 aa, Mycobacterium avium
RTEPQT

SEQ ID NO: 9639 - protein, 10 aa, Mycobacterium avium
RTGAQAAGAA

SEQ ID NO: 9640 - protein, 5 aa, Mycobacterium avium
RTGAY

SEQ ID NO: 9641 - protein, 23 aa, Mycobacterium avium
RTGPRPPPPPAEQPAELGDPAHT

SEQ ID NO: 9642 - protein, 10 aa, Mycobacterium avium
RTGQGGEPRM

SEQ ID NO: 9643 - protein, 5 aa, Mycobacterium avium
RTLGG

SEQ ID NO: 9644 - protein, 6 aa, Mycobacterium avium
RTPAQR

SEQ ID NO: 9645 - protein, 6 aa, Mycobacterium avium
RTPFTG

SEQ ID NO: 9646 - protein, 8 aa, Mycobacterium avium
RTPFTGDS

SEQ ID NO: 9647 - protein, 7 aa, Mycobacterium avium
RTPTGLR

SEQ ID NO: 9648 - protein, 5 aa, Mycobacterium avium
RTQPT

SEQ ID NO: 9649 - protein, 17 aa, Mycobacterium avium
RTRAGDAHAPAGARAAS

SEQ ID NO: 9650 - protein, 6 aa, Mycobacterium avium
RTRPAS

SEQ ID NO: 9651 - protein, 10 aa, Mycobacterium avium
RTRRPQPPGV

SEQ ID NO: 9652 - protein, 6 aa, Mycobacterium avium
RTRTAL

SEQ ID NO: 9653 - protein, 13 aa, Mycobacterium avium
RTSPELSAADRAA

SEQ ID NO: 9654 - protein, 8 aa, Mycobacterium avium
RTSSPYSL

SEQ ID NO: 9655 - protein, 12 aa, Mycobacterium avium
RVADPNVQGRPR

SEQ ID NO: 9656 - protein, 7 aa, Mycobacterium avium
RVEPDQD

SEQ ID NO: 9657 - protein, 27 aa, Mycobacterium avium
RVPPPEPEPVGPPPAQPATLAPPYRPG

SEQ ID NO: 9658 - protein, 7 aa, Mycobacterium avium
RVPRRGD

SEQ ID NO: 9659 - protein, 7 aa, Mycobacterium avium
RVRPDHA

SEQ ID NO: 9660 - protein, 4 aa, Mycobacterium avium
RVRR

SEQ ID NO: 9661 - protein, 4 aa, Mycobacterium avium
RVTD

SEQ ID NO: 9662 - protein, 5 aa, Mycobacterium avium
RWPGR

SEQ ID NO: 9663 - protein, 14 aa, Mycobacterium avium
RYSPRLDPETVGQI

SEQ ID NO: 9664 - protein, 31 aa, Mycobacterium avium
SAAAAPTAPAPAPAVAAAGSAAPPPAGPGGF

SEQ ID NO: 9665 - protein, 31 aa, Mycobacterium avium
SAAAPHPGAANYPAGDTGDRRTRRPPPMPSA

SEQ ID NO: 9666 - protein, 22 aa, Mycobacterium avium
SAAARAARPPTRARSRPLRRPR

SEQ ID NO: 9667 - protein, 8 aa, Mycobacterium avium
SAAGAASL

SEQ ID NO: 9668 - protein, 7 aa, Mycobacterium avium
SAAGTAL

SEQ ID NO: 9669 - protein, 19 aa, Mycobacterium avium
SAARHAAPEPTDVDDDEHH

SEQ ID NO: 9670 - protein, 12 aa, Mycobacterium avium
SAATGGPPPSLS

SEQ ID NO: 9671 - protein, 11 aa, Mycobacterium avium
SAATGGPPQSL

SEQ ID NO: 9672 - protein, 14 aa, Mycobacterium avium
SACPPSGRRRPGPT

SEQ ID NO: 9673 - protein, 7 aa, Mycobacterium avium
SADCTGK

SEQ ID NO: 9674 - protein, 10 aa, Mycobacterium avium
SADRDPLRYE

SEQ ID NO: 9675 - protein, 11 aa, Mycobacterium avium
SADRDPRRYQD

SEQ ID NO: 9676 - protein, 10 aa, Mycobacterium avium
SAESLRETLR

SEQ ID NO: 9677 - protein, 14 aa, Mycobacterium avium
SAETGAPPPAPRAA

SEQ ID NO: 9678 - protein, 13 aa, Mycobacterium avium
SAEYGATEAQLQS

SEQ ID NO: 9679 - protein, 16 aa, Mycobacterium avium
SAGIGRATAKEFGRRG

SEQ ID NO: 9680 - protein, 9 aa, Mycobacterium avium
SAGPGSGPL

SEQ ID NO: 9681 - protein, 9 aa, Mycobacterium avium
SAKAGLDGF

SEQ ID NO: 9682 - protein, 36 aa, Mycobacterium avium
SALAAAPRTAPAPSIVKSGGEANNLAANAAQNSSGD

SEQ ID NO: 9683 - protein, 10 aa, Mycobacterium avium
SALRAQAAGQ

SEQ ID NO: 9684 - protein, 9 aa, Mycobacterium avium
SANPDAPGE

SEQ ID NO: 9685 - protein, 12 aa, Mycobacterium avium
SAPAYEQNPYPN

SEQ ID NO: 9686 - protein, 8 aa, Mycobacterium avium
SAPDDRAL

SEQ ID NO: 9687 - protein, 10 aa, Mycobacterium avium
SAPNRPAGPR

SEQ ID NO: 9688 - protein, 19 aa, Mycobacterium avium
SAPNRPAGPRRLDASPKRT

SEQ ID NO: 9689 - protein, 7 aa, Mycobacterium avium
SAPPAAM

SEQ ID NO: 9690 - protein, 9 aa, Mycobacterium avium
SAPPGPSER

SEQ ID NO: 9691 - protein, 14 aa, Mycobacterium avium
SAPSNQGQEAANRH

SEQ ID NO: 9692 - protein, 9 aa, Mycobacterium avium
SAPSSYPPF

SEQ ID NO: 9693 - protein, 5 aa, Mycobacterium avium
SAQEA

SEQ ID NO: 9694 - protein, 5 aa, Mycobacterium avium
SAQHG

SEQ ID NO: 9695 - protein, 53 aa, Mycobacterium avium
SAQRAARRDVRNGRRRDRAGHPRAAGRRPADGRGCHHPPAQHRRPGPAGRGDR

SEQ ID NO: 9696 - protein, 7 aa, Mycobacterium avium
SARDQSL

SEQ ID NO: 9697 - protein, 4 aa, Mycobacterium avium
SARR

SEQ ID NO: 9698 - protein, 26 aa, Mycobacterium avium
SARSDAESPDADAAEHHRRRSEAERD

SEQ ID NO: 9699 - protein, 25 aa, Mycobacterium avium
SASDGDDAPAGADRSAAAPARSRPR

SEQ ID NO: 9700 - protein, 6 aa, Mycobacterium avium
SASEAG

SEQ ID NO: 9701 - protein, 12 aa, Mycobacterium avium
SASGTTDSERAR

SEQ ID NO: 9702 - protein, 9 aa, Mycobacterium avium
SASPAPLGG

SEQ ID NO: 9703 - protein, 11 aa, Mycobacterium avium
SASPAPLGGSH

SEQ ID NO: 9704 - protein, 10 aa, Mycobacterium avium
SASPENPRTV

SEQ ID NO: 9705 - protein, 8 aa, Mycobacterium avium
SASPLGRD

SEQ ID NO: 9706 - protein, 5 aa, Mycobacterium avium
SASRL

SEQ ID NO: 9707 - protein, 16 aa, Mycobacterium avium
SASTTSNTITDNQRSL

SEQ ID NO: 9708 - protein, 6 aa, Mycobacterium avium
SATAGR

SEQ ID NO: 9709 - protein, 5 aa, Mycobacterium avium
SATGQ

SEQ ID NO: 9710 - protein, 6 aa, Mycobacterium avium
SATGQT

SEQ ID NO: 9711 - protein, 19 aa, Mycobacterium avium
SATPDGVQVGPRAGYAKGQ

SEQ ID NO: 9712 - protein, 11 aa, Mycobacterium avium
SATPSGVSDRQ

SEQ ID NO: 9713 - protein, 11 aa, Mycobacterium avium
SATPSGVSERQ

SEQ ID NO: 9714 - protein, 7 aa, Mycobacterium avium
SATRGPH

SEQ ID NO: 9715 - protein, 7 aa, Mycobacterium avium
SAYPTVE

SEQ ID NO: 9716 - protein, 9 aa, Mycobacterium avium
SDADAAESL

SEQ ID NO: 9717 - protein, 8 aa, Mycobacterium avium
SDAGSQFT

SEQ ID NO: 9718 - protein, 58 aa, Mycobacterium avium
SDDDDAADTGTQSWAPDFDDDAEDDDAEAAEPAAEREPEPEPEPEPEPAGFAGPVPPV

SEQ ID NO: 9719 - protein, 56 aa, Mycobacterium avium
SDDDDAADTGTQSWAPDFDDDAEDDDTEAAEPAAERGPEPEPEPEPAGFAGPVPPV

SEQ ID NO: 9720 - protein, 9 aa, Mycobacterium avium
SDEMNEEVS

SEQ ID NO: 9721 - protein, 7 aa, Mycobacterium avium
SDGAGAT

SEQ ID NO: 9722 - protein, 8 aa, Mycobacterium avium
SDGAGATT

SEQ ID NO: 9723 - protein, 14 aa, Mycobacterium avium
SDGHGSNTRHNQGV

SEQ ID NO: 9724 - protein, 14 aa, Mycobacterium avium
SDGHSTNTRHNQGV

SEQ ID NO: 9725 - protein, 7 aa, Mycobacterium avium
SDGRTAP

SEQ ID NO: 9726 - protein, 6 aa, Mycobacterium avium
SDGSEI

SEQ ID NO: 9727 - protein, 6 aa, Mycobacterium avium
SDGSVH

SEQ ID NO: 9728 - protein, 6 aa, Mycobacterium avium
SDHAVT

SEQ ID NO: 9729 - protein, 8 aa, Mycobacterium avium
SDKNAGLS

SEQ ID NO: 9730 - protein, 19 aa, Mycobacterium avium
SDPAGGGSRTLPVTLGKAD

SEQ ID NO: 9731 - protein, 9 aa, Mycobacterium avium
SDQGSQFSG

SEQ ID NO: 9732 - protein, 5 aa, Mycobacterium avium
SDQMS

SEQ ID NO: 9733 - protein, 27 aa, Mycobacterium avium
SDSALDDDLGEDLDDDHADAATLTDED

SEQ ID NO: 9734 - protein, 19 aa, Mycobacterium avium
SDSRDAAAKQGTESSTTRR

SEQ ID NO: 9735 - protein, 14 aa, Mycobacterium avium
SDTGTDAAAPPPRR

SEQ ID NO: 9736 - protein, 9 aa, Mycobacterium avium
SEADPTAGR

SEQ ID NO: 9737 - protein, 8 aa, Mycobacterium avium
SEDEARSA

SEQ ID NO: 9738 - protein, 4 aa, Mycobacterium avium
SEHS

SEQ ID NO: 9739 - protein, 5 aa, Mycobacterium avium
SEIHS

SEQ ID NO: 9740 - protein, 7 aa, Mycobacterium avium
SEKTYKA

SEQ ID NO: 9741 - protein, 11 aa, Mycobacterium avium
SELRDNDSSVA

SEQ ID NO: 9742 - protein, 8 aa, Mycobacterium avium
SEQPTGRP

SEQ ID NO: 9743 - protein, 15 aa, Mycobacterium avium
SERAPARARRDGKRV

SEQ ID NO: 9744 - protein, 14 aa, Mycobacterium avium
SERDPARARRGGKR

SEQ ID NO: 9745 - protein, 5 aa, Mycobacterium avium
SERGF

SEQ ID NO: 9746 - protein, 19 aa, Mycobacterium avium
SERRAQQAAEAAQRAETAT

SEQ ID NO: 9747 - protein, 8 aa, Mycobacterium avium
SESTIRQA

SEQ ID NO: 9748 - protein, 6 aa, Mycobacterium avium
SETAAA

SEQ ID NO: 9749 - protein, 8 aa, Mycobacterium avium
SETVEGRG

SEQ ID NO: 9750 - protein, 12 aa, Mycobacterium avium
SETVRDGKPAAK

SEQ ID NO: 9751 - protein, 14 aa, Mycobacterium avium
SETVRDGKPAAKFT

SEQ ID NO: 9752 - protein, 5 aa, Mycobacterium avium
SFAPA

SEQ ID NO: 9753 - protein, 9 aa, Mycobacterium avium
SFPAPSTSV

SEQ ID NO: 9754 - protein, 7 aa, Mycobacterium avium
SFRDPAH

SEQ ID NO: 9755 - protein, 5 aa, Mycobacterium avium
SFSNA

SEQ ID NO: 9756 - protein, 16 aa, Mycobacterium avium
SFSSRTPVNDNPDQVE

SEQ ID NO: 9757 - protein, 6 aa, Mycobacterium avium
SGAARA

SEQ ID NO: 9758 - protein, 5 aa, Mycobacterium avium
SGAGD

SEQ ID NO: 9759 - protein, 7 aa, Mycobacterium avium
SGAGGDQ

SEQ ID NO: 9760 - protein, 7 aa, Mycobacterium avium
SGAGGGQ

SEQ ID NO: 9761 - protein, 56 aa, Mycobacterium avium
SGATPASVAAPAPDPQAEPETQPAPPPPSDTPIPPPPTDPSGPSANGGQPKPSLAE

SEQ ID NO: 9762 - protein, 14 aa, Mycobacterium avium
SGAYRATRVGSQAY

SEQ ID NO: 9763 - protein, 6 aa, Mycobacterium avium
SGEWSK

SEQ ID NO: 9764 - protein, 11 aa, Mycobacterium avium
SGGAAASAGLP

SEQ ID NO: 9765 - protein, 10 aa, Mycobacterium avium
SGGDVAPGLR

SEQ ID NO: 9766 - protein, 11 aa, Mycobacterium avium
SGGDVAPGLRS

SEQ ID NO: 9767 - protein, 12 aa, Mycobacterium avium
SGGFPPPIAPDA

SEQ ID NO: 9768 - protein, 11 aa, Mycobacterium avium
SGGSGMSGGNP

SEQ ID NO: 9769 - protein, 11 aa, Mycobacterium avium
SGKLSRDASGV

SEQ ID NO: 9770 - protein, 8 aa, Mycobacterium avium
SGLQPDRR

SEQ ID NO: 9771 - protein, 8 aa, Mycobacterium avium
SGLQQQGV

SEQ ID NO: 9772 - protein, 10 aa, Mycobacterium avium
SGLRGATKEE

SEQ ID NO: 9773 - protein, 7 aa, Mycobacterium avium
SGQTATR

SEQ ID NO: 9774 - protein, 14 aa, Mycobacterium avium
SGSAAAGQAERLGA

SEQ ID NO: 9775 - protein, 7 aa, Mycobacterium avium
SGSGSSY

SEQ ID NO: 9776 - protein, 10 aa, Mycobacterium avium
SGSPQPGNYV

SEQ ID NO: 9777 - protein, 6 aa, Mycobacterium avium
SGSRRD

SEQ ID NO: 9778 - protein, 7 aa, Mycobacterium avium
SGSRRDA

SEQ ID NO: 9779 - protein, 10 aa, Mycobacterium avium
SGSRRPSARR

SEQ ID NO: 9780 - protein, 4 aa, Mycobacterium avium
SGTG

SEQ ID NO: 9781 - protein, 16 aa, Mycobacterium avium
SGTTGKPKGVPRAPRL

SEQ ID NO: 9782 - protein, 20 aa, Mycobacterium avium
SGTTGTPKGAKHSGGGPETL

SEQ ID NO: 9783 - protein, 10 aa, Mycobacterium avium
SGTTSDPKGV

SEQ ID NO: 9784 - protein, 9 aa, Mycobacterium avium
SGTTSRPKG

SEQ ID NO: 9785 - protein, 4 aa, Mycobacterium avium
SGVR

SEQ ID NO: 9786 - protein, 10 aa, Mycobacterium avium
SGVVTSDSRE

SEQ ID NO: 9787 - protein, 9 aa, Mycobacterium avium
SHASPSTGL

SEQ ID NO: 9788 - protein, 11 aa, Mycobacterium avium
SHENADAALRA

SEQ ID NO: 9789 - protein, 8 aa, Mycobacterium avium
SHGEREPA

SEQ ID NO: 9790 - protein, 10 aa, Mycobacterium avium
SHSAPEHNAA

SEQ ID NO: 9791 - protein, 5 aa, Mycobacterium avium
SHSSR

SEQ ID NO: 9792 - protein, 7 aa, Mycobacterium avium
SIAGQTL

SEQ ID NO: 9793 - protein, 4 aa, Mycobacterium avium
SIGL

SEQ ID NO: 9794 - protein, 9 aa, Mycobacterium avium
SIGTVGDSF

SEQ ID NO: 9795 - protein, 5 aa, Mycobacterium avium
SKRPG

SEQ ID NO: 9796 - protein, 4 aa, Mycobacterium avium
SKSH

SEQ ID NO: 9797 - protein, 46 aa, Mycobacterium avium
SKTAARSGSRTSRSKATSRSSGSRGARPAASRRKPGRPTRRRQHPP

SEQ ID NO: 9798 - protein, 8 aa, Mycobacterium avium
SLDANPVA

SEQ ID NO: 9799 - protein, 12 aa, Mycobacterium avium
SLDANPVAAQPV

SEQ ID NO: 9800 - protein, 27 aa, Mycobacterium avium
SLDANPVAARPDPVPVAPPTKRPAARR

SEQ ID NO: 9801 - protein, 8 aa, Mycobacterium avium
SLGEPASA

SEQ ID NO: 9802 - protein, 9 aa, Mycobacterium avium
SLGGQSGQF

SEQ ID NO: 9803 - protein, 10 aa, Mycobacterium avium
SLGSSSDLRV

SEQ ID NO: 9804 - protein, 5 aa, Mycobacterium avium
SLPET

SEQ ID NO: 9805 - protein, 41 aa, Mycobacterium avium
SLPPAGHSTPAGESETDQAEAATDPAVPVAGDTANSRESAN

SEQ ID NO: 9806 - protein, 11 aa, Mycobacterium avium
SLRDDADLRDK

SEQ ID NO: 9807 - protein, 4 aa, Mycobacterium avium
SNAT

SEQ ID NO: 9808 - protein, 11 aa, Mycobacterium avium
SNKVRPDGRVD

SEQ ID NO: 9809 - protein, 6 aa, Mycobacterium avium
SNPAGG

SEQ ID NO: 9810 - protein, 10 aa, Mycobacterium avium
SNPQGGADAV

SEQ ID NO: 9811 - protein, 13 aa, Mycobacterium avium
SNPQGSADAVTVA

SEQ ID NO: 9812 - protein, 6 aa, Mycobacterium avium
SNPRER

SEQ ID NO: 9813 - protein, 10 aa, Mycobacterium avium
SNPSDPHDGV

SEQ ID NO: 9814 - protein, 5 aa, Mycobacterium avium
SNSHG

SEQ ID NO: 9815 - protein, 17 aa, Mycobacterium avium
SPAPRERSRTAESGKPL

SEQ ID NO: 9816 - protein, 32 aa, Mycobacterium avium
SPAPRPAPEPQQPAPEPQQPAPRPARAASDTS

SEQ ID NO: 9817 - protein, 33 aa, Mycobacterium avium
SPAPRPAPERAPEPAPEPQQPAPRPARAASDTS

SEQ ID NO: 9818 - protein, 22 aa, Mycobacterium avium
SPASFGGSTSSSGGGVLGGGGR

SEQ ID NO: 9819 - protein, 8 aa, Mycobacterium avium
SPDGKTAR

SEQ ID NO: 9820 - protein, 10 aa, Mycobacterium avium
SPDGSAHDPE

SEQ ID NO: 9821 - protein, 11 aa, Mycobacterium avium
SPDRSARLGQH

SEQ ID NO: 9822 - protein, 13 aa, Mycobacterium avium
SPDVPTTHEPPTY

SEQ ID NO: 9823 - protein, 10 aa, Mycobacterium avium
SPEPGSGKTR

SEQ ID NO: 9824 - protein, 17 aa, Mycobacterium avium
SPGEPGSSEQMTANRIN

SEQ ID NO: 9825 - protein, 6 aa, Mycobacterium avium
SPGEPQ

SEQ ID NO: 9826 - protein, 11 aa, Mycobacterium avium
SPGPQSPRDSR

SEQ ID NO: 9827 - protein, 11 aa, Mycobacterium avium
SPGRGGPVTAA

SEQ ID NO: 9828 - protein, 7 aa, Mycobacterium avium
SPHPAEF

SEQ ID NO: 9829 - protein, 4 aa, Mycobacterium avium
SPLA

SEQ ID NO: 9830 - protein, 7 aa, Mycobacterium avium
SPNADEN

SEQ ID NO: 9831 - protein, 5 aa, Mycobacterium avium
SPPIE

SEQ ID NO: 9832 - protein, 8 aa, Mycobacterium avium
SPREIGRS

SEQ ID NO: 9833 - protein, 8 aa, Mycobacterium avium
SPTDWPRY

SEQ ID NO: 9834 - protein, 6 aa, Mycobacterium avium
SPTEVA

SEQ ID NO: 9835 - protein, 22 aa, Mycobacterium avium
SPVTASAGLRTSLDGDTDQYQA

SEQ ID NO: 9836 - protein, 25 aa, Mycobacterium avium
SPYEPFGNAGPGRVPGGTGTGPLPG

SEQ ID NO: 9837 - protein, 37 aa, Mycobacterium avium
SQDADTSDEPVPYTGRDATGEYASEARRFDDAAAGGL

SEQ ID NO: 9838 - protein, 8 aa, Mycobacterium avium
SQLPPPGD

SEQ ID NO: 9839 - protein, 10 aa, Mycobacterium avium
SQPSQTTQFR

SEQ ID NO: 9840 - protein, 40 aa, Mycobacterium avium
SQQPPTGELPPPGFPPDRPEGFEQPGNVDPFDQQAEPTPW

SEQ ID NO: 9841 - protein, 17 aa, Mycobacterium avium
SQRADPQVGQPATPPLP

SEQ ID NO: 9842 - protein, 7 aa, Mycobacterium avium
SQRFPGA

SEQ ID NO: 9843 - protein, 19 aa, Mycobacterium avium
SQRSRNRHVGEQLGAGKPI

SEQ ID NO: 9844 - protein, 9 aa, Mycobacterium avium
SQSSALEQI

SEQ ID NO: 9845 - protein, 6 aa, Mycobacterium avium
SQTGHQ

SEQ ID NO: 9846 - protein, 12 aa, Mycobacterium avium
SQTVIGGPPEQI

SEQ ID NO: 9847 - protein, 17 aa, Mycobacterium avium
SQWRSPADTSEADTPDN

SEQ ID NO: 9848 - protein, 8 aa, Mycobacterium avium
SRAAPEGT

SEQ ID NO: 9849 - protein, 5 aa, Mycobacterium avium
SRAGD

SEQ ID NO: 9850 - protein, 6 aa, Mycobacterium avium
SRAGGR

SEQ ID NO: 9851 - protein, 7 aa, Mycobacterium avium
SRAPRIN

SEQ ID NO: 9852 - protein, 6 aa, Mycobacterium avium
SRGPVG

SEQ ID NO: 9853 - protein, 5 aa, Mycobacterium avium
SRIET

SEQ ID NO: 9854 - protein, 8 aa, Mycobacterium avium
SRPDADDV

SEQ ID NO: 9855 - protein, 7 aa, Mycobacterium avium
SRPGADF

SEQ ID NO: 9856 - protein, 8 aa, Mycobacterium avium
SRPPGPHK

SEQ ID NO: 9857 - protein, 4 aa, Mycobacterium avium
SRPV

SEQ ID NO: 9858 - protein, 5 aa, Mycobacterium avium
SRPVR

SEQ ID NO: 9859 - protein, 8 aa, Mycobacterium avium
SRQPTTGF

SEQ ID NO: 9860 - protein, 10 aa, Mycobacterium avium
SRQQSHETPF

SEQ ID NO: 9861 - protein, 7 aa, Mycobacterium avium
SRRHRGP

SEQ ID NO: 9862 - protein, 9 aa, Mycobacterium avium
SRRHRGPAT

SEQ ID NO: 9863 - protein, 8 aa, Mycobacterium avium
SRRHRGPG

SEQ ID NO: 9864 - protein, 4 aa, Mycobacterium avium
SRRP

SEQ ID NO: 9865 - protein, 12 aa, Mycobacterium avium
SRRPPAGLSPQE

SEQ ID NO: 9866 - protein, 13 aa, Mycobacterium avium
SRRPPAGLSPQEL

SEQ ID NO: 9867 - protein, 17 aa, Mycobacterium avium
SRRRSPPIPRWPRPPCS

SEQ ID NO: 9868 - protein, 9 aa, Mycobacterium avium
SRTGTRTDT

SEQ ID NO: 9869 - protein, 25 aa, Mycobacterium avium
SRTTSPAALTTTTSWNSYPRPISHI

SEQ ID NO: 9870 - protein, 33 aa, Mycobacterium avium
SSAASASAQSRKPKSAAAAAARAAAAAAAETHH

SEQ ID NO: 9871 - protein, 8 aa, Mycobacterium avium
SSEAGDNY

SEQ ID NO: 9872 - protein, 47 aa, Mycobacterium avium
SSGDQRGPAAEQGAGERRETARPDADPQRRNGPSTSSRRRQAPPDDR

SEQ ID NO: 9873 - protein, 6 aa, Mycobacterium avium
SSGSVG

SEQ ID NO: 9874 - protein, 8 aa, Mycobacterium avium
SSGVSWTD

SEQ ID NO: 9875 - protein, 8 aa, Mycobacterium avium
SSKRPGVV

SEQ ID NO: 9876 - protein, 6 aa, Mycobacterium avium
SSPLTV

SEQ ID NO: 9877 - protein, 14 aa, Mycobacterium avium
SSPPPRPSAVNPHV

SEQ ID NO: 9878 - protein, 12 aa, Mycobacterium avium
SSSEPAPKADRH

SEQ ID NO: 9879 - protein, 6 aa, Mycobacterium avium
SSSFST

SEQ ID NO: 9880 - protein, 11 aa, Mycobacterium avium
SSTATAPPAAE

SEQ ID NO: 9881 - protein, 14 aa, Mycobacterium avium
SSVDGSPTRPARAG

SEQ ID NO: 9882 - protein, 7 aa, Mycobacterium avium
SSWDGPA

SEQ ID NO: 9883 - protein, 11 aa, Mycobacterium avium
STAGNKAPEHH

SEQ ID NO: 9884 - protein, 15 aa, Mycobacterium avium
STAMRGGSGRIGSQS

SEQ ID NO: 9885 - protein, 16 aa, Mycobacterium avium
STAPRTTSPPPSASSG

SEQ ID NO: 9886 - protein, 13 aa, Mycobacterium avium
STCTTSEHGREIS

SEQ ID NO: 9887 - protein, 10 aa, Mycobacterium avium
STEEQRSLRS

SEQ ID NO: 9888 - protein, 11 aa, Mycobacterium avium
STGPKKGKDAA

SEQ ID NO: 9889 - protein, 11 aa, Mycobacterium avium
STGSGTIVGRT

SEQ ID NO: 9890 - protein, 7 aa, Mycobacterium avium
STGTETS

SEQ ID NO: 9891 - protein, 7 aa, Mycobacterium avium
STKQQEF

SEQ ID NO: 9892 - protein, 7 aa, Mycobacterium avium
STLSVGD

SEQ ID NO: 9893 - protein, 21 aa, Mycobacterium avium
STPIHAGADPDPGDDGPNPFG

SEQ ID NO: 9894 - protein, 63 aa, Mycobacterium avium
STPSGPMTGAAQGQPPGTQRISQPQQPASSSFRQPVQPPTGAQPSHPPSGPTRYPPSGPQHAP

SEQ ID NO: 9895 - protein, 5 aa, Mycobacterium avium
STQSV

SEQ ID NO: 9896 - protein, 22 aa, Mycobacterium avium
STRPEPGAIDRSGGYTASSGIT

SEQ ID NO: 9897 - protein, 6 aa, Mycobacterium avium
STRTPL

SEQ ID NO: 9898 - protein, 4 aa, Mycobacterium avium
STSV

SEQ ID NO: 9899 - protein, 9 aa, Mycobacterium avium
STTASVTKS

SEQ ID NO: 9900 - protein, 15 aa, Mycobacterium avium
STTAVASAPQATAAP

SEQ ID NO: 9901 - protein, 12 aa, Mycobacterium avium
STTHPEAGSTAY

SEQ ID NO: 9902 - protein, 4 aa, Mycobacterium avium
STTL

SEQ ID NO: 9903 - protein, 9 aa, Mycobacterium avium
STTQPDSTV

SEQ ID NO: 9904 - protein, 6 aa, Mycobacterium avium
STVEQA

SEQ ID NO: 9905 - protein, 8 aa, Mycobacterium avium
STVINPGT

SEQ ID NO: 9906 - protein, 11 aa, Mycobacterium avium
SVAENTSDAQV

SEQ ID NO: 9907 - protein, 11 aa, Mycobacterium avium
SVDQERQAAKE

SEQ ID NO: 9908 - protein, 15 aa, Mycobacterium avium
SVIQSSPAAPPVPDG

SEQ ID NO: 9909 - protein, 26 aa, Mycobacterium avium
SVPAAQAAEQQSDDDVQGAVQKRWSS

SEQ ID NO: 9910 - protein, 15 aa, Mycobacterium avium
SVPRPAAARRAAKDF

SEQ ID NO: 9911 - protein, 15 aa, Mycobacterium avium
SVSATDTLTGAQENL

SEQ ID NO: 9912 - protein, 5 aa, Mycobacterium avium
SVSPS

SEQ ID NO: 9913 - protein, 5 aa, Mycobacterium avium
SVTTE

SEQ ID NO: 9914 - protein, 8 aa, Mycobacterium avium
SVVQPGAG

SEQ ID NO: 9915 - protein, 7 aa, Mycobacterium avium
SYADGMP

SEQ ID NO: 9916 - protein, 4 aa, Mycobacterium avium
SYAP

SEQ ID NO: 9917 - protein, 20 aa, Mycobacterium avium
SYGSSEHPSITGSQHTAPEA

SEQ ID NO: 9918 - protein, 5 aa, Mycobacterium avium
SYPAR

SEQ ID NO: 9919 - protein, 8 aa, Mycobacterium avium
SYPTYAEA

SEQ ID NO: 9920 - protein, 13 aa, Mycobacterium avium
TAAGSQSSDGKAA

SEQ ID NO: 9921 - protein, 13 aa, Mycobacterium avium
TAAPAAGANHPVA

SEQ ID NO: 9922 - protein, 15 aa, Mycobacterium avium
TAAPAAGANRPVARG

SEQ ID NO: 9923 - protein, 17 aa, Mycobacterium avium
TAAQHRATAESCAAEGD

SEQ ID NO: 9924 - protein, 14 aa, Mycobacterium avium
TAATDSYKMSGGQG

SEQ ID NO: 9925 - protein, 7 aa, Mycobacterium avium
TADGRKN

SEQ ID NO: 9926 - protein, 13 aa, Mycobacterium avium
TADRAARDRLSGF

SEQ ID NO: 9927 - protein, 14 aa, Mycobacterium avium
TADRAARDRLSGFG

SEQ ID NO: 9928 - protein, 17 aa, Mycobacterium avium
TADSGPGPRGPAGGSDL

SEQ ID NO: 9929 - protein, 71 aa, Mycobacterium avium
TAEENPAAADQNEATVAAAGDDRENGDAATESEAAETSDAQPADGAEDTQSAETVATAGAAPAAGRRTKRL

SEQ ID NO: 9930 - protein, 13 aa, Mycobacterium avium
TAGKSLSDSASGL

SEQ ID NO: 9931 - protein, 6 aa, Mycobacterium avium
TAGNAG

SEQ ID NO: 9932 - protein, 7 aa, Mycobacterium avium
TAGPGRF

SEQ ID NO: 9933 - protein, 8 aa, Mycobacterium avium
TAGPGRFE

SEQ ID NO: 9934 - protein, 8 aa, Mycobacterium avium
TAHGGGAG

SEQ ID NO: 9935 - protein, 6 aa, Mycobacterium avium
TAKPGA

SEQ ID NO: 9936 - protein, 7 aa, Mycobacterium avium
TAKPGTM

SEQ ID NO: 9937 - protein, 17 aa, Mycobacterium avium
TALPGPPLQPGIDCRTV

SEQ ID NO: 9938 - protein, 5 aa, Mycobacterium avium
TALQQ

SEQ ID NO: 9939 - protein, 6 aa, Mycobacterium avium
TANGAL

SEQ ID NO: 9940 - protein, 138 aa, Mycobacterium avium
TAPAPRPKYDPYAQYGQYGQYGQYGQQPYYGQPGGQPGGQPGGQQHSPQGYGSQYGGYGQGGAPTGGFGAQPSPQSGPQQSAQQQGPSTPPTGFPSFSPPPNVGGGSDSGSATANYSEQAGGQQSYGQEPSSPSGPTP

SEQ ID NO: 9941 - protein, 56 aa, Mycobacterium avium
TAPPAPTYTPRHTAPPTAPPALTTTAPTPSPTPTTTPPPPTTTQEPTTTSTTTTVP

SEQ ID NO: 9942 - protein, 58 aa, Mycobacterium avium
TAPPAPTYTPRHTAPPTTTAPPALTTTAPTPSPTPTTTPPPPTTTQEPTTTSTTTTVP

SEQ ID NO: 9943 - protein, 15 aa, Mycobacterium avium
TAPPPGATPAPTAPL

SEQ ID NO: 9944 - protein, 116 aa, Mycobacterium avium
TAPRPPHDPTHPAAPEPSRPARPAPAEPRPAQEPAASTTRIPARPNQPTEAQTTRFAAPGAPGRQRPAEPRPAPPQRPPTQAAPPSGDQTRAIPVPGNRPDDGDSDADAAEPTTAL

SEQ ID NO: 9945 - protein, 10 aa, Mycobacterium avium
TAPWDAQPGY

SEQ ID NO: 9946 - protein, 4 aa, Mycobacterium avium
TAQI

SEQ ID NO: 9947 - protein, 5 aa, Mycobacterium avium
TAQID

SEQ ID NO: 9948 - protein, 21 aa, Mycobacterium avium
TAQTGGTPLPGATQAGLSSPI

SEQ ID NO: 9949 - protein, 6 aa, Mycobacterium avium
TARAGQ

SEQ ID NO: 9950 - protein, 5 aa, Mycobacterium avium
TAREH

SEQ ID NO: 9951 - protein, 4 aa, Mycobacterium avium
TARR

SEQ ID NO: 9952 - protein, 15 aa, Mycobacterium avium
TASGPSLRDDEYPDK

SEQ ID NO: 9953 - protein, 8 aa, Mycobacterium avium
TASGSRMR

SEQ ID NO: 9954 - protein, 21 aa, Mycobacterium avium
TASHAKEPERGEGPPAEAYAS

SEQ ID NO: 9955 - protein, 9 aa, Mycobacterium avium
TATAEDGTV

SEQ ID NO: 9956 - protein, 10 aa, Mycobacterium avium
TATAKGLSQP

SEQ ID NO: 9957 - protein, 8 aa, Mycobacterium avium
TATAPDGS

SEQ ID NO: 9958 - protein, 6 aa, Mycobacterium avium
TATGAE

SEQ ID NO: 9959 - protein, 19 aa, Mycobacterium avium
TATSKQKPEPQTTASSARV

SEQ ID NO: 9960 - protein, 7 aa, Mycobacterium avium
TATTPGE

SEQ ID NO: 9961 - protein, 5 aa, Mycobacterium avium
TAVGA

SEQ ID NO: 9962 - protein, 8 aa, Mycobacterium avium
TDANRSAL

SEQ ID NO: 9963 - protein, 7 aa, Mycobacterium avium
TDAQGPN

SEQ ID NO: 9964 - protein, 10 aa, Mycobacterium avium
TDEAAEAERM

SEQ ID NO: 9965 - protein, 23 aa, Mycobacterium avium
TDEDYTDEDYTDGDYGDEPYDYA

SEQ ID NO: 9966 - protein, 12 aa, Mycobacterium avium
TDGCSDRSCPNL

SEQ ID NO: 9967 - protein, 21 aa, Mycobacterium avium
TDGELSAEEHRERVSAATKAV

SEQ ID NO: 9968 - protein, 24 aa, Mycobacterium avium
TDGGPEDGGPEDGAVASEASAGQL

SEQ ID NO: 9969 - protein, 8 aa, Mycobacterium avium
TDGPVTNG

SEQ ID NO: 9970 - protein, 6 aa, Mycobacterium avium
TDGTRD

SEQ ID NO: 9971 - protein, 11 aa, Mycobacterium avium
TDLPANEGYAA

SEQ ID NO: 9972 - protein, 6 aa, Mycobacterium avium
TDLPEG

SEQ ID NO: 9973 - protein, 10 aa, Mycobacterium avium
TDNNGNGARV

SEQ ID NO: 9974 - protein, 15 aa, Mycobacterium avium
TDPETGQALSDKEIR

SEQ ID NO: 9975 - protein, 4 aa, Mycobacterium avium
TDPS

SEQ ID NO: 9976 - protein, 11 aa, Mycobacterium avium
TDPSSTEATPE

SEQ ID NO: 9977 - protein, 9 aa, Mycobacterium avium
TDPTETEIA

SEQ ID NO: 9978 - protein, 24 aa, Mycobacterium avium
TDSGPEDGGPDDGPVASEASAGQL

SEQ ID NO: 9979 - protein, 11 aa, Mycobacterium avium
TDTAPDRGAPL

SEQ ID NO: 9980 - protein, 8 aa, Mycobacterium avium
TDTPPDLK

SEQ ID NO: 9981 - protein, 10 aa, Mycobacterium avium
TEADNIDPQQ

SEQ ID NO: 9982 - protein, 7 aa, Mycobacterium avium
TEAVPQH

SEQ ID NO: 9983 - protein, 9 aa, Mycobacterium avium
TEEEGNARD

SEQ ID NO: 9984 - protein, 7 aa, Mycobacterium avium
TEIPSGT

SEQ ID NO: 9985 - protein, 10 aa, Mycobacterium avium
TEKTQPDDVG

SEQ ID NO: 9986 - protein, 7 aa, Mycobacterium avium
TENKDVI

SEQ ID NO: 9987 - protein, 12 aa, Mycobacterium avium
TENNSELPAPRP

SEQ ID NO: 9988 - protein, 15 aa, Mycobacterium avium
TEPNTTVTHGDSDTV

SEQ ID NO: 9989 - protein, 7 aa, Mycobacterium avium
TESGKPL

SEQ ID NO: 9990 - protein, 7 aa, Mycobacterium avium
TESISPQ

SEQ ID NO: 9991 - protein, 7 aa, Mycobacterium avium
TESLGRF

SEQ ID NO: 9992 - protein, 17 aa, Mycobacterium avium
TEVASAAGFSPTDQDRV

SEQ ID NO: 9993 - protein, 10 aa, Mycobacterium avium
TFESEDGRAM

SEQ ID NO: 9994 - protein, 4 aa, Mycobacterium avium
TFSG

SEQ ID NO: 9995 - protein, 9 aa, Mycobacterium avium
TGAGNAEQF

SEQ ID NO: 9996 - protein, 9 aa, Mycobacterium avium
TGAGSAEQF

SEQ ID NO: 9997 - protein, 4 aa, Mycobacterium avium
TGAT

SEQ ID NO: 9998 - protein, 22 aa, Mycobacterium avium
TGDEPSQQQTAPDGTRTGAQTA

SEQ ID NO: 9999 - protein, 6 aa, Mycobacterium avium
TGDGLR

SEQ ID NO: 10000 - protein, 4 aa, Mycobacterium avium
TGDP

SEQ ID NO: 10001 - protein, 7 aa, Mycobacterium avium
TGEAAAA

SEQ ID NO: 10002 - protein, 11 aa, Mycobacterium avium
TGEAQAPRKEP

SEQ ID NO: 10003 - protein, 20 aa, Mycobacterium avium
TGEGRKDSATARMSGRARDG

SEQ ID NO: 10004 - protein, 11 aa, Mycobacterium avium
TGGAATNPKYQ

SEQ ID NO: 10005 - protein, 10 aa, Mycobacterium avium
TGGGPAGSTD

SEQ ID NO: 10006 - protein, 6 aa, Mycobacterium avium
TGGKDL

SEQ ID NO: 10007 - protein, 11 aa, Mycobacterium avium
TGGRGGDAAAE

SEQ ID NO: 10008 - protein, 4 aa, Mycobacterium avium
TGHA

SEQ ID NO: 10009 - protein, 35 aa, Mycobacterium avium
TGHGESPSDRIGLSNPDSGTTAGRARGARPHHGPR

SEQ ID NO: 10010 - protein, 9 aa, Mycobacterium avium
TGKASHASL

SEQ ID NO: 10011 - protein, 9 aa, Mycobacterium avium
TGKPVSPGE

SEQ ID NO: 10012 - protein, 8 aa, Mycobacterium avium
TGPAPAGL

SEQ ID NO: 10013 - protein, 10 aa, Mycobacterium avium
TGPKKGKDAA

SEQ ID NO: 10014 - protein, 8 aa, Mycobacterium avium
TGPSPAGL

SEQ ID NO: 10015 - protein, 7 aa, Mycobacterium avium
TGQGSTV

SEQ ID NO: 10016 - protein, 8 aa, Mycobacterium avium
TGRRASGL

SEQ ID NO: 10017 - protein, 7 aa, Mycobacterium avium
TGSIGTQ

SEQ ID NO: 10018 - protein, 7 aa, Mycobacterium avium
TGSLPAG

SEQ ID NO: 10019 - protein, 7 aa, Mycobacterium avium
TGSPLDA

SEQ ID NO: 10020 - protein, 6 aa, Mycobacterium avium
TGSPVP

SEQ ID NO: 10021 - protein, 13 aa, Mycobacterium avium
TGSPVTPPDRTAL

SEQ ID NO: 10022 - protein, 10 aa, Mycobacterium avium
TGSRRPSARR

SEQ ID NO: 10023 - protein, 4 aa, Mycobacterium avium
TGTD

SEQ ID NO: 10024 - protein, 13 aa, Mycobacterium avium
TGTGTTALRTGDT

SEQ ID NO: 10025 - protein, 7 aa, Mycobacterium avium
TGTTSGR

SEQ ID NO: 10026 - protein, 4 aa, Mycobacterium avium
TGTV

SEQ ID NO: 10027 - protein, 29 aa, Mycobacterium avium
THATGSGGGRIAGAAPSVPAANMPPGSVE

SEQ ID NO: 10028 - protein, 10 aa, Mycobacterium avium
THGADQLAGG

SEQ ID NO: 10029 - protein, 32 aa, Mycobacterium avium
THHNSSAPPPAPSTRALAPPPPTTPPPPLTPT

SEQ ID NO: 10030 - protein, 5 aa, Mycobacterium avium
THRDT

SEQ ID NO: 10031 - protein, 8 aa, Mycobacterium avium
TIADRSSP

SEQ ID NO: 10032 - protein, 10 aa, Mycobacterium avium
TINAQQKDLD

SEQ ID NO: 10033 - protein, 5 aa, Mycobacterium avium
TIPTE

SEQ ID NO: 10034 - protein, 31 aa, Mycobacterium avium
TITGGAGGSGLIGGAGGSGVGGLGGILGSIG

SEQ ID NO: 10035 - protein, 12 aa, Mycobacterium avium
TKPVASRQDEFK

SEQ ID NO: 10036 - protein, 12 aa, Mycobacterium avium
TKPVASRQDEIK

SEQ ID NO: 10037 - protein, 7 aa, Mycobacterium avium
TKSGAQL

SEQ ID NO: 10038 - protein, 7 aa, Mycobacterium avium
TKSSGTM

SEQ ID NO: 10039 - protein, 10 aa, Mycobacterium avium
TLAGPARRGE

SEQ ID NO: 10040 - protein, 10 aa, Mycobacterium avium
TLAQASPPDM

SEQ ID NO: 10041 - protein, 14 aa, Mycobacterium avium
TLGADSPDAQSGSI

SEQ ID NO: 10042 - protein, 5 aa, Mycobacterium avium
TLNTQ

SEQ ID NO: 10043 - protein, 4 aa, Mycobacterium avium
TLRP

SEQ ID NO: 10044 - protein, 7 aa, Mycobacterium avium
TLSGKDS

SEQ ID NO: 10045 - protein, 9 aa, Mycobacterium avium
TLSVGSDAD

SEQ ID NO: 10046 - protein, 10 aa, Mycobacterium avium
TMSDEAGAYL

SEQ ID NO: 10047 - protein, 10 aa, Mycobacterium avium
TNDKGTPGAK

SEQ ID NO: 10048 - protein, 14 aa, Mycobacterium avium
TNLSTTSTDTLNQS

SEQ ID NO: 10049 - protein, 12 aa, Mycobacterium avium
TNPTSDGQPRGR

SEQ ID NO: 10050 - protein, 4 aa, Mycobacterium avium
TNSR

SEQ ID NO: 10051 - protein, 12 aa, Mycobacterium avium
TNTAAPDPRIDR

SEQ ID NO: 10052 - protein, 4 aa, Mycobacterium avium
TNTL

SEQ ID NO: 10053 - protein, 14 aa, Mycobacterium avium
TPAADTEPEPWRPG

SEQ ID NO: 10054 - protein, 21 aa, Mycobacterium avium
TPESSGTGPTRSSSTPAASRR

SEQ ID NO: 10055 - protein, 8 aa, Mycobacterium avium
TPGASPDV

SEQ ID NO: 10056 - protein, 7 aa, Mycobacterium avium
TPGQRRK

SEQ ID NO: 10057 - protein, 8 aa, Mycobacterium avium
TPGQRRKQ

SEQ ID NO: 10058 - protein, 5 aa, Mycobacterium avium
TPHEE

SEQ ID NO: 10059 - protein, 11 aa, Mycobacterium avium
TPNQPGTDYDW

SEQ ID NO: 10060 - protein, 5 aa, Mycobacterium avium
TPPYK

SEQ ID NO: 10061 - protein, 19 aa, Mycobacterium avium
TPRRPNLRPAHADREMRDH

SEQ ID NO: 10062 - protein, 10 aa, Mycobacterium avium
TPRTGAAPGP

SEQ ID NO: 10063 - protein, 9 aa, Mycobacterium avium
TPSNAPGHV

SEQ ID NO: 10064 - protein, 7 aa, Mycobacterium avium
TPSSTGK

SEQ ID NO: 10065 - protein, 6 aa, Mycobacterium avium
TPTITK

SEQ ID NO: 10066 - protein, 19 aa, Mycobacterium avium
TPTPTGAEIRDANSSNGTF

SEQ ID NO: 10067 - protein, 7 aa, Mycobacterium avium
TQAAATE

SEQ ID NO: 10068 - protein, 14 aa, Mycobacterium avium
TQFDGYTSGATKDF

SEQ ID NO: 10069 - protein, 16 aa, Mycobacterium avium
TQGAPAGDADTVAAAR

SEQ ID NO: 10070 - protein, 21 aa, Mycobacterium avium
TQGHRRDCEDVASKRQRLPLV

SEQ ID NO: 10071 - protein, 13 aa, Mycobacterium avium
TQKAPKTWKDMLP

SEQ ID NO: 10072 - protein, 6 aa, Mycobacterium avium
TQPGKH

SEQ ID NO: 10073 - protein, 15 aa, Mycobacterium avium
TQRNSSTSEPSTSPL

SEQ ID NO: 10074 - protein, 7 aa, Mycobacterium avium
TQSIEST

SEQ ID NO: 10075 - protein, 6 aa, Mycobacterium avium
TRAAGA

SEQ ID NO: 10076 - protein, 5 aa, Mycobacterium avium
TRAAR

SEQ ID NO: 10077 - protein, 4 aa, Mycobacterium avium
TRAR

SEQ ID NO: 10078 - protein, 4 aa, Mycobacterium avium
TRDF

SEQ ID NO: 10079 - protein, 9 aa, Mycobacterium avium
TRDGSTDRV

SEQ ID NO: 10080 - protein, 10 aa, Mycobacterium avium
TREGTGSQVN

SEQ ID NO: 10081 - protein, 7 aa, Mycobacterium avium
TRGGAAA

SEQ ID NO: 10082 - protein, 12 aa, Mycobacterium avium
TRGGKPITGAGY

SEQ ID NO: 10083 - protein, 14 aa, Mycobacterium avium
TRGIGEPKPDRTRR

SEQ ID NO: 10084 - protein, 30 aa, Mycobacterium avium
TRGPEEWPQPDPPAHVGAEPDDDEDDYEYQ

SEQ ID NO: 10085 - protein, 21 aa, Mycobacterium avium
TRPATGGHRPPPARRTFSSGQ

SEQ ID NO: 10086 - protein, 6 aa, Mycobacterium avium
TRPEVR

SEQ ID NO: 10087 - protein, 5 aa, Mycobacterium avium
TRPGN

SEQ ID NO: 10088 - protein, 55 aa, Mycobacterium avium
TRPQRPTGKRSRQRAAGDADAEPSDEAEVSAPEKAEKAKRKKAAKPKKSADTRAN

SEQ ID NO: 10089 - protein, 13 aa, Mycobacterium avium
TRQNGRNQAYNHA

SEQ ID NO: 10090 - protein, 7 aa, Mycobacterium avium
TRSRPAA

SEQ ID NO: 10091 - protein, 5 aa, Mycobacterium avium
TRTAA

SEQ ID NO: 10092 - protein, 18 aa, Mycobacterium avium
TRVGEAGSTLSGGEKQRV

SEQ ID NO: 10093 - protein, 15 aa, Mycobacterium avium
TRVSGDGGNLSAGER

SEQ ID NO: 10094 - protein, 14 aa, Mycobacterium avium
TSAPRQPNSAPIPT

SEQ ID NO: 10095 - protein, 35 aa, Mycobacterium avium
TSARPDRPAPVRSTPPAETAPKPAAETAVKRTSKY

SEQ ID NO: 10096 - protein, 9 aa, Mycobacterium avium
TSASAGRRR

SEQ ID NO: 10097 - protein, 4 aa, Mycobacterium avium
TSAT

SEQ ID NO: 10098 - protein, 11 aa, Mycobacterium avium
TSAVPTPTGRD

SEQ ID NO: 10099 - protein, 4 aa, Mycobacterium avium
TSFP

SEQ ID NO: 10100 - protein, 14 aa, Mycobacterium avium
TSGPLPDQTDRTTV

SEQ ID NO: 10101 - protein, 4 aa, Mycobacterium avium
TSLA

SEQ ID NO: 10102 - protein, 11 aa, Mycobacterium avium
TSLADSDRIGR

SEQ ID NO: 10103 - protein, 8 aa, Mycobacterium avium
TSLASGGR

SEQ ID NO: 10104 - protein, 11 aa, Mycobacterium avium
TSLSDSDRIGR

SEQ ID NO: 10105 - protein, 12 aa, Mycobacterium avium
TSNLGAAEQDPR

SEQ ID NO: 10106 - protein, 7 aa, Mycobacterium avium
TSNPPPA

SEQ ID NO: 10107 - protein, 8 aa, Mycobacterium avium
TSNPPPAC

SEQ ID NO: 10108 - protein, 6 aa, Mycobacterium avium
TSRDDT

SEQ ID NO: 10109 - protein, 5 aa, Mycobacterium avium
TSRRS

SEQ ID NO: 10110 - protein, 6 aa, Mycobacterium avium
TSSLTD

SEQ ID NO: 10111 - protein, 5 aa, Mycobacterium avium
TSSQL

SEQ ID NO: 10112 - protein, 10 aa, Mycobacterium avium
TSTDPYSGEA

SEQ ID NO: 10113 - protein, 4 aa, Mycobacterium avium
TSTL

SEQ ID NO: 10114 - protein, 13 aa, Mycobacterium avium
TSTPQQPGPRAHR

SEQ ID NO: 10115 - protein, 13 aa, Mycobacterium avium
TSTSGVVTSDSRE

SEQ ID NO: 10116 - protein, 5 aa, Mycobacterium avium
TTAGP

SEQ ID NO: 10117 - protein, 15 aa, Mycobacterium avium
TTAVASAPQATAAPK

SEQ ID NO: 10118 - protein, 5 aa, Mycobacterium avium
TTDPS

SEQ ID NO: 10119 - protein, 4 aa, Mycobacterium avium
TTDT

SEQ ID NO: 10120 - protein, 5 aa, Mycobacterium avium
TTEGV

SEQ ID NO: 10121 - protein, 4 aa, Mycobacterium avium
TTEN

SEQ ID NO: 10122 - protein, 6 aa, Mycobacterium avium
TTGPHR

SEQ ID NO: 10123 - protein, 6 aa, Mycobacterium avium
TTGSVI

SEQ ID NO: 10124 - protein, 15 aa, Mycobacterium avium
TTIDPKAQQAAEKAV

SEQ ID NO: 10125 - protein, 4 aa, Mycobacterium avium
TTNE

SEQ ID NO: 10126 - protein, 12 aa, Mycobacterium avium
TTPAHPSPQKIS

SEQ ID NO: 10127 - protein, 4 aa, Mycobacterium avium
TTQA

SEQ ID NO: 10128 - protein, 4 aa, Mycobacterium avium
TTQE

SEQ ID NO: 10129 - protein, 4 aa, Mycobacterium avium
TTTN

SEQ ID NO: 10130 - protein, 4 aa, Mycobacterium avium
TVAE

SEQ ID NO: 10131 - protein, 6 aa, Mycobacterium avium
TVEPDS

SEQ ID NO: 10132 - protein, 5 aa, Mycobacterium avium
TVGNR

SEQ ID NO: 10133 - protein, 5 aa, Mycobacterium avium
TVGTA

SEQ ID NO: 10134 - protein, 7 aa, Mycobacterium avium
TVGTATA

SEQ ID NO: 10135 - protein, 9 aa, Mycobacterium avium
TVKPSSAAA

SEQ ID NO: 10136 - protein, 31 aa, Mycobacterium avium
TVNSQATQTASADPTEDTESRTESRAAGPDF

SEQ ID NO: 10137 - protein, 19 aa, Mycobacterium avium
TVPDAKDVAGAPGPDGRTL

SEQ ID NO: 10138 - protein, 18 aa, Mycobacterium avium
TVPPDQARAQNQTTGPNG

SEQ ID NO: 10139 - protein, 7 aa, Mycobacterium avium
TVQPGTT

SEQ ID NO: 10140 - protein, 18 aa, Mycobacterium avium
TVTANNNSAVASDANYQA

SEQ ID NO: 10141 - protein, 14 aa, Mycobacterium avium
TVTDTGPGIPDDER

SEQ ID NO: 10142 - protein, 15 aa, Mycobacterium avium
TVTDTGPGIPDDERE

SEQ ID NO: 10143 - protein, 9 aa, Mycobacterium avium
TWTTPDKPA

SEQ ID NO: 10144 - protein, 6 aa, Mycobacterium avium
TYPGAD

SEQ ID NO: 10145 - protein, 10 aa, Mycobacterium avium
VAAGESVAPP

SEQ ID NO: 10146 - protein, 24 aa, Mycobacterium avium
VAAPEQPAEAPVEEDTNAETLSDS

SEQ ID NO: 10147 - protein, 20 aa, Mycobacterium avium
VAATPQTMPAPQIAKSTAAT

SEQ ID NO: 10148 - protein, 10 aa, Mycobacterium avium
VADRPSVSLR

SEQ ID NO: 10149 - protein, 4 aa, Mycobacterium avium
VAEG

SEQ ID NO: 10150 - protein, 19 aa, Mycobacterium avium
VAEHPAPKAPAPGTPQPEK

SEQ ID NO: 10151 - protein, 19 aa, Mycobacterium avium
VAEHPAPKAPAPGTQQPEK

SEQ ID NO: 10152 - protein, 19 aa, Mycobacterium avium
VAEHPEPKAPAPGTQQPEK

SEQ ID NO: 10153 - protein, 12 aa, Mycobacterium avium
VAGAPGQGAQLT

SEQ ID NO: 10154 - protein, 12 aa, Mycobacterium avium
VAGDGHTADPFE

SEQ ID NO: 10155 - protein, 6 aa, Mycobacterium avium
VAGGAA

SEQ ID NO: 10156 - protein, 6 aa, Mycobacterium avium
VAGGSL

SEQ ID NO: 10157 - protein, 26 aa, Mycobacterium avium
VAGGVGDGSGVEGDLQRGRDRAGGFD

SEQ ID NO: 10158 - protein, 45 aa, Mycobacterium avium
VAKANRKLHPGQREPEGAAADSSVPAPERKQASVRTTDPATGQTV

SEQ ID NO: 10159 - protein, 45 aa, Mycobacterium avium
VAKANRKLHPGQREPEGAAADSSVPAPERKQASVRTTDPETGQTV

SEQ ID NO: 10160 - protein, 45 aa, Mycobacterium avium
VAKANRKLHPGQREPEGAGADSSVPAPERKQASVRTTDPETGQTV

SEQ ID NO: 10161 - protein, 13 aa, Mycobacterium avium
VAKPSPPRDDPEL

SEQ ID NO: 10162 - protein, 4 aa, Mycobacterium avium
VANT

SEQ ID NO: 10163 - protein, 7 aa, Mycobacterium avium
VANYEAP

SEQ ID NO: 10164 - protein, 10 aa, Mycobacterium avium
VAPDAPAAQV

SEQ ID NO: 10165 - protein, 6 aa, Mycobacterium avium
VAPGRA

SEQ ID NO: 10166 - protein, 52 aa, Mycobacterium avium
VAPGTEAGTATAAAVQSAAAAPATDSGSNLNHADTSSTQQQASTAAQSYPSW

SEQ ID NO: 10167 - protein, 12 aa, Mycobacterium avium
VAPPTKRPAARR

SEQ ID NO: 10168 - protein, 5 aa, Mycobacterium avium
VAPRN

SEQ ID NO: 10169 - protein, 14 aa, Mycobacterium avium
VAPTATGAKATLQL

SEQ ID NO: 10170 - protein, 15 aa, Mycobacterium avium
VARAQEVKKAVDAGE

SEQ ID NO: 10171 - protein, 23 aa, Mycobacterium avium
VARPATERAPHAPATTPDVGWSG

SEQ ID NO: 10172 - protein, 23 aa, Mycobacterium avium
VARPATERAPHTPATTPDVGWSG

SEQ ID NO: 10173 - protein, 17 aa, Mycobacterium avium
VATDPAADAALTTGPHR

SEQ ID NO: 10174 - protein, 8 aa, Mycobacterium avium
VATDPANP

SEQ ID NO: 10175 - protein, 13 aa, Mycobacterium avium
VATPSPPRDDPEL

SEQ ID NO: 10176 - protein, 13 aa, Mycobacterium avium
VATSHDVDPDGAV

SEQ ID NO: 10177 - protein, 14 aa, Mycobacterium avium
VDDDRAPRRSDPIE

SEQ ID NO: 10178 - protein, 19 aa, Mycobacterium avium
VDDPAGGPFDRAPDAPPGW

SEQ ID NO: 10179 - protein, 9 aa, Mycobacterium avium
VDDPHIDRD

SEQ ID NO: 10180 - protein, 10 aa, Mycobacterium avium
VDDPSSALRS

SEQ ID NO: 10181 - protein, 22 aa, Mycobacterium avium
VDDSATDSAEPRPERTRERLSG

SEQ ID NO: 10182 - protein, 32 aa, Mycobacterium avium
VDEDPDDYPEFPSRRPATSGPQESPASAPSLR

SEQ ID NO: 10183 - protein, 7 aa, Mycobacterium avium
VDESQAA

SEQ ID NO: 10184 - protein, 4 aa, Mycobacterium avium
VDPA

SEQ ID NO: 10185 - protein, 7 aa, Mycobacterium avium
VDPEHGP

SEQ ID NO: 10186 - protein, 8 aa, Mycobacterium avium
VDPPVTRD

SEQ ID NO: 10187 - protein, 5 aa, Mycobacterium avium
VDSGH

SEQ ID NO: 10188 - protein, 8 aa, Mycobacterium avium
VDSPRPVG

SEQ ID NO: 10189 - protein, 24 aa, Mycobacterium avium
VDSRPHPEPAAAQGHSEPGGPRLT

SEQ ID NO: 10190 - protein, 24 aa, Mycobacterium avium
VDSRPHPEPAAAQGNSEPGGPRLT

SEQ ID NO: 10191 - protein, 20 aa, Mycobacterium avium
VDTRNPNATLPAAAPSMAPS

SEQ ID NO: 10192 - protein, 11 aa, Mycobacterium avium
VEAAHPSGRSI

SEQ ID NO: 10193 - protein, 12 aa, Mycobacterium avium
VEAAHPSGRSIS

SEQ ID NO: 10194 - protein, 12 aa, Mycobacterium avium
VEAQTSQTSEVG

SEQ ID NO: 10195 - protein, 8 aa, Mycobacterium avium
VEDGTVDE

SEQ ID NO: 10196 - protein, 13 aa, Mycobacterium avium
VEDTKAEKRAERG

SEQ ID NO: 10197 - protein, 139 aa, Mycobacterium avium
VEEEPAEPEPATVAATTEAATEGVAAPADGAEAAGADATAQRPEESAEPDVEKPESEETEAAEEAEEPESEETEAAEEAGEPEAEEPEAPEAEEPEESETEEPEEPETEEPEEESGEAPEQPVAEEPEPAPQQPETKRR

SEQ ID NO: 10198 - protein, 107 aa, Mycobacterium avium
VEEEPAEPEPATVAATTEAATEGVAAPADGAEAAGADATAQRPEESAEPDVEKPESEETEAAEEASEPEAEEPEAPEAEEPEEPETEEPEADSGEEPEEESGEAPEQ

SEQ ID NO: 10199 - protein, 138 aa, Mycobacterium avium
VEEEPAEPEPATVAATTEAATEGVAAPADGAEAAGADATAQRPEESAEPDVEKPESEETEAEAAEEPESEETEAAEEPGEPEAEEPEEPEAEEPEEPETEEPEADSDEEPEEESGEAPEQPVAEEPEPAPQQPETKRR

SEQ ID NO: 10200 - protein, 7 aa, Mycobacterium avium
VEGESCG

SEQ ID NO: 10201 - protein, 11 aa, Mycobacterium avium
VEPAAQSPEDL

SEQ ID NO: 10202 - protein, 4 aa, Mycobacterium avium
VEPR

SEQ ID NO: 10203 - protein, 7 aa, Mycobacterium avium
VEQGTNA

SEQ ID NO: 10204 - protein, 8 aa, Mycobacterium avium
VERDTGKK

SEQ ID NO: 10205 - protein, 8 aa, Mycobacterium avium
VESAAADW

SEQ ID NO: 10206 - protein, 17 aa, Mycobacterium avium
VESASRDEASQGDDEEG

SEQ ID NO: 10207 - protein, 17 aa, Mycobacterium avium
VESASRNGASQGDDEEG

SEQ ID NO: 10208 - protein, 17 aa, Mycobacterium avium
VESASRNGASRGDDEEG

SEQ ID NO: 10209 - protein, 15 aa, Mycobacterium avium
VESDRSPDGEEPEHH

SEQ ID NO: 10210 - protein, 19 aa, Mycobacterium avium
VETTDKTESPSAGSARAGR

SEQ ID NO: 10211 - protein, 10 aa, Mycobacterium avium
VGDEDAESPT

SEQ ID NO: 10212 - protein, 10 aa, Mycobacterium avium
VGEEDAESPT

SEQ ID NO: 10213 - protein, 13 aa, Mycobacterium avium
VGERNGHGAPGGR

SEQ ID NO: 10214 - protein, 11 aa, Mycobacterium avium
VGGGPNSPGAG

SEQ ID NO: 10215 - protein, 12 aa, Mycobacterium avium
VGGGPQGVGNAV

SEQ ID NO: 10216 - protein, 11 aa, Mycobacterium avium
VGGGRPRAPRT

SEQ ID NO: 10217 - protein, 10 aa, Mycobacterium avium
VGGGTGSGRL

SEQ ID NO: 10218 - protein, 12 aa, Mycobacterium avium
VGGQGGTPNAVA

SEQ ID NO: 10219 - protein, 6 aa, Mycobacterium avium
VGGSMG

SEQ ID NO: 10220 - protein, 9 aa, Mycobacterium avium
VGGTGSGRL

SEQ ID NO: 10221 - protein, 10 aa, Mycobacterium avium
VGKSPDEIDE

SEQ ID NO: 10222 - protein, 15 aa, Mycobacterium avium
VGLPGGAVAEPVPNI

SEQ ID NO: 10223 - protein, 7 aa, Mycobacterium avium
VGPPTTV

SEQ ID NO: 10224 - protein, 10 aa, Mycobacterium avium
VGPSGAGKST

SEQ ID NO: 10225 - protein, 9 aa, Mycobacterium avium
VGPSSTPGH

SEQ ID NO: 10226 - protein, 9 aa, Mycobacterium avium
VGRGTGGDH

SEQ ID NO: 10227 - protein, 7 aa, Mycobacterium avium
VGRQRQR

SEQ ID NO: 10228 - protein, 5 aa, Mycobacterium avium
VGSAI

SEQ ID NO: 10229 - protein, 11 aa, Mycobacterium avium
VGSGDNLKKVP

SEQ ID NO: 10230 - protein, 4 aa, Mycobacterium avium
VGTA

SEQ ID NO: 10231 - protein, 13 aa, Mycobacterium avium
VGTASGAGASADI

SEQ ID NO: 10232 - protein, 6 aa, Mycobacterium avium
VGTATA

SEQ ID NO: 10233 - protein, 8 aa, Mycobacterium avium
VGTATTAS

SEQ ID NO: 10234 - protein, 18 aa, Mycobacterium avium
VGTKKGQTWQSMLMPPKR

SEQ ID NO: 10235 - protein, 6 aa, Mycobacterium avium
VIPDDQ

SEQ ID NO: 10236 - protein, 15 aa, Mycobacterium avium
VITSPDEVELTGPPR

SEQ ID NO: 10237 - protein, 10 aa, Mycobacterium avium
VKPPSSPVTT

SEQ ID NO: 10238 - protein, 7 aa, Mycobacterium avium
VKSQGDG

SEQ ID NO: 10239 - protein, 13 aa, Mycobacterium avium
VLDRDPDDDAGTA

SEQ ID NO: 10240 - protein, 11 aa, Mycobacterium avium
VLSDSGRNAIT

SEQ ID NO: 10241 - protein, 12 aa, Mycobacterium avium
VLTDSDRAAVSS

SEQ ID NO: 10242 - protein, 10 aa, Mycobacterium avium
VNADGAPSTF

SEQ ID NO: 10243 - protein, 12 aa, Mycobacterium avium
VNARGGPGGAPG

SEQ ID NO: 10244 - protein, 15 aa, Mycobacterium avium
VNDGTDTQLADTAQA

SEQ ID NO: 10245 - protein, 18 aa, Mycobacterium avium
VNGTRYQCTGSSEQVADT

SEQ ID NO: 10246 - protein, 10 aa, Mycobacterium avium
VNHDGRSNGL

SEQ ID NO: 10247 - protein, 7 aa, Mycobacterium avium
VNPPGSN

SEQ ID NO: 10248 - protein, 8 aa, Mycobacterium avium
VNPTTVKS

SEQ ID NO: 10249 - protein, 30 aa, Mycobacterium avium
VNSQATQTASADPTEDTEDTESRAAGPDFV

SEQ ID NO: 10250 - protein, 12 aa, Mycobacterium avium
VNYTGTELPPTT

SEQ ID NO: 10251 - protein, 21 aa, Mycobacterium avium
VPAAAGSSLGAAVAGSQPATV

SEQ ID NO: 10252 - protein, 21 aa, Mycobacterium avium
VPAAAGSSLGATVAGSQPATV

SEQ ID NO: 10253 - protein, 77 aa, Mycobacterium avium
VPALSGGATSTPGLASPGLGSPGLGSPGLGTPGLGTPGLTNPGLTSPGATSPGLTSPGLTSPGLTSPGLTSPGAAPT

SEQ ID NO: 10254 - protein, 12 aa, Mycobacterium avium
VPAPRSARVSSV

SEQ ID NO: 10255 - protein, 15 aa, Mycobacterium avium
VPAPTLTPPVSPSTI

SEQ ID NO: 10256 - protein, 27 aa, Mycobacterium avium
VPAPTLTPPVSPSTIPVTDAPPPPTVG

SEQ ID NO: 10257 - protein, 6 aa, Mycobacterium avium
VPDDEH

SEQ ID NO: 10258 - protein, 7 aa, Mycobacterium avium
VPDSGGT

SEQ ID NO: 10259 - protein, 5 aa, Mycobacterium avium
VPEDR

SEQ ID NO: 10260 - protein, 31 aa, Mycobacterium avium
VPEVAEPETADDAAYADADYPDVGYREDEYP

SEQ ID NO: 10261 - protein, 15 aa, Mycobacterium avium
VPGPDADRRPAPGRA

SEQ ID NO: 10262 - protein, 15 aa, Mycobacterium avium
VPGPDADRRPTPGRA

SEQ ID NO: 10263 - protein, 10 aa, Mycobacterium avium
VPGPSPGSPI

SEQ ID NO: 10264 - protein, 9 aa, Mycobacterium avium
VPHRSPGRP

SEQ ID NO: 10265 - protein, 6 aa, Mycobacterium avium
VPPATV

SEQ ID NO: 10266 - protein, 6 aa, Mycobacterium avium
VPPDDV

SEQ ID NO: 10267 - protein, 27 aa, Mycobacterium avium
VPPVPGAPPGVPGGPVAAPPALPGGPV

SEQ ID NO: 10268 - protein, 27 aa, Mycobacterium avium
VPPVPGTPPGVPGGPVAAPPALPGGPV

SEQ ID NO: 10269 - protein, 110 aa, Mycobacterium avium
VPQPPSPPQVGGTVPQSPPQHQTPPGEGTPPKPDGPGNYGGGHVPTPGAGGSGGSGGGHVPTPGAGGSGGSGGGHVPTPGTGGPGGTGGSGGGHVPTPGAGTPGGSGGGH

SEQ ID NO: 10270 - protein, 229 aa, Mycobacterium avium
VPQPPSPPQVGGTVPQSPPQHQTPPGEGTPPKPDSPGNYGGGHAPTPGAGGSGGSGGGHVPTPGAGGSGGGHVPTPGAGGSGGGHVPTPGAGGPGGTGGSGGGHVPTPGAGTPGGSGGGHLPIPGAGSTPGGSGGGHLPTPGAGTPGGGLGGFGGGHAPAPGGGLGGFGGGHAPAPGGGLGGFGGGHAPAPGGGLGGFGGGHAPAPGGGLGGSGGGHSGGGLGGLGGGH

SEQ ID NO: 10271 - protein, 8 aa, Mycobacterium avium
VPRGPSRL

SEQ ID NO: 10272 - protein, 9 aa, Mycobacterium avium
VPRGPSRLG

SEQ ID NO: 10273 - protein, 7 aa, Mycobacterium avium
VPRPGSD

SEQ ID NO: 10274 - protein, 4 aa, Mycobacterium avium
VPSS

SEQ ID NO: 10275 - protein, 8 aa, Mycobacterium avium
VPSSGPAI

SEQ ID NO: 10276 - protein, 8 aa, Mycobacterium avium
VPSTRGAT

SEQ ID NO: 10277 - protein, 9 aa, Mycobacterium avium
VPSTRGATL

SEQ ID NO: 10278 - protein, 30 aa, Mycobacterium avium
VPTPRPAATQTAASPATQTATNRDADDDAQ

SEQ ID NO: 10279 - protein, 45 aa, Mycobacterium avium
VPTPTELPPPPPPPAPAAPDQVDGAAPQAAPSAFAGKASKPAPSV

SEQ ID NO: 10280 - protein, 8 aa, Mycobacterium avium
VPVKPGRG

SEQ ID NO: 10281 - protein, 6 aa, Mycobacterium avium
VPYARA

SEQ ID NO: 10282 - protein, 7 aa, Mycobacterium avium
VQHAPDS

SEQ ID NO: 10283 - protein, 4 aa, Mycobacterium avium
VQQQ

SEQ ID NO: 10284 - protein, 5 aa, Mycobacterium avium
VQQQR

SEQ ID NO: 10285 - protein, 12 aa, Mycobacterium avium
VQSGVAEHMEVG

SEQ ID NO: 10286 - protein, 13 aa, Mycobacterium avium
VRATAQKLSPPAG

SEQ ID NO: 10287 - protein, 5 aa, Mycobacterium avium
VRATY

SEQ ID NO: 10288 - protein, 9 aa, Mycobacterium avium
VRDAGGRIT

SEQ ID NO: 10289 - protein, 9 aa, Mycobacterium avium
VRNRPDRRE

SEQ ID NO: 10290 - protein, 10 aa, Mycobacterium avium
VRNRPDRREF

SEQ ID NO: 10291 - protein, 10 aa, Mycobacterium avium
VRNRSDRREF

SEQ ID NO: 10292 - protein, 10 aa, Mycobacterium avium
VRPQRPDPAT

SEQ ID NO: 10293 - protein, 6 aa, Mycobacterium avium
VRRGDD

SEQ ID NO: 10294 - protein, 9 aa, Mycobacterium avium
VRRGDQRAT

SEQ ID NO: 10295 - protein, 15 aa, Mycobacterium avium
VRRSQHDDGAFAPKA

SEQ ID NO: 10296 - protein, 6 aa, Mycobacterium avium
VRSDNG

SEQ ID NO: 10297 - protein, 10 aa, Mycobacterium avium
VRSGSDAGAT

SEQ ID NO: 10298 - protein, 40 aa, Mycobacterium avium
VSAAAGLGGPRPLPTPPAQFDGPDDTLGPPAAERPPRGRV

SEQ ID NO: 10299 - protein, 8 aa, Mycobacterium avium
VSAEPDAE

SEQ ID NO: 10300 - protein, 7 aa, Mycobacterium avium
VSAGGAE

SEQ ID NO: 10301 - protein, 6 aa, Mycobacterium avium
VSDGAR

SEQ ID NO: 10302 - protein, 11 aa, Mycobacterium avium
VSEPGGHAAHS

SEQ ID NO: 10303 - protein, 13 aa, Mycobacterium avium
VSKPLNSASQAGL

SEQ ID NO: 10304 - protein, 6 aa, Mycobacterium avium
VSKSMG

SEQ ID NO: 10305 - protein, 4 aa, Mycobacterium avium
VSND

SEQ ID NO: 10306 - protein, 5 aa, Mycobacterium avium
VSPAA

SEQ ID NO: 10307 - protein, 12 aa, Mycobacterium avium
VSPPPLKSRRQE

SEQ ID NO: 10308 - protein, 12 aa, Mycobacterium avium
VSPRGEGQLTGP

SEQ ID NO: 10309 - protein, 5 aa, Mycobacterium avium
VSPVR

SEQ ID NO: 10310 - protein, 4 aa, Mycobacterium avium
VSQV

SEQ ID NO: 10311 - protein, 9 aa, Mycobacterium avium
VSSEPGDNY

SEQ ID NO: 10312 - protein, 6 aa, Mycobacterium avium
VSSPGA

SEQ ID NO: 10313 - protein, 11 aa, Mycobacterium avium
VSTAAGAAGAL

SEQ ID NO: 10314 - protein, 15 aa, Mycobacterium avium
VSTAGDEVTNPQKTM

SEQ ID NO: 10315 - protein, 12 aa, Mycobacterium avium
VSTGGGANLPAV

SEQ ID NO: 10316 - protein, 4 aa, Mycobacterium avium
VSTQ

SEQ ID NO: 10317 - protein, 7 aa, Mycobacterium avium
VSTTADL

SEQ ID NO: 10318 - protein, 13 aa, Mycobacterium avium
VSVPTRAPVSTSP

SEQ ID NO: 10319 - protein, 4 aa, Mycobacterium avium
VTAA

SEQ ID NO: 10320 - protein, 30 aa, Mycobacterium avium
VTAVTGSNGIPRRDGHRNGRFAPPTGPGRC

SEQ ID NO: 10321 - protein, 6 aa, Mycobacterium avium
VTGEDV

SEQ ID NO: 10322 - protein, 4 aa, Mycobacterium avium
VTGG

SEQ ID NO: 10323 - protein, 7 aa, Mycobacterium avium
VTGRAGQ

SEQ ID NO: 10324 - protein, 9 aa, Mycobacterium avium
VTGRRASGL

SEQ ID NO: 10325 - protein, 11 aa, Mycobacterium avium
VTPEQAGAHPT

SEQ ID NO: 10326 - protein, 9 aa, Mycobacterium avium
VTPGEGPDL

SEQ ID NO: 10327 - protein, 6 aa, Mycobacterium avium
VTPSRS

SEQ ID NO: 10328 - protein, 5 aa, Mycobacterium avium
VTRDF

SEQ ID NO: 10329 - protein, 16 aa, Mycobacterium avium
VTRDGTTTTTPIGGAP

SEQ ID NO: 10330 - protein, 9 aa, Mycobacterium avium
VTRDPEAVR

SEQ ID NO: 10331 - protein, 4 aa, Mycobacterium avium
VTSA

SEQ ID NO: 10332 - protein, 5 aa, Mycobacterium avium
VTSAD

SEQ ID NO: 10333 - protein, 4 aa, Mycobacterium avium
VTSP

SEQ ID NO: 10334 - protein, 5 aa, Mycobacterium avium
VTSPE

SEQ ID NO: 10335 - protein, 18 aa, Mycobacterium avium
VTSPSTPAPTSTPDVPRA

SEQ ID NO: 10336 - protein, 32 aa, Mycobacterium avium
VTVNSQATQTASADPTEDTESRTESRTAGPDF

SEQ ID NO: 10337 - protein, 15 aa, Mycobacterium avium
VVAGGKRSGSATLGT

SEQ ID NO: 10338 - protein, 15 aa, Mycobacterium avium
VVEDGTVDELRDAGG

SEQ ID NO: 10339 - protein, 18 aa, Mycobacterium avium
VVRESGGDRSAVTGGTTV

SEQ ID NO: 10340 - protein, 26 aa, Mycobacterium avium
VYGGGDTPRSEADAPAPSAADAVQQA

SEQ ID NO: 10341 - protein, 26 aa, Mycobacterium avium
VYGGGDTPRSEAEAPAPSAADAVQQA

SEQ ID NO: 10342 - protein, 26 aa, Mycobacterium avium
VYSGGDTPRSEAEAPVPSAADAVQQA

SEQ ID NO: 10343 - protein, 8 aa, Mycobacterium avium
WAGPSGVR

SEQ ID NO: 10344 - protein, 5 aa, Mycobacterium avium
WAPTA

SEQ ID NO: 10345 - protein, 12 aa, Mycobacterium avium
WEPGDDAGAEHD

SEQ ID NO: 10346 - protein, 11 aa, Mycobacterium avium
WGGSRYPWGSP

SEQ ID NO: 10347 - protein, 16 aa, Mycobacterium avium
WGPDRREIAAGPSNTS

SEQ ID NO: 10348 - protein, 8 aa, Mycobacterium avium
WNESDAQA

SEQ ID NO: 10349 - protein, 6 aa, Mycobacterium avium
WPHSEA

SEQ ID NO: 10350 - protein, 16 aa, Mycobacterium avium
WPSSPASWCRRPAGIG

SEQ ID NO: 10351 - protein, 5 aa, Mycobacterium avium
WRAEE

SEQ ID NO: 10352 - protein, 11 aa, Mycobacterium avium
WRPPAGDPHPI

SEQ ID NO: 10353 - protein, 7 aa, Mycobacterium avium
WSHPEPA

SEQ ID NO: 10354 - protein, 9 aa, Mycobacterium avium
WSRSGPAER

SEQ ID NO: 10355 - protein, 6 aa, Mycobacterium avium
WTPGTN

SEQ ID NO: 10356 - protein, 14 aa, Mycobacterium avium
YAASSGGDVAPGLR

SEQ ID NO: 10357 - protein, 14 aa, Mycobacterium avium
YAATDGDPATAWTA

SEQ ID NO: 10358 - protein, 10 aa, Mycobacterium avium
YADGATVEED

SEQ ID NO: 10359 - protein, 8 aa, Mycobacterium avium
YAEQSQTW

SEQ ID NO: 10360 - protein, 8 aa, Mycobacterium avium
YAKSIPAS

SEQ ID NO: 10361 - protein, 11 aa, Mycobacterium avium
YATDQRITSGP

SEQ ID NO: 10362 - protein, 18 aa, Mycobacterium avium
YDADYDDAEEAAPAKLSR

SEQ ID NO: 10363 - protein, 12 aa, Mycobacterium avium
YDEEKYMNSDRK

SEQ ID NO: 10364 - protein, 4 aa, Mycobacterium avium
YDPA

SEQ ID NO: 10365 - protein, 8 aa, Mycobacterium avium
YDPPQKAK

SEQ ID NO: 10366 - protein, 8 aa, Mycobacterium avium
YDTKKGRA

SEQ ID NO: 10367 - protein, 8 aa, Mycobacterium avium
YEPPQKAK

SEQ ID NO: 10368 - protein, 5 aa, Mycobacterium avium
YETPY

SEQ ID NO: 10369 - protein, 4 aa, Mycobacterium avium
YFTG

SEQ ID NO: 10370 - protein, 9 aa, Mycobacterium avium
YGATSGQAL

SEQ ID NO: 10371 - protein, 12 aa, Mycobacterium avium
YGESQLDGEGRT

SEQ ID NO: 10372 - protein, 18 aa, Mycobacterium avium
YGGRDPSLRGATRKLNEA

SEQ ID NO: 10373 - protein, 9 aa, Mycobacterium avium
YGGSDANGF

SEQ ID NO: 10374 - protein, 8 aa, Mycobacterium avium
YGSPEPYS

SEQ ID NO: 10375 - protein, 9 aa, Mycobacterium avium
YGSSETGNM

SEQ ID NO: 10376 - protein, 10 aa, Mycobacterium avium
YHGPGEGELE

SEQ ID NO: 10377 - protein, 19 aa, Mycobacterium avium
YHPPTDLAPPPGTRIGPDG

SEQ ID NO: 10378 - protein, 9 aa, Mycobacterium avium
YIKPGSEPV

SEQ ID NO: 10379 - protein, 16 aa, Mycobacterium avium
YKRGATVDRCEGDAKS

SEQ ID NO: 10380 - protein, 9 aa, Mycobacterium avium
YPPGATSGT

SEQ ID NO: 10381 - protein, 10 aa, Mycobacterium avium
YPTAAARAGF

SEQ ID NO: 10382 - protein, 8 aa, Mycobacterium avium
YQSGADLA

SEQ ID NO: 10383 - protein, 9 aa, Mycobacterium avium
YRPTTSANK

SEQ ID NO: 10384 - protein, 10 aa, Mycobacterium avium
YRRAAEGAEV

SEQ ID NO: 10385 - protein, 23 aa, Mycobacterium avium
YRTNYDARPYMPASAPANTGYTA

SEQ ID NO: 10386 - protein, 4 aa, Mycobacterium avium
YTAV

SEQ ID NO: 10387 - protein, 17 aa, Mycobacterium avium
YTPNPNDAPGGPLVERG

SEQ ID NO: 10388 - protein, 5 aa, Mycobacterium avium
YVPPD

SEQ ID NO: 10389 - protein, 30 aa, Mycobacterium avium
GGQRKRASVALELLTGPSLLILDEPTSGLD

SEQ ID NO: 10390 - protein, 25 aa, Mycobacterium avium
AAAHNLELLGYVGLADTARASARPL

SEQ ID NO: 10391 - protein, 24 aa, Mycobacterium avium
AAAIALLGIFAFYLSFVAELPPPP

SEQ ID NO: 10392 - protein, 25 aa, Mycobacterium avium
AAAKRLPRGRAIGVDLWQADQTDNS

SEQ ID NO: 10393 - protein, 29 aa, Mycobacterium avium
AAALSGTPAWEVFKPWAITSITVAVAVAL

SEQ ID NO: 10394 - protein, 19 aa, Mycobacterium avium
AAAPLPCYQARVVDGVVEV

SEQ ID NO: 10395 - protein, 19 aa, Mycobacterium avium
AAASPRAGHSTLIYAAATV

SEQ ID NO: 10396 - protein, 17 aa, Mycobacterium avium
AAATAWKTLKRLVLEGV

SEQ ID NO: 10397 - protein, 18 aa, Mycobacterium avium
AAAVWLVAPCTELFNDNR

SEQ ID NO: 10398 - protein, 22 aa, Mycobacterium avium
AAEAEALAAAARARARAARLRR

SEQ ID NO: 10399 - protein, 25 aa, Mycobacterium avium
AAERWLERFSWIGLVVAVVAGLTAA

SEQ ID NO: 10400 - protein, 23 aa, Mycobacterium avium
AAFFACLSMTLAGLVRNRDRLMG

SEQ ID NO: 10401 - protein, 29 aa, Mycobacterium avium
AAFLVPGLHCWRPVTLAGLGVGVLGTSIF

SEQ ID NO: 10402 - protein, 19 aa, Mycobacterium avium
AAGCMPVMIGWSAVTGTIQ

SEQ ID NO: 10403 - protein, 19 aa, Mycobacterium avium
AAHDAMRIYPGLDVSLVPS

SEQ ID NO: 10404 - protein, 25 aa, Mycobacterium avium
AAIAGALPGIWAFFSHQVAFLFTFP

SEQ ID NO: 10405 - protein, 18 aa, Mycobacterium avium
AAILGCGVVLLATVALFF

SEQ ID NO: 10406 - protein, 20 aa, Mycobacterium avium
AAILMLYTIVIVRGLRTAIA

SEQ ID NO: 10407 - protein, 27 aa, Mycobacterium avium
AAISGWRSGALGSLLSFVGVLLGAIAG

SEQ ID NO: 10408 - protein, 19 aa, Mycobacterium avium
AALAGLGWWLLRRRTDVPP

SEQ ID NO: 10409 - protein, 19 aa, Mycobacterium avium
AALGLRGAEHGLLGAVLPR

SEQ ID NO: 10410 - protein, 26 aa, Mycobacterium avium
AALIFGCLLMWILAWLTATPVRVVRA

SEQ ID NO: 10411 - protein, 25 aa, Mycobacterium avium
AALLVFFWRDWVRILAGFFSSLRHR

SEQ ID NO: 10412 - protein, 20 aa, Mycobacterium avium
AALQRCGRVTAMVGDGANDA

SEQ ID NO: 10413 - protein, 18 aa, Mycobacterium avium
AALQRLTPKLGLAGGATP

SEQ ID NO: 10414 - protein, 22 aa, Mycobacterium avium
AALREITCDATVIVVTQRVSIA

SEQ ID NO: 10415 - protein, 17 aa, Mycobacterium avium
AALSRQPWRSVDGYAGH

SEQ ID NO: 10416 - protein, 25 aa, Mycobacterium avium
AALTARKRIAWLLLLGNMILAAALN

SEQ ID NO: 10417 - protein, 17 aa, Mycobacterium avium
AAMGKWLGREGGDRMFA

SEQ ID NO: 10418 - protein, 27 aa, Mycobacterium avium
AAQEWLKSIFPFGGFPWGSVAFGQTHG

SEQ ID NO: 10419 - protein, 17 aa, Mycobacterium avium
AARFVRTCDCFNIPIIM

SEQ ID NO: 10420 - protein, 24 aa, Mycobacterium avium
AARGEVYAPLALVFLFGGADVVVG

SEQ ID NO: 10421 - protein, 24 aa, Mycobacterium avium
AASPYLRIALRSAISPQIETTKAT

SEQ ID NO: 10422 - protein, 17 aa, Mycobacterium avium
AATAALWASMRQRAQAE

SEQ ID NO: 10423 - protein, 18 aa, Mycobacterium avium
AATELDAAVGNALDNVVA

SEQ ID NO: 10424 - protein, 25 aa, Mycobacterium avium
AATNIRLTQWFLLMMAFGSLFMAAG

SEQ ID NO: 10425 - protein, 27 aa, Mycobacterium avium
AAVCLWMTNRVRAELAVEMIIGVALGI

SEQ ID NO: 10426 - protein, 25 aa, Mycobacterium avium
AAVEAGALAVLWRRLVRSRAELDEL

SEQ ID NO: 10427 - protein, 18 aa, Mycobacterium avium
AAVFTIGCFIVFSTLELH

SEQ ID NO: 10428 - protein, 26 aa, Mycobacterium avium
AAVLVGYCAGWLPWFADIDRQMYFFY

SEQ ID NO: 10429 - protein, 18 aa, Mycobacterium avium
AAVYLAGYAPWFASETAI

SEQ ID NO: 10430 - protein, 27 aa, Mycobacterium avium
AAYAESLTEVFFWAAPVALVGFVLALF

SEQ ID NO: 10431 - protein, 21 aa, Mycobacterium avium
ACITDRLDGLLARNYGMATEF

SEQ ID NO: 10432 - protein, 20 aa, Mycobacterium avium
ADAFTAVPVVLARILELPPR

SEQ ID NO: 10433 - protein, 20 aa, Mycobacterium avium
ADAIAALQNRGFKTRTLQKP

SEQ ID NO: 10434 - protein, 17 aa, Mycobacterium avium
ADAPPFFVLHGRDDSLI

SEQ ID NO: 10435 - protein, 28 aa, Mycobacterium avium
ADAVPLWAAMLMWLTLWVLYLSIVNVGQ

SEQ ID NO: 10436 - protein, 24 aa, Mycobacterium avium
ADGAPAIVPPVRWHSGRRVHLDLD

SEQ ID NO: 10437 - protein, 19 aa, Mycobacterium avium
ADGTACTLVDGGVLSNFPI

SEQ ID NO: 10438 - protein, 17 aa, Mycobacterium avium
ADKSGLTALTWPVVANF

SEQ ID NO: 10439 - protein, 25 aa, Mycobacterium avium
ADLARLRLPLIIGEPDDLAALVTDD

SEQ ID NO: 10440 - protein, 33 aa, Mycobacterium avium
ADLEPTWSRPGWRRLKHFNGFVTSLWLSPSDIT

SEQ ID NO: 10441 - protein, 23 aa, Mycobacterium avium
ADLRMVLKSAAKLKHLAPDAICV

SEQ ID NO: 10442 - protein, 19 aa, Mycobacterium avium
ADLRVAHPLIARAHVLLRF

SEQ ID NO: 10443 - protein, 19 aa, Mycobacterium avium
ADPFGRGWNPLGLAHLQVA

SEQ ID NO: 10444 - protein, 18 aa, Mycobacterium avium
ADPGVRVLDVGWSLVSTR

SEQ ID NO: 10445 - protein, 24 aa, Mycobacterium avium
ADPSRVRRSGGTGLGLAISIEDAR

SEQ ID NO: 10446 - protein, 25 aa, Mycobacterium avium
ADQRALGAALWYAATVKDAVVVAAA

SEQ ID NO: 10447 - protein, 19 aa, Mycobacterium avium
ADRGPVLLITALHRDFAST

SEQ ID NO: 10448 - protein, 24 aa, Mycobacterium avium
ADTRANPFVFVYNYLKQVVAEMRK

SEQ ID NO: 10449 - protein, 20 aa, Mycobacterium avium
ADVLIALALANYGAKSSEKL

SEQ ID NO: 10450 - protein, 22 aa, Mycobacterium avium
ADVRSAELARGLIALGAGKGTH

SEQ ID NO: 10451 - protein, 23 aa, Mycobacterium avium
ADYPTVLLSGSWLTREQASAASE

SEQ ID NO: 10452 - protein, 24 aa, Mycobacterium avium
AEAFLPRRIRYTAQVTLALGGLVA

SEQ ID NO: 10453 - protein, 24 aa, Mycobacterium avium
AEELFFRGALYTALGRYHPVLIST

SEQ ID NO: 10454 - protein, 21 aa, Mycobacterium avium
AEHRWPQYVFGGRMRTSTFVL

SEQ ID NO: 10455 - protein, 21 aa, Mycobacterium avium
AEIVLALANLMWFVFAGLGAL

SEQ ID NO: 10456 - protein, 20 aa, Mycobacterium avium
AELAVEMIIGVALGIGAGTV

SEQ ID NO: 10457 - protein, 24 aa, Mycobacterium avium
AELMIDKLMGWRSMHTHGRALGGL

SEQ ID NO: 10458 - protein, 23 aa, Mycobacterium avium
AELMPAHDSMLFAVPERVPDEMA

SEQ ID NO: 10459 - protein, 21 aa, Mycobacterium avium
AELPLREILPAVQRLVVPAAA

SEQ ID NO: 10460 - protein, 17 aa, Mycobacterium avium
AELYVRHVADTKVAQAV

SEQ ID NO: 10461 - protein, 19 aa, Mycobacterium avium
AEPQWGPPVGRVLATLLAE

SEQ ID NO: 10462 - protein, 21 aa, Mycobacterium avium
AESGFSRFPIVDGDLDETVGI

SEQ ID NO: 10463 - protein, 17 aa, Mycobacterium avium
AFDLFVGAIQAFIFSIL

SEQ ID NO: 10464 - protein, 19 aa, Mycobacterium avium
AFDNPDFQTGLRMFLSPDG

SEQ ID NO: 10465 - protein, 26 aa, Mycobacterium avium
AFELPFYRLLLSYLFVAVFLAFVANL

SEQ ID NO: 10466 - protein, 21 aa, Mycobacterium avium
AFGGFIVPLAYAWSKSQFGSI

SEQ ID NO: 10467 - protein, 24 aa, Mycobacterium avium
AFTNPEFKRGLKLFLSPDGKAARM

SEQ ID NO: 10468 - protein, 23 aa, Mycobacterium avium
AGAALPGLFALGIRLQSAGAGDI

SEQ ID NO: 10469 - protein, 17 aa, Mycobacterium avium
AGALVMIGGTVGVAAFL

SEQ ID NO: 10470 - protein, 20 aa, Mycobacterium avium
AGAVAELFATVAATCVASAV

SEQ ID NO: 10471 - protein, 20 aa, Mycobacterium avium
AGAVLALWWAIRRLRRDRDP

SEQ ID NO: 10472 - protein, 25 aa, Mycobacterium avium
AGDTARYSAVFSDVYGLREGDDVRM

SEQ ID NO: 10473 - protein, 24 aa, Mycobacterium avium
AGGSLAFGAALAWSGLVFTAVAAV

SEQ ID NO: 10474 - protein, 18 aa, Mycobacterium avium
AGGVLTIVMGLVFVGLIP

SEQ ID NO: 10475 - protein, 26 aa, Mycobacterium avium
AGISHARWLRWPARVYTDVFRGLPEV

SEQ ID NO: 10476 - protein, 23 aa, Mycobacterium avium
AGKDSFPASFIVKLNNPEQHAEF

SEQ ID NO: 10477 - protein, 23 aa, Mycobacterium avium
AGLAAVCYAELASAVPVSGSSYS

SEQ ID NO: 10478 - protein, 26 aa, Mycobacterium avium
AGLGWLRRHTRAIQIFGGVLLITVGA

SEQ ID NO: 10479 - protein, 25 aa, Mycobacterium avium
AGLKAFWYHFAIMFEALFILTAVDA

SEQ ID NO: 10480 - protein, 18 aa, Mycobacterium avium
AGLKATFLTLAVPILAIG

SEQ ID NO: 10481 - protein, 32 aa, Mycobacterium avium
AGLKRYVADGLQHWPLLIFPYMILLVVVVSFI

SEQ ID NO: 10482 - protein, 19 aa, Mycobacterium avium
AGLLLWFLIALPIGAVLGG

SEQ ID NO: 10483 - protein, 25 aa, Mycobacterium avium
AGQLHRVRMLLLTNCTFDGVVYNPL

SEQ ID NO: 10484 - protein, 26 aa, Mycobacterium avium
AGSGRSRAAVKFLLYNLFGGLIMLAA

SEQ ID NO: 10485 - protein, 19 aa, Mycobacterium avium
AGSSCDRPGTSVFAMSTSS

SEQ ID NO: 10486 - protein, 23 aa, Mycobacterium avium
AGSSLPLLLLFSVANRSLTDVLT

SEQ ID NO: 10487 - protein, 27 aa, Mycobacterium avium
AGSVMTWWTGDSLMVFDVNTLALRYTI

SEQ ID NO: 10488 - protein, 19 aa, Mycobacterium avium
AGTVIRFDGAVPFVNLQVS

SEQ ID NO: 10489 - protein, 20 aa, Mycobacterium avium
AGVLLLWSWLVLPLAQGYYS

SEQ ID NO: 10490 - protein, 21 aa, Mycobacterium avium
AGVLVGWLGGMLLSGMLTVIV

SEQ ID NO: 10491 - protein, 25 aa, Mycobacterium avium
AGVPPGLPAWIGWTHFFNLFMMMFI

SEQ ID NO: 10492 - protein, 23 aa, Mycobacterium avium
AGVVPEWLAYTLAVLLAAASLGI

SEQ ID NO: 10493 - protein, 17 aa, Mycobacterium avium
AHAPRYARVPWVGAAAL

SEQ ID NO: 10494 - protein, 18 aa, Mycobacterium avium
AHHYFARDPLKPELTLAD

SEQ ID NO: 10495 - protein, 25 aa, Mycobacterium avium
AHILRLAVFAGFLAVVFYLVAVARV

SEQ ID NO: 10496 - protein, 17 aa, Mycobacterium avium
AHLQVAYVLSMHPPVLA

SEQ ID NO: 10497 - protein, 20 aa, Mycobacterium avium
AHPLIARAHVLLRFEQGRWR

SEQ ID NO: 10498 - protein, 17 aa, Mycobacterium avium
AHPQFFGNSTFSLFVTV

SEQ ID NO: 10499 - protein, 31 aa, Mycobacterium avium
AHPVIGPWLDRLQAFNVFSSFWFTAIYVLLF

SEQ ID NO: 10500 - protein, 20 aa, Mycobacterium avium
AHTFSFFLPQGHEYQITLIV

SEQ ID NO: 10501 - protein, 18 aa, Mycobacterium avium
AHVLLRFEQGRWRAVDNN

SEQ ID NO: 10502 - protein, 19 aa, Mycobacterium avium
AHVRVRVQMWWDPFSDPDG

SEQ ID NO: 10503 - protein, 23 aa, Mycobacterium avium
AIGCTTWLPFLVRAARNPVSNTG

SEQ ID NO: 10504 - protein, 24 aa, Mycobacterium avium
AINALICLVLFRLTTARALSYRQV

SEQ ID NO: 10505 - protein, 27 aa, Mycobacterium avium
AIRFRGELVLGIALICLAYFPLTAQSS

SEQ ID NO: 10506 - protein, 18 aa, Mycobacterium avium
AIRPRQWVKNVLVLLAPV

SEQ ID NO: 10507 - protein, 20 aa, Mycobacterium avium
AISCLSARRDRLWNLSRLFP

SEQ ID NO: 10508 - protein, 17 aa, Mycobacterium avium
AISELDLSPVYLNFDEN

SEQ ID NO: 10509 - protein, 22 aa, Mycobacterium avium
AISRGVLHYCERLVTHDTALRA

SEQ ID NO: 10510 - protein, 17 aa, Mycobacterium avium
AKDVPVKPGRGMVAVNY

SEQ ID NO: 10511 - protein, 19 aa, Mycobacterium avium
AKEALKLTSLENADIYLGG

SEQ ID NO: 10512 - protein, 21 aa, Mycobacterium avium
AKFPELSAHQVINRIVQSAHN

SEQ ID NO: 10513 - protein, 21 aa, Mycobacterium avium
AKINRFRWIRDKELRAKLTPD

SEQ ID NO: 10514 - protein, 19 aa, Mycobacterium avium
AKIWIRFPGFSIQPAEFSK

SEQ ID NO: 10515 - protein, 18 aa, Mycobacterium avium
AKVDGAWNLHELTKDLDL

SEQ ID NO: 10516 - protein, 25 aa, Mycobacterium avium
AKVVNLRSAPGFSFVGEDLDRLRSL

SEQ ID NO: 10517 - protein, 18 aa, Mycobacterium avium
ALAGMPFAATRYTREVVR

SEQ ID NO: 10518 - protein, 18 aa, Mycobacterium avium
ALAMMVLSKSFSVLRSAV

SEQ ID NO: 10519 - protein, 19 aa, Mycobacterium avium
ALARLPLQIPMITTALRIR

SEQ ID NO: 10520 - protein, 19 aa, Mycobacterium avium
ALCLIFIIMLILTRSFIAA

SEQ ID NO: 10521 - protein, 18 aa, Mycobacterium avium
ALCLIFIIMLIMTRSFIA

SEQ ID NO: 10522 - protein, 18 aa, Mycobacterium avium
ALDGWQITVDRVRDPAAL

SEQ ID NO: 10523 - protein, 17 aa, Mycobacterium avium
ALDHPGTLYSYVYADQT

SEQ ID NO: 10524 - protein, 19 aa, Mycobacterium avium
ALEYLKITYGWSLLLIVVF

SEQ ID NO: 10525 - protein, 19 aa, Mycobacterium avium
ALFGFIWDVSWHIGNGRDP

SEQ ID NO: 10526 - protein, 19 aa, Mycobacterium avium
ALGAAMGYAGLRRRERQLD

SEQ ID NO: 10527 - protein, 18 aa, Mycobacterium avium
ALGGLWRGADIALLALAA

SEQ ID NO: 10528 - protein, 18 aa, Mycobacterium avium
ALGIVFAALVGVVAAQAV

SEQ ID NO: 10529 - protein, 20 aa, Mycobacterium avium
ALHECGHMWVARATGMKVRR

SEQ ID NO: 10530 - protein, 19 aa, Mycobacterium avium
ALIQLLADRAFQWSLNAGE

SEQ ID NO: 10531 - protein, 21 aa, Mycobacterium avium
ALKPLRFLPQTALLESLLITM

SEQ ID NO: 10532 - protein, 17 aa, Mycobacterium avium
ALLACTVGAAFVTALQT

SEQ ID NO: 10533 - protein, 17 aa, Mycobacterium avium
ALLDGILTFFVVAAFGA

SEQ ID NO: 10534 - protein, 28 aa, Mycobacterium avium
ALLHERWGFRPAWQCGECVEDMALAVRG

SEQ ID NO: 10535 - protein, 23 aa, Mycobacterium avium
ALLKASALVYFLGLVADQRELFQ

SEQ ID NO: 10536 - protein, 20 aa, Mycobacterium avium
ALLRRASLRQAVADGVAIAV

SEQ ID NO: 10537 - protein, 25 aa, Mycobacterium avium
ALLRTPELYVWVLLAIAATAWEQSA

SEQ ID NO: 10538 - protein, 18 aa, Mycobacterium avium
ALLVLTVITGLAYPLLVW

SEQ ID NO: 10539 - protein, 17 aa, Mycobacterium avium
ALPPQFGLPGFRHSIGL

SEQ ID NO: 10540 - protein, 18 aa, Mycobacterium avium
ALRPETLSAAGWYVVGAT

SEQ ID NO: 10541 - protein, 26 aa, Mycobacterium avium
ALRSRIGMVLQDTWLFDGTIAENIGY

SEQ ID NO: 10542 - protein, 22 aa, Mycobacterium avium
ALTCSFGGLITIAHGPPLSEPS

SEQ ID NO: 10543 - protein, 20 aa, Mycobacterium avium
ALTIIFVFAVATLQPLAIYS

SEQ ID NO: 10544 - protein, 25 aa, Mycobacterium avium
ALTLWLHVVDARFARDLRSALLRKL

SEQ ID NO: 10545 - protein, 26 aa, Mycobacterium avium
ALTPIFKRPIVFGAVSGLGVGTLGLW

SEQ ID NO: 10546 - protein, 18 aa, Mycobacterium avium
ALVLELLATLGVALIAVG

SEQ ID NO: 10547 - protein, 27 aa, Mycobacterium avium
ALVLWMVLRPLQYRAIAAEVIAIRVVL

SEQ ID NO: 10548 - protein, 20 aa, Mycobacterium avium
ALVTFALKGNILLGSETTAH

SEQ ID NO: 10549 - protein, 23 aa, Mycobacterium avium
AMGGRAAEELVFREPTTGAVSDI

SEQ ID NO: 10550 - protein, 18 aa, Mycobacterium avium
AMIVPGFFGSAFGTYLMR

SEQ ID NO: 10551 - protein, 20 aa, Mycobacterium avium
AMLLWVYRSVTAVFVLVTVI

SEQ ID NO: 10552 - protein, 22 aa, Mycobacterium avium
AMLTAFLFFIFGQYRTGATNGY

SEQ ID NO: 10553 - protein, 20 aa, Mycobacterium avium
AMNRFKRDYLAAYISASSDP

SEQ ID NO: 10554 - protein, 19 aa, Mycobacterium avium
ANEMPQCRAGIGVAAGQVV

SEQ ID NO: 10555 - protein, 23 aa, Mycobacterium avium
ANFWRRGSLLLGIGVGVAALLRL

SEQ ID NO: 10556 - protein, 25 aa, Mycobacterium avium
ANHDGRRLVAVLLHGTRQPIAPWEQ

SEQ ID NO: 10557 - protein, 20 aa, Mycobacterium avium
ANLADIWRRRDLPRDGKAPV

SEQ ID NO: 10558 - protein, 20 aa, Mycobacterium avium
ANNIPLNRMVDIRSNPALRA

SEQ ID NO: 10559 - protein, 19 aa, Mycobacterium avium
ANPGAALRVVAEDGTPLGP

SEQ ID NO: 10560 - protein, 20 aa, Mycobacterium avium
ANVSKWAFLLTFAGVGLNTD

SEQ ID NO: 10561 - protein, 25 aa, Mycobacterium avium
ANWIVRRLGVEPAEELRSARSPQEL

SEQ ID NO: 10562 - protein, 23 aa, Mycobacterium avium
APDAICVTDPLAFTGCGRTTAAG

SEQ ID NO: 10563 - protein, 24 aa, Mycobacterium avium
APDAPPGWLPDWLRPAGSRRGQAA

SEQ ID NO: 10564 - protein, 24 aa, Mycobacterium avium
APGVILRQILTWMLSTAVPVLAIV

SEQ ID NO: 10565 - protein, 31 aa, Mycobacterium avium
APGVRAKAAFIWAKFPKFVLGFLVVSAIATA

SEQ ID NO: 10566 - protein, 19 aa, Mycobacterium avium
APLAMEGLFAFFFESTFIG

SEQ ID NO: 10567 - protein, 18 aa, Mycobacterium avium
APLSSTFVRFWTVSFPVV

SEQ ID NO: 10568 - protein, 17 aa, Mycobacterium avium
APLTYGWLLVLMITTII

SEQ ID NO: 10569 - protein, 26 aa, Mycobacterium avium
APNFGTGMAPFFLTLALFFGALVLWM

SEQ ID NO: 10570 - protein, 27 aa, Mycobacterium avium
APPHPSRWRHVPTILLATSLVLLTTAM

SEQ ID NO: 10571 - protein, 17 aa, Mycobacterium avium
APPRAGDAVLVFSSGTT

SEQ ID NO: 10572 - protein, 24 aa, Mycobacterium avium
APPVLGGLCSDVGKVAYDPTNNEQ

SEQ ID NO: 10573 - protein, 21 aa, Mycobacterium avium
APSRLGAGLAAMFPELPSVDV

SEQ ID NO: 10574 - protein, 25 aa, Mycobacterium avium
AQAASLRAGNPIVVAGIPVGTVTSM

SEQ ID NO: 10575 - protein, 20 aa, Mycobacterium avium
AQGGLAWSRPLATAVLAALI

SEQ ID NO: 10576 - protein, 23 aa, Mycobacterium avium
AQKLARWRLAEAYEEIGQRVAHI

SEQ ID NO: 10577 - protein, 18 aa, Mycobacterium avium
AQLDGEWRVTIEGAACTF

SEQ ID NO: 10578 - protein, 25 aa, Mycobacterium avium
AQQWRPMLICAALVLTSQVADFMLT

SEQ ID NO: 10579 - protein, 18 aa, Mycobacterium avium
AQSRLAALSILVGAVGAT

SEQ ID NO: 10580 - protein, 23 aa, Mycobacterium avium
AQTELFPLAMLSVGGMMVFPASN

SEQ ID NO: 10581 - protein, 24 aa, Mycobacterium avium
AQTRLRAGSPILFYPAGALAATVL

SEQ ID NO: 10582 - protein, 26 aa, Mycobacterium avium
ARAKGGTPGWVIRKHVVKNAAGPALT

SEQ ID NO: 10583 - protein, 17 aa, Mycobacterium avium
ARALFRKGADFTAAMAF

SEQ ID NO: 10584 - protein, 20 aa, Mycobacterium avium
ARALLKPAPILLVDEATSAL

SEQ ID NO: 10585 - protein, 20 aa, Mycobacterium avium
ARAVFLGRFIALLRILAGPL

SEQ ID NO: 10586 - protein, 19 aa, Mycobacterium avium
ARAVIPCGEPQVVVRQGVA

SEQ ID NO: 10587 - protein, 32 aa, Mycobacterium avium
ARDTDLCGLSWLYRYAVGVYRDDRGCGQVSTL

SEQ ID NO: 10588 - protein, 35 aa, Mycobacterium avium
ARIKYKVGPTIAWYQDWLRYYFLTVESNPDGSMAR

SEQ ID NO: 10589 - protein, 17 aa, Mycobacterium avium
ARILEHLEYTGIAVGAS

SEQ ID NO: 10590 - protein, 24 aa, Mycobacterium avium
ARIPYRAHWDAGAVVLELYEHLVE

SEQ ID NO: 10591 - protein, 24 aa, Mycobacterium avium
ARLIFERFGRFWGAFSVGDLLILN

SEQ ID NO: 10592 - protein, 18 aa, Mycobacterium avium
ARLIPRVGVASVIAEGFL

SEQ ID NO: 10593 - protein, 18 aa, Mycobacterium avium
ARLPRLLQPYLLRHHELI

SEQ ID NO: 10594 - protein, 20 aa, Mycobacterium avium
ARPADLLVLLDSLRQREGTL

SEQ ID NO: 10595 - protein, 18 aa, Mycobacterium avium
ARPARPMRTWTLIPALAG

SEQ ID NO: 10596 - protein, 17 aa, Mycobacterium avium
ARPSFWYDEAATISASY

SEQ ID NO: 10597 - protein, 29 aa, Mycobacterium avium
ARPYQWWRVALVIASGLAYVVIFSLPLAR

SEQ ID NO: 10598 - protein, 21 aa, Mycobacterium avium
ARQAKFALAHGGIFGDGLGQG

SEQ ID NO: 10599 - protein, 27 aa, Mycobacterium avium
ARRGQLRAGTALIARGEFSLIIIGLAG

SEQ ID NO: 10600 - protein, 19 aa, Mycobacterium avium
ARTYGWHRAEVFTAVANAG

SEQ ID NO: 10601 - protein, 17 aa, Mycobacterium avium
ARVPWVGAAALPDVGEP

SEQ ID NO: 10602 - protein, 21 aa, Mycobacterium avium
ASALFKLLVPVALIVLLGLVV

SEQ ID NO: 10603 - protein, 21 aa, Mycobacterium avium
ASALGDFGIGWLRRLSSRDRE

SEQ ID NO: 10604 - protein, 26 aa, Mycobacterium avium
ASASFMLCAAFNVLLRAVCGRDTSAP

SEQ ID NO: 10605 - protein, 21 aa, Mycobacterium avium
ASFSGKFQTFVPLTLVSDRAG

SEQ ID NO: 10606 - protein, 27 aa, Mycobacterium avium
ASGLLGWWRWHHNSWLPTVYAGVIGVL

SEQ ID NO: 10607 - protein, 23 aa, Mycobacterium avium
ASHELRTPLAAIRGYTELTQRMG

SEQ ID NO: 10608 - protein, 25 aa, Mycobacterium avium
ASIGACVWLMLNLTALTWVRFGIWL

SEQ ID NO: 10609 - protein, 22 aa, Mycobacterium avium
ASLGASGYMVWQHRVAAHNRQL

SEQ ID NO: 10610 - protein, 21 aa, Mycobacterium avium
ASLRLLAPGGRFIEMGKTDVR

SEQ ID NO: 10611 - protein, 19 aa, Mycobacterium avium
ASQMRRLRAPRPQVKHGSS

SEQ ID NO: 10612 - protein, 18 aa, Mycobacterium avium
ASSIDFPSLVKVKQIPTN

SEQ ID NO: 10613 - protein, 19 aa, Mycobacterium avium
ASYSWYYAWTPGTGYLANL

SEQ ID NO: 10614 - protein, 27 aa, Mycobacterium avium
ATAAFKISPTAWWVCGAATTVTLLYLG

SEQ ID NO: 10615 - protein, 29 aa, Mycobacterium avium
ATAAPRLGNAFGLAWRLDRAALLLWTAGL

SEQ ID NO: 10616 - protein, 25 aa, Mycobacterium avium
ATADLYPRYVCDYGTPAHASSAADY

SEQ ID NO: 10617 - protein, 24 aa, Mycobacterium avium
ATASFGVTPLMLWQQATKHYTNIS

SEQ ID NO: 10618 - protein, 19 aa, Mycobacterium avium
ATAVPWARQRTAMVAAERL

SEQ ID NO: 10619 - protein, 24 aa, Mycobacterium avium
ATDSKFTAPASMWGIQGGDPNEQI

SEQ ID NO: 10620 - protein, 19 aa, Mycobacterium avium
ATESVRMLAPIPGKSAVGI

SEQ ID NO: 10621 - protein, 17 aa, Mycobacterium avium
ATHDRVLLIPAILAVIL

SEQ ID NO: 10622 - protein, 19 aa, Mycobacterium avium
ATHVLPKVDFEFDPAVRRL

SEQ ID NO: 10623 - protein, 17 aa, Mycobacterium avium
ATMSRYVVAPVFVVAAA

SEQ ID NO: 10624 - protein, 29 aa, Mycobacterium avium
ATPYELAATIARRLGLTGALGTVAESVDG

SEQ ID NO: 10625 - protein, 19 aa, Mycobacterium avium
ATRFVKLLSPRASSAAGTA

SEQ ID NO: 10626 - protein, 22 aa, Mycobacterium avium
ATRHKRGCVIVVGLAAVAASAV

SEQ ID NO: 10627 - protein, 21 aa, Mycobacterium avium
ATRLHPALFFLASVAATLPLA

SEQ ID NO: 10628 - protein, 26 aa, Mycobacterium avium
ATRRFSAIALWCWVAMALSGLVNAAV

SEQ ID NO: 10629 - protein, 25 aa, Mycobacterium avium
ATRRLRRVAVIAGITLDVLIVVAAG

SEQ ID NO: 10630 - protein, 17 aa, Mycobacterium avium
ATVSRPAAVPAPNPSPA

SEQ ID NO: 10631 - protein, 28 aa, Mycobacterium avium
AVAFKLYPRRAVLGLALFIGQAFLYNGV

SEQ ID NO: 10632 - protein, 18 aa, Mycobacterium avium
AVAKRFGFENVRSTVDLA

SEQ ID NO: 10633 - protein, 24 aa, Mycobacterium avium
AVALVLWWRMVRFEYALIVTTATA

SEQ ID NO: 10634 - protein, 21 aa, Mycobacterium avium
AVARLRPRVPGLHLDIVGDGW

SEQ ID NO: 10635 - protein, 24 aa, Mycobacterium avium
AVATWLVYRITRGVPKKRTEAGFR

SEQ ID NO: 10636 - protein, 26 aa, Mycobacterium avium
AVAVVAWEWLCARSELSGAQQAAPVA

SEQ ID NO: 10637 - protein, 24 aa, Mycobacterium avium
AVDAPEFHAAVLAELALIGHRGPA

SEQ ID NO: 10638 - protein, 25 aa, Mycobacterium avium
AVEIAEAMRGMLQRIWKEQDRTKEA

SEQ ID NO: 10639 - protein, 19 aa, Mycobacterium avium
AVGLYPGDQVRVLGVPVGT

SEQ ID NO: 10640 - protein, 21 aa, Mycobacterium avium
AVGQQCARRPLPPVAAMVKLL

SEQ ID NO: 10641 - protein, 20 aa, Mycobacterium avium
AVIAPAAWYGLGALLGAAVM

SEQ ID NO: 10642 - protein, 22 aa, Mycobacterium avium
AVIAVGLPVMILAGVATYFNSR

SEQ ID NO: 10643 - protein, 17 aa, Mycobacterium avium
AVIEELVGWGGGRLRRP

SEQ ID NO: 10644 - protein, 24 aa, Mycobacterium avium
AVIPARWRAAWVGWWVAAGIASAI

SEQ ID NO: 10645 - protein, 17 aa, Mycobacterium avium
AVIRRGVIPASWGGKLK

SEQ ID NO: 10646 - protein, 18 aa, Mycobacterium avium
AVLALLGFLKVRRIRGPR

SEQ ID NO: 10647 - protein, 20 aa, Mycobacterium avium
AVLAVLAWRALDRSDRLGRL

SEQ ID NO: 10648 - protein, 30 aa, Mycobacterium avium
AVLVRRLPGWPVWFALLWAAQEWLKSIFPF

SEQ ID NO: 10649 - protein, 19 aa, Mycobacterium avium
AVMAVFPMYFLKSSAYTIV

SEQ ID NO: 10650 - protein, 22 aa, Mycobacterium avium
AVPLGGFCDIAGMTSVEELAPD

SEQ ID NO: 10651 - protein, 20 aa, Mycobacterium avium
AVSKALFLGFMFAFAIKAPL

SEQ ID NO: 10652 - protein, 26 aa, Mycobacterium avium
AVTAVEMVLLWWARRLFAAPLPLLGV

SEQ ID NO: 10653 - protein, 20 aa, Mycobacterium avium
AVTGCTRGPTVTRYEVELGP

SEQ ID NO: 10654 - protein, 21 aa, Mycobacterium avium
AVTGTIQWPALVMFAIIFFWT

SEQ ID NO: 10655 - protein, 17 aa, Mycobacterium avium
AVTLSLVLAWFVVRNIP

SEQ ID NO: 10656 - protein, 25 aa, Mycobacterium avium
AVVCVLISVALTFLVINIRGLLRDR

SEQ ID NO: 10657 - protein, 25 aa, Mycobacterium avium
AVVGLHFVSALAFNAVERQLNARLR

SEQ ID NO: 10658 - protein, 21 aa, Mycobacterium avium
AVVMVCFHLGILVSIPMGVPL

SEQ ID NO: 10659 - protein, 29 aa, Mycobacterium avium
AVVVVVGSVILWRFFGDALSKRSHTAAGR

SEQ ID NO: 10660 - protein, 17 aa, Mycobacterium avium
AVWGVFDGRADAIANPD

SEQ ID NO: 10661 - protein, 17 aa, Mycobacterium avium
AWITFGVGPAYVASALA

SEQ ID NO: 10662 - protein, 20 aa, Mycobacterium avium
AWRYWRTVVGVLAAVAVLVI

SEQ ID NO: 10663 - protein, 19 aa, Mycobacterium avium
AWTAALWAVALLVAGTGIG

SEQ ID NO: 10664 - protein, 18 aa, Mycobacterium avium
AYGEFCPHLAAPMADGWL

SEQ ID NO: 10665 - protein, 31 aa, Mycobacterium avium
AYHEGGHTLAAWAMPDIEPIYKVTILARGRT

SEQ ID NO: 10666 - protein, 20 aa, Mycobacterium avium
AYLSGCLDLADGRPVTIGSF

SEQ ID NO: 10667 - protein, 20 aa, Mycobacterium avium
CAELSAPLIEVHISNVHARE

SEQ ID NO: 10668 - protein, 25 aa, Mycobacterium avium
CALAVGLKFKLGFDDSLDVVGVHLV

SEQ ID NO: 10669 - protein, 21 aa, Mycobacterium avium
CDLNATGFFPGLNDITTFIVN

SEQ ID NO: 10670 - protein, 24 aa, Mycobacterium avium
CERADAVLVLTEWRQFVEMDPDDL

SEQ ID NO: 10671 - protein, 18 aa, Mycobacterium avium
CIVSVWRSVPFATVVLLA

SEQ ID NO: 10672 - protein, 19 aa, Mycobacterium avium
CLLALAELHLRTIRLVVAF

SEQ ID NO: 10673 - protein, 24 aa, Mycobacterium avium
CNSDQPFMPLAMKQHVLGPYPLDP

SEQ ID NO: 10674 - protein, 26 aa, Mycobacterium avium
CPACEAGDYSLCWSFADGDLKPGIHT

SEQ ID NO: 10675 - protein, 18 aa, Mycobacterium avium
CPDVLLVNVPGTWESAPQ

SEQ ID NO: 10676 - protein, 20 aa, Mycobacterium avium
CPGCGSLRMVYALMHGNLLG

SEQ ID NO: 10677 - protein, 26 aa, Mycobacterium avium
CQQGFCGTCKVKVLAGQVDRRGRTVE

SEQ ID NO: 10678 - protein, 23 aa, Mycobacterium avium
CSAVGDVVYAVWVPDGRSPSVAD

SEQ ID NO: 10679 - protein, 17 aa, Mycobacterium avium
CSYLIGFRFYARLIERK

SEQ ID NO: 10680 - protein, 21 aa, Mycobacterium avium
CTHLFKLPGALFVVVAVTVAG

SEQ ID NO: 10681 - protein, 19 aa, Mycobacterium avium
CTYVLLRLAGDIGQIQANQ

SEQ ID NO: 10682 - protein, 31 aa, Mycobacterium avium
CWPTAPRWLGVPLYLLLGWVAIWYAPTILHQ

SEQ ID NO: 10683 - protein, 21 aa, Mycobacterium avium
CYHVAGIWRRGVVGHPLAVLK

SEQ ID NO: 10684 - protein, 20 aa, Mycobacterium avium
DAAQSWPVLQADASSPATLN

SEQ ID NO: 10685 - protein, 19 aa, Mycobacterium avium
DAARFSFLLATPIILAAGV

SEQ ID NO: 10686 - protein, 22 aa, Mycobacterium avium
DAARVRLGTPLLQIDTGQVADR

SEQ ID NO: 10687 - protein, 27 aa, Mycobacterium avium
DADSRLYLPMPFFWVGGFGSGILSALL

SEQ ID NO: 10688 - protein, 20 aa, Mycobacterium avium
DAGLALGMFLMFSTFGTLSY

SEQ ID NO: 10689 - protein, 19 aa, Mycobacterium avium
DAGPPFGGPGDRYQSDDPT

SEQ ID NO: 10690 - protein, 17 aa, Mycobacterium avium
DAKGMKLSININDVRLK

SEQ ID NO: 10691 - protein, 23 aa, Mycobacterium avium
DALEVRGRILSAFEQAERSRDPE

SEQ ID NO: 10692 - protein, 19 aa, Mycobacterium avium
DALKCGAQVVLPADADGHA

SEQ ID NO: 10693 - protein, 17 aa, Mycobacterium avium
DALPPVQRIELMTTHDL

SEQ ID NO: 10694 - protein, 22 aa, Mycobacterium avium
DALPVRVGVAVIGTIVVFTLIM

SEQ ID NO: 10695 - protein, 18 aa, Mycobacterium avium
DALRRAVHRAGPAIVASN

SEQ ID NO: 10696 - protein, 24 aa, Mycobacterium avium
DANHRITTILGWGVGILISLLNMV

SEQ ID NO: 10697 - protein, 22 aa, Mycobacterium avium
DANKYVQCRVVATGNSVDAVWH

SEQ ID NO: 10698 - protein, 21 aa, Mycobacterium avium
DAPLHYERFGPPPVVDGVPFE

SEQ ID NO: 10699 - protein, 18 aa, Mycobacterium avium
DARHPFLVMELIEGGTLR

SEQ ID NO: 10700 - protein, 24 aa, Mycobacterium avium
DATARSQLWLSLLSWAVVVALYFV

SEQ ID NO: 10701 - protein, 24 aa, Mycobacterium avium
DATLIRMLVIFGIVTVIALAAATI

SEQ ID NO: 10702 - protein, 38 aa, Mycobacterium avium
DAVKYLFRRPFQWREFLEQSWFVARVSLAPTLLVAIPF

SEQ ID NO: 10703 - protein, 24 aa, Mycobacterium avium
DAVRASMAIPFFYRPVKLARADGT

SEQ ID NO: 10704 - protein, 25 aa, Mycobacterium avium
DAVTDRLPLVLGLMAAITFVLLFLL

SEQ ID NO: 10705 - protein, 21 aa, Mycobacterium avium
DDAYRRPTLYNPLNSAVTFRY

SEQ ID NO: 10706 - protein, 24 aa, Mycobacterium avium
DDLRPGRLSRWIAHLSTAIEMLVP

SEQ ID NO: 10707 - protein, 22 aa, Mycobacterium avium
DDLRPSALAGFIAHFSTAVEGL

SEQ ID NO: 10708 - protein, 31 aa, Mycobacterium avium
DDYRPNLFVTYWSFRLMIGFLAIPVLFALTV

SEQ ID NO: 10709 - protein, 22 aa, Mycobacterium avium
DECELARAIVFFAEDAHVFATT

SEQ ID NO: 10710 - protein, 24 aa, Mycobacterium avium
DEDACAKLVADVQVFARVSPEQKV

SEQ ID NO: 10711 - protein, 17 aa, Mycobacterium avium
DEMFDRITVPTLIIRGG

SEQ ID NO: 10712 - protein, 24 aa, Mycobacterium avium
DEPIPIRYAHWASHAVRGDFGKTV

SEQ ID NO: 10713 - protein, 35 aa, Mycobacterium avium
DERDRLALWSRVLPITFTAVGLIALVGGGLLASFS

SEQ ID NO: 10714 - protein, 20 aa, Mycobacterium avium
DERRRRLVVTVADVTAAQLV

SEQ ID NO: 10715 - protein, 30 aa, Mycobacterium avium
DFDPGRRLFCTAAPQLRRVLFAPQTVGAPG

SEQ ID NO: 10716 - protein, 38 aa, Mycobacterium avium
DFFRPVRSYFYWEKHCFDIPACFAFRSVFDALDGIDEL

SEQ ID NO: 10717 - protein, 22 aa, Mycobacterium avium
DFLSVGWWPVFNVADPSVVGGA

SEQ ID NO: 10718 - protein, 21 aa, Mycobacterium avium
DGEVKIADFGLVRAVAAAGIT

SEQ ID NO: 10719 - protein, 17 aa, Mycobacterium avium
DGIKEREFHLALVGALT

SEQ ID NO: 10720 - protein, 23 aa, Mycobacterium avium
DGLKQRCSWSPDVPTTHEPPTYA

SEQ ID NO: 10721 - protein, 19 aa, Mycobacterium avium
DGPYRWLHHPNYVAVVAEG

SEQ ID NO: 10722 - protein, 18 aa, Mycobacterium avium
DGRLQLALWVTRKDLSLR

SEQ ID NO: 10723 - protein, 21 aa, Mycobacterium avium
DGRLYPALNLTSARLATGTAN

SEQ ID NO: 10724 - protein, 20 aa, Mycobacterium avium
DGRVGRQWWAGVAIGLTLTL

SEQ ID NO: 10725 - protein, 23 aa, Mycobacterium avium
DHANPAVLWWSLALGTDFGGNLT

SEQ ID NO: 10726 - protein, 23 aa, Mycobacterium avium
DHVAFSIWTLWPVMALFMPAAVY

SEQ ID NO: 10727 - protein, 18 aa, Mycobacterium avium
DHVNSLSNAMGWNFTAAK

SEQ ID NO: 10728 - protein, 29 aa, Mycobacterium avium
DIGPQPAWRNLRFPLAWAPPEANVARIVA

SEQ ID NO: 10729 - protein, 18 aa, Mycobacterium avium
DIRRTVGLLDNWPTKAAP

SEQ ID NO: 10730 - protein, 30 aa, Mycobacterium avium
DKHGRPFRRRNPRPAIVVVSLLAVATAVIW

SEQ ID NO: 10731 - protein, 21 aa, Mycobacterium avium
DKPPPARIVLFSDGKETMPTN

SEQ ID NO: 10732 - protein, 25 aa, Mycobacterium avium
DLADGRPVTIGSFFKPRNFGMVFLA

SEQ ID NO: 10733 - protein, 24 aa, Mycobacterium avium
DLDEWDWVKWLPHFGDPRRQDAAG

SEQ ID NO: 10734 - protein, 26 aa, Mycobacterium avium
DLEPFRCFYLSAPFVVPKTKEVAATV

SEQ ID NO: 10735 - protein, 18 aa, Mycobacterium avium
DLERGFKAPWVPVLPIAS

SEQ ID NO: 10736 - protein, 19 aa, Mycobacterium avium
DLFLRIAPELYLKRLCVGG

SEQ ID NO: 10737 - protein, 19 aa, Mycobacterium avium
DLMLYALVMAFCFTTLSTY

SEQ ID NO: 10738 - protein, 24 aa, Mycobacterium avium
DLSALRPGSLQALLPPEQRARPGA

SEQ ID NO: 10739 - protein, 24 aa, Mycobacterium avium
DLSTAVVIGTAFTALVTTFTDSII

SEQ ID NO: 10740 - protein, 24 aa, Mycobacterium avium
DLSTLRRIPWLPGTALVIADVVGA

SEQ ID NO: 10741 - protein, 21 aa, Mycobacterium avium
DLVGWPFVLLLMRAMSRDERA

SEQ ID NO: 10742 - protein, 27 aa, Mycobacterium avium
DNGLRPEPIIALGILLTWCSVERAVAT

SEQ ID NO: 10743 - protein, 30 aa, Mycobacterium avium
DNTNRPPVVWRISVGLTRDGGQLKMSKVDF

SEQ ID NO: 10744 - protein, 33 aa, Mycobacterium avium
DPASRREFGRPAGLRGSFVAERVRPKKYREQSE

SEQ ID NO: 10745 - protein, 21 aa, Mycobacterium avium
DPATGQSRWSYARDTDLCGLS

SEQ ID NO: 10746 - protein, 21 aa, Mycobacterium avium
DPGQTWVLVFAVTMMAGLLVS

SEQ ID NO: 10747 - protein, 37 aa, Mycobacterium avium
DPHPENARHLGLFVVGRIAAWHGMRVGLRGPAANESG

SEQ ID NO: 10748 - protein, 20 aa, Mycobacterium avium
DPKETVSFVAWVIYAAYLHA

SEQ ID NO: 10749 - protein, 40 aa, Mycobacterium avium
DPKRQMATRGWRRIGTAIVRWPGPILVVATGVALVGLLAL

SEQ ID NO: 10750 - protein, 21 aa, Mycobacterium avium
DPRVHRGWRGPYDIDSTFHEP

SEQ ID NO: 10751 - protein, 24 aa, Mycobacterium avium
DRLYRDRHIQLWVVYVDNFNKFKP

SEQ ID NO: 10752 - protein, 20 aa, Mycobacterium avium
DRRGQLGKMFALRHYGPDKV

SEQ ID NO: 10753 - protein, 17 aa, Mycobacterium avium
DRRGWYGMFTLLGGGTA

SEQ ID NO: 10754 - protein, 24 aa, Mycobacterium avium
DRRHRLRVVLLLGAYVLLTVAVTG

SEQ ID NO: 10755 - protein, 22 aa, Mycobacterium avium
DRRWEARGGERGVIYDIALWTV

SEQ ID NO: 10756 - protein, 23 aa, Mycobacterium avium
DRTRLRTGSRISVAMPMFHGLGL

SEQ ID NO: 10757 - protein, 23 aa, Mycobacterium avium
DRVGDAIMAFLALLIVTSVSMVF

SEQ ID NO: 10758 - protein, 24 aa, Mycobacterium avium
DRYELGEILGFGGMSEVHLARDVR

SEQ ID NO: 10759 - protein, 17 aa, Mycobacterium avium
DRYRTAGEFAAAAHEAL

SEQ ID NO: 10760 - protein, 25 aa, Mycobacterium avium
DSAACKAWLLAQPYLAAGVLLVLYT

SEQ ID NO: 10761 - protein, 23 aa, Mycobacterium avium
DSARRSGNEFLFQQLAAQAVETL

SEQ ID NO: 10762 - protein, 21 aa, Mycobacterium avium
DSEALCWDVGEVVELRGRTAP

SEQ ID NO: 10763 - protein, 24 aa, Mycobacterium avium
DSFDGYEYLFWVGCAGAYDDKAKK

SEQ ID NO: 10764 - protein, 24 aa, Mycobacterium avium
DSGCGHAALSLRLAALGHTVVGLD

SEQ ID NO: 10765 - protein, 27 aa, Mycobacterium avium
DSPLSVRGARNYPCMGHPGKRAPTVEI

SEQ ID NO: 10766 - protein, 19 aa, Mycobacterium avium
DSRGYLLRDGELTQITKDD

SEQ ID NO: 10767 - protein, 30 aa, Mycobacterium avium
DTELPRQFGYNMPLELVLTVTPFLIISVLF

SEQ ID NO: 10768 - protein, 17 aa, Mycobacterium avium
DTGGWLRITDRLKEMIK

SEQ ID NO: 10769 - protein, 25 aa, Mycobacterium avium
DTMGRSRLRAPFGVRSDNGELLFLD

SEQ ID NO: 10770 - protein, 24 aa, Mycobacterium avium
DVGASPAWRNLRLPLSAIPAAATQ

SEQ ID NO: 10771 - protein, 18 aa, Mycobacterium avium
DVIPARWSLVAVALAIVA

SEQ ID NO: 10772 - protein, 18 aa, Mycobacterium avium
DVNIAWPSAQIAVMGASG

SEQ ID NO: 10773 - protein, 26 aa, Mycobacterium avium
DVSAEAWLVADLDSGAVIAAKDPHGR

SEQ ID NO: 10774 - protein, 19 aa, Mycobacterium avium
DVVDARFAIRDNYSEEMIR

SEQ ID NO: 10775 - protein, 22 aa, Mycobacterium avium
DVVGILVSWGLVELFPGTLARQ

SEQ ID NO: 10776 - protein, 26 aa, Mycobacterium avium
DVVGVSFPVGHRWARIDLPDDEYIPV

SEQ ID NO: 10777 - protein, 24 aa, Mycobacterium avium
DWAQSVGPWFPLAFLLAHIVVTVV

SEQ ID NO: 10778 - protein, 25 aa, Mycobacterium avium
DWDRHLRPMLARRYAIATGQRQAKD

SEQ ID NO: 10779 - protein, 26 aa, Mycobacterium avium
DWLELSWRWLFGLSIVPALISLIIRY

SEQ ID NO: 10780 - protein, 25 aa, Mycobacterium avium
DWRDNLRWPPASALVTPEEAVNALR

SEQ ID NO: 10781 - protein, 26 aa, Mycobacterium avium
DYDCGCKRPTFSNSFYRVLTQPNVHL

SEQ ID NO: 10782 - protein, 21 aa, Mycobacterium avium
DYGAPAGWRAPGWPPQQSQQP

SEQ ID NO: 10783 - protein, 26 aa, Mycobacterium avium
DYLGCPRFPGAPDFLAISVAQVLLVV

SEQ ID NO: 10784 - protein, 18 aa, Mycobacterium avium
DYRGSVLDAVTSVFHDHG

SEQ ID NO: 10785 - protein, 25 aa, Mycobacterium avium
DYWFRSIRQTVQFERAVRGAAEAGY

SEQ ID NO: 10786 - protein, 31 aa, Mycobacterium avium
EAAALAGIFVCLFCAFYFMTVTYSLMTFWIT

SEQ ID NO: 10787 - protein, 26 aa, Mycobacterium avium
EADRAMFKQATWKRVAVLFAGPGANF

SEQ ID NO: 10788 - protein, 20 aa, Mycobacterium avium
EAIKGTPWEGAKVYLGGTAA

SEQ ID NO: 10789 - protein, 18 aa, Mycobacterium avium
EAIRDGWYRTGDAGWLDT

SEQ ID NO: 10790 - protein, 21 aa, Mycobacterium avium
EAISSMYAYSAFVPNFLAPQL

SEQ ID NO: 10791 - protein, 44 aa, Mycobacterium avium
EALAAAVRGPWAWREILEQIWFVARVSIFPTIMLSIPYTVLIVF

SEQ ID NO: 10792 - protein, 21 aa, Mycobacterium avium
EAMLIPMYFLIGGFGAGSGRS

SEQ ID NO: 10793 - protein, 19 aa, Mycobacterium avium
EAPAGRFAKVAAATAGAVV

SEQ ID NO: 10794 - protein, 23 aa, Mycobacterium avium
EASRRIELHVGRDLQFIRINGTV

SEQ ID NO: 10795 - protein, 18 aa, Mycobacterium avium
EAVDRIWLRGTVILTGTM

SEQ ID NO: 10796 - protein, 25 aa, Mycobacterium avium
EAVMNKLRWVLLIVGGVGVAVAAVA

SEQ ID NO: 10797 - protein, 25 aa, Mycobacterium avium
EDFLCPACGNFERTFGPTVSKLIDL

SEQ ID NO: 10798 - protein, 19 aa, Mycobacterium avium
EDFSWKAMLDFATCTECGR

SEQ ID NO: 10799 - protein, 20 aa, Mycobacterium avium
EDPTRWVADAVILSASVASL

SEQ ID NO: 10800 - protein, 21 aa, Mycobacterium avium
EDRFALRGRWTLDDQGATAAG

SEQ ID NO: 10801 - protein, 23 aa, Mycobacterium avium
EDRTVGSVGRWIVAVAALAVLTI

SEQ ID NO: 10802 - protein, 26 aa, Mycobacterium avium
EEDKGLRTRSEMIAQLVFAMGGRAAE

SEQ ID NO: 10803 - protein, 20 aa, Mycobacterium avium
EELRSARSPQELLSLVRSSA

SEQ ID NO: 10804 - protein, 18 aa, Mycobacterium avium
EFALRPVAAQALEAGPPP

SEQ ID NO: 10805 - protein, 19 aa, Mycobacterium avium
EFGVTVLRLAVIRRGVIPA

SEQ ID NO: 10806 - protein, 17 aa, Mycobacterium avium
EFIAGFFFLTALLYGVL

SEQ ID NO: 10807 - protein, 23 aa, Mycobacterium avium
EFKLSGPDMRGVRQAVTRARRAG

SEQ ID NO: 10808 - protein, 23 aa, Mycobacterium avium
EGAACTFLALPRLTRVLASVPRG

SEQ ID NO: 10809 - protein, 17 aa, Mycobacterium avium
EGAKYDLLIAGIAALSL

SEQ ID NO: 10810 - protein, 23 aa, Mycobacterium avium
EGLFLGALSFVFANFSVSSANAG

SEQ ID NO: 10811 - protein, 18 aa, Mycobacterium avium
EGPTVVLVHGFPDSHVLW

SEQ ID NO: 10812 - protein, 24 aa, Mycobacterium avium
EGQLWNVWLPLVIAGFAVACALSA

SEQ ID NO: 10813 - protein, 26 aa, Mycobacterium avium
EGSLGLRERVTFYAPILLTAENVINA

SEQ ID NO: 10814 - protein, 24 aa, Mycobacterium avium
EGSVQWWQARLEWVAVLSAVTAVE

SEQ ID NO: 10815 - protein, 26 aa, Mycobacterium avium
EHTTHWGLQIDHFWWTAIWAAIVLSI

SEQ ID NO: 10816 - protein, 25 aa, Mycobacterium avium
EHVGFSVWMLWSIVVVHMTAGPHGH

SEQ ID NO: 10817 - protein, 31 aa, Mycobacterium avium
EHYHRLKGPILQWWITWVCSYAVSVSAIATS

SEQ ID NO: 10818 - protein, 19 aa, Mycobacterium avium
EIGAAWSTVLAIVGPTWFA

SEQ ID NO: 10819 - protein, 24 aa, Mycobacterium avium
EIPEWSRRARPIVLIPDAAAALLA

SEQ ID NO: 10820 - protein, 31 aa, Mycobacterium avium
EIPGCLVALYFVARLRHRGMDSAGYMPDEAG

SEQ ID NO: 10821 - protein, 24 aa, Mycobacterium avium
EIRANARIIVFLSVALVIATAVAV

SEQ ID NO: 10822 - protein, 19 aa, Mycobacterium avium
EIVVLSWAGTRGVVSLAAI

SEQ ID NO: 10823 - protein, 21 aa, Mycobacterium avium
EKAAHPWAFLMRSLVGGAMVA

SEQ ID NO: 10824 - protein, 22 aa, Mycobacterium avium
EKLFNRWGARAVFLGRFIALLR

SEQ ID NO: 10825 - protein, 24 aa, Mycobacterium avium
EKYGSWAVILARFAPFVRTFVPVI

SEQ ID NO: 10826 - protein, 19 aa, Mycobacterium avium
ELAIKTGRPLIGINDGAGA

SEQ ID NO: 10827 - protein, 17 aa, Mycobacterium avium
ELDRRRPDLVASVGSLA

SEQ ID NO: 10828 - protein, 30 aa, Mycobacterium avium
ELGYKGLLAPLTFVCVFGYMAQSSFFKHAN

SEQ ID NO: 10829 - protein, 18 aa, Mycobacterium avium
ELNRAGATIVKLPSEELA

SEQ ID NO: 10830 - protein, 19 aa, Mycobacterium avium
ELQPIIQRLMRIHVTEEAR

SEQ ID NO: 10831 - protein, 18 aa, Mycobacterium avium
ELRNRLKNATGLTLSPTL

SEQ ID NO: 10832 - protein, 20 aa, Mycobacterium avium
ELSDRTWAALGERLDDRQRM

SEQ ID NO: 10833 - protein, 25 aa, Mycobacterium avium
EPDTRLRKDLTWWDLVVFGVAVVIG

SEQ ID NO: 10834 - protein, 24 aa, Mycobacterium avium
EPGRSLWWSWAWVAGMVGYAGDVA

SEQ ID NO: 10835 - protein, 17 aa, Mycobacterium avium
EPIRCLLFPNPLETQRM

SEQ ID NO: 10836 - protein, 23 aa, Mycobacterium avium
EPPRMSDMRALFDAIINDDPLPE

SEQ ID NO: 10837 - protein, 19 aa, Mycobacterium avium
EPVDLSRLAVDAVNDAHVA

SEQ ID NO: 10838 - protein, 34 aa, Mycobacterium avium
EQLFRFSRILDVQPRLAILLGDYAVPVEGRVGLL

SEQ ID NO: 10839 - protein, 23 aa, Mycobacterium avium
ERDRLRDLFGRHVGADVAQRAIE

SEQ ID NO: 10840 - protein, 25 aa, Mycobacterium avium
ERLARYEIPTEIAIVDALPRTPSGK

SEQ ID NO: 10841 - protein, 25 aa, Mycobacterium avium
ERLDRRLDETAGFAIPFLPRGLNEI

SEQ ID NO: 10842 - protein, 24 aa, Mycobacterium avium
ERLGKLHFWLTFIGFHTTFLVQHW

SEQ ID NO: 10843 - protein, 20 aa, Mycobacterium avium
ERRQTVAFTNGYDFGYYALV

SEQ ID NO: 10844 - protein, 18 aa, Mycobacterium avium
ERVLRPVAVAALRSGVPE

SEQ ID NO: 10845 - protein, 22 aa, Mycobacterium avium
ESKGRVALYLLITIAPFAVIAP

SEQ ID NO: 10846 - protein, 23 aa, Mycobacterium avium
ESYTSTYLRFVWTLSATALVVCY

SEQ ID NO: 10847 - protein, 34 aa, Mycobacterium avium
ETALLRYLLYGLLPAWFIPALLDWNQHRRSRIEI

SEQ ID NO: 10848 - protein, 17 aa, Mycobacterium avium
ETARFGAPTLLTRSTND

SEQ ID NO: 10849 - protein, 27 aa, Mycobacterium avium
ETIKGDASVGWVRLGALVLALAALTAL

SEQ ID NO: 10850 - protein, 25 aa, Mycobacterium avium
ETLALYPGDRVQIMGVRVGSIDKIE

SEQ ID NO: 10851 - protein, 20 aa, Mycobacterium avium
ETLSRNGIRDLAAVVSTGGG

SEQ ID NO: 10852 - protein, 24 aa, Mycobacterium avium
ETLVLCVIALFAVNVVLTTIGVRF

SEQ ID NO: 10853 - protein, 22 aa, Mycobacterium avium
ETRLSWVLAVLAGVLGATAFTH

SEQ ID NO: 10854 - protein, 18 aa, Mycobacterium avium
ETTWIPVVTFLQVSADMA

SEQ ID NO: 10855 - protein, 19 aa, Mycobacterium avium
EVAAATGFRAPEGPYETIG

SEQ ID NO: 10856 - protein, 38 aa, Mycobacterium avium
EVFGQRRLLKWSIPGLAHFFTMWGFFILLTVYIEAYGL

SEQ ID NO: 10857 - protein, 19 aa, Mycobacterium avium
EVQRRWDAPGGKVVPKPAP

SEQ ID NO: 10858 - protein, 17 aa, Mycobacterium avium
EVVRDGRHVTLTVKPDP

SEQ ID NO: 10859 - protein, 17 aa, Mycobacterium avium
EVYRASFGAQFFSGLVA

SEQ ID NO: 10860 - protein, 17 aa, Mycobacterium avium
EWNEAWRSDQFVLDATR

SEQ ID NO: 10861 - protein, 31 aa, Mycobacterium avium
EWYNTALGLAMAFGRFLPIVLVLALAGSLAR

SEQ ID NO: 10862 - protein, 19 aa, Mycobacterium avium
FAAFPGWYATVFSTLYLPL

SEQ ID NO: 10863 - protein, 20 aa, Mycobacterium avium
FAAGAWIALFAMSLLFGIMK

SEQ ID NO: 10864 - protein, 17 aa, Mycobacterium avium
FAAGRLYTTLSVADAAA

SEQ ID NO: 10865 - protein, 23 aa, Mycobacterium avium
FAARDDNSWIGFGIFSAAMVLTA

SEQ ID NO: 10866 - protein, 18 aa, Mycobacterium avium
FAATRYTREVVRLVAEIS

SEQ ID NO: 10867 - protein, 25 aa, Mycobacterium avium
FAAYLLNFGPTFTIGADLGPGIGGR

SEQ ID NO: 10868 - protein, 22 aa, Mycobacterium avium
FADRAFAAALPWLAGALGTPGI

SEQ ID NO: 10869 - protein, 20 aa, Mycobacterium avium
FAIGLVFAPRYTRLVAGVFS

SEQ ID NO: 10870 - protein, 24 aa, Mycobacterium avium
FALVAFAWRRPRFDPLKPGRALPA

SEQ ID NO: 10871 - protein, 21 aa, Mycobacterium avium
FAMQAGCRFTAQLGAMRIAEE

SEQ ID NO: 10872 - protein, 18 aa, Mycobacterium avium
FANMEVLERVAPPHPSRW

SEQ ID NO: 10873 - protein, 19 aa, Mycobacterium avium
FARDLRSALLRKLSRLPLG

SEQ ID NO: 10874 - protein, 19 aa, Mycobacterium avium
FARLDFRGRNTLFVVYLGT

SEQ ID NO: 10875 - protein, 26 aa, Mycobacterium avium
FARLRFPGRDALFWVYIATLMVPGTV

SEQ ID NO: 10876 - protein, 18 aa, Mycobacterium avium
FAVGVLIVSTAALIFGCL

SEQ ID NO: 10877 - protein, 17 aa, Mycobacterium avium
FAVKSGAFFAAIVGVLG

SEQ ID NO: 10878 - protein, 23 aa, Mycobacterium avium
FAVLCGAASYIAVPAVQRLAIPE

SEQ ID NO: 10879 - protein, 18 aa, Mycobacterium avium
FAVLVPRSRFFTPKPASV

SEQ ID NO: 10880 - protein, 25 aa, Mycobacterium avium
FAYTKVCSHLGCPASLYEEQSYRIL

SEQ ID NO: 10881 - protein, 22 aa, Mycobacterium avium
FCAMLALPIVPLFAYSRTAAML

SEQ ID NO: 10882 - protein, 20 aa, Mycobacterium avium
FCLLAPVAVVPVMVPDGQDY

SEQ ID NO: 10883 - protein, 23 aa, Mycobacterium avium
FCPHLAAPMADGWLDRGRLVCPW

SEQ ID NO: 10884 - protein, 31 aa, Mycobacterium avium
FDGPPTLTRILFDWRFDLIFGTAAIVLAGLY

SEQ ID NO: 10885 - protein, 17 aa, Mycobacterium avium
FDRRRGRHGRGILLTAL

SEQ ID NO: 10886 - protein, 18 aa, Mycobacterium avium
FDVGKLLNGFEPLFTLLN

SEQ ID NO: 10887 - protein, 17 aa, Mycobacterium avium
FDVLDRLTTLPAQLLDD

SEQ ID NO: 10888 - protein, 22 aa, Mycobacterium avium
FEVRGGLFVRQVHHWAALIFSA

SEQ ID NO: 10889 - protein, 25 aa, Mycobacterium avium
FEVVGRRRLWFGISGAIVAVAILSI

SEQ ID NO: 10890 - protein, 18 aa, Mycobacterium avium
FFALSGFLLWRGHAAAAR

SEQ ID NO: 10891 - protein, 23 aa, Mycobacterium avium
FFFVLPRWPELMGDTTHSLGTAL

SEQ ID NO: 10892 - protein, 17 aa, Mycobacterium avium
FFKVFEWARLVRTGNGL

SEQ ID NO: 10893 - protein, 19 aa, Mycobacterium avium
FFNLFMMMFIIRTGIQILC

SEQ ID NO: 10894 - protein, 37 aa, Mycobacterium avium
FFRPIRSYFYWEKHCFDIPVCWSMRSLFDALDGIDEL

SEQ ID NO: 10895 - protein, 32 aa, Mycobacterium avium
FFVAELLDTWLWRWVAFLIVFGVQVVVGAVLA

SEQ ID NO: 10896 - protein, 38 aa, Mycobacterium avium
FGAGLFVAFDQLWRWNSIVALVLSVLVILGLVVGVRVV

SEQ ID NO: 10897 - protein, 32 aa, Mycobacterium avium
FGALGVAGLVEWPVLLAVGGGALLLQRLNRKE

SEQ ID NO: 10898 - protein, 21 aa, Mycobacterium avium
FGAPPARWPRALHLVPPIHEA

SEQ ID NO: 10899 - protein, 18 aa, Mycobacterium avium
FGELVPKYLAVARPMSTA

SEQ ID NO: 10900 - protein, 24 aa, Mycobacterium avium
FGFASLRIASYALWPFGRTIVDKP

SEQ ID NO: 10901 - protein, 25 aa, Mycobacterium avium
FGGKVSYLALLVLLLIALVIGLIGG

SEQ ID NO: 10902 - protein, 17 aa, Mycobacterium avium
FGGLMLLGGRLGDTIGR

SEQ ID NO: 10903 - protein, 27 aa, Mycobacterium avium
FGLPGFRHSIGLARWWHLGVDVLWLLN

SEQ ID NO: 10904 - protein, 18 aa, Mycobacterium avium
FGLSVLIWQHLIGIELHW

SEQ ID NO: 10905 - protein, 21 aa, Mycobacterium avium
FGMLRYCLQLFPDAATYFRPL

SEQ ID NO: 10906 - protein, 20 aa, Mycobacterium avium
FGNDHFAEFAPGMKSIDDAL

SEQ ID NO: 10907 - protein, 18 aa, Mycobacterium avium
FGPAQVMLAAAGVTAWSL

SEQ ID NO: 10908 - protein, 20 aa, Mycobacterium avium
FGPDYANFVAVTGNDPGAKT

SEQ ID NO: 10909 - protein, 18 aa, Mycobacterium avium
FGPLAGRYFPPMGSILYW

SEQ ID NO: 10910 - protein, 18 aa, Mycobacterium avium
FGPLRRRATAALAVAGER

SEQ ID NO: 10911 - protein, 18 aa, Mycobacterium avium
FGPYFPAVWILRRLQAKY

SEQ ID NO: 10912 - protein, 18 aa, Mycobacterium avium
FGQGYAILLLAIWIGIGF

SEQ ID NO: 10913 - protein, 20 aa, Mycobacterium avium
FGRIDGRPVGIVANQPTQFA

SEQ ID NO: 10914 - protein, 20 aa, Mycobacterium avium
FGRISWAAAGLIAAGSLVGG

SEQ ID NO: 10915 - protein, 18 aa, Mycobacterium avium
FGVVLGALVAFIVFGRRA

SEQ ID NO: 10916 - protein, 18 aa, Mycobacterium avium
FHALIAVFCQLTGAAPTT

SEQ ID NO: 10917 - protein, 18 aa, Mycobacterium avium
FHDLSVPWGIAVDNGGTV

SEQ ID NO: 10918 - protein, 18 aa, Mycobacterium avium
FHIVERWQFHYSQVVKST

SEQ ID NO: 10919 - protein, 18 aa, Mycobacterium avium
FHVRRIDLDGSPLDALQL

SEQ ID NO: 10920 - protein, 22 aa, Mycobacterium avium
FIGLWIFGWGRLPKLIHLACIW

SEQ ID NO: 10921 - protein, 20 aa, Mycobacterium avium
FILLAVVALAGWATLGGSTA

SEQ ID NO: 10922 - protein, 17 aa, Mycobacterium avium
FKHLSGYADRAGAMVPR

SEQ ID NO: 10923 - protein, 17 aa, Mycobacterium avium
FKRGLKMFVSPDGTAVR

SEQ ID NO: 10924 - protein, 25 aa, Mycobacterium avium
FLDRNRLAAFAAMFLAGGVFFTLTV

SEQ ID NO: 10925 - protein, 18 aa, Mycobacterium avium
FLEFGYASALAWVMFAVL

SEQ ID NO: 10926 - protein, 17 aa, Mycobacterium avium
FLFFKVFEWARLVRTGN

SEQ ID NO: 10927 - protein, 17 aa, Mycobacterium avium
FLLLLPITGVILLILVL

SEQ ID NO: 10928 - protein, 27 aa, Mycobacterium avium
FLLRLGVGVGCGALIGLERQWRARRAG

SEQ ID NO: 10929 - protein, 25 aa, Mycobacterium avium
FLPDYRVVGALPLAYAVIVTGSLLK

SEQ ID NO: 10930 - protein, 18 aa, Mycobacterium avium
FLTCLLALAELHLRTIRL

SEQ ID NO: 10931 - protein, 25 aa, Mycobacterium avium
FLVALSFASVNGWWYVSNFGVPWSN

SEQ ID NO: 10932 - protein, 17 aa, Mycobacterium avium
FLVLLGTFNRYWLAAAF

SEQ ID NO: 10933 - protein, 25 aa, Mycobacterium avium
FMFGSPYAIFLLREHFRMIPNDLVN

SEQ ID NO: 10934 - protein, 17 aa, Mycobacterium avium
FMLMLDMLRETAHESAD

SEQ ID NO: 10935 - protein, 34 aa, Mycobacterium avium
FNNGLRPEPLIALGVLVTWMLVERAIALQRLAPA

SEQ ID NO: 10936 - protein, 23 aa, Mycobacterium avium
FNRGMPYFPNLVVPLIVCAIGIG

SEQ ID NO: 10937 - protein, 17 aa, Mycobacterium avium
FNTWGVFAISYATGALG

SEQ ID NO: 10938 - protein, 17 aa, Mycobacterium avium
FNVAAWIFVFFRMPDLT

SEQ ID NO: 10939 - protein, 34 aa, Mycobacterium avium
FNYTRWRRLATAIVRWPAPILATSVILAIVGAIG

SEQ ID NO: 10940 - protein, 19 aa, Mycobacterium avium
FPALASFVAEDRFLPRQLT

SEQ ID NO: 10941 - protein, 19 aa, Mycobacterium avium
FPMYFLKSSAYTIVATAII

SEQ ID NO: 10942 - protein, 17 aa, Mycobacterium avium
FPPMGSILYWLRPGTIR

SEQ ID NO: 10943 - protein, 20 aa, Mycobacterium avium
FPSDGVIALCDFGAGGTTVT

SEQ ID NO: 10944 - protein, 19 aa, Mycobacterium avium
FPVVVAALFALVIAMPLGI

SEQ ID NO: 10945 - protein, 17 aa, Mycobacterium avium
FQMLTTLLEDWRDNLRW

SEQ ID NO: 10946 - protein, 17 aa, Mycobacterium avium
FQTFVPLTLVSDRAGLV

SEQ ID NO: 10947 - protein, 17 aa, Mycobacterium avium
FRDGSTYDLFIAGVGAL

SEQ ID NO: 10948 - protein, 24 aa, Mycobacterium avium
FRDRNRLVTFIAIFLAGGVMFTLT

SEQ ID NO: 10949 - protein, 19 aa, Mycobacterium avium
FRLFVRPRLVDAARAQAQR

SEQ ID NO: 10950 - protein, 22 aa, Mycobacterium avium
FRMSLRDTRWWLGGLAAITNYS

SEQ ID NO: 10951 - protein, 21 aa, Mycobacterium avium
FRREARIAAGLNDPHVVPIHG

SEQ ID NO: 10952 - protein, 24 aa, Mycobacterium avium
FRRRLDEYVGFLVAWQRPLAGKKT

SEQ ID NO: 10953 - protein, 18 aa, Mycobacterium avium
FSGGCGLADDVLVEPDSN

SEQ ID NO: 10954 - protein, 17 aa, Mycobacterium avium
FSLPLARKAFLLDPSNV

SEQ ID NO: 10955 - protein, 25 aa, Mycobacterium avium
FSNISGLRAGQFVRASGVEVGKVSS

SEQ ID NO: 10956 - protein, 17 aa, Mycobacterium avium
FSNVTYRGVQLGKVTAV

SEQ ID NO: 10957 - protein, 17 aa, Mycobacterium avium
FSRFWRADPSRVRRSGG

SEQ ID NO: 10958 - protein, 24 aa, Mycobacterium avium
FSSYYGRPVVKPAPWGHEVGAYLF

SEQ ID NO: 10959 - protein, 19 aa, Mycobacterium avium
FTALCVFLPGIIGVTIGRW

SEQ ID NO: 10960 - protein, 24 aa, Mycobacterium avium
FTISSVLCAVAWDEATMVIARLSQ

SEQ ID NO: 10961 - protein, 18 aa, Mycobacterium avium
FTLADPHGGLLPSWTPGA

SEQ ID NO: 10962 - protein, 25 aa, Mycobacterium avium
FTPTKWTHHFGVFAGLAGPLGALAA

SEQ ID NO: 10963 - protein, 17 aa, Mycobacterium avium
FTPVLGVLAQKSNNFVP

SEQ ID NO: 10964 - protein, 18 aa, Mycobacterium avium
FTQHAFDIFGSVRAAHTA

SEQ ID NO: 10965 - protein, 19 aa, Mycobacterium avium
FTVHYARLYYSGQPGGINF

SEQ ID NO: 10966 - protein, 19 aa, Mycobacterium avium
FTVIIGMLLLVYRSVITVL

SEQ ID NO: 10967 - protein, 18 aa, Mycobacterium avium
FVARRAVFHAMMRSLSSL

SEQ ID NO: 10968 - protein, 18 aa, Mycobacterium avium
FVFVCYHVAGIWRRGVVG

SEQ ID NO: 10969 - protein, 19 aa, Mycobacterium avium
FVNFYACDITLKINGLQAG

SEQ ID NO: 10970 - protein, 17 aa, Mycobacterium avium
FVSEFLVLLGTFNRYWL

SEQ ID NO: 10971 - protein, 22 aa, Mycobacterium avium
FVTAGSLVVHWATMQELYGITD

SEQ ID NO: 10972 - protein, 23 aa, Mycobacterium avium
FVWNVFKSWRYGEVVTVDDPWGY

SEQ ID NO: 10973 - protein, 24 aa, Mycobacterium avium
FWAALAVALPLAFPSLAEMAQKHP

SEQ ID NO: 10974 - protein, 24 aa, Mycobacterium avium
FWQHLIGLHLHWLVLPLTFIILVA

SEQ ID NO: 10975 - protein, 22 aa, Mycobacterium avium
FYGARARRLLPAAAIVGTVTAI

SEQ ID NO: 10976 - protein, 30 aa, Mycobacterium avium
FYLPPEIFQNPDFQLGLSLMVSPDGKAARF

SEQ ID NO: 10977 - protein, 19 aa, Mycobacterium avium
FYLVWPLLIIAVAASVRRV

SEQ ID NO: 10978 - protein, 20 aa, Mycobacterium avium
FYNRRLRAATTRFSVRMKHD

SEQ ID NO: 10979 - protein, 26 aa, Mycobacterium avium
GAAARRFALSPIPVYLLAGLALGKGG

SEQ ID NO: 10980 - protein, 18 aa, Mycobacterium avium
GAAGAEFVGIPGAAGTLP

SEQ ID NO: 10981 - protein, 18 aa, Mycobacterium avium
GAASLLFGRGEQLPPLPR

SEQ ID NO: 10982 - protein, 24 aa, Mycobacterium avium
GAFVVRGAMRAAWDKLRAPAGKLG

SEQ ID NO: 10983 - protein, 17 aa, Mycobacterium avium
GAGEIRQFFAITVPLIR

SEQ ID NO: 10984 - protein, 22 aa, Mycobacterium avium
GAGKSTFARLVAGYTHPTTGTV

SEQ ID NO: 10985 - protein, 19 aa, Mycobacterium avium
GAIALHILFGLPLLAGGLI

SEQ ID NO: 10986 - protein, 26 aa, Mycobacterium avium
GAIGYGLGVFAVWLYRYLWAKPSSPP

SEQ ID NO: 10987 - protein, 37 aa, Mycobacterium avium
GALACLKFTRLPYFSSLAFPCAVGLLVVVAAGVTLTP

SEQ ID NO: 10988 - protein, 18 aa, Mycobacterium avium
GALLKLTVFAVGVMPYIT

SEQ ID NO: 10989 - protein, 19 aa, Mycobacterium avium
GALTCSWLSDLRGRRGTLL

SEQ ID NO: 10990 - protein, 24 aa, Mycobacterium avium
GALTDVSWRLAFLVNVPIGLAVIY

SEQ ID NO: 10991 - protein, 29 aa, Mycobacterium avium
GALYVRVGDRLYPALNLASARLITGRPDN

SEQ ID NO: 10992 - protein, 19 aa, Mycobacterium avium
GAMMAGRLLVPVTGAIGVY

SEQ ID NO: 10993 - protein, 33 aa, Mycobacterium avium
GAMVVEARPGSTLYGLHAMFFDQPRVNEKDQVM

SEQ ID NO: 10994 - protein, 25 aa, Mycobacterium avium
GAMYCLSFCRLPYFQSLGVPCAVGM

SEQ ID NO: 10995 - protein, 19 aa, Mycobacterium avium
GAPLRTWAVVALVLGPLLA

SEQ ID NO: 10996 - protein, 20 aa, Mycobacterium avium
GAPTRGAVLFGHSTAGAVAE

SEQ ID NO: 10997 - protein, 20 aa, Mycobacterium avium
GAQGLRVLLLGAADRAVDHP

SEQ ID NO: 10998 - protein, 26 aa, Mycobacterium avium
GARHAVELFAAFGLTALIGLERTIQG

SEQ ID NO: 10999 - protein, 25 aa, Mycobacterium avium
GATIPYYLCMLELRGTDLQGKTVRA

SEQ ID NO: 11000 - protein, 24 aa, Mycobacterium avium
GAVFALLPRMTWAGMEARPYAFVA

SEQ ID NO: 11001 - protein, 19 aa, Mycobacterium avium
GAVFVHWLIFQSLYRIGAL

SEQ ID NO: 11002 - protein, 25 aa, Mycobacterium avium
GAVLCLSFTRLPYFQPLGIPVAVGI

SEQ ID NO: 11003 - protein, 18 aa, Mycobacterium avium
GAVLPRPDSGGVVLTGRL

SEQ ID NO: 11004 - protein, 25 aa, Mycobacterium avium
GAVNGLRALPTLGVLLFGTLLFGLG

SEQ ID NO: 11005 - protein, 18 aa, Mycobacterium avium
GAVPRGAPAGPRGENPPP

SEQ ID NO: 11006 - protein, 20 aa, Mycobacterium avium
GAVSWLIALVYKGLYTGGLI

SEQ ID NO: 11007 - protein, 19 aa, Mycobacterium avium
GDALGSCGIVAAPNTPPLP

SEQ ID NO: 11008 - protein, 25 aa, Mycobacterium avium
GDEARLRLLVNDMFETMSRRSRSLV

SEQ ID NO: 11009 - protein, 22 aa, Mycobacterium avium
GDEPRIRQVLGNLIANALQHTP

SEQ ID NO: 11010 - protein, 17 aa, Mycobacterium avium
GDLAMTWLLAGLVAGVL

SEQ ID NO: 11011 - protein, 22 aa, Mycobacterium avium
GDLRARELVVVAPLIALLLVLG

SEQ ID NO: 11012 - protein, 21 aa, Mycobacterium avium
GDRLAFSNGILFLSGAALLAI

SEQ ID NO: 11013 - protein, 20 aa, Mycobacterium avium
GDVFGLRRWYVITFLMGLFF

SEQ ID NO: 11014 - protein, 29 aa, Mycobacterium avium
GEHSPAFMHWGWRVPFLISSGLIGIALYV

SEQ ID NO: 11015 - protein, 20 aa, Mycobacterium avium
GEIRQFFAITVPLIRGSISF

SEQ ID NO: 11016 - protein, 23 aa, Mycobacterium avium
GELQRLALAAALARDPKLLIADE

SEQ ID NO: 11017 - protein, 27 aa, Mycobacterium avium
GERQRLRIGVVATMCAGAFLGATMSRY

SEQ ID NO: 11018 - protein, 22 aa, Mycobacterium avium
GESKMNMPWLFFFSGLAIPAFY

SEQ ID NO: 11019 - protein, 18 aa, Mycobacterium avium
GEVLRRRVAPVADEPAVP

SEQ ID NO: 11020 - protein, 18 aa, Mycobacterium avium
GEYTRLGVCTVPVSLLVA

SEQ ID NO: 11021 - protein, 19 aa, Mycobacterium avium
GFAELYRQGAARDVAMLLS

SEQ ID NO: 11022 - protein, 19 aa, Mycobacterium avium
GFCAGFLLLRGRSYVDRWQ

SEQ ID NO: 11023 - protein, 18 aa, Mycobacterium avium
GFDGGWDSGAGWDSGGSD

SEQ ID NO: 11024 - protein, 23 aa, Mycobacterium avium
GFFGSAFGTYLMRQFFRTLPTDL

SEQ ID NO: 11025 - protein, 26 aa, Mycobacterium avium
GFFPVSFYPILRVTRLVGIAIIAISL

SEQ ID NO: 11026 - protein, 23 aa, Mycobacterium avium
GFFSPHSWWPILIALSGSVAAVG

SEQ ID NO: 11027 - protein, 24 aa, Mycobacterium avium
GFKTKVSTLLSWTVTFLSTRRGQL

SEQ ID NO: 11028 - protein, 25 aa, Mycobacterium avium
GFLAIPVLFALTVLWVTRRGRTPRQ

SEQ ID NO: 11029 - protein, 21 aa, Mycobacterium avium
GFSRGSLNVIARKAGVAKGSL

SEQ ID NO: 11030 - protein, 26 aa, Mycobacterium avium
GGALTEVSWRLAFLVNVPIGLVMMYL

SEQ ID NO: 11031 - protein, 46 aa, Mycobacterium avium
GGFFRMCVLTGKALFRWPFQWREFVLQCWFIMRVAFLPTIMVSIPL

SEQ ID NO: 11032 - protein, 32 aa, Mycobacterium avium
GGFFRTCVLTGKALFRRPFQWRETIEQGWFIT

SEQ ID NO: 11033 - protein, 22 aa, Mycobacterium avium
GGFWRETWRRLRRRPKFIGAGL

SEQ ID NO: 11034 - protein, 25 aa, Mycobacterium avium
GGGCLPKDIRAFMARAGELGADQAL

SEQ ID NO: 11035 - protein, 20 aa, Mycobacterium avium
GGGRLRRPLLGLPMAHPGAV

SEQ ID NO: 11036 - protein, 22 aa, Mycobacterium avium
GGIRLSGRTGALSRSARIQLVT

SEQ ID NO: 11037 - protein, 19 aa, Mycobacterium avium
GGISFGGVIAFIYADLLIL

SEQ ID NO: 11038 - protein, 21 aa, Mycobacterium avium
GGLAPTLWGWRRTPVLRWFVL

SEQ ID NO: 11039 - protein, 26 aa, Mycobacterium avium
GGLFAQLGIWRWAFVVMAVLTALMAL

SEQ ID NO: 11040 - protein, 17 aa, Mycobacterium avium
GGLSRILGHDVGFGPLL

SEQ ID NO: 11041 - protein, 22 aa, Mycobacterium avium
GGMVTRAGLRPVARLTEAAERV

SEQ ID NO: 11042 - protein, 24 aa, Mycobacterium avium
GGQLTVWLTWPFHAAGALAGFGVT

SEQ ID NO: 11043 - protein, 24 aa, Mycobacterium avium
GGRFPELDVPAVLARHPQVVLVDE

SEQ ID NO: 11044 - protein, 18 aa, Mycobacterium avium
GGVGLSLGQRQRLGLARA

SEQ ID NO: 11045 - protein, 19 aa, Mycobacterium avium
GHCAEFCGTYHSMMNFEVR

SEQ ID NO: 11046 - protein, 30 aa, Mycobacterium avium
GHGLKRYFDGTSWTGEWAFFTEQRKNGTSG

SEQ ID NO: 11047 - protein, 19 aa, Mycobacterium avium
GHHPQMLLRVGWAPINADP

SEQ ID NO: 11048 - protein, 17 aa, Mycobacterium avium
GHLLFSIAMTGYILLAV

SEQ ID NO: 11049 - protein, 27 aa, Mycobacterium avium
GHVFFCSLAGYAFARLDFRGRNTLFVV

SEQ ID NO: 11050 - protein, 25 aa, Mycobacterium avium
GHVPGVASGPAWRLIGTTAVGLLLL

SEQ ID NO: 11051 - protein, 31 aa, Mycobacterium avium
GIAEGVRFVWNLRVLRTLGLIDLAVTALYLP

SEQ ID NO: 11052 - protein, 27 aa, Mycobacterium avium
GIFIVFLFHDWRYVFWINVPLTLIAMV

SEQ ID NO: 11053 - protein, 23 aa, Mycobacterium avium
GIGCWLIISHWVLRRLGPGRGGL

SEQ ID NO: 11054 - protein, 22 aa, Mycobacterium avium
GIGMAFGMWAFFAALGSGPISV

SEQ ID NO: 11055 - protein, 36 aa, Mycobacterium avium
GIPLAHWEFYMALAYFKLAIIAAGIDFRRRMSDQAR

SEQ ID NO: 11056 - protein, 18 aa, Mycobacterium avium
GIVSGILLSIARVIGETA

SEQ ID NO: 11057 - protein, 17 aa, Mycobacterium avium
GKAIARRNLIFSIFAEH

SEQ ID NO: 11058 - protein, 19 aa, Mycobacterium avium
GKGGLLLGLLAPHGLLELT

SEQ ID NO: 11059 - protein, 33 aa, Mycobacterium avium
GKMAAVAKRRGWPILRFSSRGPVGLRRQLRTLA

SEQ ID NO: 11060 - protein, 18 aa, Mycobacterium avium
GKSRLANVIGALQDKIKA

SEQ ID NO: 11061 - protein, 19 aa, Mycobacterium avium
GKSTLAWIMAGLTTPTSGS

SEQ ID NO: 11062 - protein, 27 aa, Mycobacterium avium
GLAERRRGHRGLAVVGSVAATLMLLSG

SEQ ID NO: 11063 - protein, 26 aa, Mycobacterium avium
GLAGGPWHWDRWAPASPWATPPPLVM

SEQ ID NO: 11064 - protein, 24 aa, Mycobacterium avium
GLFIPPRVTHMLKMSDHLYHMQAV

SEQ ID NO: 11065 - protein, 23 aa, Mycobacterium avium
GLGAFAFGVARQAPYLPTLLAGL

SEQ ID NO: 11066 - protein, 18 aa, Mycobacterium avium
GLGCCFGPLAGRYFPPMG

SEQ ID NO: 11067 - protein, 22 aa, Mycobacterium avium
GLGGVLRRRWQLFDFASVAVLL

SEQ ID NO: 11068 - protein, 17 aa, Mycobacterium avium
GLGKPGGEVRWGVAGRM

SEQ ID NO: 11069 - protein, 23 aa, Mycobacterium avium
GLGLGALAWLAARPDKPAPATVT

SEQ ID NO: 11070 - protein, 24 aa, Mycobacterium avium
GLGLRSGGPLAIIFSLVCIGIAAF

SEQ ID NO: 11071 - protein, 20 aa, Mycobacterium avium
GLGRYRVVAAPSRNGSDIIV

SEQ ID NO: 11072 - protein, 18 aa, Mycobacterium avium
GLHSGCRLISAAASSSAV

SEQ ID NO: 11073 - protein, 23 aa, Mycobacterium avium
GLITTASAWRWTAILAAAITLAS

SEQ ID NO: 11074 - protein, 25 aa, Mycobacterium avium
GLLDPVLRWQARVIRMDGRRIDVLE

SEQ ID NO: 11075 - protein, 21 aa, Mycobacterium avium
GLLGARYGRRLSGGALRAIIV

SEQ ID NO: 11076 - protein, 23 aa, Mycobacterium avium
GLLLCLAVPLLPVRQTTATVLWP

SEQ ID NO: 11077 - protein, 28 aa, Mycobacterium avium
GLLNRRAVLKSSYAQFIYLLSGADHDQM

SEQ ID NO: 11078 - protein, 20 aa, Mycobacterium avium
GLLSIPEFANPVQFICGGSF

SEQ ID NO: 11079 - protein, 19 aa, Mycobacterium avium
GLLVLRAGLGVVLGAHGLQ

SEQ ID NO: 11080 - protein, 21 aa, Mycobacterium avium
GLLVSLLVRRRRVWVRLTPDA

SEQ ID NO: 11081 - protein, 24 aa, Mycobacterium avium
GLMSGSLWGLFAVLTKGVVDQLDR

SEQ ID NO: 11082 - protein, 21 aa, Mycobacterium avium
GLRTLPMVVGMLFTSTGSGTI

SEQ ID NO: 11083 - protein, 18 aa, Mycobacterium avium
GLSTWVMVIFKPDGSHGM

SEQ ID NO: 11084 - protein, 22 aa, Mycobacterium avium
GLSYRFPFHTEKKTYPYFDPIA

SEQ ID NO: 11085 - protein, 23 aa, Mycobacterium avium
GLTDHEFGLWAGLSVDNTAETTA

SEQ ID NO: 11086 - protein, 24 aa, Mycobacterium avium
GLTSLRAGLIAGAIGLLLVLLYSL

SEQ ID NO: 11087 - protein, 24 aa, Mycobacterium avium
GLVGGVVWNLLTWLLGIPSSSSHA

SEQ ID NO: 11088 - protein, 19 aa, Mycobacterium avium
GLVMNPDAKVKMRGVQVGK

SEQ ID NO: 11089 - protein, 25 aa, Mycobacterium avium
GMLPIPRFLAGQSWRRTPSIFHLHY

SEQ ID NO: 11090 - protein, 20 aa, Mycobacterium avium
GNAPFPDRDLLLFCTLVVVL

SEQ ID NO: 11091 - protein, 19 aa, Mycobacterium avium
GNFAWLNWVTILLACSAID

SEQ ID NO: 11092 - protein, 19 aa, Mycobacterium avium
GNKRIARRNLLCTIAGDHV

SEQ ID NO: 11093 - protein, 26 aa, Mycobacterium avium
GNMFPRKISFLPGMRYYAGNWDTTLW

SEQ ID NO: 11094 - protein, 18 aa, Mycobacterium avium
GNNFLVPNGTFFFVLAIF

SEQ ID NO: 11095 - protein, 20 aa, Mycobacterium avium
GNRELEAYAPLNIPNSDLHW

SEQ ID NO: 11096 - protein, 20 aa, Mycobacterium avium
GNVDLVFTGGMLVRRQEAAT

SEQ ID NO: 11097 - protein, 19 aa, Mycobacterium avium
GNVIFLGFWLAPRTSIDLT

SEQ ID NO: 11098 - protein, 17 aa, Mycobacterium avium
GNWVAGAACALWLGIAG

SEQ ID NO: 11099 - protein, 20 aa, Mycobacterium avium
GPAKLTAIVDGGLFLLSTLD

SEQ ID NO: 11100 - protein, 25 aa, Mycobacterium avium
GPAPEGMAAWIIGMVAAIGLALWIG

SEQ ID NO: 11101 - protein, 18 aa, Mycobacterium avium
GPEAGWRSPITIGSGVVA

SEQ ID NO: 11102 - protein, 22 aa, Mycobacterium avium
GPGEVPTAVVFVVSAAAHLTPS

SEQ ID NO: 11103 - protein, 30 aa, Mycobacterium avium
GPHRRLLLRVTRWDVVLAMAVAGTVNAAML

SEQ ID NO: 11104 - protein, 19 aa, Mycobacterium avium
GPQQYSLVLADGVQTLPPL

SEQ ID NO: 11105 - protein, 19 aa, Mycobacterium avium
GPSTSSWLVCDTVSNSTGA

SEQ ID NO: 11106 - protein, 30 aa, Mycobacterium avium
GPVARLWRGLLLFFSRWWQLETLYRSNMKY

SEQ ID NO: 11107 - protein, 27 aa, Mycobacterium avium
GPVRAWRGARLVGWGWLALTVIGVPWL

SEQ ID NO: 11108 - protein, 17 aa, Mycobacterium avium
GPVREREPIPPLKFAQL

SEQ ID NO: 11109 - protein, 27 aa, Mycobacterium avium
GPYETIGGLVLREIGHIPAAGETVKLP

SEQ ID NO: 11110 - protein, 18 aa, Mycobacterium avium
GPYVLPSLSLLVAGDPPK

SEQ ID NO: 11111 - protein, 18 aa, Mycobacterium avium
GQESFNFGEFFAYTKVCS

SEQ ID NO: 11112 - protein, 24 aa, Mycobacterium avium
GQLAGTSFRSALMYPEPNHPRHEH

SEQ ID NO: 11113 - protein, 20 aa, Mycobacterium avium
GQQPNPCVYKPSGPPTAVYS

SEQ ID NO: 11114 - protein, 23 aa, Mycobacterium avium
GQRFPVKYYLTAMLFIVFDIEIV

SEQ ID NO: 11115 - protein, 22 aa, Mycobacterium avium
GQRLPLGPLRPVLRAAEGPAGL

SEQ ID NO: 11116 - protein, 22 aa, Mycobacterium avium
GQRQLFDLSGWIPSDSVLGAVT

SEQ ID NO: 11117 - protein, 23 aa, Mycobacterium avium
GQRRIPVQYAKRMVGRRMYGGTS

SEQ ID NO: 11118 - protein, 21 aa, Mycobacterium avium
GQSLKLQWGVARPDGSTVPLA

SEQ ID NO: 11119 - protein, 24 aa, Mycobacterium avium
GQWDRLRWQLPASLAGAGLGAYLL

SEQ ID NO: 11120 - protein, 21 aa, Mycobacterium avium
GRAAFRRPFQFGEFLDQTWMI

SEQ ID NO: 11121 - protein, 19 aa, Mycobacterium avium
GRALLTLAHRAMADYDEDD

SEQ ID NO: 11122 - protein, 20 aa, Mycobacterium avium
GRAPRWPTFGITVMPSPTEG

SEQ ID NO: 11123 - protein, 26 aa, Mycobacterium avium
GRGPSDRQLFGIGIAVLVVSALLTTV

SEQ ID NO: 11124 - protein, 18 aa, Mycobacterium avium
GRHRAVAVVSGLALATAS

SEQ ID NO: 11125 - protein, 20 aa, Mycobacterium avium
GRHWHFFAVIGWVLVGLSYY

SEQ ID NO: 11126 - protein, 17 aa, Mycobacterium avium
GRIADWWTQPIVYQKLV

SEQ ID NO: 11127 - protein, 17 aa, Mycobacterium avium
GRIAIALCPDHCDHPRE

SEQ ID NO: 11128 - protein, 25 aa, Mycobacterium avium
GRLFGRFDLAVAVFFALSGFLLWRG

SEQ ID NO: 11129 - protein, 25 aa, Mycobacterium avium
GRLTGRYALLVVGLWVLAAAVANVA

SEQ ID NO: 11130 - protein, 18 aa, Mycobacterium avium
GRLVTPWAHAVRGGARRS

SEQ ID NO: 11131 - protein, 32 aa, Mycobacterium avium
GRPLRWLRIPSDEWAVALALALRAFPMLIEEF

SEQ ID NO: 11132 - protein, 17 aa, Mycobacterium avium
GRPPSKFYVRGVSTDGT

SEQ ID NO: 11133 - protein, 20 aa, Mycobacterium avium
GRTATSFALLTGQIVGVGYT

SEQ ID NO: 11134 - protein, 20 aa, Mycobacterium avium
GRVIPGLAIREGTVHQYPLY

SEQ ID NO: 11135 - protein, 20 aa, Mycobacterium avium
GRVRGWGTLAAAFVVSVLLG

SEQ ID NO: 11136 - protein, 21 aa, Mycobacterium avium
GRYTGEIAFYCYGEGKVQAIR

SEQ ID NO: 11137 - protein, 19 aa, Mycobacterium avium
GSAPPYLACTHIHTDDLRA

SEQ ID NO: 11138 - protein, 18 aa, Mycobacterium avium
GSAVVLAGIVARVVGDTS

SEQ ID NO: 11139 - protein, 22 aa, Mycobacterium avium
GSAWSAANARFNDYFREIATRF

SEQ ID NO: 11140 - protein, 18 aa, Mycobacterium avium
GSFLWLWWTTNLLSGLLA

SEQ ID NO: 11141 - protein, 26 aa, Mycobacterium avium
GSGPLTARFWPPFGGFLYWLRPNTIR

SEQ ID NO: 11142 - protein, 18 aa, Mycobacterium avium
GSIARVTRRLSAIADDVD

SEQ ID NO: 11143 - protein, 22 aa, Mycobacterium avium
GSISWRGPIGLACVPAAIMLWL

SEQ ID NO: 11144 - protein, 24 aa, Mycobacterium avium
GSLFGRTAMFFAVLFAIGMNVYTY

SEQ ID NO: 11145 - protein, 23 aa, Mycobacterium avium
GSLVAAGGFGFQAAALGFGSVVL

SEQ ID NO: 11146 - protein, 17 aa, Mycobacterium avium
GSNPVSCQHCMFYVNAY

SEQ ID NO: 11147 - protein, 22 aa, Mycobacterium avium
GSQWPGMGAQLLDRSTVFAEHM

SEQ ID NO: 11148 - protein, 25 aa, Mycobacterium avium
GSSHSRFGAWLSRPMTSFHLIIAIA

SEQ ID NO: 11149 - protein, 18 aa, Mycobacterium avium
GSTAPRVVTPDVLVNIPE

SEQ ID NO: 11150 - protein, 18 aa, Mycobacterium avium
GSTGRRGPARSGYADPRV

SEQ ID NO: 11151 - protein, 25 aa, Mycobacterium avium
GSVIRIPIVLGVAQLLGRIPLPGSA

SEQ ID NO: 11152 - protein, 23 aa, Mycobacterium avium
GSVLCGLAQSMAMLVGARALQGI

SEQ ID NO: 11153 - protein, 19 aa, Mycobacterium avium
GSVSGTWGYRAELRGQWDR

SEQ ID NO: 11154 - protein, 17 aa, Mycobacterium avium
GSVVAMLSLVPWGTTGV

SEQ ID NO: 11155 - protein, 21 aa, Mycobacterium avium
GSWARARLKSGDELRLPAVTF

SEQ ID NO: 11156 - protein, 27 aa, Mycobacterium avium
GSYRVGSLLDVCWPASSVLIAMASWAP

SEQ ID NO: 11157 - protein, 22 aa, Mycobacterium avium
GTAADWLGYFLLFASFVVGATV

SEQ ID NO: 11158 - protein, 27 aa, Mycobacterium avium
GTALLRLCMLPGLVLLIWATPRLARHL

SEQ ID NO: 11159 - protein, 26 aa, Mycobacterium avium
GTCALAALCYAEFASTLPVAGSAYTF

SEQ ID NO: 11160 - protein, 23 aa, Mycobacterium avium
GTPYRFTPKVAWLTVVAGSAMGL

SEQ ID NO: 11161 - protein, 25 aa, Mycobacterium avium
GTTALRVGVATVWLSVIVLLPLAAI

SEQ ID NO: 11162 - protein, 17 aa, Mycobacterium avium
GTYHSMMNFEVRVVSPN

SEQ ID NO: 11163 - protein, 18 aa, Mycobacterium avium
GVAAFLNWMHLQGVGAGL

SEQ ID NO: 11164 - protein, 25 aa, Mycobacterium avium
GVAGFCVYRLHGIFGSHNNTSAAGG

SEQ ID NO: 11165 - protein, 19 aa, Mycobacterium avium
GVAHLKWYDYPVAGVLSLV

SEQ ID NO: 11166 - protein, 27 aa, Mycobacterium avium
GVALTGVVCFAGFFASYMFNVYFQNGA

SEQ ID NO: 11167 - protein, 18 aa, Mycobacterium avium
GVAQKCTLCYDRLLEDEI

SEQ ID NO: 11168 - protein, 25 aa, Mycobacterium avium
GVEKRPRLTMFDDFGGRIPSDKPPI

SEQ ID NO: 11169 - protein, 18 aa, Mycobacterium avium
GVLAIVLSGCSSWADALA

SEQ ID NO: 11170 - protein, 18 aa, Mycobacterium avium
GVLCLFLLEMGMTASRKL

SEQ ID NO: 11171 - protein, 23 aa, Mycobacterium avium
GVLLGAFLIMWAAYRGLAAHWQT

SEQ ID NO: 11172 - protein, 26 aa, Mycobacterium avium
GVLLWQHLFWFFGHPEVYIIALPFFG

SEQ ID NO: 11173 - protein, 25 aa, Mycobacterium avium
GVLTSPEFVPWLLVALTGMIFQQSA

SEQ ID NO: 11174 - protein, 24 aa, Mycobacterium avium
GVLWTRTSPSWAFFSLPTRAWELA

SEQ ID NO: 11175 - protein, 19 aa, Mycobacterium avium
GVNGLRQLILGGIDARLWQ

SEQ ID NO: 11176 - protein, 24 aa, Mycobacterium avium
GVPATDWTLNWAHGLIANAPQPKH

SEQ ID NO: 11177 - protein, 17 aa, Mycobacterium avium
GVPVHALGIVFAALVGV

SEQ ID NO: 11178 - protein, 24 aa, Mycobacterium avium
GVTVVACLFWRLFMQDNRKRPEPF

SEQ ID NO: 11179 - protein, 31 aa, Mycobacterium avium
GWRGLRDAWVRPALVLGCGIAVFTQLSGIEM

SEQ ID NO: 11180 - protein, 25 aa, Mycobacterium avium
GWVLLALIFYFVWGRHHSALNDAAV

SEQ ID NO: 11181 - protein, 36 aa, Mycobacterium avium
GYFRRSLEDIVRFQAEFLWRDYFPRGISDDGEEAPA

SEQ ID NO: 11182 - protein, 21 aa, Mycobacterium avium
GYLPCTIWIVAGAVFAGAVQD

SEQ ID NO: 11183 - protein, 23 aa, Mycobacterium avium
GYPADLTSPVAFLQRPARWIQAM

SEQ ID NO: 11184 - protein, 19 aa, Mycobacterium avium
GYVLLRRTLLPGGGHLIGV

SEQ ID NO: 11185 - protein, 22 aa, Mycobacterium avium
HAKGKLTARERILALLDEDSFV

SEQ ID NO: 11186 - protein, 18 aa, Mycobacterium avium
HALLVHFVLVLVPLTALL

SEQ ID NO: 11187 - protein, 22 aa, Mycobacterium avium
HAPESKAGVVLDISPASARLAV

SEQ ID NO: 11188 - protein, 26 aa, Mycobacterium avium
HARTWKTRLLTLLAIVGPGIIVMVGD

SEQ ID NO: 11189 - protein, 17 aa, Mycobacterium avium
HAVTRKPVLTRYPDRPA

SEQ ID NO: 11190 - protein, 22 aa, Mycobacterium avium
HCPLPRPAIGPGTYNLVVQLGN

SEQ ID NO: 11191 - protein, 17 aa, Mycobacterium avium
HDRIMRLPHGYDTVLGA

SEQ ID NO: 11192 - protein, 28 aa, Mycobacterium avium
HDYGEIDGRFFVEMRLVDGIDLGSLLHR

SEQ ID NO: 11193 - protein, 21 aa, Mycobacterium avium
HELRRSATRFLFEFADDLQHD

SEQ ID NO: 11194 - protein, 21 aa, Mycobacterium avium
HELRTPLTTIRGFAELYRQGA

SEQ ID NO: 11195 - protein, 19 aa, Mycobacterium avium
HEQIMPLLVVSLMMQMVLC

SEQ ID NO: 11196 - protein, 31 aa, Mycobacterium avium
HGGEFHYRYTVGLWFRRIWILQPHGEVMVNA

SEQ ID NO: 11197 - protein, 25 aa, Mycobacterium avium
HGVIWKGVISKAIIPAIVSAILAIL

SEQ ID NO: 11198 - protein, 20 aa, Mycobacterium avium
HHELIKFAIVGGTTFVIDSA

SEQ ID NO: 11199 - protein, 24 aa, Mycobacterium avium
HIVDVKRALAWVKENIARYGGDPN

SEQ ID NO: 11200 - protein, 25 aa, Mycobacterium avium
HIVDVKRALAWVKQHIAGYGGDPDF

SEQ ID NO: 11201 - protein, 25 aa, Mycobacterium avium
HLDLDPLLPFPRWHEYAPAVEEPVR

SEQ ID NO: 11202 - protein, 18 aa, Mycobacterium avium
HLLPSRKEGWGLAVVEAA

SEQ ID NO: 11203 - protein, 19 aa, Mycobacterium avium
HLYPGRTATSFALLTGQIV

SEQ ID NO: 11204 - protein, 24 aa, Mycobacterium avium
HMGRQAFAAVLGRGLANSGQLVLD

SEQ ID NO: 11205 - protein, 22 aa, Mycobacterium avium
HNLFKPLLLFFYFGFLIPILKV

SEQ ID NO: 11206 - protein, 22 aa, Mycobacterium avium
HPARYLSVFLLLLVGVYLLVFL

SEQ ID NO: 11207 - protein, 19 aa, Mycobacterium avium
HPFLVMELIEGGTLRELLG

SEQ ID NO: 11208 - protein, 23 aa, Mycobacterium avium
HPGSGGVSLWWMIGLLAAAGVLG

SEQ ID NO: 11209 - protein, 26 aa, Mycobacterium avium
HPLMSHLAELGWICVAINYRHSPRNT

SEQ ID NO: 11210 - protein, 20 aa, Mycobacterium avium
HPPGALLTFVWLDRLGLHGG

SEQ ID NO: 11211 - protein, 18 aa, Mycobacterium avium
HPQPFFAPIAAAVSLSTS

SEQ ID NO: 11212 - protein, 19 aa, Mycobacterium avium
HPQWGRAAKSFVVPSISGG

SEQ ID NO: 11213 - protein, 26 aa, Mycobacterium avium
HPVADLRPAQMWSLAGLITTASAWRW

SEQ ID NO: 11214 - protein, 17 aa, Mycobacterium avium
HPYVFVVGDLMSVPGVP

SEQ ID NO: 11215 - protein, 24 aa, Mycobacterium avium
HQGRLEAWGEPGVGSCFRLTLPLV

SEQ ID NO: 11216 - protein, 24 aa, Mycobacterium avium
HRAVDFALEIGRIIDRFNSQTGHQ

SEQ ID NO: 11217 - protein, 19 aa, Mycobacterium avium
HRLVVPRVVAATIVATLLN

SEQ ID NO: 11218 - protein, 23 aa, Mycobacterium avium
HRQQVWLSVAGLVLILVVATAYL

SEQ ID NO: 11219 - protein, 26 aa, Mycobacterium avium
HRRFLPARWWSIGGLDALVIAVLTWW

SEQ ID NO: 11220 - protein, 23 aa, Mycobacterium avium
HRSDAVLVTGPWMAGVTAVAAAL

SEQ ID NO: 11221 - protein, 24 aa, Mycobacterium avium
HSALRELSQAAGRLGDSRGDIFGT

SEQ ID NO: 11222 - protein, 20 aa, Mycobacterium avium
HSLIPIVVGYIFAHYLSYLV

SEQ ID NO: 11223 - protein, 22 aa, Mycobacterium avium
HSLTYLDVCDQVLLLAPGGKTA

SEQ ID NO: 11224 - protein, 22 aa, Mycobacterium avium
HSPYPRPGPGPRFLDAPGQPAG

SEQ ID NO: 11225 - protein, 21 aa, Mycobacterium avium
HSVFIRFLRYLSFGGMFIGLS

SEQ ID NO: 11226 - protein, 25 aa, Mycobacterium avium
HTGGAWLVLFMIFNVIWTYVLVRGS

SEQ ID NO: 11227 - protein, 19 aa, Mycobacterium avium
HYFIIIGLFGVFLGGMVSV

SEQ ID NO: 11228 - protein, 17 aa, Mycobacterium avium
IAAAIGFLQMKRWGHQW

SEQ ID NO: 11229 - protein, 19 aa, Mycobacterium avium
IAACAAGVYLVDVRPKLLE

SEQ ID NO: 11230 - protein, 25 aa, Mycobacterium avium
IAALVGVDVDEMWDIRNRGVISPSA

SEQ ID NO: 11231 - protein, 26 aa, Mycobacterium avium
IAAVLALRFTGRRLAIYTAIVTVSAI

SEQ ID NO: 11232 - protein, 17 aa, Mycobacterium avium
IADGTWSNLYSQWVPRT

SEQ ID NO: 11233 - protein, 24 aa, Mycobacterium avium
IAERLRPGGLVQREIALRTVGVFA

SEQ ID NO: 11234 - protein, 18 aa, Mycobacterium avium
IAGFAGVLLFIFGYTMGF

SEQ ID NO: 11235 - protein, 19 aa, Mycobacterium avium
IAGKLGLQVRFVGTDFAGL

SEQ ID NO: 11236 - protein, 27 aa, Mycobacterium avium
IAILLLGWRGARWWRRGLSILAVPLCL

SEQ ID NO: 11237 - protein, 23 aa, Mycobacterium avium
IAISLPLLWWRFRRDDRDALTGI

SEQ ID NO: 11238 - protein, 17 aa, Mycobacterium avium
IAKVGAPNRPVHRRAAP

SEQ ID NO: 11239 - protein, 19 aa, Mycobacterium avium
IALLLSWRFAPRALGPDDT

SEQ ID NO: 11240 - protein, 19 aa, Mycobacterium avium
IALPLGMLVQRRRFARRLT

SEQ ID NO: 11241 - protein, 20 aa, Mycobacterium avium
IAPELYLKRLCVGGVERVFE

SEQ ID NO: 11242 - protein, 18 aa, Mycobacterium avium
IAPFVLPLAVTIFVFILI

SEQ ID NO: 11243 - protein, 23 aa, Mycobacterium avium
IARTGWRPLVVAVIGLTVVATVS

SEQ ID NO: 11244 - protein, 25 aa, Mycobacterium avium
IASHMPLLLGLAFALLVARERVGSR

SEQ ID NO: 11245 - protein, 33 aa, Mycobacterium avium
IASTIPMGVPLEWNVFFIFSLFYLFGHYAGVTA

SEQ ID NO: 11246 - protein, 21 aa, Mycobacterium avium
IATRFDYRDALLLDTQGNVVY

SEQ ID NO: 11247 - protein, 24 aa, Mycobacterium avium
IATRFEYRDALLLDTRGNVVYSVR

SEQ ID NO: 11248 - protein, 19 aa, Mycobacterium avium
IAVRDIVVVLGFALAALCL

SEQ ID NO: 11249 - protein, 20 aa, Mycobacterium avium
IAVVGLILVRAWFLDNALSQ

SEQ ID NO: 11250 - protein, 22 aa, Mycobacterium avium
IAYCLGLGIPFVLLAFGSAGAV

SEQ ID NO: 11251 - protein, 24 aa, Mycobacterium avium
IAYSVLKCVVFVWLSSTVQCYYGF

SEQ ID NO: 11252 - protein, 20 aa, Mycobacterium avium
ICLGALLWSFISPAGQVGDS

SEQ ID NO: 11253 - protein, 20 aa, Mycobacterium avium
ICVLNPLVLIHLMGGVHNEM

SEQ ID NO: 11254 - protein, 20 aa, Mycobacterium avium
ICVLVGLLVLVRMTPLIALW

SEQ ID NO: 11255 - protein, 25 aa, Mycobacterium avium
IDAARLLTWRASWMAANNVPFERGE

SEQ ID NO: 11256 - protein, 19 aa, Mycobacterium avium
IDEKPWFFALTDHLSVAEA

SEQ ID NO: 11257 - protein, 17 aa, Mycobacterium avium
IDLDGSPLDALQLPDLP

SEQ ID NO: 11258 - protein, 24 aa, Mycobacterium avium
IDRLLRRVCPGDIVVLDVLDLDRI

SEQ ID NO: 11259 - protein, 23 aa, Mycobacterium avium
IDSLRLRGPRVLSVTTQIAIADA

SEQ ID NO: 11260 - protein, 22 aa, Mycobacterium avium
IDTELLGGLLIAVADEVIDGTL

SEQ ID NO: 11261 - protein, 20 aa, Mycobacterium avium
IEGYNFLDLLGLGPATGFVS

SEQ ID NO: 11262 - protein, 25 aa, Mycobacterium avium
IELTPPYRGGPVLGNHDTIGLPRTK

SEQ ID NO: 11263 - protein, 19 aa, Mycobacterium avium
IESTRRWLINGPAHLRSEQ

SEQ ID NO: 11264 - protein, 29 aa, Mycobacterium avium
IFFQPGFYPYPFWGPGWGWALGDVLLMDA

SEQ ID NO: 11265 - protein, 18 aa, Mycobacterium avium
IFFVLSGYLLFRPWVKSA

SEQ ID NO: 11266 - protein, 17 aa, Mycobacterium avium
IFRGDFFSSALINSVGI

SEQ ID NO: 11267 - protein, 18 aa, Mycobacterium avium
IFVLGFLAQFVFGVRLGI

SEQ ID NO: 11268 - protein, 19 aa, Mycobacterium avium
IGACAAIYLALLGVSVAAC

SEQ ID NO: 11269 - protein, 23 aa, Mycobacterium avium
IGAPGRAAGVLALPLPIAKVNRI

SEQ ID NO: 11270 - protein, 23 aa, Mycobacterium avium
IGATGLFLACRWAQAQPGVGAWV

SEQ ID NO: 11271 - protein, 19 aa, Mycobacterium avium
IGDPRAWPQAVDAWLGLCQ

SEQ ID NO: 11272 - protein, 20 aa, Mycobacterium avium
IGELFVGTLVVWFFVLFDML

SEQ ID NO: 11273 - protein, 20 aa, Mycobacterium avium
IGFALGWRPALAALALGAAV

SEQ ID NO: 11274 - protein, 23 aa, Mycobacterium avium
IGFIAGLLLAIAVALTREAGDRT

SEQ ID NO: 11275 - protein, 24 aa, Mycobacterium avium
IGGITVRTGLLWWTVAIHLLTSMT

SEQ ID NO: 11276 - protein, 22 aa, Mycobacterium avium
IGGPRRKGRIISEQEKKITAYH

SEQ ID NO: 11277 - protein, 40 aa, Mycobacterium avium
IGLGVGLYFGGLRLNLGRFFRVTGVFLVLIAAGLVLGALR

SEQ ID NO: 11278 - protein, 18 aa, Mycobacterium avium
IGLGVQWIVLPLSIVILL

SEQ ID NO: 11279 - protein, 25 aa, Mycobacterium avium
IGTSRRSRWARLFEEGIGPRIVELS

SEQ ID NO: 11280 - protein, 25 aa, Mycobacterium avium
IGVVAEAAFLCYIGYFGRRGVKAGE

SEQ ID NO: 11281 - protein, 19 aa, Mycobacterium avium
IILALIGLHLAMVWFQKHT

SEQ ID NO: 11282 - protein, 17 aa, Mycobacterium avium
IIVVIAFNTFGGGARDV

SEQ ID NO: 11283 - protein, 31 aa, Mycobacterium avium
IKPDICFLWDEAWYAFATAVPWARQRTAMVA

SEQ ID NO: 11284 - protein, 17 aa, Mycobacterium avium
ILEGFDFGVGMLMEPFA

SEQ ID NO: 11285 - protein, 18 aa, Mycobacterium avium
ILFGLPLLAGGLITGVVA

SEQ ID NO: 11286 - protein, 17 aa, Mycobacterium avium
ILFPIGELFVGTLVVWF

SEQ ID NO: 11287 - protein, 23 aa, Mycobacterium avium
ILGAHWKLALTALLACTVGAAFV

SEQ ID NO: 11288 - protein, 28 aa, Mycobacterium avium
ILGGWLIGAYGWKWIFLINLPIGLTAFA

SEQ ID NO: 11289 - protein, 20 aa, Mycobacterium avium
ILHYIAMWFAVFYTGDHAWL

SEQ ID NO: 11290 - protein, 18 aa, Mycobacterium avium
ILLERIRATPIWIPQQSI

SEQ ID NO: 11291 - protein, 18 aa, Mycobacterium avium
ILLLIGVGVLGKYAQIWW

SEQ ID NO: 11292 - protein, 20 aa, Mycobacterium avium
ILLLPGIILALIGLHLAMVW

SEQ ID NO: 11293 - protein, 25 aa, Mycobacterium avium
ILLYAVCVVLRLARFNALLDDGSQP

SEQ ID NO: 11294 - protein, 19 aa, Mycobacterium avium
ILLYILGGWLFASATRGLG

SEQ ID NO: 11295 - protein, 18 aa, Mycobacterium avium
ILPRCRFADPEADQQRAE

SEQ ID NO: 11296 - protein, 18 aa, Mycobacterium avium
ILRPGRAGLESTPGAVKI

SEQ ID NO: 11297 - protein, 24 aa, Mycobacterium avium
ILRSAARPGHWSLFDGGYTFASKI

SEQ ID NO: 11298 - protein, 27 aa, Mycobacterium avium
ILVGLSPDRFIAWATMVRYQALFTEAG

SEQ ID NO: 11299 - protein, 19 aa, Mycobacterium avium
ILVSLPISVTLSIQFALLA

SEQ ID NO: 11300 - protein, 28 aa, Mycobacterium avium
ILVVIWLSLCRWDLLGPLRFVGLSNWRS

SEQ ID NO: 11301 - protein, 22 aa, Mycobacterium avium
ILWDVIPFDWANDSNTAATRYM

SEQ ID NO: 11302 - protein, 21 aa, Mycobacterium avium
IMALYLWHMIPVVIVAIVGYP

SEQ ID NO: 11303 - protein, 17 aa, Mycobacterium avium
IMLVSKYGFSDVLSAGS

SEQ ID NO: 11304 - protein, 19 aa, Mycobacterium avium
IMNALLLPIVLGLLLALEA

SEQ ID NO: 11305 - protein, 24 aa, Mycobacterium avium
IMTPLRVMFLIALVFLALGWSTKA

SEQ ID NO: 11306 - protein, 17 aa, Mycobacterium avium
INAGRAFQDLGFDSLTA

SEQ ID NO: 11307 - protein, 18 aa, Mycobacterium avium
INAILGVLLLIVLATGSV

SEQ ID NO: 11308 - protein, 25 aa, Mycobacterium avium
INCQRAIPHVIDWYDRYHDSGFLVI

SEQ ID NO: 11309 - protein, 17 aa, Mycobacterium avium
INFVIIAAVVYFLVVLP

SEQ ID NO: 11310 - protein, 17 aa, Mycobacterium avium
IPAAKPRSSDFLLPGIL

SEQ ID NO: 11311 - protein, 17 aa, Mycobacterium avium
IPANVYWVVGQLAVVVL

SEQ ID NO: 11312 - protein, 24 aa, Mycobacterium avium
IPDVLRPDLTIAYTDTDGHGQRGD

SEQ ID NO: 11313 - protein, 25 aa, Mycobacterium avium
IPEDKRLPTVLFQTTVSKLRDLLAA

SEQ ID NO: 11314 - protein, 18 aa, Mycobacterium avium
IPFEVLEPTFSRLVTAGY

SEQ ID NO: 11315 - protein, 25 aa, Mycobacterium avium
IPIAVFMGCYLRFLRPGRVAEVSVL

SEQ ID NO: 11316 - protein, 24 aa, Mycobacterium avium
IPIERTRVPVEWDQLRDSINAILR

SEQ ID NO: 11317 - protein, 17 aa, Mycobacterium avium
IPLALGICTVVVTMGLV

SEQ ID NO: 11318 - protein, 21 aa, Mycobacterium avium
IPLALGSYWGLLFVVPGTALL

SEQ ID NO: 11319 - protein, 27 aa, Mycobacterium avium
IPMVVRRLITLCPALLILAVGYDTTRA

SEQ ID NO: 11320 - protein, 33 aa, Mycobacterium avium
IPPFLPRMIHRLALPIVLVWLGIVFITNTVAPQ

SEQ ID NO: 11321 - protein, 22 aa, Mycobacterium avium
IPPPEGKPWWLVVVGVLVVGLL

SEQ ID NO: 11322 - protein, 22 aa, Mycobacterium avium
IPSDLLWSFLQAIVMSIAVMLV

SEQ ID NO: 11323 - protein, 17 aa, Mycobacterium avium
IQLKRLGFDNIVILDRE

SEQ ID NO: 11324 - protein, 24 aa, Mycobacterium avium
IRENPATCWWWQKTSGENRARVQV

SEQ ID NO: 11325 - protein, 29 aa, Mycobacterium avium
IRGKMKGGPLPRGRGLLMAEDTGVFVQVA

SEQ ID NO: 11326 - protein, 21 aa, Mycobacterium avium
IRITADFTPVLGVLAQKSNNF

SEQ ID NO: 11327 - protein, 25 aa, Mycobacterium avium
IRPVAPEAYALYGLSRVMPQGLRNA

SEQ ID NO: 11328 - protein, 26 aa, Mycobacterium avium
IRVLALPIVLGWLVLAVGVNVFVPQL

SEQ ID NO: 11329 - protein, 17 aa, Mycobacterium avium
ISAGTAWASDLRGPAGA

SEQ ID NO: 11330 - protein, 17 aa, Mycobacterium avium
ISAPLTYGWLLVLMITT

SEQ ID NO: 11331 - protein, 17 aa, Mycobacterium avium
ISFEVRGGLFVRQVHHW

SEQ ID NO: 11332 - protein, 17 aa, Mycobacterium avium
ISGFGWAAGYVGSVLLL

SEQ ID NO: 11333 - protein, 17 aa, Mycobacterium avium
ISIGGGQTIDLNNVLSA

SEQ ID NO: 11334 - protein, 17 aa, Mycobacterium avium
ISLLVEPWYSLAGDREQ

SEQ ID NO: 11335 - protein, 17 aa, Mycobacterium avium
ISPPEVTLRFIGSYLGG

SEQ ID NO: 11336 - protein, 22 aa, Mycobacterium avium
ISSLCLIFIIMLIITRGVVASA

SEQ ID NO: 11337 - protein, 23 aa, Mycobacterium avium
ISSVFFVGAFIWKHSYYHCHHHH

SEQ ID NO: 11338 - protein, 18 aa, Mycobacterium avium
ISTISFGTPYGFVEINDQ

SEQ ID NO: 11339 - protein, 19 aa, Mycobacterium avium
ISVAMPMFHGLGLGMLMLT

SEQ ID NO: 11340 - protein, 23 aa, Mycobacterium avium
ISWTHHWVWLVPLMIWAIHGPVR

SEQ ID NO: 11341 - protein, 17 aa, Mycobacterium avium
ITESALVDSVRSRNTVT

SEQ ID NO: 11342 - protein, 38 aa, Mycobacterium avium
ITETINLPAGFAIGWAMWPLVACVVLQAIAAVVVVLLD

SEQ ID NO: 11343 - protein, 17 aa, Mycobacterium avium
ITLLNGVVLKFAMRTMN

SEQ ID NO: 11344 - protein, 18 aa, Mycobacterium avium
IVAVPAAAALLFAVVAGG

SEQ ID NO: 11345 - protein, 18 aa, Mycobacterium avium
IVCFAFGTGRLWPNGVLA

SEQ ID NO: 11346 - protein, 21 aa, Mycobacterium avium
IVDPVAALTWDVPDGPVKPPQ

SEQ ID NO: 11347 - protein, 27 aa, Mycobacterium avium
IVDRYHPRPVLGFGFSLLAIALTWLTF

SEQ ID NO: 11348 - protein, 18 aa, Mycobacterium avium
IVGGIAWGGGATLAGYFL

SEQ ID NO: 11349 - protein, 25 aa, Mycobacterium avium
IVGRMKDLLIVYGRNHYPEDIESTV

SEQ ID NO: 11350 - protein, 21 aa, Mycobacterium avium
IVLLLFLPAILYWEGLNISFR

SEQ ID NO: 11351 - protein, 29 aa, Mycobacterium avium
IVLSGCSSWADALALGWPKGITPQAHLNR

SEQ ID NO: 11352 - protein, 17 aa, Mycobacterium avium
IVLSLGAAFGFSTLIWQ

SEQ ID NO: 11353 - protein, 23 aa, Mycobacterium avium
IVLWGSAGALGFVEKDLGFKIIF

SEQ ID NO: 11354 - protein, 17 aa, Mycobacterium avium
IVPPIVYFVTYRWCIGL

SEQ ID NO: 11355 - protein, 24 aa, Mycobacterium avium
IVRRSNALLDWAYGRSLRYSESMS

SEQ ID NO: 11356 - protein, 18 aa, Mycobacterium avium
IVRRSQRLFVAQWTSVGR

SEQ ID NO: 11357 - protein, 21 aa, Mycobacterium avium
IVSALHRPVPLSGEGSDTDTV

SEQ ID NO: 11358 - protein, 23 aa, Mycobacterium avium
IVSEGDIAPPTRVVLRRQRNVQV

SEQ ID NO: 11359 - protein, 17 aa, Mycobacterium avium
IVSSGFLLRAIAGGAAT

SEQ ID NO: 11360 - protein, 26 aa, Mycobacterium avium
IVVVIAGAVVWFGITSAWRERLDRRL

SEQ ID NO: 11361 - protein, 17 aa, Mycobacterium avium
IVVVLGFALAALCLAAA

SEQ ID NO: 11362 - protein, 24 aa, Mycobacterium avium
IWQHLADFQLHWVATEFALIVLLA

SEQ ID NO: 11363 - protein, 22 aa, Mycobacterium avium
IWQHSKHIFVFDMAMLALLSIG

SEQ ID NO: 11364 - protein, 26 aa, Mycobacterium avium
IYAYHLAAFLAICYLIPAAKPRSSDF

SEQ ID NO: 11365 - protein, 22 aa, Mycobacterium avium
IYTPRYLCFTAPAMALILGVCS

SEQ ID NO: 11366 - protein, 25 aa, Mycobacterium avium
IYYSPRIFEAMGFTGNFALLALPAL

SEQ ID NO: 11367 - protein, 25 aa, Mycobacterium avium
KAAAQGGAVPLVIVGVVASGVAAYF

SEQ ID NO: 11368 - protein, 23 aa, Mycobacterium avium
KAATSVACPWPYPEAKVYDPQGF

SEQ ID NO: 11369 - protein, 19 aa, Mycobacterium avium
KALACNFLSLTAAFGALVW

SEQ ID NO: 11370 - protein, 19 aa, Mycobacterium avium
KALASNDVDFVWITDFQPY

SEQ ID NO: 11371 - protein, 24 aa, Mycobacterium avium
KALPASAVVGLWTFDGHEGRSEVT

SEQ ID NO: 11372 - protein, 17 aa, Mycobacterium avium
KALTGLRIVAALWVVLF

SEQ ID NO: 11373 - protein, 23 aa, Mycobacterium avium
KAPLWPFHRWLPDAAVEATPATA

SEQ ID NO: 11374 - protein, 23 aa, Mycobacterium avium
KARGSEDRMRRFITDASHELRTP

SEQ ID NO: 11375 - protein, 21 aa, Mycobacterium avium
KARGTWWGWHGAGWFLLTVMA

SEQ ID NO: 11376 - protein, 19 aa, Mycobacterium avium
KARVGDIKKITGFLDTQIA

SEQ ID NO: 11377 - protein, 19 aa, Mycobacterium avium
KCTLCYDRLLEDEIPACAK

SEQ ID NO: 11378 - protein, 18 aa, Mycobacterium avium
KDLGFKIIFGLPGIVLAS

SEQ ID NO: 11379 - protein, 18 aa, Mycobacterium avium
KDLSLRPGDNYVVDGVTF

SEQ ID NO: 11380 - protein, 23 aa, Mycobacterium avium
KDPQFGKDLGFYAFELPFYRLLL

SEQ ID NO: 11381 - protein, 26 aa, Mycobacterium avium
KDPVFLDWLVGLAFPCQRPFGHQNGV

SEQ ID NO: 11382 - protein, 22 aa, Mycobacterium avium
KDREVLSYVSGFMTQFTSIDPF

SEQ ID NO: 11383 - protein, 17 aa, Mycobacterium avium
KEIGRLYAPGASSAPTP

SEQ ID NO: 11384 - protein, 22 aa, Mycobacterium avium
KEWGHRLRAFVVKKEGADLDED

SEQ ID NO: 11385 - protein, 22 aa, Mycobacterium avium
KFFLPPRLVSLYGTPMWDEMTR

SEQ ID NO: 11386 - protein, 18 aa, Mycobacterium avium
KGATFDCDVSIDGAPKHV

SEQ ID NO: 11387 - protein, 17 aa, Mycobacterium avium
KGGSAVKPFAGVPHVSR

SEQ ID NO: 11388 - protein, 17 aa, Mycobacterium avium
KGGSTGLGLAIVSAVVK

SEQ ID NO: 11389 - protein, 20 aa, Mycobacterium avium
KGPSCFTAPLIPVRPDLPDV

SEQ ID NO: 11390 - protein, 17 aa, Mycobacterium avium
KGTRSLIVTDWRMIGKC

SEQ ID NO: 11391 - protein, 22 aa, Mycobacterium avium
KHREELVYLPPAWFASYPPPQL

SEQ ID NO: 11392 - protein, 24 aa, Mycobacterium avium
KHVRARLRDEFGFPKSEVHAQAYW

SEQ ID NO: 11393 - protein, 36 aa, Mycobacterium avium
KIGPLEFSGLFAWFAWLVLHLVYLVGFKTKVSTLLS

SEQ ID NO: 11394 - protein, 22 aa, Mycobacterium avium
KIVVTCPHCFNTLGREYRQLGA

SEQ ID NO: 11395 - protein, 30 aa, Mycobacterium avium
KKGLLKWAWIPGAPLLWDLVVTLSASWQKI

SEQ ID NO: 11396 - protein, 24 aa, Mycobacterium avium
KLKDLRSAGWGFIVFGLVAPNVFA

SEQ ID NO: 11397 - protein, 20 aa, Mycobacterium avium
KLLWFGLAMVIVFGVVHALF

SEQ ID NO: 11398 - protein, 22 aa, Mycobacterium avium
KLPCILPAPFCPPSTTPSTPAP

SEQ ID NO: 11399 - protein, 21 aa, Mycobacterium avium
KLPTQRPDLRSESGPDEPTEA

SEQ ID NO: 11400 - protein, 26 aa, Mycobacterium avium
KLTNGRTAQAWARRHRQLRAALTPLV

SEQ ID NO: 11401 - protein, 19 aa, Mycobacterium avium
KLTPAVFLLYFLLRRDHRA

SEQ ID NO: 11402 - protein, 22 aa, Mycobacterium avium
KLVTWFPPRVVVIASGGLILGA

SEQ ID NO: 11403 - protein, 25 aa, Mycobacterium avium
KPDLEGADQLLLRWRQANDRITSYI

SEQ ID NO: 11404 - protein, 19 aa, Mycobacterium avium
KPFVRQIRTTRQMQELQPQ

SEQ ID NO: 11405 - protein, 17 aa, Mycobacterium avium
KPGAVLRSRNVTVEVNT

SEQ ID NO: 11406 - protein, 19 aa, Mycobacterium avium
KPRIPPLLWAGLIFGAVVL

SEQ ID NO: 11407 - protein, 25 aa, Mycobacterium avium
KPSADVGANCQYPPSPEPAAKQVKP

SEQ ID NO: 11408 - protein, 40 aa, Mycobacterium avium
KPSSPPPPRWAWKILIPVGAVGMVLMAIWFHVWQDKVRDL

SEQ ID NO: 11409 - protein, 22 aa, Mycobacterium avium
KQLEATSGLMLQKAEESKASSK

SEQ ID NO: 11410 - protein, 27 aa, Mycobacterium avium
KQTWLGRFVSTYGWRAYALPALVVLTA

SEQ ID NO: 11411 - protein, 23 aa, Mycobacterium avium
KRAERGVALWLLLGGGFGLALLL

SEQ ID NO: 11412 - protein, 22 aa, Mycobacterium avium
KRAKGPLIFDLGICLVLISLPT

SEQ ID NO: 11413 - protein, 17 aa, Mycobacterium avium
KRALIVFQIFIYGYLLA

SEQ ID NO: 11414 - protein, 19 aa, Mycobacterium avium
KRGHRLVFSNGIITLTALS

SEQ ID NO: 11415 - protein, 26 aa, Mycobacterium avium
KRHEEIRVRIGIHMGRSVRRGDDLFG

SEQ ID NO: 11416 - protein, 17 aa, Mycobacterium avium
KRLLPYMIGAFLLVVGV

SEQ ID NO: 11417 - protein, 22 aa, Mycobacterium avium
KRRGWPTTLFRPHNLPFVMLGA

SEQ ID NO: 11418 - protein, 21 aa, Mycobacterium avium
KRSTLREFAILAVIAVLLYYV

SEQ ID NO: 11419 - protein, 19 aa, Mycobacterium avium
KRWGHQWMVITCWMGVVIW

SEQ ID NO: 11420 - protein, 21 aa, Mycobacterium avium
KSGLTALTWPVVANFAVDAAM

SEQ ID NO: 11421 - protein, 20 aa, Mycobacterium avium
KSHHYGLVLAGAYPLYLDAY

SEQ ID NO: 11422 - protein, 24 aa, Mycobacterium avium
KSKLPLYLNIAVVALGFAAYLLNF

SEQ ID NO: 11423 - protein, 18 aa, Mycobacterium avium
KSSGVSWTDPVKAAALRD

SEQ ID NO: 11424 - protein, 21 aa, Mycobacterium avium
KSTGRLDDYVRVVADLVNVGD

SEQ ID NO: 11425 - protein, 18 aa, Mycobacterium avium
KSVMKFKVVSEVTGQPVG

SEQ ID NO: 11426 - protein, 25 aa, Mycobacterium avium
KTKPSVAPWVALRLLPQGPTLSRAD

SEQ ID NO: 11427 - protein, 18 aa, Mycobacterium avium
KTPGLLRMLRIYRDYAHD

SEQ ID NO: 11428 - protein, 20 aa, Mycobacterium avium
KTSEVDWVLDRLARELEALR

SEQ ID NO: 11429 - protein, 23 aa, Mycobacterium avium
KTVPKRLSALLNTSGLPAVLEPF

SEQ ID NO: 11430 - protein, 23 aa, Mycobacterium avium
KVAATGGPKCMGLPTLPFNTNPP

SEQ ID NO: 11431 - protein, 19 aa, Mycobacterium avium
KVGEHIPLGLSNVLRYGYY

SEQ ID NO: 11432 - protein, 19 aa, Mycobacterium avium
KVMAVHNFVDWRLRVGGLV

SEQ ID NO: 11433 - protein, 24 aa, Mycobacterium avium
KVNQAGVIPVIFASSLIYIPHLIT

SEQ ID NO: 11434 - protein, 19 aa, Mycobacterium avium
KVPTALNMIGRAIGSYGDF

SEQ ID NO: 11435 - protein, 22 aa, Mycobacterium avium
KVRPLPRLPRSLPLADGLSRMR

SEQ ID NO: 11436 - protein, 27 aa, Mycobacterium avium
KWLPKPARPAPPWPTAQREVCATLTAD

SEQ ID NO: 11437 - protein, 18 aa, Mycobacterium avium
KYAQIWWNALAKHEHWTV

SEQ ID NO: 11438 - protein, 26 aa, Mycobacterium avium
KYYFMVELPPDFSAAIASPVTGQPKK

SEQ ID NO: 11439 - protein, 33 aa, Mycobacterium avium
LAAGMLPILGWRNEIRWALLVAGLVLFAVADGA

SEQ ID NO: 11440 - protein, 20 aa, Mycobacterium avium
LAARALRILPGFYVCMIVTA

SEQ ID NO: 11441 - protein, 22 aa, Mycobacterium avium
LAATLPLLWSRGLSALPVTYIG

SEQ ID NO: 11442 - protein, 26 aa, Mycobacterium avium
LAAVLATAGYEGWLLFEQHQKDVAAA

SEQ ID NO: 11443 - protein, 25 aa, Mycobacterium avium
LAAVPRPPLGPVWVALLIIGASSGV

SEQ ID NO: 11444 - protein, 20 aa, Mycobacterium avium
LAAWATRTGFRVAAIVISLV

SEQ ID NO: 11445 - protein, 17 aa, Mycobacterium avium
LAAYGRFTGDRSDELTA

SEQ ID NO: 11446 - protein, 20 aa, Mycobacterium avium
LACGTKWSGLYFVLFFAAMS

SEQ ID NO: 11447 - protein, 23 aa, Mycobacterium avium
LADDLKARVIGFVQKPVVLASLA

SEQ ID NO: 11448 - protein, 18 aa, Mycobacterium avium
LAEGRFSGVTLRGVNELQ

SEQ ID NO: 11449 - protein, 21 aa, Mycobacterium avium
LAFLLVFGIFVRRVRDIIIGL

SEQ ID NO: 11450 - protein, 24 aa, Mycobacterium avium
LAGAWGLAEVFGWKHTLNQRPNRA

SEQ ID NO: 11451 - protein, 24 aa, Mycobacterium avium
LAGLTVGWWVIQRNYYVAEYNGRI

SEQ ID NO: 11452 - protein, 27 aa, Mycobacterium avium
LAGPRLIDAYVDWLWFGELGYRSVFST

SEQ ID NO: 11453 - protein, 19 aa, Mycobacterium avium
LAKKLPRRSLTVLKAESLI

SEQ ID NO: 11454 - protein, 25 aa, Mycobacterium avium
LALHPRLPRRDVIKVLAEAVTVDPE

SEQ ID NO: 11455 - protein, 24 aa, Mycobacterium avium
LALLWYAGLPLRVFITSLLAVFMA

SEQ ID NO: 11456 - protein, 20 aa, Mycobacterium avium
LALSLRVASIVAHVLAGLLI

SEQ ID NO: 11457 - protein, 25 aa, Mycobacterium avium
LAMFLGVVCAVFLASQLPALTRGFV

SEQ ID NO: 11458 - protein, 18 aa, Mycobacterium avium
LAMYLRAFYSPRRGAALV

SEQ ID NO: 11459 - protein, 27 aa, Mycobacterium avium
LANPGLPLWLFVLCAALTGLGGGNYAA

SEQ ID NO: 11460 - protein, 23 aa, Mycobacterium avium
LAPGEASALMFGALLTIAAASIA

SEQ ID NO: 11461 - protein, 17 aa, Mycobacterium avium
LAPLRAPLQNVLRLASA

SEQ ID NO: 11462 - protein, 24 aa, Mycobacterium avium
LAPWHSRVGAFAIDVAPGAAVIAT

SEQ ID NO: 11463 - protein, 19 aa, Mycobacterium avium
LARDPKLLIADEVTTMVDQ

SEQ ID NO: 11464 - protein, 30 aa, Mycobacterium avium
LASAKRFRIPVVIGELIAGLAIGRTGFGVV

SEQ ID NO: 11465 - protein, 24 aa, Mycobacterium avium
LASASRWTPARVVPVRRTTTAVVT

SEQ ID NO: 11466 - protein, 20 aa, Mycobacterium avium
LATLSLVFAFLFAPAGAVLG

SEQ ID NO: 11467 - protein, 25 aa, Mycobacterium avium
LAVAGSMTWEILWALILGFALSAVV

SEQ ID NO: 11468 - protein, 17 aa, Mycobacterium avium
LAVLMLLPLSAFEAMTP

SEQ ID NO: 11469 - protein, 18 aa, Mycobacterium avium
LAVLTIIVVIAFNTFGGG

SEQ ID NO: 11470 - protein, 19 aa, Mycobacterium avium
LAVPGRFGPAQVMLAAAGV

SEQ ID NO: 11471 - protein, 25 aa, Mycobacterium avium
LAVPLCLLCSLLVLNQWVGYFQTVQ

SEQ ID NO: 11472 - protein, 19 aa, Mycobacterium avium
LAVVAAVCAFLFMNNLTEI

SEQ ID NO: 11473 - protein, 20 aa, Mycobacterium avium
LCAYTGGLAGIVKRHRRGTP

SEQ ID NO: 11474 - protein, 19 aa, Mycobacterium avium
LCDHPRLYFSRNATPGKDE

SEQ ID NO: 11475 - protein, 20 aa, Mycobacterium avium
LCIRGPYLMQRYHKRSREEC

SEQ ID NO: 11476 - protein, 24 aa, Mycobacterium avium
LDALRRYGCNITQGFVHTPPLPPD

SEQ ID NO: 11477 - protein, 18 aa, Mycobacterium avium
LDAPTAWVVSPVGMNGRI

SEQ ID NO: 11478 - protein, 18 aa, Mycobacterium avium
LDATIDWTTDGIKQSVQN

SEQ ID NO: 11479 - protein, 17 aa, Mycobacterium avium
LDEALAARDSRAPELDA

SEQ ID NO: 11480 - protein, 24 aa, Mycobacterium avium
LDFPGKRLLIGATLLITMFPAISL

SEQ ID NO: 11481 - protein, 18 aa, Mycobacterium avium
LDGLLARNYGMATEFGAF

SEQ ID NO: 11482 - protein, 17 aa, Mycobacterium avium
LDGLRPYFTGYLPTLML

SEQ ID NO: 11483 - protein, 18 aa, Mycobacterium avium
LDLLLAIVRRTRAGRSAF

SEQ ID NO: 11484 - protein, 21 aa, Mycobacterium avium
LDLTGRAPVLFQIPGGAWTTG

SEQ ID NO: 11485 - protein, 23 aa, Mycobacterium avium
LDPTARQAWQWFVTEVPQRSLHN

SEQ ID NO: 11486 - protein, 28 aa, Mycobacterium avium
LDTKTPLSFLCYWIIPFALLGLAAVVSR

SEQ ID NO: 11487 - protein, 27 aa, Mycobacterium avium
LDTPEFPWTGLTIFLLIAVFAAAVGTR

SEQ ID NO: 11488 - protein, 19 aa, Mycobacterium avium
LDVTRWQRAGWRVYRLGAP

SEQ ID NO: 11489 - protein, 20 aa, Mycobacterium avium
LDYLPGILLLIGVGVLGKYA

SEQ ID NO: 11490 - protein, 23 aa, Mycobacterium avium
LEAEIKSTTAFGSKFVDLIVPER

SEQ ID NO: 11491 - protein, 19 aa, Mycobacterium avium
LEAPLKFRAPNVTLQIGLG

SEQ ID NO: 11492 - protein, 23 aa, Mycobacterium avium
LEATPPLFRWLAEFEPMHQVFLG

SEQ ID NO: 11493 - protein, 24 aa, Mycobacterium avium
LEGRFPGILLIIARDATGKVQAFH

SEQ ID NO: 11494 - protein, 39 aa, Mycobacterium avium
LEPRRTQRIRGWRKVGTVVVRWPGPILVLTIGVALVGLL

SEQ ID NO: 11495 - protein, 20 aa, Mycobacterium avium
LERQVRRWGSQWALVRLPED

SEQ ID NO: 11496 - protein, 17 aa, Mycobacterium avium
LERYGLRGSTLSVASGR

SEQ ID NO: 11497 - protein, 31 aa, Mycobacterium avium
LESIHMSWLRFGHGLVLSSIVLWTGVGLMLI

SEQ ID NO: 11498 - protein, 23 aa, Mycobacterium avium
LESRLAALGSRAGAAVMPKGPLP

SEQ ID NO: 11499 - protein, 18 aa, Mycobacterium avium
LETARPADLLVLLDSLRQ

SEQ ID NO: 11500 - protein, 18 aa, Mycobacterium avium
LFAFFGGFAIMLGAELNA

SEQ ID NO: 11501 - protein, 31 aa, Mycobacterium avium
LFAGPGANFVICLVLLYAIALIWGLPNLHPP

SEQ ID NO: 11502 - protein, 18 aa, Mycobacterium avium
LFAIVPLRNILPGAPPPG

SEQ ID NO: 11503 - protein, 23 aa, Mycobacterium avium
LFAPAGAVLGHLGLAQIRRTGEL

SEQ ID NO: 11504 - protein, 19 aa, Mycobacterium avium
LFERLGRRFPKHFGPGHVA

SEQ ID NO: 11505 - protein, 18 aa, Mycobacterium avium
LFFGALVLWMVLRPLQYR

SEQ ID NO: 11506 - protein, 17 aa, Mycobacterium avium
LFLCIWITGTSILMVSK

SEQ ID NO: 11507 - protein, 29 aa, Mycobacterium avium
LFMLVDCAWVGGLCGIVKRKGRGTPTVAL

SEQ ID NO: 11508 - protein, 24 aa, Mycobacterium avium
LFMPSTLFLMFIMFGVPQLQLYIS

SEQ ID NO: 11509 - protein, 24 aa, Mycobacterium avium
LFRRLLRDRRWWTGSLVAAGGFGF

SEQ ID NO: 11510 - protein, 29 aa, Mycobacterium avium
LFTFASGLCGIAWAGGTLIAARLLHGAAA

SEQ ID NO: 11511 - protein, 20 aa, Mycobacterium avium
LFTQRQCMDLIFTIGGYLLL

SEQ ID NO: 11512 - protein, 25 aa, Mycobacterium avium
LFVPAALPWYYSWPLAVLAPLAQSR

SEQ ID NO: 11513 - protein, 26 aa, Mycobacterium avium
LFVPTLRRWLATEVRPKLDEVVSDLA

SEQ ID NO: 11514 - protein, 18 aa, Mycobacterium avium
LGAAIAVALGLWPRLKEY

SEQ ID NO: 11515 - protein, 42 aa, Mycobacterium avium
LGAEPRLAVPSVYARLVLLWFLCSAFPIAVIAALVVLRSYGW

SEQ ID NO: 11516 - protein, 33 aa, Mycobacterium avium
LGELLTCPFCLDMWVATGFAIGLVFAPRYTRLV

SEQ ID NO: 11517 - protein, 23 aa, Mycobacterium avium
LGFAVARPRGWPEAVAAVPAALL

SEQ ID NO: 11518 - protein, 17 aa, Mycobacterium avium
LGFDNIVILDREDDLGG

SEQ ID NO: 11519 - protein, 19 aa, Mycobacterium avium
LGFHGGLGWAGKLGLALSV

SEQ ID NO: 11520 - protein, 27 aa, Mycobacterium avium
LGGAVAQHLGFRAAFLLLAGLSLGALI

SEQ ID NO: 11521 - protein, 30 aa, Mycobacterium avium
LGGYFTDYLSWRWAFWVNVPVSVIVIFVAA

SEQ ID NO: 11522 - protein, 26 aa, Mycobacterium avium
LGIARRADNPISFWEFTRKGVVVTAV

SEQ ID NO: 11523 - protein, 24 aa, Mycobacterium avium
LGITRISLNFAMFRSAFEQGAQLG

SEQ ID NO: 11524 - protein, 26 aa, Mycobacterium avium
LGKPALELFADVALTCVASAMLGLAL

SEQ ID NO: 11525 - protein, 25 aa, Mycobacterium avium
LGLFDTWPGLILPYITFALPLAIYT

SEQ ID NO: 11526 - protein, 20 aa, Mycobacterium avium
LGLFPLFVMFIITAITMQRE

SEQ ID NO: 11527 - protein, 17 aa, Mycobacterium avium
LGLIVFICVVALTFSLA

SEQ ID NO: 11528 - protein, 20 aa, Mycobacterium avium
LGPVPIRAYALFIIAGIVAA

SEQ ID NO: 11529 - protein, 17 aa, Mycobacterium avium
LGQRQRLGLARALGSRA

SEQ ID NO: 11530 - protein, 20 aa, Mycobacterium avium
LGRDHWKSGVGYALAAVAVV

SEQ ID NO: 11531 - protein, 26 aa, Mycobacterium avium
LGSALALAGVSAWLITRAWQMPPVLD

SEQ ID NO: 11532 - protein, 20 aa, Mycobacterium avium
LGSLLHREGPLAPPRAIAII

SEQ ID NO: 11533 - protein, 24 aa, Mycobacterium avium
LGTFNRYWLAAAFGVTALVLSAVY

SEQ ID NO: 11534 - protein, 19 aa, Mycobacterium avium
LGTRNWADIFAKVGADPDE

SEQ ID NO: 11535 - protein, 18 aa, Mycobacterium avium
LGWAGKLGLALSVGVLGG

SEQ ID NO: 11536 - protein, 21 aa, Mycobacterium avium
LGWKLLIPASLVWVLIAAVIR

SEQ ID NO: 11537 - protein, 22 aa, Mycobacterium avium
LHEVPILSGLGLTMTGARPGGF

SEQ ID NO: 11538 - protein, 17 aa, Mycobacterium avium
LHIGYPIALDNDYATWN

SEQ ID NO: 11539 - protein, 34 aa, Mycobacterium avium
LHPIFRPGVLTYEFWLKAGIVALGSRFVLGDIAK

SEQ ID NO: 11540 - protein, 20 aa, Mycobacterium avium
LHRAKGGGLSTLFGGGVQSS

SEQ ID NO: 11541 - protein, 20 aa, Mycobacterium avium
LHRGDALVTFALKGNILLGS

SEQ ID NO: 11542 - protein, 20 aa, Mycobacterium avium
LHWAALRALLVLTVITGLAY

SEQ ID NO: 11543 - protein, 25 aa, Mycobacterium avium
LHYSDRLFAALSWFGAALSAAIVAG

SEQ ID NO: 11544 - protein, 24 aa, Mycobacterium avium
LIAVCCYVALVVTNFAWLFPVLTG

SEQ ID NO: 11545 - protein, 27 aa, Mycobacterium avium
LICALSIGAAAVFAWLLAAFAVRPFKR

SEQ ID NO: 11546 - protein, 25 aa, Mycobacterium avium
LIDVLHWPGYLLVVAGVVGACGSLA

SEQ ID NO: 11547 - protein, 19 aa, Mycobacterium avium
LIEGGTLRELLGERGPMPP

SEQ ID NO: 11548 - protein, 25 aa, Mycobacterium avium
LIFGCVGLIALVFVKVFGAAAPGGD

SEQ ID NO: 11549 - protein, 27 aa, Mycobacterium avium
LIGHRNRLAAMFAWGISFLGRTRGQMA

SEQ ID NO: 11550 - protein, 29 aa, Mycobacterium avium
LIGLSMLGELPWWITVLILAREFGVTVLR

SEQ ID NO: 11551 - protein, 24 aa, Mycobacterium avium
LIHWPESWPLVSLSPTVEPFVVFG

SEQ ID NO: 11552 - protein, 34 aa, Mycobacterium avium
LITALCLFTAVFIMLRRKRIPGVARGPAWRLMGV

SEQ ID NO: 11553 - protein, 17 aa, Mycobacterium avium
LIVGLGVGLAISAGTAW

SEQ ID NO: 11554 - protein, 19 aa, Mycobacterium avium
LIVLGGRLVTPWAHAVRGG

SEQ ID NO: 11555 - protein, 17 aa, Mycobacterium avium
LIWQHLIGIELHWMVLA

SEQ ID NO: 11556 - protein, 21 aa, Mycobacterium avium
LKAIVFGAIVAIVSSQKGLST

SEQ ID NO: 11557 - protein, 19 aa, Mycobacterium avium
LKFAMFMLAEYVNMMTVSS

SEQ ID NO: 11558 - protein, 20 aa, Mycobacterium avium
LKGNWYLLGPAFVAAIAYVD

SEQ ID NO: 11559 - protein, 20 aa, Mycobacterium avium
LKITYGWSLLLIVVFSVLCY

SEQ ID NO: 11560 - protein, 27 aa, Mycobacterium avium
LKLQFGDGWWTSPLFLCIWITGTSILM

SEQ ID NO: 11561 - protein, 17 aa, Mycobacterium avium
LKRLCVGGVERVFELGR

SEQ ID NO: 11562 - protein, 22 aa, Mycobacterium avium
LLAGIALLVSRQVVVPVRSASR

SEQ ID NO: 11563 - protein, 18 aa, Mycobacterium avium
LLAMRIAATRGYWPAILI

SEQ ID NO: 11564 - protein, 19 aa, Mycobacterium avium
LLANIGFALVMFVVGTHVP

SEQ ID NO: 11565 - protein, 25 aa, Mycobacterium avium
LLDLGCGRGAVLLAAAKRLPRGRAI

SEQ ID NO: 11566 - protein, 20 aa, Mycobacterium avium
LLDVLRRVATDFDRIQKEAS

SEQ ID NO: 11567 - protein, 23 aa, Mycobacterium avium
LLEIIMIVGALHFKESRGRGNIS

SEQ ID NO: 11568 - protein, 17 aa, Mycobacterium avium
LLFLPPAWLLGTTMLGL

SEQ ID NO: 11569 - protein, 18 aa, Mycobacterium avium
LLFSIAMTGYILLAVHLE

SEQ ID NO: 11570 - protein, 21 aa, Mycobacterium avium
LLFSPAAVRWAAGGQDDSASS

SEQ ID NO: 11571 - protein, 17 aa, Mycobacterium avium
LLFSYAPFEYVLKNIAV

SEQ ID NO: 11572 - protein, 25 aa, Mycobacterium avium
LLGDQRLGGGIAWSAGEFPLVIVML

SEQ ID NO: 11573 - protein, 19 aa, Mycobacterium avium
LLGPLRFVGLSNWRSVLTD

SEQ ID NO: 11574 - protein, 19 aa, Mycobacterium avium
LLGQFSFGVLMLRIEETAL

SEQ ID NO: 11575 - protein, 18 aa, Mycobacterium avium
LLHGLLMHSGNDAAHALA

SEQ ID NO: 11576 - protein, 17 aa, Mycobacterium avium
LLIFLFWPWEYKPKEAA

SEQ ID NO: 11577 - protein, 23 aa, Mycobacterium avium
LLIPCLLLAWAVSHPGIPFGVLV

SEQ ID NO: 11578 - protein, 17 aa, Mycobacterium avium
LLIVIGIQLLKPAHIET

SEQ ID NO: 11579 - protein, 19 aa, Mycobacterium avium
LLLARAVISPARIVLLDEP

SEQ ID NO: 11580 - protein, 24 aa, Mycobacterium avium
LLLGWGVFCNYGLMLMGLPAAAVL

SEQ ID NO: 11581 - protein, 25 aa, Mycobacterium avium
LLLNYYLIAPRHSFTIAEPNSAITE

SEQ ID NO: 11582 - protein, 18 aa, Mycobacterium avium
LLLPVMVVCGFLLGVTGQ

SEQ ID NO: 11583 - protein, 30 aa, Mycobacterium avium
LLMPSIATLLGRWFWWPMVVHPRGDNARRP

SEQ ID NO: 11584 - protein, 21 aa, Mycobacterium avium
LLNGVVLKFAMRTMNNTFASA

SEQ ID NO: 11585 - protein, 27 aa, Mycobacterium avium
LLPGPAWLRRWWLAVVVAAAATIWLEP

SEQ ID NO: 11586 - protein, 19 aa, Mycobacterium avium
LLPNLFERFVRADKSRSDG

SEQ ID NO: 11587 - protein, 21 aa, Mycobacterium avium
LLPVRTHRIWLALNAVGALAV

SEQ ID NO: 11588 - protein, 17 aa, Mycobacterium avium
LLQISYGVVVTVDVADG

SEQ ID NO: 11589 - protein, 21 aa, Mycobacterium avium
LLREHFRMIPNDLVNAARLDG

SEQ ID NO: 11590 - protein, 25 aa, Mycobacterium avium
LLRVEVPNALPLILGGLRSATLQVV

SEQ ID NO: 11591 - protein, 27 aa, Mycobacterium avium
LLTGGRFRLGIGLGWNAVEYEALGETF

SEQ ID NO: 11592 - protein, 18 aa, Mycobacterium avium
LLTLFAGSVLRGADLETL

SEQ ID NO: 11593 - protein, 17 aa, Mycobacterium avium
LLTLPGYRTNYNDRNYL

SEQ ID NO: 11594 - protein, 34 aa, Mycobacterium avium
LLVIAILVAWRWVPARLAIVPGPLVAIVVVTIIS

SEQ ID NO: 11595 - protein, 26 aa, Mycobacterium avium
LLVLLKAVAYWLDRYELLSHTRGGKP

SEQ ID NO: 11596 - protein, 25 aa, Mycobacterium avium
LLVSIPFTVLVAFTLNILLREIGAA

SEQ ID NO: 11597 - protein, 36 aa, Mycobacterium avium
LLVVLGVSVLLTFFPGWVTVGLMLALLVAAARLAHI

SEQ ID NO: 11598 - protein, 28 aa, Mycobacterium avium
LLVYVLPLLLLVGLFVMFSRMQGGARMG

SEQ ID NO: 11599 - protein, 20 aa, Mycobacterium avium
LMAVGGIPILLGPIGGPILG

SEQ ID NO: 11600 - protein, 18 aa, Mycobacterium avium
LMENMGYRLVLKARTAGA

SEQ ID NO: 11601 - protein, 24 aa, Mycobacterium avium
LMIANPFRAGERIGSLFSTHPPIE

SEQ ID NO: 11602 - protein, 17 aa, Mycobacterium avium
LMLALLVAAARLAHIPR

SEQ ID NO: 11603 - protein, 24 aa, Mycobacterium avium
LNARLRGTVRLRIIYANGRGVLRE

SEQ ID NO: 11604 - protein, 24 aa, Mycobacterium avium
LNERELRAVLGHELSHVYNRDILI

SEQ ID NO: 11605 - protein, 26 aa, Mycobacterium avium
LNMIGRAIGSYGDFVNFYACDITLKI

SEQ ID NO: 11606 - protein, 25 aa, Mycobacterium avium
LNPLNWPPAFFSWFAAGMLLAEWVH

SEQ ID NO: 11607 - protein, 23 aa, Mycobacterium avium
LNVDKAKSVIVLKRSMNSGFAGI

SEQ ID NO: 11608 - protein, 18 aa, Mycobacterium avium
LPAAPAYEAAVGLRRVAI

SEQ ID NO: 11609 - protein, 17 aa, Mycobacterium avium
LPATFGLDQLRELAAQD

SEQ ID NO: 11610 - protein, 22 aa, Mycobacterium avium
LPDDLLSGIGLRAALSSITLGM

SEQ ID NO: 11611 - protein, 22 aa, Mycobacterium avium
LPGRGWNIFLGVISLLAGIVVL

SEQ ID NO: 11612 - protein, 25 aa, Mycobacterium avium
LPHSLRPGPDWEPLGMLLAGAVLIT

SEQ ID NO: 11613 - protein, 32 aa, Mycobacterium avium
LPILVAVGPWLFLRLRFFRRKLTVTALAATPA

SEQ ID NO: 11614 - protein, 20 aa, Mycobacterium avium
LPKVDFEFDPAVRRLFARVP

SEQ ID NO: 11615 - protein, 17 aa, Mycobacterium avium
LPLLAFALAGRRVAQRV

SEQ ID NO: 11616 - protein, 22 aa, Mycobacterium avium
LPLRSRDRLPLMNTLLGPNEDA

SEQ ID NO: 11617 - protein, 17 aa, Mycobacterium avium
LPPDELRAWIASHAPDP

SEQ ID NO: 11618 - protein, 25 aa, Mycobacterium avium
LPPPTWRIPVTVVAVLIALVITGAV

SEQ ID NO: 11619 - protein, 19 aa, Mycobacterium avium
LPRSLPLADGLSRMRRSNS

SEQ ID NO: 11620 - protein, 17 aa, Mycobacterium avium
LPTPLSVHVYRLVWRQM

SEQ ID NO: 11621 - protein, 24 aa, Mycobacterium avium
LPTYGFVRQHFWLPGGSTGSSDVA

SEQ ID NO: 11622 - protein, 18 aa, Mycobacterium avium
LPVWKKLRAGDWAPSADG

SEQ ID NO: 11623 - protein, 17 aa, Mycobacterium avium
LQIMPLFFFAGAAACVS

SEQ ID NO: 11624 - protein, 22 aa, Mycobacterium avium
LQIPSLVGIGRYTLKAELPASG

SEQ ID NO: 11625 - protein, 17 aa, Mycobacterium avium
LQVAYVLSMHPPVLAAI

SEQ ID NO: 11626 - protein, 22 aa, Mycobacterium avium
LQVNHPLRLGGDRVYLQGHGYA

SEQ ID NO: 11627 - protein, 18 aa, Mycobacterium avium
LRAGQTLQGQHVMVEINT

SEQ ID NO: 11628 - protein, 32 aa, Mycobacterium avium
LRALARERGWEIRDFRTARKAARIGVPSALAL

SEQ ID NO: 11629 - protein, 20 aa, Mycobacterium avium
LRDRVFQLLALAWMVTVGAA

SEQ ID NO: 11630 - protein, 18 aa, Mycobacterium avium
LREVHALLYHEVFDTLGS

SEQ ID NO: 11631 - protein, 17 aa, Mycobacterium avium
LRGPFAAAMSQSVLLPA

SEQ ID NO: 11632 - protein, 21 aa, Mycobacterium avium
LRIVDCPDRRISRSAQLMVAK

SEQ ID NO: 11633 - protein, 17 aa, Mycobacterium avium
LRLRVETQVGFKMAKWI

SEQ ID NO: 11634 - protein, 18 aa, Mycobacterium avium
LRNPAGLIAIERITRHIM

SEQ ID NO: 11635 - protein, 26 aa, Mycobacterium avium
LRNPSWRPGVWLCSLAVAAGWGGILL

SEQ ID NO: 11636 - protein, 24 aa, Mycobacterium avium
LRPDRNLYVPLAFHLGYHSVPIGG

SEQ ID NO: 11637 - protein, 18 aa, Mycobacterium avium
LRQISDYVARHHDSVGAD

SEQ ID NO: 11638 - protein, 20 aa, Mycobacterium avium
LRQLRWALSEVQRGNYNAHM

SEQ ID NO: 11639 - protein, 22 aa, Mycobacterium avium
LRRDRTSFIIAHRLSTIRDADR

SEQ ID NO: 11640 - protein, 17 aa, Mycobacterium avium
LRRGIGTFQLTMFGVGS

SEQ ID NO: 11641 - protein, 23 aa, Mycobacterium avium
LRRPQYRPLWVFLLLPVLILLTV

SEQ ID NO: 11642 - protein, 29 aa, Mycobacterium avium
LRSALLRKLSRLPLGWFTARGSGSIKQLL

SEQ ID NO: 11643 - protein, 17 aa, Mycobacterium avium
LRSRVVRIMPAYLVAVV

SEQ ID NO: 11644 - protein, 18 aa, Mycobacterium avium
LRSVMAPPVLLVATMLGA

SEQ ID NO: 11645 - protein, 26 aa, Mycobacterium avium
LRVVHRSKCGYLWSHHLPIARRAGLS

SEQ ID NO: 11646 - protein, 23 aa, Mycobacterium avium
LSAARGMVAFLGYYKIIGLSTFA

SEQ ID NO: 11647 - protein, 21 aa, Mycobacterium avium
LSACRLRPGHVGIVFTRPRAS

SEQ ID NO: 11648 - protein, 20 aa, Mycobacterium avium
LSAHLGRTVGVLFAIILLDA

SEQ ID NO: 11649 - protein, 25 aa, Mycobacterium avium
LSATFLFRQQRLWGASTVVASWQLV

SEQ ID NO: 11650 - protein, 26 aa, Mycobacterium avium
LSDLFCTPDRCPLIVGNTLVFRDDNH

SEQ ID NO: 11651 - protein, 35 aa, Mycobacterium avium
LSFTRMPIFQTMGLPCSVGMLISVFIALTLVPAVL

SEQ ID NO: 11652 - protein, 17 aa, Mycobacterium avium
LSGGYVFSVFLQGVNPG

SEQ ID NO: 11653 - protein, 18 aa, Mycobacterium avium
LSGVVAFLGAVLVLAKLC

SEQ ID NO: 11654 - protein, 18 aa, Mycobacterium avium
LSHRAVTAGEWVWAALLT

SEQ ID NO: 11655 - protein, 28 aa, Mycobacterium avium
LSIPLCVLCAGLALNGWVGYFPTVLAAW

SEQ ID NO: 11656 - protein, 22 aa, Mycobacterium avium
LSLTAAFGAMVWIFQDGHLGAL

SEQ ID NO: 11657 - protein, 21 aa, Mycobacterium avium
LSLTLAVLIARSFSTQRSMFV

SEQ ID NO: 11658 - protein, 19 aa, Mycobacterium avium
LSMLVPILLALGAPVTLAL

SEQ ID NO: 11659 - protein, 19 aa, Mycobacterium avium
LSMTLPILIPFVYFSHALN

SEQ ID NO: 11660 - protein, 31 aa, Mycobacterium avium
LSNAMGWNFTAAKNMFAWIGPVLAALQGNPV

SEQ ID NO: 11661 - protein, 21 aa, Mycobacterium avium
LSNLLWRRVLRQHGVDAGVGE

SEQ ID NO: 11662 - protein, 21 aa, Mycobacterium avium
LSPAGEQFINFEAASDAGPYL

SEQ ID NO: 11663 - protein, 19 aa, Mycobacterium avium
LSSEQWFAFTPPRVPVTET

SEQ ID NO: 11664 - protein, 17 aa, Mycobacterium avium
LSSLRIVFVSGSQLGAE

SEQ ID NO: 11665 - protein, 18 aa, Mycobacterium avium
LSTIARRQVRLVVSDRGY

SEQ ID NO: 11666 - protein, 24 aa, Mycobacterium avium
LTALMVSTSLAWTGRLTPPGTFTA

SEQ ID NO: 11667 - protein, 29 aa, Mycobacterium avium
LTARALRILPGFYICLIVTAFVFAPLSVV

SEQ ID NO: 11668 - protein, 19 aa, Mycobacterium avium
LTCAIGFVFDAWLEIQLVH

SEQ ID NO: 11669 - protein, 17 aa, Mycobacterium avium
LTFGGLMLLGGRLGDTI

SEQ ID NO: 11670 - protein, 25 aa, Mycobacterium avium
LTFHIARPWRWGYLGVLFLIFGFPL

SEQ ID NO: 11671 - protein, 17 aa, Mycobacterium avium
LTGWRVIRAKIEAAQLD

SEQ ID NO: 11672 - protein, 22 aa, Mycobacterium avium
LTHGFFKAGLFLGSGAVIHAMH

SEQ ID NO: 11673 - protein, 27 aa, Mycobacterium avium
LTIAGACYCLTFARLNYFHTMGPAVAI

SEQ ID NO: 11674 - protein, 42 aa, Mycobacterium avium
LTIAGGYLLVLAMLYGWWCMHRGVPYFPNLVLPIVVGGIGIG

SEQ ID NO: 11675 - protein, 24 aa, Mycobacterium avium
LTLLRLVLVPVFLLALFAGDGHET

SEQ ID NO: 11676 - protein, 19 aa, Mycobacterium avium
LTLLVALPLAGMRIGFNEP

SEQ ID NO: 11677 - protein, 19 aa, Mycobacterium avium
LTLSRLMSGLASRLSPALA

SEQ ID NO: 11678 - protein, 23 aa, Mycobacterium avium
LTPGRPWAWLALVVAGLVVGIFI

SEQ ID NO: 11679 - protein, 18 aa, Mycobacterium avium
LVAEIGMGTGAMAVVGGT

SEQ ID NO: 11680 - protein, 18 aa, Mycobacterium avium
LVAGRLGDRFGTKNLYLI

SEQ ID NO: 11681 - protein, 17 aa, Mycobacterium avium
LVALPLSLGIAIASNAP

SEQ ID NO: 11682 - protein, 23 aa, Mycobacterium avium
LVAMGAAVTGWVTRLPAAPQTTR

SEQ ID NO: 11683 - protein, 19 aa, Mycobacterium avium
LVARPGTLTALIGGSGAGK

SEQ ID NO: 11684 - protein, 29 aa, Mycobacterium avium
LVAVFGMRLLFPLLIVWATAGLDPVRALE

SEQ ID NO: 11685 - protein, 21 aa, Mycobacterium avium
LVCAIGLSGGYVFSVFLQGVN

SEQ ID NO: 11686 - protein, 20 aa, Mycobacterium avium
LVDGLGWQWIFFVNVPIGVL

SEQ ID NO: 11687 - protein, 21 aa, Mycobacterium avium
LVFAPRFWVPIVAMAILVASH

SEQ ID NO: 11688 - protein, 19 aa, Mycobacterium avium
LVGASRWYTQLPFLVEAML

SEQ ID NO: 11689 - protein, 18 aa, Mycobacterium avium
LVGFRPWAHRDGGTDAFG

SEQ ID NO: 11690 - protein, 24 aa, Mycobacterium avium
LVGGGLLASFSLRSESALTDPGLD

SEQ ID NO: 11691 - protein, 19 aa, Mycobacterium avium
LVGGRLYHLATDWRTYWGP

SEQ ID NO: 11692 - protein, 17 aa, Mycobacterium avium
LVGGRWAQDLSVSAHRS

SEQ ID NO: 11693 - protein, 25 aa, Mycobacterium avium
LVGVPRGRIGIGLKLTNGRTAQAWA

SEQ ID NO: 11694 - protein, 17 aa, Mycobacterium avium
LVICLGALLWSFISPAG

SEQ ID NO: 11695 - protein, 26 aa, Mycobacterium avium
LVIVGWLTLWPFFGWLTTHFVVTNRR

SEQ ID NO: 11696 - protein, 17 aa, Mycobacterium avium
LVIVILVAWRWVPAKVR

SEQ ID NO: 11697 - protein, 17 aa, Mycobacterium avium
LVLAMTFGLSMDYEIFL

SEQ ID NO: 11698 - protein, 24 aa, Mycobacterium avium
LVLLATFLLGWGVVAPMAGSQLLR

SEQ ID NO: 11699 - protein, 19 aa, Mycobacterium avium
LVLWTLFWLGWVIALAATF

SEQ ID NO: 11700 - protein, 17 aa, Mycobacterium avium
LVMAFCFTTLSTYMRFK

SEQ ID NO: 11701 - protein, 24 aa, Mycobacterium avium
LVPNGTFFFVLAIFLIVLAVIGTF

SEQ ID NO: 11702 - protein, 21 aa, Mycobacterium avium
LVQYLRYLGGVLRGDLGRAYS

SEQ ID NO: 11703 - protein, 24 aa, Mycobacterium avium
LVRAAGWRLTRLVRHRSMDTVEER

SEQ ID NO: 11704 - protein, 28 aa, Mycobacterium avium
LVRGFARRRTGELGNFWVDLVRGTLRIL

SEQ ID NO: 11705 - protein, 17 aa, Mycobacterium avium
LVRPELALMGGLALIMM

SEQ ID NO: 11706 - protein, 17 aa, Mycobacterium avium
LVVAVVFVIIKLVQAGV

SEQ ID NO: 11707 - protein, 21 aa, Mycobacterium avium
LVVGFCWALFFNGFLGAKLGV

SEQ ID NO: 11708 - protein, 17 aa, Mycobacterium avium
LVVMDWLELSWRWLFGL

SEQ ID NO: 11709 - protein, 23 aa, Mycobacterium avium
LVVSDRGYTIFLAVLPFLIGALS

SEQ ID NO: 11710 - protein, 18 aa, Mycobacterium avium
LVVVVFPLLVFVLTRLNR

SEQ ID NO: 11711 - protein, 24 aa, Mycobacterium avium
LVWQYLLHMQLHWTVLSTSVIVLL

SEQ ID NO: 11712 - protein, 17 aa, Mycobacterium avium
LWICVLNPLVLIHLMGG

SEQ ID NO: 11713 - protein, 17 aa, Mycobacterium avium
LWLHLGWQDIKQRYRRS

SEQ ID NO: 11714 - protein, 27 aa, Mycobacterium avium
LWMARLLLFRVEFGAGLIKMRGDPCWR

SEQ ID NO: 11715 - protein, 23 aa, Mycobacterium avium
LWRMLVRRDWRYAAVLVGYCAGW

SEQ ID NO: 11716 - protein, 23 aa, Mycobacterium avium
LWSLFWEVMCYLVVAAIGVAGLA

SEQ ID NO: 11717 - protein, 21 aa, Mycobacterium avium
LWSTRRGETEYGLKAVPLGGF

SEQ ID NO: 11718 - protein, 18 aa, Mycobacterium avium
LWVAFWFFLAQLNLILGA

SEQ ID NO: 11719 - protein, 18 aa, Mycobacterium avium
LYAACLAIGYLSTQIVVS

SEQ ID NO: 11720 - protein, 17 aa, Mycobacterium avium
LYHCVERVAVARRISTV

SEQ ID NO: 11721 - protein, 20 aa, Mycobacterium avium
LYISPWLFVLGVSIAGLTAY

SEQ ID NO: 11722 - protein, 24 aa, Mycobacterium avium
LYQKERRFAIAFVIPAVALFVAGA

SEQ ID NO: 11723 - protein, 19 aa, Mycobacterium avium
LYTGTGAFEVVGRRRLWFG

SEQ ID NO: 11724 - protein, 19 aa, Mycobacterium avium
MAAMRKRPWLLGFLGLAVG

SEQ ID NO: 11725 - protein, 25 aa, Mycobacterium avium
MAIALICAAAVFSAITMRDLRIPAI

SEQ ID NO: 11726 - protein, 30 aa, Mycobacterium avium
MALSGPVAFWACGLLLCMFIGPSQSSSRAL

SEQ ID NO: 11727 - protein, 25 aa, Mycobacterium avium
MALVGWASGLGFGWIYTLGTANVVR

SEQ ID NO: 11728 - protein, 20 aa, Mycobacterium avium
MARPGFKAWWTRLVPATIER

SEQ ID NO: 11729 - protein, 27 aa, Mycobacterium avium
MASPPGPRIGAFFDLDGTLVAGFTAVI

SEQ ID NO: 11730 - protein, 17 aa, Mycobacterium avium
MAVPGVRAVQSASRPDG

SEQ ID NO: 11731 - protein, 18 aa, Mycobacterium avium
MAVVCLVLYFQFRNRNWL

SEQ ID NO: 11732 - protein, 22 aa, Mycobacterium avium
MDGFDPRAGVILIAATNRPDIL

SEQ ID NO: 11733 - protein, 37 aa, Mycobacterium avium
MDPKRTLQTRGWRRMGTAVVRWPAPVLAVTIAVALVG

SEQ ID NO: 11734 - protein, 24 aa, Mycobacterium avium
MEVMGVSVVRRLVVPRFAAAVMIG

SEQ ID NO: 11735 - protein, 18 aa, Mycobacterium avium
MFADVRFAGVVLPVVGWW

SEQ ID NO: 11736 - protein, 19 aa, Mycobacterium avium
MFDRITVPTLIIRGGENDM

SEQ ID NO: 11737 - protein, 17 aa, Mycobacterium avium
MFIEFSRQRALAADGRC

SEQ ID NO: 11738 - protein, 27 aa, Mycobacterium avium
MFMEELFWGCAGIGLAIVMPALALSAI

SEQ ID NO: 11739 - protein, 24 aa, Mycobacterium avium
MGHPGKRAPTVEICNSDQPFMPLA

SEQ ID NO: 11740 - protein, 19 aa, Mycobacterium avium
MGLHPLMFFLPMWHGADSM

SEQ ID NO: 11741 - protein, 26 aa, Mycobacterium avium
MGSATNWARTALLLVEPTSATLAVVD

SEQ ID NO: 11742 - protein, 18 aa, Mycobacterium avium
MHQVFLGTRSLLYFGGRG

SEQ ID NO: 11743 - protein, 17 aa, Mycobacterium avium
MIAQLVFAMGGRAAEEL

SEQ ID NO: 11744 - protein, 22 aa, Mycobacterium avium
MIFNVIWTYVLVRGSAVNNGTL

SEQ ID NO: 11745 - protein, 22 aa, Mycobacterium avium
MIFVICVASMFVAQAAVRPVRR

SEQ ID NO: 11746 - protein, 23 aa, Mycobacterium avium
MIGKCLRPLPNKWKGLTDPEARV

SEQ ID NO: 11747 - protein, 17 aa, Mycobacterium avium
MIGRFALVFAAGTLLHQ

SEQ ID NO: 11748 - protein, 17 aa, Mycobacterium avium
MIIVVFGQMRFDRTNGY

SEQ ID NO: 11749 - protein, 22 aa, Mycobacterium avium
MITGGAVLLVLLAGIALLVSRQ

SEQ ID NO: 11750 - protein, 20 aa, Mycobacterium avium
MLEWAPECFGTPGDLKLAAL

SEQ ID NO: 11751 - protein, 18 aa, Mycobacterium avium
MLLLVYRSVITVLLTLVM

SEQ ID NO: 11752 - protein, 24 aa, Mycobacterium avium
MLLRNRPWQVAAFLGVLLGGGTVV

SEQ ID NO: 11753 - protein, 23 aa, Mycobacterium avium
MLLTARLLLGLTIGVTVVVVPVY

SEQ ID NO: 11754 - protein, 18 aa, Mycobacterium avium
MLMFVYRSIGTVLLTMVI

SEQ ID NO: 11755 - protein, 26 aa, Mycobacterium avium
MLSYGWRIPLLLGLPFGLVALYLRLR

SEQ ID NO: 11756 - protein, 24 aa, Mycobacterium avium
MLVPLPLFFCHGGWPVTVAAVVMV

SEQ ID NO: 11757 - protein, 24 aa, Mycobacterium avium
MLYPEMVTKLVVWNIVGGIYGTFV

SEQ ID NO: 11758 - protein, 25 aa, Mycobacterium avium
MMESEFPSELSVLFKNLETKANPWG

SEQ ID NO: 11759 - protein, 23 aa, Mycobacterium avium
MMTRPRPVLQLLAFLAGGFAMGM

SEQ ID NO: 11760 - protein, 24 aa, Mycobacterium avium
MNNKCPLTSYVLMGFSQGAVIAGD

SEQ ID NO: 11761 - protein, 21 aa, Mycobacterium avium
MNSDKFVPIFTRLNRLSDKFF

SEQ ID NO: 11762 - protein, 23 aa, Mycobacterium avium
MPEVNRPDVPIVLRIYDRTLGDA

SEQ ID NO: 11763 - protein, 17 aa, Mycobacterium avium
MPISRLLVVLGNAVTPG

SEQ ID NO: 11764 - protein, 23 aa, Mycobacterium avium
MPPGLRQLAKWTGLVFGVLTLAV

SEQ ID NO: 11765 - protein, 23 aa, Mycobacterium avium
MRDLRIPAIGLVLLLLSSLIVGA

SEQ ID NO: 11766 - protein, 23 aa, Mycobacterium avium
MRFKDLELRYARLARAVALESAL

SEQ ID NO: 11767 - protein, 20 aa, Mycobacterium avium
MRKMHAVAVPPSWAAPLLAV

SEQ ID NO: 11768 - protein, 17 aa, Mycobacterium avium
MRKVIWPNRKQMLTYTS

SEQ ID NO: 11769 - protein, 17 aa, Mycobacterium avium
MRRPWMSALAASLVLLV

SEQ ID NO: 11770 - protein, 31 aa, Mycobacterium avium
MRTSTFVLIVAFLLVWWVYDTYRPEPAPKPP

SEQ ID NO: 11771 - protein, 24 aa, Mycobacterium avium
MSLSGFEHSWFFLFLLVVAGLAAL

SEQ ID NO: 11772 - protein, 25 aa, Mycobacterium avium
MSRFWQRMFLTIGILVAVFGMRLLF

SEQ ID NO: 11773 - protein, 20 aa, Mycobacterium avium
MSRGDLDRTLLLWVLPLLIA

SEQ ID NO: 11774 - protein, 17 aa, Mycobacterium avium
MSYWPIRNMLSSRQRMN

SEQ ID NO: 11775 - protein, 23 aa, Mycobacterium avium
MTAGAALVMWMGELITERGIGNG

SEQ ID NO: 11776 - protein, 30 aa, Mycobacterium avium
MTPTIAALLGRWFWWPQLVRRRPASQLLRS

SEQ ID NO: 11777 - protein, 18 aa, Mycobacterium avium
MVDALGGVEVCSSTPLHD

SEQ ID NO: 11778 - protein, 26 aa, Mycobacterium avium
MVHLARIFFTGAFRRPREANWVIGSL

SEQ ID NO: 11779 - protein, 19 aa, Mycobacterium avium
MVPEGLVLLTSVAFAVGVV

SEQ ID NO: 11780 - protein, 23 aa, Mycobacterium avium
MVPITAAVMLRAQVPEARAALDA

SEQ ID NO: 11781 - protein, 17 aa, Mycobacterium avium
MVVGMLFTSTGSGTIVG

SEQ ID NO: 11782 - protein, 20 aa, Mycobacterium avium
MVVHVIRGDGLAGLSESRMA

SEQ ID NO: 11783 - protein, 17 aa, Mycobacterium avium
MVVRLGAVTGVGHARLI

SEQ ID NO: 11784 - protein, 26 aa, Mycobacterium avium
MVYTETKLNSAFAFGGPKCLVKEIQK

SEQ ID NO: 11785 - protein, 17 aa, Mycobacterium avium
NAIWKAFDLFVGAIQAF

SEQ ID NO: 11786 - protein, 23 aa, Mycobacterium avium
NALDFFCAVIIVGVLAGIAGVAT

SEQ ID NO: 11787 - protein, 29 aa, Mycobacterium avium
NAPNVPLIDSWMCAISGRAKQFGMIQYFK

SEQ ID NO: 11788 - protein, 24 aa, Mycobacterium avium
NARGEVVSLGFLISLWAGSSAISA

SEQ ID NO: 11789 - protein, 18 aa, Mycobacterium avium
NCTLREAVRAGSVRFGRA

SEQ ID NO: 11790 - protein, 23 aa, Mycobacterium avium
NDGKEVPANLVGRDPKTDLAVLK

SEQ ID NO: 11791 - protein, 18 aa, Mycobacterium avium
NDVDFVWITDFQPYQPQL

SEQ ID NO: 11792 - protein, 20 aa, Mycobacterium avium
NDVLNAWAMSIVLWGVLIAV

SEQ ID NO: 11793 - protein, 18 aa, Mycobacterium avium
NEQITMTRFYAAQRTFWV

SEQ ID NO: 11794 - protein, 26 aa, Mycobacterium avium
NFAADLGWRLAFGIGAILGIFVLLVR

SEQ ID NO: 11795 - protein, 19 aa, Mycobacterium avium
NFDGVRANTIWEIRDSGTV

SEQ ID NO: 11796 - protein, 23 aa, Mycobacterium avium
NFGDMRSAFYAGYEESDREHVLI

SEQ ID NO: 11797 - protein, 26 aa, Mycobacterium avium
NFHFMPELNWTWGYPAVMAGMAVVCL

SEQ ID NO: 11798 - protein, 17 aa, Mycobacterium avium
NGFPALASFVAEDRFLP

SEQ ID NO: 11799 - protein, 22 aa, Mycobacterium avium
NGGRLSPQRAVAVIEQVAAALD

SEQ ID NO: 11800 - protein, 19 aa, Mycobacterium avium
NGIPVCPGCTLGGRVGGSQ

SEQ ID NO: 11801 - protein, 24 aa, Mycobacterium avium
NGKKAVLWTSGWTPRYPGETIYLA

SEQ ID NO: 11802 - protein, 24 aa, Mycobacterium avium
NGSRKWFVVAGFSMQPSELAKIAF

SEQ ID NO: 11803 - protein, 19 aa, Mycobacterium avium
NGSVRARFLTDRLLFDSQY

SEQ ID NO: 11804 - protein, 19 aa, Mycobacterium avium
NINPILSCGSVMITPQASL

SEQ ID NO: 11805 - protein, 28 aa, Mycobacterium avium
NIPVLLFCIAFGLAMDYEVFLVSRIHEY

SEQ ID NO: 11806 - protein, 23 aa, Mycobacterium avium
NKPSMPYRLRVIVHEDDAGRMTG

SEQ ID NO: 11807 - protein, 20 aa, Mycobacterium avium
NKRKQWIIVGAVALVALVAF

SEQ ID NO: 11808 - protein, 24 aa, Mycobacterium avium
NLETRPDAVFVVGSGIDIPLIKPA

SEQ ID NO: 11809 - protein, 26 aa, Mycobacterium avium
NLHDELFDACGWRRLVFATPEELEAT

SEQ ID NO: 11810 - protein, 27 aa, Mycobacterium avium
NLLQMAFRFWAFRRWVFPDQFARDPDK

SEQ ID NO: 11811 - protein, 28 aa, Mycobacterium avium
NLPLLFVGVGLLWFGWFGFNAGSALAAN

SEQ ID NO: 11812 - protein, 18 aa, Mycobacterium avium
NLRGKWRVTPGVAATGHF

SEQ ID NO: 11813 - protein, 23 aa, Mycobacterium avium
NLSPLVAAGACYLILTVPLTHLV

SEQ ID NO: 11814 - protein, 24 aa, Mycobacterium avium
NLTALTWVRFGIWLVVGTAIYAGY

SEQ ID NO: 11815 - protein, 22 aa, Mycobacterium avium
NMKYQPDWVPRYACYEDARLIP

SEQ ID NO: 11816 - protein, 25 aa, Mycobacterium avium
NNERAHPGFVRRVLSSALPSGLIVG

SEQ ID NO: 11817 - protein, 19 aa, Mycobacterium avium
NNTRWVLIAIALTRIGAVL

SEQ ID NO: 11818 - protein, 25 aa, Mycobacterium avium
NPIDLLWSFLQAILMALTILLIHTY

SEQ ID NO: 11819 - protein, 20 aa, Mycobacterium avium
NPLYAFLLMVLFQYGVALHE

SEQ ID NO: 11820 - protein, 23 aa, Mycobacterium avium
NPREIKLAASYFLVTPLIVLTGT

SEQ ID NO: 11821 - protein, 19 aa, Mycobacterium avium
NPVVFCLAVAAATVPLAAA

SEQ ID NO: 11822 - protein, 18 aa, Mycobacterium avium
NQLQRITWIITMYLLGYI

SEQ ID NO: 11823 - protein, 23 aa, Mycobacterium avium
NQNRIRWGNLLTLPVGQGGLLYV

SEQ ID NO: 11824 - protein, 23 aa, Mycobacterium avium
NQRNGIDPIWWAPTLFIVIGGLV

SEQ ID NO: 11825 - protein, 21 aa, Mycobacterium avium
NRDRVALQAVHFFMADMEAGM

SEQ ID NO: 11826 - protein, 18 aa, Mycobacterium avium
NRHFPFVISTMLANNPFI

SEQ ID NO: 11827 - protein, 17 aa, Mycobacterium avium
NSALVLVAATSRITNAA

SEQ ID NO: 11828 - protein, 24 aa, Mycobacterium avium
NSAVTFRYFYNGAYQQAYLARGAR

SEQ ID NO: 11829 - protein, 26 aa, Mycobacterium avium
NSRIPGDSVVAWWVRLVMPALAVVAV

SEQ ID NO: 11830 - protein, 18 aa, Mycobacterium avium
NSVDAVWHQLMPRYTRPH

SEQ ID NO: 11831 - protein, 17 aa, Mycobacterium avium
NTPADWLGPGGAFTAID

SEQ ID NO: 11832 - protein, 22 aa, Mycobacterium avium
NTQPGWIVAPGMQGQQVGPITA

SEQ ID NO: 11833 - protein, 25 aa, Mycobacterium avium
NTRSFTGAVVWLGIASFAAAGVVGL

SEQ ID NO: 11834 - protein, 17 aa, Mycobacterium avium
NVQQCIKEASGGAAGQI

SEQ ID NO: 11835 - protein, 25 aa, Mycobacterium avium
NYGGDAWVIRDGRRSRIDATNRSVL

SEQ ID NO: 11836 - protein, 24 aa, Mycobacterium avium
NYLSLASPFAFSGLSFFHTIEYQM

SEQ ID NO: 11837 - protein, 23 aa, Mycobacterium avium
PADARGRIAGLFTTSFMVGAVGG

SEQ ID NO: 11838 - protein, 18 aa, Mycobacterium avium
PAGVHFRPFLAALGASLF

SEQ ID NO: 11839 - protein, 18 aa, Mycobacterium avium
PAIARWAQRPRVWWWTAI

SEQ ID NO: 11840 - protein, 17 aa, Mycobacterium avium
PAKLGMLGSVLITLGGL

SEQ ID NO: 11841 - protein, 24 aa, Mycobacterium avium
PALAKAFLRFNVHLLTASTLPPRV

SEQ ID NO: 11842 - protein, 21 aa, Mycobacterium avium
PALNALFPDYRGSVLDAVTSV

SEQ ID NO: 11843 - protein, 23 aa, Mycobacterium avium
PALRATLLYPRGTVVMATEGPNT

SEQ ID NO: 11844 - protein, 17 aa, Mycobacterium avium
PALSQRVHWLSKRLSIQ

SEQ ID NO: 11845 - protein, 18 aa, Mycobacterium avium
PAQTGSPLLSYGAPTSPT

SEQ ID NO: 11846 - protein, 22 aa, Mycobacterium avium
PARTAAPIFAARIVLGGLAGAA

SEQ ID NO: 11847 - protein, 21 aa, Mycobacterium avium
PASGRAAVLGAMAIDRPTLYL

SEQ ID NO: 11848 - protein, 30 aa, Mycobacterium avium
PASIYPPCPFKWLTGWNCPFCGGLRMTHDL

SEQ ID NO: 11849 - protein, 25 aa, Mycobacterium avium
PATAVYVCGPTAMLEAVRTARDEHA

SEQ ID NO: 11850 - protein, 17 aa, Mycobacterium avium
PATEAFVPPGQDNTTQF

SEQ ID NO: 11851 - protein, 27 aa, Mycobacterium avium
PATGARLRWVPSQGPSAMPAQGLESAD

SEQ ID NO: 11852 - protein, 18 aa, Mycobacterium avium
PAVLSVLVLEDFAMAAYL

SEQ ID NO: 11853 - protein, 24 aa, Mycobacterium avium
PAYSHNFYLWWLAKAGAVGMAAFV

SEQ ID NO: 11854 - protein, 19 aa, Mycobacterium avium
PCLTGFIPASEWRSPADTS

SEQ ID NO: 11855 - protein, 24 aa, Mycobacterium avium
PDARRRAAGFIGFAIGGPLSDGLT

SEQ ID NO: 11856 - protein, 24 aa, Mycobacterium avium
PDDVFWSFLEAIIITAVVMITHCF

SEQ ID NO: 11857 - protein, 19 aa, Mycobacterium avium
PDGNYPCSIRVEPLSAGYS

SEQ ID NO: 11858 - protein, 24 aa, Mycobacterium avium
PDGSHGMYSWLHFSLATAVALVAW

SEQ ID NO: 11859 - protein, 25 aa, Mycobacterium avium
PDILDPALLRPGRFDRQIPVSNPDL

SEQ ID NO: 11860 - protein, 19 aa, Mycobacterium avium
PDLVASVGSLARLSDRLSA

SEQ ID NO: 11861 - protein, 17 aa, Mycobacterium avium
PDPEWVTVLSWQGRMQN

SEQ ID NO: 11862 - protein, 25 aa, Mycobacterium avium
PDPSDDRRVLAYTYRGGWGDPTSSA

SEQ ID NO: 11863 - protein, 20 aa, Mycobacterium avium
PDTSIAWSFVLALLAAALTA

SEQ ID NO: 11864 - protein, 22 aa, Mycobacterium avium
PDYRVVAALPLAYAVVVSGSLL

SEQ ID NO: 11865 - protein, 28 aa, Mycobacterium avium
PELGTTIGLLPAWKIVLILLVLAVLGLR

SEQ ID NO: 11866 - protein, 21 aa, Mycobacterium avium
PELSDSALVSRSWAMAFATLV

SEQ ID NO: 11867 - protein, 19 aa, Mycobacterium avium
PELYACILVALGGVVWSQA

SEQ ID NO: 11868 - protein, 17 aa, Mycobacterium avium
PEPVMRLAMKVLRPPGR

SEQ ID NO: 11869 - protein, 21 aa, Mycobacterium avium
PERRHQVVIIGSGFGGLNAAK

SEQ ID NO: 11870 - protein, 27 aa, Mycobacterium avium
PESWQGTYRIAFWVGVGLAVLVTLLSL

SEQ ID NO: 11871 - protein, 25 aa, Mycobacterium avium
PESYSLPVRRLVGFVATGLDASLIP

SEQ ID NO: 11872 - protein, 19 aa, Mycobacterium avium
PETFNVIFVDMKFESAAQD

SEQ ID NO: 11873 - protein, 19 aa, Mycobacterium avium
PETLSAAGWYVVGATAATS

SEQ ID NO: 11874 - protein, 19 aa, Mycobacterium avium
PEVTLRFIGSYLGGIAAGL

SEQ ID NO: 11875 - protein, 22 aa, Mycobacterium avium
PEVVQPYLPIAVVAALDAVFGG

SEQ ID NO: 11876 - protein, 26 aa, Mycobacterium avium
PEVYPLADAQLGLWVDNGVALHLHSG

SEQ ID NO: 11877 - protein, 23 aa, Mycobacterium avium
PFADPGNPLAILVPLTAAALDLV

SEQ ID NO: 11878 - protein, 31 aa, Mycobacterium avium
PFAGALMDRWDRRLVLVGANVGRLVLIAAIG

SEQ ID NO: 11879 - protein, 19 aa, Mycobacterium avium
PFLEKRFSGDYAHHNLLQR

SEQ ID NO: 11880 - protein, 21 aa, Mycobacterium avium
PFLLIMGGFMYFASRRQRRAM

SEQ ID NO: 11881 - protein, 25 aa, Mycobacterium avium
PFVMLGAGLLWFGWYGFNAGSATSS

SEQ ID NO: 11882 - protein, 18 aa, Mycobacterium avium
PFVVFGYVTFYFGPYFPA

SEQ ID NO: 11883 - protein, 31 aa, Mycobacterium avium
PGERPLLVARPVRPPRGWLLPLAGTAAALLM

SEQ ID NO: 11884 - protein, 26 aa, Mycobacterium avium
PGFDPRASRASDEWTPETGEEPDGGF

SEQ ID NO: 11885 - protein, 18 aa, Mycobacterium avium
PGGFGDLNAKTNEICAPG

SEQ ID NO: 11886 - protein, 17 aa, Mycobacterium avium
PGGFGFGLGNLILLGNV

SEQ ID NO: 11887 - protein, 18 aa, Mycobacterium avium
PGKRLVDAIIDLPFALPT

SEQ ID NO: 11888 - protein, 18 aa, Mycobacterium avium
PGLPRYFAAYVLGLSAAC

SEQ ID NO: 11889 - protein, 19 aa, Mycobacterium avium
PGPLSWFFHHLPKPLHRIE

SEQ ID NO: 11890 - protein, 18 aa, Mycobacterium avium
PGTLTALIGGSGAGKTTL

SEQ ID NO: 11891 - protein, 17 aa, Mycobacterium avium
PGTLTALVGPSGSGKST

SEQ ID NO: 11892 - protein, 27 aa, Mycobacterium avium
PGVGSCFRLTLPLVRGHKVTTSPLPMK

SEQ ID NO: 11893 - protein, 27 aa, Mycobacterium avium
PHACKLWPLVFARVAASLVVFAMAGTS

SEQ ID NO: 11894 - protein, 24 aa, Mycobacterium avium
PHEECEVLVGLGMRTWADGRTLLL

SEQ ID NO: 11895 - protein, 18 aa, Mycobacterium avium
PHSSEIRNADVLRMVIGG

SEQ ID NO: 11896 - protein, 17 aa, Mycobacterium avium
PHYGELKGPSCFTAPLI

SEQ ID NO: 11897 - protein, 18 aa, Mycobacterium avium
PIDRCAKTTPVQRLWEAL

SEQ ID NO: 11898 - protein, 19 aa, Mycobacterium avium
PIGDWLSRSVFAAKFAERN

SEQ ID NO: 11899 - protein, 29 aa, Mycobacterium avium
PIHELWAGTKLLVVFAMSLLLTVFPGWVA

SEQ ID NO: 11900 - protein, 21 aa, Mycobacterium avium
PIIGRWDALGFLQDFFATAVF

SEQ ID NO: 11901 - protein, 24 aa, Mycobacterium avium
PILPVRLFASPVFTVCCVLSFVVG

SEQ ID NO: 11902 - protein, 26 aa, Mycobacterium avium
PIVGRVRPRLYLALGPPALSISLLSF

SEQ ID NO: 11903 - protein, 21 aa, Mycobacterium avium
PIYYPRYLIFTAPAMAIVLAV

SEQ ID NO: 11904 - protein, 19 aa, Mycobacterium avium
PKAGYLVDYYRYFGTTDAP

SEQ ID NO: 11905 - protein, 25 aa, Mycobacterium avium
PKDAKAIIMSPNLVAARFIQLTPAY

SEQ ID NO: 11906 - protein, 19 aa, Mycobacterium avium
PLAAIVFCPFAWMHMPTAS

SEQ ID NO: 11907 - protein, 18 aa, Mycobacterium avium
PLAIGMVVVVAAALTLGP

SEQ ID NO: 11908 - protein, 26 aa, Mycobacterium avium
PLARKGYPSLYAWMFGLVVTELPLQT

SEQ ID NO: 11909 - protein, 30 aa, Mycobacterium avium
PLARKGYSTVLVFWFGWPASEVPGIYFSAS

SEQ ID NO: 11910 - protein, 23 aa, Mycobacterium avium
PLDQPRVYFGPVISNTSADYAIV

SEQ ID NO: 11911 - protein, 18 aa, Mycobacterium avium
PLEREPVDLSRLAVDAVN

SEQ ID NO: 11912 - protein, 23 aa, Mycobacterium avium
PLFYAEGTTMLFGDAKKSVTEVA

SEQ ID NO: 11913 - protein, 18 aa, Mycobacterium avium
PLGIWVFGPLRRRATAAL

SEQ ID NO: 11914 - protein, 20 aa, Mycobacterium avium
PLIDLRLFRNPVLTHANVTM

SEQ ID NO: 11915 - protein, 22 aa, Mycobacterium avium
PLLGRASDRFGRKLVLQVSLAL

SEQ ID NO: 11916 - protein, 19 aa, Mycobacterium avium
PLMFHPLNTITAYKGQIIY

SEQ ID NO: 11917 - protein, 24 aa, Mycobacterium avium
PLPEAKWAVFYSMGLGATGGIYYN

SEQ ID NO: 11918 - protein, 18 aa, Mycobacterium avium
PLPTGTYCKIPMDTPANS

SEQ ID NO: 11919 - protein, 25 aa, Mycobacterium avium
PLVAEIGVACAVAIAVDATVVRLVM

SEQ ID NO: 11920 - protein, 20 aa, Mycobacterium avium
PLVLGFVALIAFVMLLVSIH

SEQ ID NO: 11921 - protein, 17 aa, Mycobacterium avium
PLYSIAVILSFVASQFT

SEQ ID NO: 11922 - protein, 23 aa, Mycobacterium avium
PLYSLSVLAAFFAARFTTVYING

SEQ ID NO: 11923 - protein, 28 aa, Mycobacterium avium
PMAMGRRKFLPPFATWYAANLFAIVPLR

SEQ ID NO: 11924 - protein, 18 aa, Mycobacterium avium
PMLFPAILLALTLLLVST

SEQ ID NO: 11925 - protein, 24 aa, Mycobacterium avium
PMLIDEFRVLYAARRLRPRRPAQT

SEQ ID NO: 11926 - protein, 19 aa, Mycobacterium avium
PMQCEAWDPSTGKYGPIYD

SEQ ID NO: 11927 - protein, 20 aa, Mycobacterium avium
PNLYRPAGGLSNPVVRQTAG

SEQ ID NO: 11928 - protein, 20 aa, Mycobacterium avium
PPAAMPGLLEVVNQARAEGI

SEQ ID NO: 11929 - protein, 18 aa, Mycobacterium avium
PPASIWVLAPAVAIVAVL

SEQ ID NO: 11930 - protein, 26 aa, Mycobacterium avium
PPAYRGRLVLCFQIAIGVGILTATLV

SEQ ID NO: 11931 - protein, 20 aa, Mycobacterium avium
PPEELQFVLADLKGGSAVKP

SEQ ID NO: 11932 - protein, 24 aa, Mycobacterium avium
PPEQRARPGARATLFGMTEAFGPY

SEQ ID NO: 11933 - protein, 20 aa, Mycobacterium avium
PPFYPPGWFWIGGRAAALSG

SEQ ID NO: 11934 - protein, 23 aa, Mycobacterium avium
PPICTVGFMPPNTWRSPDDLSDI

SEQ ID NO: 11935 - protein, 27 aa, Mycobacterium avium
PPKSAPGWYPDPAVGHGLKRYFDGTSW

SEQ ID NO: 11936 - protein, 24 aa, Mycobacterium avium
PPLARPRRGTLRWQSRVLRVVSVA

SEQ ID NO: 11937 - protein, 20 aa, Mycobacterium avium
PPLHDQWRPVLWTISILTMA

SEQ ID NO: 11938 - protein, 19 aa, Mycobacterium avium
PPLTFPGVWTIPQLAVRSA

SEQ ID NO: 11939 - protein, 17 aa, Mycobacterium avium
PPMPLAVPAKPVGGDAL

SEQ ID NO: 11940 - protein, 17 aa, Mycobacterium avium
PPRGTPIDRCAKTTPVQ

SEQ ID NO: 11941 - protein, 21 aa, Mycobacterium avium
PPRVRELAILRVAHRRQCAYE

SEQ ID NO: 11942 - protein, 25 aa, Mycobacterium avium
PPSRPGEKNMPFWGTSFSAAYVSGV

SEQ ID NO: 11943 - protein, 27 aa, Mycobacterium avium
PPTPEWGLLVAEGRRYLATAWWLSTLP

SEQ ID NO: 11944 - protein, 17 aa, Mycobacterium avium
PPVPVLLVIVDEYLELF

SEQ ID NO: 11945 - protein, 18 aa, Mycobacterium avium
PPVRRLPATFGLDQLREL

SEQ ID NO: 11946 - protein, 22 aa, Mycobacterium avium
PQERRLVFERFYRSTSARAMPG

SEQ ID NO: 11947 - protein, 21 aa, Mycobacterium avium
PQFFGNSTFSLFVTVAGTCIA

SEQ ID NO: 11948 - protein, 17 aa, Mycobacterium avium
PQQALNVPLPWSKVLSS

SEQ ID NO: 11949 - protein, 25 aa, Mycobacterium avium
PQTEFNVSLPWSKVVVLEPGVQTES

SEQ ID NO: 11950 - protein, 25 aa, Mycobacterium avium
PQYQAGSALLAWLTAAAVAIAMLTL

SEQ ID NO: 11951 - protein, 24 aa, Mycobacterium avium
PRGALPSPRRWIWIVLAVGGITAA

SEQ ID NO: 11952 - protein, 22 aa, Mycobacterium avium
PRHVPFPGVWDGVLWTLIFEIF

SEQ ID NO: 11953 - protein, 29 aa, Mycobacterium avium
PRKIPPGSGWRKFIYTISFHKINPGESPR

SEQ ID NO: 11954 - protein, 18 aa, Mycobacterium avium
PRKPVLVLAAIGLCGFAL

SEQ ID NO: 11955 - protein, 23 aa, Mycobacterium avium
PRLGVRWWRFGAGVLLGLACGTK

SEQ ID NO: 11956 - protein, 21 aa, Mycobacterium avium
PRLLQPYLLRHHELIKFAIVG

SEQ ID NO: 11957 - protein, 19 aa, Mycobacterium avium
PRMPSWWPLNMTWGGLPLF

SEQ ID NO: 11958 - protein, 18 aa, Mycobacterium avium
PRMRGWIHFYSAWLAVIT

SEQ ID NO: 11959 - protein, 21 aa, Mycobacterium avium
PRMVMAAAILAAFFVVELVTS

SEQ ID NO: 11960 - protein, 17 aa, Mycobacterium avium
PRNTVDTAIRWGGTTLV

SEQ ID NO: 11961 - protein, 28 aa, Mycobacterium avium
PRPPATRSRQTWLRRVLDAARAMRDDVN

SEQ ID NO: 11962 - protein, 23 aa, Mycobacterium avium
PRPRDLAPLLAAWVISVGVMAFE

SEQ ID NO: 11963 - protein, 20 aa, Mycobacterium avium
PRPSSLAFLGGWLLSLAALT

SEQ ID NO: 11964 - protein, 28 aa, Mycobacterium avium
PRQWAPYHLRLDWLMWFAAISPGYAQPW

SEQ ID NO: 11965 - protein, 19 aa, Mycobacterium avium
PRTGRYVGPDGKLYQQSDL

SEQ ID NO: 11966 - protein, 19 aa, Mycobacterium avium
PRVRLIERLLSGKVGDVTL

SEQ ID NO: 11967 - protein, 21 aa, Mycobacterium avium
PSCQKVLEGSGFVIAPDRVMT

SEQ ID NO: 11968 - protein, 21 aa, Mycobacterium avium
PSGMVPVFFVLWALSNFAGPL

SEQ ID NO: 11969 - protein, 23 aa, Mycobacterium avium
PSGSGLPALLAIAATAAVLANVV

SEQ ID NO: 11970 - protein, 17 aa, Mycobacterium avium
PSGYLERQVRRWGSQWA

SEQ ID NO: 11971 - protein, 27 aa, Mycobacterium avium
PSIAAALGHWFWWPINTIRMTRRTHHD

SEQ ID NO: 11972 - protein, 24 aa, Mycobacterium avium
PSLRARRLDWRGGHRSEGGRRGVS

SEQ ID NO: 11973 - protein, 24 aa, Mycobacterium avium
PSPSRPLPAETFTTVTSPSAAPSV

SEQ ID NO: 11974 - protein, 23 aa, Mycobacterium avium
PSPTCIIVGLPAGLRLAVDNAIA

SEQ ID NO: 11975 - protein, 24 aa, Mycobacterium avium
PSPVPRSLIPWPYNGIPVCPGCTL

SEQ ID NO: 11976 - protein, 38 aa, Mycobacterium avium
PSTPRIAAAVLMCLASIGLLVWFWPRLGPDKLTLPVTL

SEQ ID NO: 11977 - protein, 20 aa, Mycobacterium avium
PSVFSPGPLKWIYLTMGVLM

SEQ ID NO: 11978 - protein, 18 aa, Mycobacterium avium
PTGALFRTEFGTVVVQHD

SEQ ID NO: 11979 - protein, 21 aa, Mycobacterium avium
PTPISRLFILASRSARRESLP

SEQ ID NO: 11980 - protein, 24 aa, Mycobacterium avium
PTTEARKALLPGVRISGTNGFDSD

SEQ ID NO: 11981 - protein, 17 aa, Mycobacterium avium
PTWDRLDRLVGRRRSLS

SEQ ID NO: 11982 - protein, 23 aa, Mycobacterium avium
PTWPQCFPGSFVPVPHAEVPRIH

SEQ ID NO: 11983 - protein, 25 aa, Mycobacterium avium
PVAAFLNRHLGWFFLFKTGNVSLAG

SEQ ID NO: 11984 - protein, 21 aa, Mycobacterium avium
PVAEYWPAFAANGKANMTVRQ

SEQ ID NO: 11985 - protein, 23 aa, Mycobacterium avium
PVDDLRPSWIPKVMAHVGGTTAE

SEQ ID NO: 11986 - protein, 24 aa, Mycobacterium avium
PVDFGIGVSAGRVFAGNVGAENRY

SEQ ID NO: 11987 - protein, 22 aa, Mycobacterium avium
PVFPSATSRWVFEARPDLPTTV

SEQ ID NO: 11988 - protein, 18 aa, Mycobacterium avium
PVIMVVGATVVFGAFAHR

SEQ ID NO: 11989 - protein, 23 aa, Mycobacterium avium
PVKTEVFRPLSVRRRITNNAATI

SEQ ID NO: 11990 - protein, 21 aa, Mycobacterium avium
PVMKVLRERDAMVAKTAADNR

SEQ ID NO: 11991 - protein, 20 aa, Mycobacterium avium
PVRRGGRFVVAPGMGYSFGA

SEQ ID NO: 11992 - protein, 20 aa, Mycobacterium avium
PVSWSHHWVWVLPTVLVTGV

SEQ ID NO: 11993 - protein, 19 aa, Mycobacterium avium
PVTLWRGRLSVALDALQTD

SEQ ID NO: 11994 - protein, 17 aa, Mycobacterium avium
PVTVNLDGLGRYRVVAA

SEQ ID NO: 11995 - protein, 19 aa, Mycobacterium avium
PVWQSLRHADTWIMSLLYI

SEQ ID NO: 11996 - protein, 32 aa, Mycobacterium avium
PWQVYWRILLPHARPAVMVLAVLTWVNVWNDF

SEQ ID NO: 11997 - protein, 19 aa, Mycobacterium avium
PYAGDRWWVLVLHLVTTAG

SEQ ID NO: 11998 - protein, 21 aa, Mycobacterium avium
PYLNADYNWTGWPADSRWRPA

SEQ ID NO: 11999 - protein, 21 aa, Mycobacterium avium
QAGGVWAFIGVLIVAFFLASA

SEQ ID NO: 12000 - protein, 20 aa, Mycobacterium avium
QAPAMYRIVRELATAAHQPM

SEQ ID NO: 12001 - protein, 27 aa, Mycobacterium avium
QAPAYRFPGYLGFHIVERWQFHYSQVV

SEQ ID NO: 12002 - protein, 19 aa, Mycobacterium avium
QASSILLTLALTVSVVNAM

SEQ ID NO: 12003 - protein, 25 aa, Mycobacterium avium
QAVVLYCVVRFALGMHAVHPVAMLG

SEQ ID NO: 12004 - protein, 27 aa, Mycobacterium avium
QDGSIDRPECWGSIAAGSPDAYTPGAF

SEQ ID NO: 12005 - protein, 28 aa, Mycobacterium avium
QDILGIKLYWICLALSVIILLAVGSDYN

SEQ ID NO: 12006 - protein, 17 aa, Mycobacterium avium
QDRENWQTPSLALLDRP

SEQ ID NO: 12007 - protein, 22 aa, Mycobacterium avium
QEGRGANVFFMLGGQRLDLSSL

SEQ ID NO: 12008 - protein, 23 aa, Mycobacterium avium
QELRHWAVVLVLTAVGWLLAAFA

SEQ ID NO: 12009 - protein, 20 aa, Mycobacterium avium
QEVLAIKPDICFLWDEAWYA

SEQ ID NO: 12010 - protein, 18 aa, Mycobacterium avium
QEWRTVWDSALDRAEIGS

SEQ ID NO: 12011 - protein, 21 aa, Mycobacterium avium
QEYIGGAFFVLYGLVVFSLGA

SEQ ID NO: 12012 - protein, 21 aa, Mycobacterium avium
QFCCLYEAVQLGAPAVLCAVM

SEQ ID NO: 12013 - protein, 24 aa, Mycobacterium avium
QFFGCTPLGPVAWTGVLGSTAGAT

SEQ ID NO: 12014 - protein, 22 aa, Mycobacterium avium
QFIMPDLSGMFWTDAEPRLRAL

SEQ ID NO: 12015 - protein, 23 aa, Mycobacterium avium
QGGARMGFGFGKSRAKQLSKDMP

SEQ ID NO: 12016 - protein, 22 aa, Mycobacterium avium
QGLRVLAVAQRGWKHDTDDDDT

SEQ ID NO: 12017 - protein, 34 aa, Mycobacterium avium
QGSPIWAAIFVWELARPPLWLFLLFLLTATAAHG

SEQ ID NO: 12018 - protein, 20 aa, Mycobacterium avium
QISFLPAMRYYAGNWATSTW

SEQ ID NO: 12019 - protein, 18 aa, Mycobacterium avium
QKLFGWWGGSGVTGLRNS

SEQ ID NO: 12020 - protein, 20 aa, Mycobacterium avium
QLERYEHRLTLLSDVDELPA

SEQ ID NO: 12021 - protein, 24 aa, Mycobacterium avium
QLFFSVGVDGFFAISGFLITRSWL

SEQ ID NO: 12022 - protein, 25 aa, Mycobacterium avium
QLRDSFFDWDMYRQAIPTLLRTGLP

SEQ ID NO: 12023 - protein, 18 aa, Mycobacterium avium
QLSVCFVLLITGVGSLIH

SEQ ID NO: 12024 - protein, 24 aa, Mycobacterium avium
QLTFSVLAGYAFARLRFPGRDALF

SEQ ID NO: 12025 - protein, 19 aa, Mycobacterium avium
QLVLWAGIGLVFAAVSGRL

SEQ ID NO: 12026 - protein, 22 aa, Mycobacterium avium
QMLFGAELWEWVNPNNVTRTGG

SEQ ID NO: 12027 - protein, 24 aa, Mycobacterium avium
QPGKKRPVGLIAGVAGGIALLLIA

SEQ ID NO: 12028 - protein, 17 aa, Mycobacterium avium
QPLIPPFLPRMIHRLAL

SEQ ID NO: 12029 - protein, 34 aa, Mycobacterium avium
QPTGRPAWMRWLRSHYRRWGLIGVGLFQVAIAAA

SEQ ID NO: 12030 - protein, 24 aa, Mycobacterium avium
QQQMSRPKLDSMRAQFMLMLDMLR

SEQ ID NO: 12031 - protein, 18 aa, Mycobacterium avium
QRALRWVTDVLLEIIMIV

SEQ ID NO: 12032 - protein, 20 aa, Mycobacterium avium
QRITWIITMYLLGYIAAMPL

SEQ ID NO: 12033 - protein, 18 aa, Mycobacterium avium
QRPVPSPWPKPAAQEREV

SEQ ID NO: 12034 - protein, 42 aa, Mycobacterium avium
QRSEQRLGFTARRAAVLAAVICVLTLTIAGPVRTYFAQRTEM

SEQ ID NO: 12035 - protein, 23 aa, Mycobacterium avium
QSGADAEPVWTTRLTGAGGATQI

SEQ ID NO: 12036 - protein, 21 aa, Mycobacterium avium
QTLFFPFVLLLAATAMYRGND

SEQ ID NO: 12037 - protein, 21 aa, Mycobacterium avium
QVDGAGAWRRLTRVTLPIIKP

SEQ ID NO: 12038 - protein, 20 aa, Mycobacterium avium
QWNNFMWPLVITSGHKWRVL

SEQ ID NO: 12039 - protein, 20 aa, Mycobacterium avium
QYFLLCPTLIVFGVAVAGVL

SEQ ID NO: 12040 - protein, 25 aa, Mycobacterium avium
QYTKEICNLMGLRQLGCSTGTIQDF

SEQ ID NO: 12041 - protein, 23 aa, Mycobacterium avium
RAATPRECRDPKPYVPAGTNPWY

SEQ ID NO: 12042 - protein, 20 aa, Mycobacterium avium
RAATTRFSVRMKHDDRKQTA

SEQ ID NO: 12043 - protein, 20 aa, Mycobacterium avium
RADETLSLIRRGDEEKRKQS

SEQ ID NO: 12044 - protein, 17 aa, Mycobacterium avium
RADHPLIDLRLFRNPVL

SEQ ID NO: 12045 - protein, 20 aa, Mycobacterium avium
RADTVLGAFVVVIGAAALVM

SEQ ID NO: 12046 - protein, 19 aa, Mycobacterium avium
RAEQLIAPWGERLNIATVN

SEQ ID NO: 12047 - protein, 20 aa, Mycobacterium avium
RAFRGLRAMWQRGDEIFAEV

SEQ ID NO: 12048 - protein, 19 aa, Mycobacterium avium
RAFYSPRRGAALVAVLAGL

SEQ ID NO: 12049 - protein, 18 aa, Mycobacterium avium
RAGLFTLRGYLVVAVVFV

SEQ ID NO: 12050 - protein, 23 aa, Mycobacterium avium
RAIEYGGQWFSWAQLGATARQVA

SEQ ID NO: 12051 - protein, 18 aa, Mycobacterium avium
RALGFFGEPCVNVLQLNL

SEQ ID NO: 12052 - protein, 22 aa, Mycobacterium avium
RALRRWLACTDIDRDADGDTVD

SEQ ID NO: 12053 - protein, 19 aa, Mycobacterium avium
RAMTRCYDGALIRFRDGGR

SEQ ID NO: 12054 - protein, 18 aa, Mycobacterium avium
RAQFMLMLDMLRETAHES

SEQ ID NO: 12055 - protein, 29 aa, Mycobacterium avium
RARKKGFLGRFWLVLTIAAVVALSGFVVY

SEQ ID NO: 12056 - protein, 23 aa, Mycobacterium avium
RARSRLQSYAFWDIATFLLNGSL

SEQ ID NO: 12057 - protein, 18 aa, Mycobacterium avium
RASAIMHGVWILLFTIPF

SEQ ID NO: 12058 - protein, 28 aa, Mycobacterium avium
RASLPRLRYDQFMGLGWKLLIPASLVWV

SEQ ID NO: 12059 - protein, 18 aa, Mycobacterium avium
RAVAIEWRGKIDDTKWRG

SEQ ID NO: 12060 - protein, 20 aa, Mycobacterium avium
RAVSEGSYGNAYACDLNATG

SEQ ID NO: 12061 - protein, 22 aa, Mycobacterium avium
RCGPAPALTGITGWLNTPDGKP

SEQ ID NO: 12062 - protein, 24 aa, Mycobacterium avium
RDDAYRFAVWLSLPVTGLVAGFGL

SEQ ID NO: 12063 - protein, 22 aa, Mycobacterium avium
RDGENPFALLLVSLLGPIAATV

SEQ ID NO: 12064 - protein, 24 aa, Mycobacterium avium
RDLAELLDLAPLVADNAYNMIDRA

SEQ ID NO: 12065 - protein, 17 aa, Mycobacterium avium
RDPRKPVLVLAAIGLCG

SEQ ID NO: 12066 - protein, 20 aa, Mycobacterium avium
REALERGWPVMSFSRPVSLR

SEQ ID NO: 12067 - protein, 18 aa, Mycobacterium avium
REALGLKTKPSVAPWVAL

SEQ ID NO: 12068 - protein, 24 aa, Mycobacterium avium
REIALRTVGVFAHRLYGAITSAHF

SEQ ID NO: 12069 - protein, 24 aa, Mycobacterium avium
REITRPVLEYVKRAREESPRTVVT

SEQ ID NO: 12070 - protein, 24 aa, Mycobacterium avium
RELFQEVFLNPGLVLLMGGIIIGL

SEQ ID NO: 12071 - protein, 18 aa, Mycobacterium avium
RELLRLSGQRDWQLTELD

SEQ ID NO: 12072 - protein, 19 aa, Mycobacterium avium
RELWIGAVIASLVVGAIVY

SEQ ID NO: 12073 - protein, 17 aa, Mycobacterium avium
REPDLPRGFRVPGYPVT

SEQ ID NO: 12074 - protein, 21 aa, Mycobacterium avium
RERRAQLWQAFNIQRQEDKRL

SEQ ID NO: 12075 - protein, 23 aa, Mycobacterium avium
RETGIDWDVIFLLLGMMIIVSVL

SEQ ID NO: 12076 - protein, 18 aa, Mycobacterium avium
RETLRLVAEIGMGTGAMA

SEQ ID NO: 12077 - protein, 19 aa, Mycobacterium avium
REVLGWLYDFAFLSFDGTM

SEQ ID NO: 12078 - protein, 21 aa, Mycobacterium avium
REYRAEAAILEMFRTDRPELV

SEQ ID NO: 12079 - protein, 27 aa, Mycobacterium avium
RFLDFDSGEFLKVMLRWLNAFVSKPGQ

SEQ ID NO: 12080 - protein, 23 aa, Mycobacterium avium
RFLSYGWRIGFLLSVLLVAIGIV

SEQ ID NO: 12081 - protein, 19 aa, Mycobacterium avium
RGDPCWRDLTCLYYHHETQ

SEQ ID NO: 12082 - protein, 36 aa, Mycobacterium avium
RGFRASSLAPRERRVASWLAALIVPSVICAVTVTWL

SEQ ID NO: 12083 - protein, 22 aa, Mycobacterium avium
RGLRYTTIIALVAVLVGGVYVL

SEQ ID NO: 12084 - protein, 25 aa, Mycobacterium avium
RGPHTLRGMCGRSREELFTVDGFYP

SEQ ID NO: 12085 - protein, 20 aa, Mycobacterium avium
RGPMPPYAVAAVLRPVLGGL

SEQ ID NO: 12086 - protein, 20 aa, Mycobacterium avium
RGRLVCPWHGSWFAAESGEV

SEQ ID NO: 12087 - protein, 33 aa, Mycobacterium avium
RGSLMTLCIPGALFMLGCFFVFGSLYHLHGATP

SEQ ID NO: 12088 - protein, 26 aa, Mycobacterium avium
RGVAGPWRWSATMLAEAVPEFYTDEG

SEQ ID NO: 12089 - protein, 23 aa, Mycobacterium avium
RGVGVCGGRVRGRVRIVRPETID

SEQ ID NO: 12090 - protein, 23 aa, Mycobacterium avium
RGVSRSRIAWTVAGITALVVLAS

SEQ ID NO: 12091 - protein, 17 aa, Mycobacterium avium
RGYDVLPETTWIPVVTF

SEQ ID NO: 12092 - protein, 19 aa, Mycobacterium avium
RGYTYGLLWLAGVVALLGG

SEQ ID NO: 12093 - protein, 26 aa, Mycobacterium avium
RHGLPRGGAVALVLLGGFAILGGILA

SEQ ID NO: 12094 - protein, 22 aa, Mycobacterium avium
RHPGESSFYWLTLGLAAVWTVG

SEQ ID NO: 12095 - protein, 17 aa, Mycobacterium avium
RHTDQWVLIIAGLVVGV

SEQ ID NO: 12096 - protein, 20 aa, Mycobacterium avium
RIAAACLVGSAIEFYDFLIY

SEQ ID NO: 12097 - protein, 22 aa, Mycobacterium avium
RIAATRGYWPAILIALTALPVR

SEQ ID NO: 12098 - protein, 20 aa, Mycobacterium avium
RIAIGVCILAGVVIVYVLSL

SEQ ID NO: 12099 - protein, 18 aa, Mycobacterium avium
RIIESGAFRLEPPQNYAA

SEQ ID NO: 12100 - protein, 22 aa, Mycobacterium avium
RILELPPRVRARNPLPQLRVVM

SEQ ID NO: 12101 - protein, 19 aa, Mycobacterium avium
RIMRLPHGYDTVLGAGVGL

SEQ ID NO: 12102 - protein, 20 aa, Mycobacterium avium
RIPLSFGDVAKRVFLGKPLI

SEQ ID NO: 12103 - protein, 24 aa, Mycobacterium avium
RIQEGVVSLGLYSRIFRNNILASG

SEQ ID NO: 12104 - protein, 21 aa, Mycobacterium avium
RKRVFQAAVLFFVAGSVLCGL

SEQ ID NO: 12105 - protein, 20 aa, Mycobacterium avium
RKSRHPVVIIPGGPGVASVQ

SEQ ID NO: 12106 - protein, 26 aa, Mycobacterium avium
RKYAFRKRVLMAMAVVLVGSATAAFK

SEQ ID NO: 12107 - protein, 19 aa, Mycobacterium avium
RLAALSILVGAVGATGPGV

SEQ ID NO: 12108 - protein, 24 aa, Mycobacterium avium
RLAATAVLISPAWKRDEVEHALAL

SEQ ID NO: 12109 - protein, 19 aa, Mycobacterium avium
RLDHSMIFVFIAGSYTPFA

SEQ ID NO: 12110 - protein, 34 aa, Mycobacterium avium
RLDRLPWSRFHWRVVIGLGGVWVLDGLEVTMVGN

SEQ ID NO: 12111 - protein, 23 aa, Mycobacterium avium
RLGATPLPVWGIIAGKSLAVVTV

SEQ ID NO: 12112 - protein, 19 aa, Mycobacterium avium
RLGPVLVALAALFLIGAVV

SEQ ID NO: 12113 - protein, 19 aa, Mycobacterium avium
RLHGREVYAGTGVGLALVK

SEQ ID NO: 12114 - protein, 24 aa, Mycobacterium avium
RLINERFGRGWGWFSVGDLFLLNF

SEQ ID NO: 12115 - protein, 25 aa, Mycobacterium avium
RLLGKSAYHALTFGWLMSGLGRAVT

SEQ ID NO: 12116 - protein, 22 aa, Mycobacterium avium
RLLGPMERLLILSLGVGGQLAA

SEQ ID NO: 12117 - protein, 25 aa, Mycobacterium avium
RLLVTCGVVLLAVFAAFIAHGPLHL

SEQ ID NO: 12118 - protein, 30 aa, Mycobacterium avium
RLPTLAMALTCWWVISREVMPRLGHAVKQN

SEQ ID NO: 12119 - protein, 21 aa, Mycobacterium avium
RLRAWESRLRTVARRFDREVE

SEQ ID NO: 12120 - protein, 19 aa, Mycobacterium avium
RLRGWRTAIRHHDGAGPDA

SEQ ID NO: 12121 - protein, 29 aa, Mycobacterium avium
RLRNELQHGFKLVKWIKGIEFVADYRDIG

SEQ ID NO: 12122 - protein, 29 aa, Mycobacterium avium
RLSLDWLVFGKNWMDGWNGLLISLLLGLA

SEQ ID NO: 12123 - protein, 20 aa, Mycobacterium avium
RLTARGALVRAPRTIEALGR

SEQ ID NO: 12124 - protein, 20 aa, Mycobacterium avium
RLTESFNLMLRALAESRERQ

SEQ ID NO: 12125 - protein, 23 aa, Mycobacterium avium
RLTRPVRIIAWLVAGLSALGLLN

SEQ ID NO: 12126 - protein, 17 aa, Mycobacterium avium
RLVFSNGIITLTALSVA

SEQ ID NO: 12127 - protein, 18 aa, Mycobacterium avium
RLVVPRFAAAVMIGVALT

SEQ ID NO: 12128 - protein, 19 aa, Mycobacterium avium
RMLASGLVAFLLNSLVVII

SEQ ID NO: 12129 - protein, 22 aa, Mycobacterium avium
RMSRPARLVYWVQAELVAIATD

SEQ ID NO: 12130 - protein, 35 aa, Mycobacterium avium
RMVLVPAFIHLLGRWTWWAPRPMVWLRERSATGEA

SEQ ID NO: 12131 - protein, 19 aa, Mycobacterium avium
RMYALHILLLPGIILALIG

SEQ ID NO: 12132 - protein, 24 aa, Mycobacterium avium
RNARSRAWVKVGYVVFVLAGIYAV

SEQ ID NO: 12133 - protein, 19 aa, Mycobacterium avium
RNGVDHGKYYFMVELPPDF

SEQ ID NO: 12134 - protein, 17 aa, Mycobacterium avium
RNMVIGFIAGLLLAIAV

SEQ ID NO: 12135 - protein, 20 aa, Mycobacterium avium
RNPEVWSWIVWLPHNLHDEL

SEQ ID NO: 12136 - protein, 21 aa, Mycobacterium avium
RNSILAIRWRLPSGVEIDTGF

SEQ ID NO: 12137 - protein, 18 aa, Mycobacterium avium
RNVWSYMIIFCGHFPDGT

SEQ ID NO: 12138 - protein, 26 aa, Mycobacterium avium
RPAELPRIVGDPMLLTMLWQNLIGNA

SEQ ID NO: 12139 - protein, 19 aa, Mycobacterium avium
RPAPLLRVRNKFFAHADQL

SEQ ID NO: 12140 - protein, 17 aa, Mycobacterium avium
RPAVIAVGLPVMILAGV

SEQ ID NO: 12141 - protein, 19 aa, Mycobacterium avium
RPDSGGVVLTGRLSTSAQA

SEQ ID NO: 12142 - protein, 17 aa, Mycobacterium avium
RPFQFGEFLDQTWMIAR

SEQ ID NO: 12143 - protein, 25 aa, Mycobacterium avium
RPGCARAPDSVRCAPSMELAPEEPV

SEQ ID NO: 12144 - protein, 19 aa, Mycobacterium avium
RPGDIVLIDRNCHKSHHYG

SEQ ID NO: 12145 - protein, 22 aa, Mycobacterium avium
RPLRSYFYWEKHCYDIPICWSL

SEQ ID NO: 12146 - protein, 18 aa, Mycobacterium avium
RPRPVKFIFGLDYMTFIQ

SEQ ID NO: 12147 - protein, 20 aa, Mycobacterium avium
RPSASPLKPGAVLRSRNVTV

SEQ ID NO: 12148 - protein, 18 aa, Mycobacterium avium
RPSKGVVVPVDIDGNGPS

SEQ ID NO: 12149 - protein, 25 aa, Mycobacterium avium
RPTTVWWRVTLPLLLPGVVSGAVLA

SEQ ID NO: 12150 - protein, 21 aa, Mycobacterium avium
RPVAVEALWKTALRSACCACD

SEQ ID NO: 12151 - protein, 21 aa, Mycobacterium avium
RPVDEPLWLGSIKSNMGHTSA

SEQ ID NO: 12152 - protein, 23 aa, Mycobacterium avium
RPVFPRWVAHFNLLVAAALVPAA

SEQ ID NO: 12153 - protein, 19 aa, Mycobacterium avium
RQAETPLLLAVDGTLVGLI

SEQ ID NO: 12154 - protein, 19 aa, Mycobacterium avium
RQGRAYWIHLMMASQTIES

SEQ ID NO: 12155 - protein, 25 aa, Mycobacterium avium
RQHNRRMVLVWLALVLAVTGMVATA

SEQ ID NO: 12156 - protein, 17 aa, Mycobacterium avium
RQIDAWVAPAGQAATTI

SEQ ID NO: 12157 - protein, 21 aa, Mycobacterium avium
RQPARPGPRLPARGVDRSTWR

SEQ ID NO: 12158 - protein, 18 aa, Mycobacterium avium
RQPWLRTGDLGFISAGEL

SEQ ID NO: 12159 - protein, 31 aa, Mycobacterium avium
RQRGWLAIVSLRLIPAVPFSALNYAAGASSV

SEQ ID NO: 12160 - protein, 25 aa, Mycobacterium avium
RQVAPAGAVLARFGGDEFAVCIADH

SEQ ID NO: 12161 - protein, 28 aa, Mycobacterium avium
RQVRLVVADRAYFVFLALLPFILGSLSL

SEQ ID NO: 12162 - protein, 17 aa, Mycobacterium avium
RRAATPLAYAVDLLAAV

SEQ ID NO: 12163 - protein, 22 aa, Mycobacterium avium
RRADGLAGLSLAWGLWEQASAM

SEQ ID NO: 12164 - protein, 17 aa, Mycobacterium avium
RRAELDDIFALLSNNTA

SEQ ID NO: 12165 - protein, 22 aa, Mycobacterium avium
RRAPEVPRFAPLAVAAFAAAAV

SEQ ID NO: 12166 - protein, 21 aa, Mycobacterium avium
RRASDGWAFTCLALVVAAVVI

SEQ ID NO: 12167 - protein, 18 aa, Mycobacterium avium
RRAVEHRALMAIAIGEAG

SEQ ID NO: 12168 - protein, 17 aa, Mycobacterium avium
RRDLPRDGKAPVLLQVP

SEQ ID NO: 12169 - protein, 37 aa, Mycobacterium avium
RRGLRRPWLYFVSSLFTSFAFAFAFYFATMERQRRHE

SEQ ID NO: 12170 - protein, 19 aa, Mycobacterium avium
RRGQILFERVITGLLLVIA

SEQ ID NO: 12171 - protein, 25 aa, Mycobacterium avium
RRGSRPRAAFAFALPVLPVLLTLAI

SEQ ID NO: 12172 - protein, 25 aa, Mycobacterium avium
RRHYSCWPVPVGDIALMAARAARAG

SEQ ID NO: 12173 - protein, 23 aa, Mycobacterium avium
RRIECACKVWAAGVQASALGAMI

SEQ ID NO: 12174 - protein, 22 aa, Mycobacterium avium
RRIESACKVWSAGVSASPLGRD

SEQ ID NO: 12175 - protein, 20 aa, Mycobacterium avium
RRIVGITIISFVAMMFTPTK

SEQ ID NO: 12176 - protein, 17 aa, Mycobacterium avium
RRNAELLLLGFAATITV

SEQ ID NO: 12177 - protein, 25 aa, Mycobacterium avium
RRPRRPRPAVGLAVTATLFFALANA

SEQ ID NO: 12178 - protein, 27 aa, Mycobacterium avium
RRQSRWPWLCFGLALVCSVLLDAYIAL

SEQ ID NO: 12179 - protein, 20 aa, Mycobacterium avium
RRQVDIEGFQLVRQVYDMAL

SEQ ID NO: 12180 - protein, 17 aa, Mycobacterium avium
RRRAAALAAARRLDPTD

SEQ ID NO: 12181 - protein, 25 aa, Mycobacterium avium
RRRGELIPVGLTWASLIAVDAALLL

SEQ ID NO: 12182 - protein, 18 aa, Mycobacterium avium
RRRLHPLLLLCISAMSFS

SEQ ID NO: 12183 - protein, 21 aa, Mycobacterium avium
RRRPEVLVYAWLMPVSTVVQA

SEQ ID NO: 12184 - protein, 18 aa, Mycobacterium avium
RRRPKFIGAGLLILVILA

SEQ ID NO: 12185 - protein, 23 aa, Mycobacterium avium
RRRRRPMLMAGRSVAALAAVLAL

SEQ ID NO: 12186 - protein, 24 aa, Mycobacterium avium
RRRRSWRWVLATLLVLAVIAGVDA

SEQ ID NO: 12187 - protein, 19 aa, Mycobacterium avium
RRRTLAWIAALSVAGVVLL

SEQ ID NO: 12188 - protein, 19 aa, Mycobacterium avium
RRRVMLWGLVACLPWAFVV

SEQ ID NO: 12189 - protein, 19 aa, Mycobacterium avium
RRVALAASFVLRTALAAVL

SEQ ID NO: 12190 - protein, 23 aa, Mycobacterium avium
RRWARDAPRPAIRRWPSRATSGR

SEQ ID NO: 12191 - protein, 19 aa, Mycobacterium avium
RRWYVITFLMGLFFVLGQG

SEQ ID NO: 12192 - protein, 19 aa, Mycobacterium avium
RRYADYLPSDGFQPYNVAS

SEQ ID NO: 12193 - protein, 19 aa, Mycobacterium avium
RSAEAVARFLSWVYATNPP

SEQ ID NO: 12194 - protein, 24 aa, Mycobacterium avium
RSAGLPCAIGILATMVAALTLTPA

SEQ ID NO: 12195 - protein, 25 aa, Mycobacterium avium
RSAMATLRIAFLSALVLELLATLGV

SEQ ID NO: 12196 - protein, 22 aa, Mycobacterium avium
RSASRIAERFAEGHLSERMPVR

SEQ ID NO: 12197 - protein, 25 aa, Mycobacterium avium
RSFLEYGIPSMEVFRRRKFGGEPGP

SEQ ID NO: 12198 - protein, 31 aa, Mycobacterium avium
RSFSTRATLHFLWLRLARVWPVYLVTLHLAA

SEQ ID NO: 12199 - protein, 18 aa, Mycobacterium avium
RSRKGGSTGLGLAIVSAV

SEQ ID NO: 12200 - protein, 33 aa, Mycobacterium avium
RSSAMPSRHTWTKGMLPGLMAVPLTIAGQIERW

SEQ ID NO: 12201 - protein, 25 aa, Mycobacterium avium
RSVGPRPLVRALLHQPRHAVPPPPT

SEQ ID NO: 12202 - protein, 18 aa, Mycobacterium avium
RTDLSYGVYIYAWPMQQL

SEQ ID NO: 12203 - protein, 26 aa, Mycobacterium avium
RTELQADCYAGIWAHYASTVKQESTG

SEQ ID NO: 12204 - protein, 18 aa, Mycobacterium avium
RTFARLLGRLLHDRTADK

SEQ ID NO: 12205 - protein, 21 aa, Mycobacterium avium
RTHPLRVAMLLGAAAAVVIAG

SEQ ID NO: 12206 - protein, 23 aa, Mycobacterium avium
RTILHRRITRFGALPLIAPLLAA

SEQ ID NO: 12207 - protein, 18 aa, Mycobacterium avium
RTRLEQLAVLAAETKRPA

SEQ ID NO: 12208 - protein, 31 aa, Mycobacterium avium
RTRRTPLRSRFRFGIQSKILITMLLSSILGV

SEQ ID NO: 12209 - protein, 26 aa, Mycobacterium avium
RTSKYYPAWLPSRRFIAAVIAIGGMQ

SEQ ID NO: 12210 - protein, 19 aa, Mycobacterium avium
RTVDLRRKILFTLGIVVLY

SEQ ID NO: 12211 - protein, 19 aa, Mycobacterium avium
RVANLFLTKTVYSVLLALL

SEQ ID NO: 12212 - protein, 26 aa, Mycobacterium avium
RVDALIGRGGLWAVVGQRFVPGISDA

SEQ ID NO: 12213 - protein, 20 aa, Mycobacterium avium
RVGARIILLNSEFSGPQIKE

SEQ ID NO: 12214 - protein, 25 aa, Mycobacterium avium
RVGRRPILLCGTAMMIVADVVLVAV

SEQ ID NO: 12215 - protein, 19 aa, Mycobacterium avium
RVGVASVIAEGFLVLPFSR

SEQ ID NO: 12216 - protein, 17 aa, Mycobacterium avium
RVIAKGMAKRPEDRYRT

SEQ ID NO: 12217 - protein, 20 aa, Mycobacterium avium
RVLLIPAILAVILIVLAVLL

SEQ ID NO: 12218 - protein, 25 aa, Mycobacterium avium
RVLQGFALGGEWGGAVLLAVEHSPG

SEQ ID NO: 12219 - protein, 18 aa, Mycobacterium avium
RVPERDPRTEVGRLSLAL

SEQ ID NO: 12220 - protein, 18 aa, Mycobacterium avium
RVVATGNSVDAVWHQLMP

SEQ ID NO: 12221 - protein, 24 aa, Mycobacterium avium
RWAQRPRVWWWTAIGNSGAMTLYL

SEQ ID NO: 12222 - protein, 28 aa, Mycobacterium avium
RWIRDKELRAKLTPDYDCGCKRPTFSNS

SEQ ID NO: 12223 - protein, 20 aa, Mycobacterium avium
RWSNYTEVFALMPIGRMFVN

SEQ ID NO: 12224 - protein, 19 aa, Mycobacterium avium
RWSSWLRVVLGAGLIGYGI

SEQ ID NO: 12225 - protein, 25 aa, Mycobacterium avium
RYGGLRAALPVTFVTFGLGYLAIIG

SEQ ID NO: 12226 - protein, 25 aa, Mycobacterium avium
RYTLKAELPASGGLYPTANVTYRGI

SEQ ID NO: 12227 - protein, 18 aa, Mycobacterium avium
RYVVPPVRRLMAARQEAV

SEQ ID NO: 12228 - protein, 24 aa, Mycobacterium avium
SAAMVLTAIAWVWATPFTIRHPRV

SEQ ID NO: 12229 - protein, 17 aa, Mycobacterium avium
SAATLAALSLVVGAGRF

SEQ ID NO: 12230 - protein, 22 aa, Mycobacterium avium
SAAVQLPAVWLLSAVTVCVFGV

SEQ ID NO: 12231 - protein, 24 aa, Mycobacterium avium
SAELCAQYLAPVLDAIKFNYPPAG

SEQ ID NO: 12232 - protein, 23 aa, Mycobacterium avium
SAFARTEFQAVQFIPLVMVPQLL

SEQ ID NO: 12233 - protein, 20 aa, Mycobacterium avium
SAFCSFPQVMGHEVVADVVA

SEQ ID NO: 12234 - protein, 25 aa, Mycobacterium avium
SAFGPRPGPPPGQAPGGLGADLGGG

SEQ ID NO: 12235 - protein, 22 aa, Mycobacterium avium
SAGRPPLTTSIPIVSTPSGPMT

SEQ ID NO: 12236 - protein, 17 aa, Mycobacterium avium
SAIKEFTDLAAGQRIGV

SEQ ID NO: 12237 - protein, 28 aa, Mycobacterium avium
SALDHRFGWSSVPAWLSLLGDVLVATGL

SEQ ID NO: 12238 - protein, 22 aa, Mycobacterium avium
SALIAVPVGLLIGHTGRGTLLV

SEQ ID NO: 12239 - protein, 29 aa, Mycobacterium avium
SALRAGVGFIPFVIAMGIGLGVSSQLVAR

SEQ ID NO: 12240 - protein, 19 aa, Mycobacterium avium
SANTEWYNTALGLAMAFGR

SEQ ID NO: 12241 - protein, 24 aa, Mycobacterium avium
SARAMPGSGLGLAIVKKVVLNHGG

SEQ ID NO: 12242 - protein, 20 aa, Mycobacterium avium
SARLKLGRPAVLVVRCTVAV

SEQ ID NO: 12243 - protein, 29 aa, Mycobacterium avium
SARRWRRIGTAIVRWPAPILIATLAVSLV

SEQ ID NO: 12244 - protein, 26 aa, Mycobacterium avium
SATVFLACWVPLFASFAALLVYPADG

SEQ ID NO: 12245 - protein, 23 aa, Mycobacterium avium
SAVYMLWLYQRMMTGPVAGGNEK

SEQ ID NO: 12246 - protein, 26 aa, Mycobacterium avium
SAYDIGLFYRYAWQNPTFADIVATRT

SEQ ID NO: 12247 - protein, 17 aa, Mycobacterium avium
SCDVLGLGVAVALWDAF

SEQ ID NO: 12248 - protein, 23 aa, Mycobacterium avium
SDIDTPDGLYCKLPQDSPLSVRG

SEQ ID NO: 12249 - protein, 18 aa, Mycobacterium avium
SDLVDGFRRHELWLHLGW

SEQ ID NO: 12250 - protein, 30 aa, Mycobacterium avium
SDPARRASCLTGLGYPASTPVLGARPVAIN

SEQ ID NO: 12251 - protein, 24 aa, Mycobacterium avium
SDQPRPLVPAMFSGVLSRLRRTHT

SEQ ID NO: 12252 - protein, 17 aa, Mycobacterium avium
SDTVPLYGAELLSQGKF

SEQ ID NO: 12253 - protein, 25 aa, Mycobacterium avium
SDVRIPLNRAVVMLVIDVSESMAST

SEQ ID NO: 12254 - protein, 18 aa, Mycobacterium avium
SEALDITGALLLSPGVAI

SEQ ID NO: 12255 - protein, 25 aa, Mycobacterium avium
SEDEPRPAPPDVVRDLAAQSWKDSP

SEQ ID NO: 12256 - protein, 25 aa, Mycobacterium avium
SEGFSRLGPSLVFFVALAFSMTGLA

SEQ ID NO: 12257 - protein, 23 aa, Mycobacterium avium
SEGGRRGVSIGVIVALVAVVVVV

SEQ ID NO: 12258 - protein, 20 aa, Mycobacterium avium
SEIRNADVLRMVIGGAALAL

SEQ ID NO: 12259 - protein, 20 aa, Mycobacterium avium
SEKERARWSLGDTVTLRGHE

SEQ ID NO: 12260 - protein, 22 aa, Mycobacterium avium
SELRPPVRSGFGSRVELRLAAV

SEQ ID NO: 12261 - protein, 17 aa, Mycobacterium avium
SELRVLGQFGSTVCIGL

SEQ ID NO: 12262 - protein, 19 aa, Mycobacterium avium
SERQRLRDLFGRYVGEDVA

SEQ ID NO: 12263 - protein, 17 aa, Mycobacterium avium
SEVHLARDVRLHRDVAV

SEQ ID NO: 12264 - protein, 20 aa, Mycobacterium avium
SEVPRHSWAAAAAGEASHVV

SEQ ID NO: 12265 - protein, 24 aa, Mycobacterium avium
SFQRWDVFTPPKFVGLKNFTDLFS

SEQ ID NO: 12266 - protein, 23 aa, Mycobacterium avium
SFTRFTLLMAAPWLAAVATLYAV

SEQ ID NO: 12267 - protein, 28 aa, Mycobacterium avium
SFYLPPEVFKNPDFKRGLKMFVSPDGTA

SEQ ID NO: 12268 - protein, 21 aa, Mycobacterium avium
SGEFLRLLSNITWGNGSIVVG

SEQ ID NO: 12269 - protein, 31 aa, Mycobacterium avium
SGGQRKRASVALELLTGPSLLILDEPTSGLD

SEQ ID NO: 12270 - protein, 20 aa, Mycobacterium avium
SGKELARWQSARALGELVGV

SEQ ID NO: 12271 - protein, 19 aa, Mycobacterium avium
SGLAKRHQTALVHITHYDN

SEQ ID NO: 12272 - protein, 25 aa, Mycobacterium avium
SGLASRLSPALAVAAAVVCVLISVA

SEQ ID NO: 12273 - protein, 34 aa, Mycobacterium avium
SGLTVAGAVLCLRFTRLNYFQSLGIPAAIGIGVA

SEQ ID NO: 12274 - protein, 23 aa, Mycobacterium avium
SGPLPYIVMEYVDGVTLRDIVHT

SEQ ID NO: 12275 - protein, 22 aa, Mycobacterium avium
SGSGKSEFFLSLVYGIALTHSP

SEQ ID NO: 12276 - protein, 23 aa, Mycobacterium avium
SHELRTPLTTVRMAADLIYDHSA

SEQ ID NO: 12277 - protein, 27 aa, Mycobacterium avium
SHIAAPRAKLFAALFLILALVVIGEVA

SEQ ID NO: 12278 - protein, 19 aa, Mycobacterium avium
SHPGIPFGVLVAIAATAGF

SEQ ID NO: 12279 - protein, 17 aa, Mycobacterium avium
SHTRGYIATALRLLERK

SEQ ID NO: 12280 - protein, 30 aa, Mycobacterium avium
SIAALLGKWFWWPQRVRQRPVPSPWPKPAA

SEQ ID NO: 12281 - protein, 21 aa, Mycobacterium avium
SIEPALRFYVVFFLGLLAVTW

SEQ ID NO: 12282 - protein, 25 aa, Mycobacterium avium
SIHRAYRYARAMARWSPTSRSEIDD

SEQ ID NO: 12283 - protein, 31 aa, Mycobacterium avium
SIMTAMGRWFWWPKRVRVRPASQMLRSVGPR

SEQ ID NO: 12284 - protein, 22 aa, Mycobacterium avium
SKDPSRWGIVGWSMGGTCSVDL

SEQ ID NO: 12285 - protein, 17 aa, Mycobacterium avium
SKILLLIFFSAVLIAKR

SEQ ID NO: 12286 - protein, 21 aa, Mycobacterium avium
SKPFFAQGLLNRRAVLKSSYA

SEQ ID NO: 12287 - protein, 24 aa, Mycobacterium avium
SLAAGLSWYLAHDVLDHPQPFFAP

SEQ ID NO: 12288 - protein, 24 aa, Mycobacterium avium
SLAFAMQGGCRFTAQLGSMRIAEE

SEQ ID NO: 12289 - protein, 21 aa, Mycobacterium avium
SLAGRRPWLLAGVSAVLLAAL

SEQ ID NO: 12290 - protein, 22 aa, Mycobacterium avium
SLDRVAKALIRLHGVAMVQGMT

SEQ ID NO: 12291 - protein, 19 aa, Mycobacterium avium
SLGAAFGFSTLIWQHLADF

SEQ ID NO: 12292 - protein, 25 aa, Mycobacterium avium
SLGWADPASGVAFSLVHNRLLTPLV

SEQ ID NO: 12293 - protein, 20 aa, Mycobacterium avium
SLIAGVLWGAGWVAVLAVLT

SEQ ID NO: 12294 - protein, 26 aa, Mycobacterium avium
SLIRNWPAWLGIYGFMTLDRWLLFNW

SEQ ID NO: 12295 - protein, 18 aa, Mycobacterium avium
SLLHKTLNYLDAVQQPLI

SEQ ID NO: 12296 - protein, 27 aa, Mycobacterium avium
SLPLLAALAWVCGDAILLVRTGNRRYA

SEQ ID NO: 12297 - protein, 17 aa, Mycobacterium avium
SLQLRVVALTLGLSLAV

SEQ ID NO: 12298 - protein, 20 aa, Mycobacterium avium
SLRLRLLVGQIVVLALVCLG

SEQ ID NO: 12299 - protein, 23 aa, Mycobacterium avium
SLTADGSLDWHVVDLPEARNGVD

SEQ ID NO: 12300 - protein, 23 aa, Mycobacterium avium
SLTARPGTLTAIIGGSGAGKTTL

SEQ ID NO: 12301 - protein, 20 aa, Mycobacterium avium
SLTLRPGTLTALVGPSGSGK

SEQ ID NO: 12302 - protein, 20 aa, Mycobacterium avium
SMDANYRWFHPAPTTLAAAV

SEQ ID NO: 12303 - protein, 19 aa, Mycobacterium avium
SMFPFVWNVFKSWRYGEVV

SEQ ID NO: 12304 - protein, 18 aa, Mycobacterium avium
SMLKRAVGPSLSWFDEHI

SEQ ID NO: 12305 - protein, 20 aa, Mycobacterium avium
SNFFAWALSVMFLVFTLRAL

SEQ ID NO: 12306 - protein, 25 aa, Mycobacterium avium
SNFGVPWSNAFPAWHYAFATALLGL

SEQ ID NO: 12307 - protein, 24 aa, Mycobacterium avium
SNVLRAQRAVQMMIGVTLGIGLGT

SEQ ID NO: 12308 - protein, 17 aa, Mycobacterium avium
SNWLSVLPLQYTDKSGH

SEQ ID NO: 12309 - protein, 26 aa, Mycobacterium avium
SPAEPAHPRWWFISTTPGRILTIGIV

SEQ ID NO: 12310 - protein, 24 aa, Mycobacterium avium
SPAIEARFPWYVRMWGGRQWARSL

SEQ ID NO: 12311 - protein, 19 aa, Mycobacterium avium
SPASRAVAQIVLLDNRFAT

SEQ ID NO: 12312 - protein, 20 aa, Mycobacterium avium
SPATPIWRLVLPFFAMGVGM

SEQ ID NO: 12313 - protein, 31 aa, Mycobacterium avium
SPGGPVHVLAHDWGSVGVWHYLKRPGANDRV

SEQ ID NO: 12314 - protein, 19 aa, Mycobacterium avium
SPIRRLRADAPPFFVLHGR

SEQ ID NO: 12315 - protein, 26 aa, Mycobacterium avium
SPLTAALSLMWGWRLAVVCVTVAAAV

SEQ ID NO: 12316 - protein, 17 aa, Mycobacterium avium
SPPRWSSWLRVVLGAGL

SEQ ID NO: 12317 - protein, 18 aa, Mycobacterium avium
SPPSGRVRGWGTLAAAFV

SEQ ID NO: 12318 - protein, 19 aa, Mycobacterium avium
SPRLPRLAAAITLGVLSLG

SEQ ID NO: 12319 - protein, 19 aa, Mycobacterium avium
SPRRCDRSAVLAAIGEAAH

SEQ ID NO: 12320 - protein, 21 aa, Mycobacterium avium
SQLRTADWWWALLGLLVSALT

SEQ ID NO: 12321 - protein, 26 aa, Mycobacterium avium
SQRFSRRYTVVFCAMLALPIVPLFAY

SEQ ID NO: 12322 - protein, 26 aa, Mycobacterium avium
SQVKSGDAIERWARNLNRLGAQSAQE

SEQ ID NO: 12323 - protein, 25 aa, Mycobacterium avium
SRALSWAMPLAPWVFASATLGFVTI

SEQ ID NO: 12324 - protein, 23 aa, Mycobacterium avium
SRANPRRALLLLSLSDFHEITES

SEQ ID NO: 12325 - protein, 20 aa, Mycobacterium avium
SRARTAAIMLGRTDGTCVLH

SEQ ID NO: 12326 - protein, 21 aa, Mycobacterium avium
SRITLPGSIYLGAISVLPNLF

SEQ ID NO: 12327 - protein, 19 aa, Mycobacterium avium
SRKEGWGLAVVEAAQHRVP

SEQ ID NO: 12328 - protein, 20 aa, Mycobacterium avium
SRPLGAAVFGYFGDRLGRKK

SEQ ID NO: 12329 - protein, 19 aa, Mycobacterium avium
SRSYLAPTINAFTAQLSAG

SEQ ID NO: 12330 - protein, 20 aa, Mycobacterium avium
SRTALLLSLRTAAASTALCV

SEQ ID NO: 12331 - protein, 20 aa, Mycobacterium avium
SRTQPALDLDALIGGFKPLF

SEQ ID NO: 12332 - protein, 18 aa, Mycobacterium avium
SSGLYRFVRHPMYTGNVI

SEQ ID NO: 12333 - protein, 25 aa, Mycobacterium avium
SSGPLHLGGICWRGRNQRPVITGTT

SEQ ID NO: 12334 - protein, 23 aa, Mycobacterium avium
SSSCSYAAVALARALFRKGADFT

SEQ ID NO: 12335 - protein, 26 aa, Mycobacterium avium
SSVGGRRAWTIPLAVLGIIAIGATLL

SEQ ID NO: 12336 - protein, 23 aa, Mycobacterium avium
STFHEPFVLFGYLAAITSLELVT

SEQ ID NO: 12337 - protein, 25 aa, Mycobacterium avium
STLVLRRKFKPPLVLQDIEKYRPTA

SEQ ID NO: 12338 - protein, 23 aa, Mycobacterium avium
STMFCSFLAGLLATMADFTLFYA

SEQ ID NO: 12339 - protein, 18 aa, Mycobacterium avium
STQPLPVWGTWKTLLRVQ

SEQ ID NO: 12340 - protein, 20 aa, Mycobacterium avium
SVAARLAWTYLVPNGANFVD

SEQ ID NO: 12341 - protein, 21 aa, Mycobacterium avium
SVEPFRIGMAVLMMTRPRPVL

SEQ ID NO: 12342 - protein, 18 aa, Mycobacterium avium
SVGGVRIGPTVTIRQAGG

SEQ ID NO: 12343 - protein, 21 aa, Mycobacterium avium
SVHVYRLVWRQMILFAHNIVI

SEQ ID NO: 12344 - protein, 19 aa, Mycobacterium avium
SVLLEFAIQIARLHDKRKA

SEQ ID NO: 12345 - protein, 19 aa, Mycobacterium avium
SVLLPAFIALFGIVAALFL

SEQ ID NO: 12346 - protein, 35 aa, Mycobacterium avium
SVRLPEAGFRFLLYGFLCCAAFLVVRIEERHTRSV

SEQ ID NO: 12347 - protein, 25 aa, Mycobacterium avium
SVSKTAAMPPLWVIVSCALAMATGT

SEQ ID NO: 12348 - protein, 18 aa, Mycobacterium avium
SVTARVVPSNVFAVSSVQ

SEQ ID NO: 12349 - protein, 19 aa, Mycobacterium avium
SVTLSIQFALLAGQVGATS

SEQ ID NO: 12350 - protein, 20 aa, Mycobacterium avium
SVWCGLAGSAAMLIAARVVQ

SEQ ID NO: 12351 - protein, 21 aa, Mycobacterium avium
SWAMPARWGYAAASATVDLRH

SEQ ID NO: 12352 - protein, 23 aa, Mycobacterium avium
SWIMWVWYKLFAAMLGPSNFFAW

SEQ ID NO: 12353 - protein, 22 aa, Mycobacterium avium
SYAFYDFERGWALVGLAVAFAV

SEQ ID NO: 12354 - protein, 23 aa, Mycobacterium avium
SYDLSSLRYIVWGATPVNAEVAQ

SEQ ID NO: 12355 - protein, 19 aa, Mycobacterium avium
TAAALVFPAVFFPRLGPTV

SEQ ID NO: 12356 - protein, 18 aa, Mycobacterium avium
TAAARAGFAASIMASPAQ

SEQ ID NO: 12357 - protein, 20 aa, Mycobacterium avium
TAATRGWRGLRDAWVRPALV

SEQ ID NO: 12358 - protein, 18 aa, Mycobacterium avium
TADKQWRAAGMGRTAETY

SEQ ID NO: 12359 - protein, 23 aa, Mycobacterium avium
TAFQWNWKFGYQKVNFKDGTLTY

SEQ ID NO: 12360 - protein, 26 aa, Mycobacterium avium
TAFVVIFAVALVFYIVTSHHKKAGPT

SEQ ID NO: 12361 - protein, 17 aa, Mycobacterium avium
TAGCFALSFLAIGALRL

SEQ ID NO: 12362 - protein, 24 aa, Mycobacterium avium
TAHIRTGTLLGERMLTLESAGTGT

SEQ ID NO: 12363 - protein, 21 aa, Mycobacterium avium
TALGRWLSARFGWRRPQTLLV

SEQ ID NO: 12364 - protein, 28 aa, Mycobacterium avium
TALKTGACVRLHPRFDIDKVLHHIESDR

SEQ ID NO: 12365 - protein, 25 aa, Mycobacterium avium
TALNEGRGDFFAVVRSLALFVNALH

SEQ ID NO: 12366 - protein, 17 aa, Mycobacterium avium
TALPNRRQLVTALQGLP

SEQ ID NO: 12367 - protein, 23 aa, Mycobacterium avium
TALPVRGVLAASVITSWGVIPVQ

SEQ ID NO: 12368 - protein, 23 aa, Mycobacterium avium
TARLLLRSMGYRDALIGALLAGS

SEQ ID NO: 12369 - protein, 18 aa, Mycobacterium avium
TARNTWRALTSMGTALVL

SEQ ID NO: 12370 - protein, 24 aa, Mycobacterium avium
TATAPFKSATKWSGVSFAGHGDWV

SEQ ID NO: 12371 - protein, 25 aa, Mycobacterium avium
TATARIGFNLGFAVLDHSQHDVADR

SEQ ID NO: 12372 - protein, 28 aa, Mycobacterium avium
TATLGLRFYLRWITSTGYTYGALSTPIA

SEQ ID NO: 12373 - protein, 17 aa, Mycobacterium avium
TATVLLVVFLYDNFGLR

SEQ ID NO: 12374 - protein, 21 aa, Mycobacterium avium
TAVQYRLPVAFVLINNNAQAM

SEQ ID NO: 12375 - protein, 19 aa, Mycobacterium avium
TAVSEIWLSLDAAGRWLFG

SEQ ID NO: 12376 - protein, 18 aa, Mycobacterium avium
TCEITATVLLVVFLYDNF

SEQ ID NO: 12377 - protein, 25 aa, Mycobacterium avium
TDAEPRLRALGWTGILDKGPDVDAG

SEQ ID NO: 12378 - protein, 17 aa, Mycobacterium avium
TDLLLDALAQRRPVPRG

SEQ ID NO: 12379 - protein, 22 aa, Mycobacterium avium
TDMFPALAVAVTSQYVEPDEAE

SEQ ID NO: 12380 - protein, 17 aa, Mycobacterium avium
TDMPRVVKRQGQESFNF

SEQ ID NO: 12381 - protein, 18 aa, Mycobacterium avium
TDVSLRWSNAEDDLGKHH

SEQ ID NO: 12382 - protein, 17 aa, Mycobacterium avium
TEAGFRRGQIGSASLVS

SEQ ID NO: 12383 - protein, 30 aa, Mycobacterium avium
TEARPWPARDRPRRAGVSSFGISGTNAHVI

SEQ ID NO: 12384 - protein, 18 aa, Mycobacterium avium
TEGAWLVVVVFPLLVFVL

SEQ ID NO: 12385 - protein, 22 aa, Mycobacterium avium
TEGFFSPLFFVWLGASLQVREL

SEQ ID NO: 12386 - protein, 25 aa, Mycobacterium avium
TELFGRIVKILGWIWVATFAGMTVS

SEQ ID NO: 12387 - protein, 20 aa, Mycobacterium avium
TELRDWLARKAFYGGSAAPL

SEQ ID NO: 12388 - protein, 21 aa, Mycobacterium avium
TERGFSMALGRLGDPADGDCL

SEQ ID NO: 12389 - protein, 21 aa, Mycobacterium avium
TERGIGNGMSLLIFVGIAARI

SEQ ID NO: 12390 - protein, 32 aa, Mycobacterium avium
TESVVATSFYGRLSCSIFNAAGQRVVASANAS

SEQ ID NO: 12391 - protein, 17 aa, Mycobacterium avium
TETEFAVGVLIVSTAAL

SEQ ID NO: 12392 - protein, 17 aa, Mycobacterium avium
TFAAFTALCVFLPGIIG

SEQ ID NO: 12393 - protein, 26 aa, Mycobacterium avium
TFETPMLFCVGFLLTFLLGGLTGVML

SEQ ID NO: 12394 - protein, 19 aa, Mycobacterium avium
TFKDFRDGSTYDLFIAGVG

SEQ ID NO: 12395 - protein, 22 aa, Mycobacterium avium
TFLYELLWNLLIFVALLYADRR

SEQ ID NO: 12396 - protein, 20 aa, Mycobacterium avium
TGDARLIPRMVMAAAILAAF

SEQ ID NO: 12397 - protein, 22 aa, Mycobacterium avium
TGFARVVLLAAILGAALSSAFS

SEQ ID NO: 12398 - protein, 24 aa, Mycobacterium avium
TGIGMAWPHLSARAMASVNDPAEG

SEQ ID NO: 12399 - protein, 25 aa, Mycobacterium avium
TGLAYPLLVWVVAQFPGLRDHAEGS

SEQ ID NO: 12400 - protein, 19 aa, Mycobacterium avium
TGLWILVGLAVYDAIATIA

SEQ ID NO: 12401 - protein, 17 aa, Mycobacterium avium
TGRRVFRMAPFHHHFEL

SEQ ID NO: 12402 - protein, 27 aa, Mycobacterium avium
TGRVRRLAQLGGLVFVSAFTVVTLGMP

SEQ ID NO: 12403 - protein, 24 aa, Mycobacterium avium
TGSDPGWVSYHLFGPPPTTDHDLL

SEQ ID NO: 12404 - protein, 21 aa, Mycobacterium avium
TGTMHPMALIPVSRTSSPYSL

SEQ ID NO: 12405 - protein, 21 aa, Mycobacterium avium
TGTTVGLVFIWFSLTPSLLPR

SEQ ID NO: 12406 - protein, 25 aa, Mycobacterium avium
TGVGLGMSVARGFVEAMGGTITATD

SEQ ID NO: 12407 - protein, 22 aa, Mycobacterium avium
TIGRRKMVGLSLGVGLGAFGLS

SEQ ID NO: 12408 - protein, 19 aa, Mycobacterium avium
TILDSRGGMIFAAVLVAAL

SEQ ID NO: 12409 - protein, 24 aa, Mycobacterium avium
TILSGRLARHFGERVRAWISTVLA

SEQ ID NO: 12410 - protein, 26 aa, Mycobacterium avium
TIPAIALASIWLKGPLVLGLGAIQLV

SEQ ID NO: 12411 - protein, 26 aa, Mycobacterium avium
TITAIAVVVLLGWSFFYFSDDTRGYK

SEQ ID NO: 12412 - protein, 18 aa, Mycobacterium avium
TKIARAMVTEFGMSSKLG

SEQ ID NO: 12413 - protein, 18 aa, Mycobacterium avium
TKLKAAGFSKFKQANSPS

SEQ ID NO: 12414 - protein, 33 aa, Mycobacterium avium
TKRLAGKAWAVAAMVAALLFVGSAGFAGAMVQP

SEQ ID NO: 12415 - protein, 19 aa, Mycobacterium avium
TKWRGWADFGIAAGSWLPA

SEQ ID NO: 12416 - protein, 22 aa, Mycobacterium avium
TKYPSGYAVDLFNALSAKNAKV

SEQ ID NO: 12417 - protein, 19 aa, Mycobacterium avium
TLCALMLVSHESRERAASK

SEQ ID NO: 12418 - protein, 26 aa, Mycobacterium avium
TLFMIVSLTLTWLVYVSLRRDVAGDT

SEQ ID NO: 12419 - protein, 17 aa, Mycobacterium avium
TLIPLHLALAFRGMNTH

SEQ ID NO: 12420 - protein, 19 aa, Mycobacterium avium
TLLAGLAITGLGMGCTMMP

SEQ ID NO: 12421 - protein, 19 aa, Mycobacterium avium
TLLMLWVGHAHRTHRIQWL

SEQ ID NO: 12422 - protein, 17 aa, Mycobacterium avium
TLLSWYALVAALTTIPL

SEQ ID NO: 12423 - protein, 24 aa, Mycobacterium avium
TLQIGLGIGRLVFRALNTVEVVFA

SEQ ID NO: 12424 - protein, 25 aa, Mycobacterium avium
TLRPLRRLAAIAAHVAAMPLTDDDH

SEQ ID NO: 12425 - protein, 25 aa, Mycobacterium avium
TLSSLLLAAGLSWAAIQLAHLTGLS

SEQ ID NO: 12426 - protein, 23 aa, Mycobacterium avium
TLTLGDGRVVIWGTTDRTDEKAE

SEQ ID NO: 12427 - protein, 21 aa, Mycobacterium avium
TMCAGAFLGATMSRYVVAPVF

SEQ ID NO: 12428 - protein, 25 aa, Mycobacterium avium
TMFIPRFLFGVSFCGVLVATACYLL

SEQ ID NO: 12429 - protein, 19 aa, Mycobacterium avium
TMIAAIYGMNFHFMPELNW

SEQ ID NO: 12430 - protein, 21 aa, Mycobacterium avium
TMTGARPGGFGDLNAKTNEIC

SEQ ID NO: 12431 - protein, 19 aa, Mycobacterium avium
TMTLDWGYAAGVALFGVTL

SEQ ID NO: 12432 - protein, 20 aa, Mycobacterium avium
TMTRFYAAQRTFWVDPVSGT

SEQ ID NO: 12433 - protein, 24 aa, Mycobacterium avium
TNDILRLGMALIFLAVVITGSVIT

SEQ ID NO: 12434 - protein, 17 aa, Mycobacterium avium
TNSLIVWSGGFTINEAT

SEQ ID NO: 12435 - protein, 25 aa, Mycobacterium avium
TNVAAGNPWWANWFPTTKNPPEAPR

SEQ ID NO: 12436 - protein, 20 aa, Mycobacterium avium
TPALIRLFTRQGFGHHTRED

SEQ ID NO: 12437 - protein, 25 aa, Mycobacterium avium
TPARIRELIKLSGPDIYRDPAPVTR

SEQ ID NO: 12438 - protein, 20 aa, Mycobacterium avium
TPFLIISVLFYFTVVVQEKM

SEQ ID NO: 12439 - protein, 24 aa, Mycobacterium avium
TPGPLDWPGTVTFGVGLTVVLVGI

SEQ ID NO: 12440 - protein, 17 aa, Mycobacterium avium
TPLKMAAMILGLVLTGA

SEQ ID NO: 12441 - protein, 17 aa, Mycobacterium avium
TPLLLAVDGTLVGLISL

SEQ ID NO: 12442 - protein, 25 aa, Mycobacterium avium
TPPKWASWVRLVFGVALLALAAYHW

SEQ ID NO: 12443 - protein, 19 aa, Mycobacterium avium
TPRGRYTIPTPYGGPQLPI

SEQ ID NO: 12444 - protein, 45 aa, Mycobacterium avium
TPSLATLLGRWFWWPQHVRPRPASTMLRPYGPRRAVRELILADVD

SEQ ID NO: 12445 - protein, 41 aa, Mycobacterium avium
TPSVAALLGRWFWWPQRVRPRPASTMLRPYGPRPAVRQLLL

SEQ ID NO: 12446 - protein, 24 aa, Mycobacterium avium
TPTARACLRLGLTPDVVTVAGTIV

SEQ ID NO: 12447 - protein, 18 aa, Mycobacterium avium
TPVLGSWRSGIQVPAHLR

SEQ ID NO: 12448 - protein, 19 aa, Mycobacterium avium
TPYYPDARPAQLLLGTATR

SEQ ID NO: 12449 - protein, 19 aa, Mycobacterium avium
TQFAGCLDINASEKAARFV

SEQ ID NO: 12450 - protein, 24 aa, Mycobacterium avium
TQLTRQLRLELGHEAVRQAGELVR

SEQ ID NO: 12451 - protein, 24 aa, Mycobacterium avium
TQPKKAAAALAWLVEEMEQRYQDM

SEQ ID NO: 12452 - protein, 18 aa, Mycobacterium avium
TQPMPGPLSWFFHHLPKP

SEQ ID NO: 12453 - protein, 17 aa, Mycobacterium avium
TQQMLWTLIGVVTFALV

SEQ ID NO: 12454 - protein, 18 aa, Mycobacterium avium
TQSRAVAMGAVLLVTGLA

SEQ ID NO: 12455 - protein, 20 aa, Mycobacterium avium
TRALMVVGVVLVQFATANQL

SEQ ID NO: 12456 - protein, 19 aa, Mycobacterium avium
TRDEYRYTESLVYPALGNG

SEQ ID NO: 12457 - protein, 17 aa, Mycobacterium avium
TREVVRLVAEISMGAGT

SEQ ID NO: 12458 - protein, 22 aa, Mycobacterium avium
TRGKRWGRGLAVITQLLLLPVA

SEQ ID NO: 12459 - protein, 23 aa, Mycobacterium avium
TRGLGGFTHVASWWSEPIVFEKV

SEQ ID NO: 12460 - protein, 21 aa, Mycobacterium avium
TRGYIATALRLLERKIAHLPP

SEQ ID NO: 12461 - protein, 18 aa, Mycobacterium avium
TRLPAGVMVSHRNLQVNF

SEQ ID NO: 12462 - protein, 23 aa, Mycobacterium avium
TRLYLDGGLQFSTRDEYRYTESL

SEQ ID NO: 12463 - protein, 19 aa, Mycobacterium avium
TRNALVFGLVLTAGSFLWL

SEQ ID NO: 12464 - protein, 26 aa, Mycobacterium avium
TRNRRPRVSGWLWQALAALLIATVFA

SEQ ID NO: 12465 - protein, 21 aa, Mycobacterium avium
TRTEALIAHATRELRRDRTSF

SEQ ID NO: 12466 - protein, 24 aa, Mycobacterium avium
TRYGPMSVRLLFLVFGVGLIADAL

SEQ ID NO: 12467 - protein, 30 aa, Mycobacterium avium
TSLWGNCTIKVMVGFLFLYPAFVAKAHQAN

SEQ ID NO: 12468 - protein, 23 aa, Mycobacterium avium
TSMACVACSAWISDRVGRRRVML

SEQ ID NO: 12469 - protein, 24 aa, Mycobacterium avium
TSPGLPARGTVAVCDFGGSGTSIT

SEQ ID NO: 12470 - protein, 24 aa, Mycobacterium avium
TSPHSSWLVIRWVVASALGGPLLM

SEQ ID NO: 12471 - protein, 23 aa, Mycobacterium avium
TTAEFLVPLVLVFVADGHRWAWF

SEQ ID NO: 12472 - protein, 29 aa, Mycobacterium avium
TTARALSYRQVWPGAVAAALVWQLLQWFG

SEQ ID NO: 12473 - protein, 22 aa, Mycobacterium avium
TTDAPFDWYLGLLSRLASVSTA

SEQ ID NO: 12474 - protein, 22 aa, Mycobacterium avium
TTLVNLLMRFYDVDAGRISIDG

SEQ ID NO: 12475 - protein, 23 aa, Mycobacterium avium
TTPEEPEMALARGASLAAANARL

SEQ ID NO: 12476 - protein, 18 aa, Mycobacterium avium
TTPVQRLWEALRVLNDHQ

SEQ ID NO: 12477 - protein, 23 aa, Mycobacterium avium
TTSEQRKAATILRDGQIAALGAG

SEQ ID NO: 12478 - protein, 26 aa, Mycobacterium avium
TTVIIRFWLLTAIACGLGVALFYGEW

SEQ ID NO: 12479 - protein, 28 aa, Mycobacterium avium
TVEAAPLSALWARFPLPVIPAPGDPTPS

SEQ ID NO: 12480 - protein, 25 aa, Mycobacterium avium
TVEDRARNGLSILIAPEGTRVDTTE

SEQ ID NO: 12481 - protein, 24 aa, Mycobacterium avium
TVELRAALFDSPRFAVHRVGPFVL

SEQ ID NO: 12482 - protein, 25 aa, Mycobacterium avium
TVFGRGDIALAWAFLGAAIGSVIRP

SEQ ID NO: 12483 - protein, 17 aa, Mycobacterium avium
TVGALLVPRRTRRAAAL

SEQ ID NO: 12484 - protein, 24 aa, Mycobacterium avium
TVITRKAYGGAYCVMGSKDMGCDV

SEQ ID NO: 12485 - protein, 31 aa, Mycobacterium avium
TVLVILRLLYGIGMGGEWGLGAALAMEKVPV

SEQ ID NO: 12486 - protein, 21 aa, Mycobacterium avium
TVNPLRILAAMGIVMLGAAFF

SEQ ID NO: 12487 - protein, 17 aa, Mycobacterium avium
TVPPLVLAMTFGLSMDY

SEQ ID NO: 12488 - protein, 25 aa, Mycobacterium avium
TVSAKSLRPGDVIDLAAPEVVPADA

SEQ ID NO: 12489 - protein, 27 aa, Mycobacterium avium
TVSFPVVAYRSWRWWVATGAAFFAVVV

SEQ ID NO: 12490 - protein, 29 aa, Mycobacterium avium
TVTLELPATGGLYRFSNVTYRGVQLGKVT

SEQ ID NO: 12491 - protein, 19 aa, Mycobacterium avium
TVVFSFMALFFINILTTAL

SEQ ID NO: 12492 - protein, 24 aa, Mycobacterium avium
TVVICIAGALLGLLIGGRKEHAEE

SEQ ID NO: 12493 - protein, 21 aa, Mycobacterium avium
TVVLCVVALYAVNVVLTTIGV

SEQ ID NO: 12494 - protein, 20 aa, Mycobacterium avium
TVVLGWRLVGFLWATVAGAV

SEQ ID NO: 12495 - protein, 25 aa, Mycobacterium avium
TVWTVIAILALFGWPQVARIARGAV

SEQ ID NO: 12496 - protein, 19 aa, Mycobacterium avium
TVYSPLFRKFVEWIEYLCL

SEQ ID NO: 12497 - protein, 25 aa, Mycobacterium avium
TWRGFSDRLTREFAAPPALASSVLR

SEQ ID NO: 12498 - protein, 24 aa, Mycobacterium avium
TWTPRIAAQLAILAAAAFTYVTAE

SEQ ID NO: 12499 - protein, 18 aa, Mycobacterium avium
TYLDVCDQVLLMAPGGKT

SEQ ID NO: 12500 - protein, 25 aa, Mycobacterium avium
TYLGGWRIIRTLGKGLVEIQSPQGM

SEQ ID NO: 12501 - protein, 20 aa, Mycobacterium avium
TYLSHDWGRDWGSLRRFETI

SEQ ID NO: 12502 - protein, 20 aa, Mycobacterium avium
TYRVWKARGTWWGWHGAGWF

SEQ ID NO: 12503 - protein, 18 aa, Mycobacterium avium
TYVYIPFQYLSVILGAYL

SEQ ID NO: 12504 - protein, 27 aa, Mycobacterium avium
VAAALVWQLLQWFGAGYVAHVVKRASA

SEQ ID NO: 12505 - protein, 23 aa, Mycobacterium avium
VAACAACGIIYELALLTLSASLD

SEQ ID NO: 12506 - protein, 17 aa, Mycobacterium avium
VAACLLLEYGVATAAVS

SEQ ID NO: 12507 - protein, 23 aa, Mycobacterium avium
VAAGACSVLHAWADAGAAGAEFV

SEQ ID NO: 12508 - protein, 19 aa, Mycobacterium avium
VAAIRNWSVGYVKRHPVAS

SEQ ID NO: 12509 - protein, 18 aa, Mycobacterium avium
VAALSAWGLYRFNQIVAN

SEQ ID NO: 12510 - protein, 26 aa, Mycobacterium avium
VAATLMLLSGFGAMVVEARPGSTLYG

SEQ ID NO: 12511 - protein, 19 aa, Mycobacterium avium
VACQVPIYLMRSSKQTALE

SEQ ID NO: 12512 - protein, 25 aa, Mycobacterium avium
VAEAAYRLIELALRGGGPDNVTVVV

SEQ ID NO: 12513 - protein, 23 aa, Mycobacterium avium
VAEFGWGVTCFITVVAGVLQVLL

SEQ ID NO: 12514 - protein, 20 aa, Mycobacterium avium
VAESLPASGRAAVLGAMAID

SEQ ID NO: 12515 - protein, 23 aa, Mycobacterium avium
VAGCLGMLGWLSVEQIRDGRPTT

SEQ ID NO: 12516 - protein, 23 aa, Mycobacterium avium
VAGISCLILIFTIMLIITRSVVA

SEQ ID NO: 12517 - protein, 23 aa, Mycobacterium avium
VAGRMPGHMNVLLAEAEVDYDAM

SEQ ID NO: 12518 - protein, 22 aa, Mycobacterium avium
VAGSVLEYAGWAVAMHLWFLAV

SEQ ID NO: 12519 - protein, 26 aa, Mycobacterium avium
VAHRIGEPFGSLVLAAAVTIIEVALI

SEQ ID NO: 12520 - protein, 23 aa, Mycobacterium avium
VAIAPRRWGLRDAVRAADHQAVH

SEQ ID NO: 12521 - protein, 25 aa, Mycobacterium avium
VAIFLCGVCSIPGRHTVADRYVLVP

SEQ ID NO: 12522 - protein, 23 aa, Mycobacterium avium
VAINARPGVVLVIPGDSPHVLTV

SEQ ID NO: 12523 - protein, 19 aa, Mycobacterium avium
VAIPLTVLIIFTLNILLAE

SEQ ID NO: 12524 - protein, 23 aa, Mycobacterium avium
VALDDPRAATAWTADIITGTDLA

SEQ ID NO: 12525 - protein, 24 aa, Mycobacterium avium
VALIAVGIGLRLVFGEMTLTAGLT

SEQ ID NO: 12526 - protein, 17 aa, Mycobacterium avium
VALMRWTPIDLLPKHHE

SEQ ID NO: 12527 - protein, 19 aa, Mycobacterium avium
VALTFVWLGMVLAISFLEA

SEQ ID NO: 12528 - protein, 26 aa, Mycobacterium avium
VALTVLWLLNIGEYLQDLTLRRTRRA

SEQ ID NO: 12529 - protein, 19 aa, Mycobacterium avium
VALVGLLTLPGYRTNYNDR

SEQ ID NO: 12530 - protein, 24 aa, Mycobacterium avium
VALVIATAVAVSWTARALGMDPHA

SEQ ID NO: 12531 - protein, 20 aa, Mycobacterium avium
VAMARRRVAALHAQGLTEAR

SEQ ID NO: 12532 - protein, 23 aa, Mycobacterium avium
VANLELYLIFPLKNEQATIQLVR

SEQ ID NO: 12533 - protein, 18 aa, Mycobacterium avium
VAQVAAVLLVWRRASDGW

SEQ ID NO: 12534 - protein, 32 aa, Mycobacterium avium
VARVAAWWRQIRWRPVLAYALPGTPAVVLGAN

SEQ ID NO: 12535 - protein, 18 aa, Mycobacterium avium
VASGRVAYALGLEGPAVS

SEQ ID NO: 12536 - protein, 19 aa, Mycobacterium avium
VASIVAHVLAGLLIIGTAV

SEQ ID NO: 12537 - protein, 18 aa, Mycobacterium avium
VATKRMGAVFNEYKSNSS

SEQ ID NO: 12538 - protein, 18 aa, Mycobacterium avium
VAVACIIGALTLFSGPTG

SEQ ID NO: 12539 - protein, 18 aa, Mycobacterium avium
VAVIFGFVLWHVIGANSS

SEQ ID NO: 12540 - protein, 21 aa, Mycobacterium avium
VAVLFAWGGWQRRWIADDGLI

SEQ ID NO: 12541 - protein, 19 aa, Mycobacterium avium
VAVLVYLFAVDWRVALVLF

SEQ ID NO: 12542 - protein, 25 aa, Mycobacterium avium
VDAEPAAWLRFWFPDPDGSKTEFQR

SEQ ID NO: 12543 - protein, 26 aa, Mycobacterium avium
VDDALELRGRILGAFEAAEVATDPAE

SEQ ID NO: 12544 - protein, 24 aa, Mycobacterium avium
VDGGKRLRQVAVRRAPKPGPPADR

SEQ ID NO: 12545 - protein, 24 aa, Mycobacterium avium
VDGPLRPGHWLMMAAISVSTLGAM

SEQ ID NO: 12546 - protein, 25 aa, Mycobacterium avium
VDLQFKPAAANTWADFTAAHIGTQT

SEQ ID NO: 12547 - protein, 23 aa, Mycobacterium avium
VDLRPMLTHTFTLDRWRDAFHAL

SEQ ID NO: 12548 - protein, 17 aa, Mycobacterium avium
VDTRLDRPVAVKVMDPR

SEQ ID NO: 12549 - protein, 17 aa, Mycobacterium avium
VDVEIMNALLLPIVLGL

SEQ ID NO: 12550 - protein, 21 aa, Mycobacterium avium
VDYSLFILMRFREELRSGRQP

SEQ ID NO: 12551 - protein, 22 aa, Mycobacterium avium
VDYYPTKRLNFIDTAANPTTCV

SEQ ID NO: 12552 - protein, 17 aa, Mycobacterium avium
VEDEMFDRITVPTLIIR

SEQ ID NO: 12553 - protein, 24 aa, Mycobacterium avium
VEDLPHPWLDAVGIPDRVGDAIMA

SEQ ID NO: 12554 - protein, 17 aa, Mycobacterium avium
VEEQFYLVWPLLIIAVA

SEQ ID NO: 12555 - protein, 33 aa, Mycobacterium avium
VEFAGFIAWLAWLLLHLYYLIGHRNRLAAMFAW

SEQ ID NO: 12556 - protein, 18 aa, Mycobacterium avium
VEGYNFLNLLGLGPATGI

SEQ ID NO: 12557 - protein, 17 aa, Mycobacterium avium
VEIMNALLLPIVLGLLL

SEQ ID NO: 12558 - protein, 18 aa, Mycobacterium avium
VELRLPRQLPVLAPGQEW

SEQ ID NO: 12559 - protein, 18 aa, Mycobacterium avium
VELTGHWVLQPAFKASMA

SEQ ID NO: 12560 - protein, 27 aa, Mycobacterium avium
VETEPSWRRRLDDLSYSPALAPLRAPL

SEQ ID NO: 12561 - protein, 21 aa, Mycobacterium avium
VETQVGFKMAKWINQIEFVDD

SEQ ID NO: 12562 - protein, 23 aa, Mycobacterium avium
VFAARKSWSVLYLLLAAIAGALP

SEQ ID NO: 12563 - protein, 18 aa, Mycobacterium avium
VFATLGIFVACSYASLTH

SEQ ID NO: 12564 - protein, 24 aa, Mycobacterium avium
VFDIEIVFLYPWAVSYDALGTFAL

SEQ ID NO: 12565 - protein, 17 aa, Mycobacterium avium
VFGESLGSFGGEAPFMS

SEQ ID NO: 12566 - protein, 23 aa, Mycobacterium avium
VFGFGVIFGAIWAEEAWGRYWGW

SEQ ID NO: 12567 - protein, 21 aa, Mycobacterium avium
VFGGAGAIFPIFMIGGVAMMM

SEQ ID NO: 12568 - protein, 25 aa, Mycobacterium avium
VFGGLSVGMGVAWICVISAEMISGR

SEQ ID NO: 12569 - protein, 23 aa, Mycobacterium avium
VFGQMRFDRTNGYSAEFSNISGL

SEQ ID NO: 12570 - protein, 17 aa, Mycobacterium avium
VFHAMMRSLSSLVDTLS

SEQ ID NO: 12571 - protein, 27 aa, Mycobacterium avium
VFLYDNFGLRWGLFGAAAIMVVTSFVV

SEQ ID NO: 12572 - protein, 22 aa, Mycobacterium avium
VFRAEVLRVRALDYVEAAFLSG

SEQ ID NO: 12573 - protein, 18 aa, Mycobacterium avium
VFSSFWFTAIYVLLFVSL

SEQ ID NO: 12574 - protein, 20 aa, Mycobacterium avium
VFTGYPFLRGALRSLRSGRA

SEQ ID NO: 12575 - protein, 17 aa, Mycobacterium avium
VFTMRIAAAIGFLQMKR

SEQ ID NO: 12576 - protein, 25 aa, Mycobacterium avium
VGAAELAFLVAMVMARPDPGALAHG

SEQ ID NO: 12577 - protein, 26 aa, Mycobacterium avium
VGAFLRLPYTFAVPVFGGRNWTTISA

SEQ ID NO: 12578 - protein, 21 aa, Mycobacterium avium
VGALADWFAVTALFRHPLGIP

SEQ ID NO: 12579 - protein, 24 aa, Mycobacterium avium
VGALAILVMVVWVGTALTISTTAS

SEQ ID NO: 12580 - protein, 27 aa, Mycobacterium avium
VGATVVFGAFAHRWLARRTRRRINPGL

SEQ ID NO: 12581 - protein, 17 aa, Mycobacterium avium
VGFLCAFAPNFTVLVIL

SEQ ID NO: 12582 - protein, 19 aa, Mycobacterium avium
VGFVTVFVFWQSVNVREPL

SEQ ID NO: 12583 - protein, 21 aa, Mycobacterium avium
VGIALWLPWLIVAGVMFILSS

SEQ ID NO: 12584 - protein, 19 aa, Mycobacterium avium
VGIAPAWVALCGASVLAVR

SEQ ID NO: 12585 - protein, 20 aa, Mycobacterium avium
VGLASYLLIGFWYHKPTAAT

SEQ ID NO: 12586 - protein, 23 aa, Mycobacterium avium
VGLCVGVSIVLPAAVWGVLTPGR

SEQ ID NO: 12587 - protein, 19 aa, Mycobacterium avium
VGLIMPNNTRWVLIAIALT

SEQ ID NO: 12588 - protein, 24 aa, Mycobacterium avium
VGLRPGEEKLVFSRFWRADPSRVR

SEQ ID NO: 12589 - protein, 17 aa, Mycobacterium avium
VGLVFNRLMAVARPARP

SEQ ID NO: 12590 - protein, 24 aa, Mycobacterium avium
VGLVTCWLLLGVPFGIAAVVTGDI

SEQ ID NO: 12591 - protein, 17 aa, Mycobacterium avium
VGNYRAATQVALGSSEE

SEQ ID NO: 12592 - protein, 28 aa, Mycobacterium avium
VGPFKKGPFRIAMAAGIPIVPIVIRNAE

SEQ ID NO: 12593 - protein, 27 aa, Mycobacterium avium
VGPTWFAWLTVIWLWLTVLFANLAEAV

SEQ ID NO: 12594 - protein, 23 aa, Mycobacterium avium
VGSSTWIAWAAWAAIALAVITLI

SEQ ID NO: 12595 - protein, 25 aa, Mycobacterium avium
VGTPAMWWLAVPVLVFALWRMLVRR

SEQ ID NO: 12596 - protein, 18 aa, Mycobacterium avium
VGTWWRYRYDKFGWTSRS

SEQ ID NO: 12597 - protein, 19 aa, Mycobacterium avium
VGVATCWEVIFDRVPRRAV

SEQ ID NO: 12598 - protein, 18 aa, Mycobacterium avium
VGVLLSMAPLWFSSYVLQ

SEQ ID NO: 12599 - protein, 18 aa, Mycobacterium avium
VGWEVDPYAIPLFQTAHR

SEQ ID NO: 12600 - protein, 24 aa, Mycobacterium avium
VGYLAAALVCFLLIITIPFGFASL

SEQ ID NO: 12601 - protein, 30 aa, Mycobacterium avium
VGYLLVQGLYRWFPPITVWTGLSLLAVAVI

SEQ ID NO: 12602 - protein, 25 aa, Mycobacterium avium
VHAYPRTGSVVIWYSPRRCDRSAVL

SEQ ID NO: 12603 - protein, 17 aa, Mycobacterium avium
VHLHIAGPGLVPFDSED

SEQ ID NO: 12604 - protein, 19 aa, Mycobacterium avium
VHNCYYEIFDQLGPQLRWW

SEQ ID NO: 12605 - protein, 26 aa, Mycobacterium avium
VHTDGPLPPRRAIEIIADACQALNFS

SEQ ID NO: 12606 - protein, 22 aa, Mycobacterium avium
VIDEFYEWFRIMPTAVDVLDSI

SEQ ID NO: 12607 - protein, 25 aa, Mycobacterium avium
VIDGEIKQRYELFTSVGARDANDYE

SEQ ID NO: 12608 - protein, 24 aa, Mycobacterium avium
VIEGACTFLALPRLTGVLASIPER

SEQ ID NO: 12609 - protein, 24 aa, Mycobacterium avium
VIGGAALALLGVRRYVFARPPLLG

SEQ ID NO: 12610 - protein, 24 aa, Mycobacterium avium
VIGLGCGFGPLNNRFFPPMGSILY

SEQ ID NO: 12611 - protein, 27 aa, Mycobacterium avium
VIHLSMIFFWGWGRLTAAMIFGSVRNT

SEQ ID NO: 12612 - protein, 26 aa, Mycobacterium avium
VILVAWRWVPAKVRRVPGPLVAIVAV

SEQ ID NO: 12613 - protein, 24 aa, Mycobacterium avium
VIPYIMICLIAFMLFNGGGLQLMG

SEQ ID NO: 12614 - protein, 25 aa, Mycobacterium avium
VIVAVARWRGLLALVGILVAFVVLV

SEQ ID NO: 12615 - protein, 20 aa, Mycobacterium avium
VKAEMLVGTPAMWWLAVPVL

SEQ ID NO: 12616 - protein, 19 aa, Mycobacterium avium
VKGLGIAGGAKRPGAKKSA

SEQ ID NO: 12617 - protein, 18 aa, Mycobacterium avium
VKLTSPMNLGSWILSAFS

SEQ ID NO: 12618 - protein, 21 aa, Mycobacterium avium
VKSNIAFRIALRAESGDDSRE

SEQ ID NO: 12619 - protein, 24 aa, Mycobacterium avium
VLAEVWKTTPFMSLLLLAGLALVP

SEQ ID NO: 12620 - protein, 17 aa, Mycobacterium avium
VLALALFVFVCYHVAGI

SEQ ID NO: 12621 - protein, 23 aa, Mycobacterium avium
VLATCYRPLLFATVDPDVAAARG

SEQ ID NO: 12622 - protein, 24 aa, Mycobacterium avium
VLAWATSGINGWFYVGNYGVPWYD

SEQ ID NO: 12623 - protein, 18 aa, Mycobacterium avium
VLDHPQPFFAPIAAAVSL

SEQ ID NO: 12624 - protein, 25 aa, Mycobacterium avium
VLDMSRRYGADFGFTSYDPAWIDTL

SEQ ID NO: 12625 - protein, 19 aa, Mycobacterium avium
VLFTGLWALIAYFRAEVRR

SEQ ID NO: 12626 - protein, 17 aa, Mycobacterium avium
VLILLVLAVLGLRDKVI

SEQ ID NO: 12627 - protein, 17 aa, Mycobacterium avium
VLLIFTIGVTWSSVHYL

SEQ ID NO: 12628 - protein, 24 aa, Mycobacterium avium
VLLVKKIWWPLAVWLLLVVVNVDA

SEQ ID NO: 12629 - protein, 31 aa, Mycobacterium avium
VLLVLLIWVLFVWRRRRPGPEATGYGVDHGY

SEQ ID NO: 12630 - protein, 20 aa, Mycobacterium avium
VLLVWRRASDGWAFTCLALV

SEQ ID NO: 12631 - protein, 29 aa, Mycobacterium avium
VLLYRMLTCWLPVFVGWPVMRWLTKHEMV

SEQ ID NO: 12632 - protein, 20 aa, Mycobacterium avium
VLLYWQWRTMPAVIWEVTAP

SEQ ID NO: 12633 - protein, 23 aa, Mycobacterium avium
VLMGMCGAMFGMVLTGQRLPGRA

SEQ ID NO: 12634 - protein, 17 aa, Mycobacterium avium
VLNHGGMLRVEDTVPGG

SEQ ID NO: 12635 - protein, 26 aa, Mycobacterium avium
VLPFFAMGVGMAFVWSPLTATATRNL

SEQ ID NO: 12636 - protein, 28 aa, Mycobacterium avium
VLSLPLYLMCGLARHRRLLSQEAAMKYF

SEQ ID NO: 12637 - protein, 18 aa, Mycobacterium avium
VLTECLTGVPPYRADTVE

SEQ ID NO: 12638 - protein, 25 aa, Mycobacterium avium
VLTHLRAGVLYNIAFPGAYLCLSAA

SEQ ID NO: 12639 - protein, 29 aa, Mycobacterium avium
VLTLAVGWRSRRWRTVWVPVAALAGAAVA

SEQ ID NO: 12640 - protein, 21 aa, Mycobacterium avium
VLTRPRLTGICGSDAKQILMD

SEQ ID NO: 12641 - protein, 19 aa, Mycobacterium avium
VLVILAMLLWVYRSVTAVF

SEQ ID NO: 12642 - protein, 28 aa, Mycobacterium avium
VLVMLLCLFGMLVILLRRGHVPGVASGP

SEQ ID NO: 12643 - protein, 19 aa, Mycobacterium avium
VLVYTELWVGFTAVTALLI

SEQ ID NO: 12644 - protein, 19 aa, Mycobacterium avium
VLWGAGWVAVLAVLTRLRH

SEQ ID NO: 12645 - protein, 24 aa, Mycobacterium avium
VMTLVVLLGTWVWVGVTNDQYNQL

SEQ ID NO: 12646 - protein, 36 aa, Mycobacterium avium
VMVPALMAMFAQWNWWLPPWLSRVLPSVDFDRPLPE

SEQ ID NO: 12647 - protein, 24 aa, Mycobacterium avium
VNFRDVLVALGMYPGGGRLGAEGA

SEQ ID NO: 12648 - protein, 29 aa, Mycobacterium avium
VNIPANRKRVVAVSFPRDLAITPMQCEAW

SEQ ID NO: 12649 - protein, 26 aa, Mycobacterium avium
VPAHLRSGWYRLPARDKARPLLVVSA

SEQ ID NO: 12650 - protein, 22 aa, Mycobacterium avium
VPARSLVGLAVGWVVGALVVLV

SEQ ID NO: 12651 - protein, 17 aa, Mycobacterium avium
VPDVSSLSYSDAVTKLK

SEQ ID NO: 12652 - protein, 21 aa, Mycobacterium avium
VPESPRWLFIHGREEEAEHIV

SEQ ID NO: 12653 - protein, 18 aa, Mycobacterium avium
VPGSAGFGYADPAGESAG

SEQ ID NO: 12654 - protein, 22 aa, Mycobacterium avium
VPHARTAAFFDLDKTIIAKSST

SEQ ID NO: 12655 - protein, 29 aa, Mycobacterium avium
VPIVAEHKVFFCVAAILLVMALNLRGVRE

SEQ ID NO: 12656 - protein, 26 aa, Mycobacterium avium
VPLIWVLSVVLERGWYAVTRSGWWTH

SEQ ID NO: 12657 - protein, 20 aa, Mycobacterium avium
VPLTLIAMVMIQFSLPSHEK

SEQ ID NO: 12658 - protein, 26 aa, Mycobacterium avium
VPLVLFCSTGGWPTALAAFVMIVFHL

SEQ ID NO: 12659 - protein, 24 aa, Mycobacterium avium
VPPARYTKMTAMPQLVAFFNGVGG

SEQ ID NO: 12660 - protein, 21 aa, Mycobacterium avium
VPSVICAVTVTWLDPYLDTGG

SEQ ID NO: 12661 - protein, 26 aa, Mycobacterium avium
VPTGIKFFNWIGTMWKGQLTFETPML

SEQ ID NO: 12662 - protein, 24 aa, Mycobacterium avium
VPVEGRVGLLRKVLDSASITVNPI

SEQ ID NO: 12663 - protein, 18 aa, Mycobacterium avium
VPYAYAMVGAAWALTFTF

SEQ ID NO: 12664 - protein, 20 aa, Mycobacterium avium
VQFICGGSFETAGGPRAPDY

SEQ ID NO: 12665 - protein, 26 aa, Mycobacterium avium
VQPFGEYLPMPWLFKHLSGYADRAGA

SEQ ID NO: 12666 - protein, 18 aa, Mycobacterium avium
VQTLGGWGYITDHPVEKW

SEQ ID NO: 12667 - protein, 20 aa, Mycobacterium avium
VRANTIWEIRDSGTVLPAFQ

SEQ ID NO: 12668 - protein, 21 aa, Mycobacterium avium
VRGSRNIPCTDIPGKRAATPR

SEQ ID NO: 12669 - protein, 18 aa, Mycobacterium avium
VRIDGEIVLLLFLPAILY

SEQ ID NO: 12670 - protein, 24 aa, Mycobacterium avium
VRIPRNRAVVMLVIDVSQSMRATD

SEQ ID NO: 12671 - protein, 17 aa, Mycobacterium avium
VRLLLRFDTLPTVTEIV

SEQ ID NO: 12672 - protein, 21 aa, Mycobacterium avium
VRLPWDYRRLYGLDPDEQPVA

SEQ ID NO: 12673 - protein, 21 aa, Mycobacterium avium
VRLWWDKPWPMRIAALARLPL

SEQ ID NO: 12674 - protein, 18 aa, Mycobacterium avium
VRQGALAEWNEAWRSDQF

SEQ ID NO: 12675 - protein, 19 aa, Mycobacterium avium
VRQRFFALFLYVVMLVGVV

SEQ ID NO: 12676 - protein, 19 aa, Mycobacterium avium
VRRRRVVVAITLVLGAAVL

SEQ ID NO: 12677 - protein, 33 aa, Mycobacterium avium
VRTCDCFNIPIIMLVDVPGFLPGTGQEYNGIIR

SEQ ID NO: 12678 - protein, 20 aa, Mycobacterium avium
VRVGDEVLAAGAPLGLRSTV

SEQ ID NO: 12679 - protein, 18 aa, Mycobacterium avium
VRVMPVFAVKSGAFFAAI

SEQ ID NO: 12680 - protein, 25 aa, Mycobacterium avium
VRWGVAGRMGVAWLVTLPLAGLVGA

SEQ ID NO: 12681 - protein, 19 aa, Mycobacterium avium
VSCQHCMFYVNAYHTANVC

SEQ ID NO: 12682 - protein, 18 aa, Mycobacterium avium
VSGAICWAGGTTALVYFA

SEQ ID NO: 12683 - protein, 29 aa, Mycobacterium avium
VSPLIRYLIKVPREFINDYLFNFPDTSIA

SEQ ID NO: 12684 - protein, 23 aa, Mycobacterium avium
VSRLKPGQSVRVAGIRVGTVNSV

SEQ ID NO: 12685 - protein, 19 aa, Mycobacterium avium
VSSLVWLQIGIGVAVLAVV

SEQ ID NO: 12686 - protein, 22 aa, Mycobacterium avium
VSSRRAAVVLIFSMLGFAIAVL

SEQ ID NO: 12687 - protein, 17 aa, Mycobacterium avium
VSVCLGAAYLIAQLVGL

SEQ ID NO: 12688 - protein, 21 aa, Mycobacterium avium
VSVLLGIGIGWGLYGNTSSPL

SEQ ID NO: 12689 - protein, 26 aa, Mycobacterium avium
VTAAGATAAWAIGRWTPGTERRTATM

SEQ ID NO: 12690 - protein, 19 aa, Mycobacterium avium
VTAARWPGRTAIIDDDGAL

SEQ ID NO: 12691 - protein, 24 aa, Mycobacterium avium
VTALQRLGIRISIDDYGTGWSSLA

SEQ ID NO: 12692 - protein, 17 aa, Mycobacterium avium
VTARAGLDDALAAVPTI

SEQ ID NO: 12693 - protein, 18 aa, Mycobacterium avium
VTFSASDKPVIFWTPEHG

SEQ ID NO: 12694 - protein, 17 aa, Mycobacterium avium
VTFVDHLSGWQLTATRP

SEQ ID NO: 12695 - protein, 17 aa, Mycobacterium avium
VTGKALQEFGRYQSVVY

SEQ ID NO: 12696 - protein, 24 aa, Mycobacterium avium
VTLLPAIMVLAGPRGWIRPRRELT

SEQ ID NO: 12697 - protein, 24 aa, Mycobacterium avium
VTRDFPGTITITFAYIGLTCPRWR

SEQ ID NO: 12698 - protein, 17 aa, Mycobacterium avium
VTRSGWWTHSLHGVLPE

SEQ ID NO: 12699 - protein, 23 aa, Mycobacterium avium
VTTRWPYADVVVAVLVALWVLPR

SEQ ID NO: 12700 - protein, 26 aa, Mycobacterium avium
VVAAAVGIGWWLLRPDDDTITVTAQF

SEQ ID NO: 12701 - protein, 19 aa, Mycobacterium avium
VVAEMRKVIWPNRKQMLTY

SEQ ID NO: 12702 - protein, 18 aa, Mycobacterium avium
VVALKVLPPHLAEDQDFQ

SEQ ID NO: 12703 - protein, 17 aa, Mycobacterium avium
VVGDLMSVPGVPGMAQG

SEQ ID NO: 12704 - protein, 24 aa, Mycobacterium avium
VVHTFWVPEFLFKRDVIPNAEANN

SEQ ID NO: 12705 - protein, 23 aa, Mycobacterium avium
VVISCIKAALFGLIAGLVACYRG

SEQ ID NO: 12706 - protein, 19 aa, Mycobacterium avium
VVKGFRAITSTVWWSHSQA

SEQ ID NO: 12707 - protein, 23 aa, Mycobacterium avium
VVLLFARPRLRIGPAGVSVRNLL

SEQ ID NO: 12708 - protein, 31 aa, Mycobacterium avium
VVLPPLLAVCGRRLFWPFIPVDRPATESGAW

SEQ ID NO: 12709 - protein, 23 aa, Mycobacterium avium
VVMTCILPPLLYHAALESSLVGI

SEQ ID NO: 12710 - protein, 18 aa, Mycobacterium avium
VVPPVMKVLRERDAMVAK

SEQ ID NO: 12711 - protein, 18 aa, Mycobacterium avium
VVRAKLYLQCAIAGTPRF

SEQ ID NO: 12712 - protein, 23 aa, Mycobacterium avium
VVSKIDVHRGWREVLAANRDTLA

SEQ ID NO: 12713 - protein, 17 aa, Mycobacterium avium
VVTLILALILKYTMGLR

SEQ ID NO: 12714 - protein, 22 aa, Mycobacterium avium
VVVAPCWIFRRSVLAWDGQIAW

SEQ ID NO: 12715 - protein, 18 aa, Mycobacterium avium
VVVLLLIFAKSWAFDPEK

SEQ ID NO: 12716 - protein, 18 aa, Mycobacterium avium
VVVLMAFAVYAVISAALY

SEQ ID NO: 12717 - protein, 26 aa, Mycobacterium avium
VVVVPEIPRLPSGKVLRRVLKERHGC

SEQ ID NO: 12718 - protein, 18 aa, Mycobacterium avium
VWAVCAALLVPLTLSDVS

SEQ ID NO: 12719 - protein, 18 aa, Mycobacterium avium
VWLGEISYEIFLIHLITM

SEQ ID NO: 12720 - protein, 20 aa, Mycobacterium avium
VWNDFLWPLLMIQRSSLATL

SEQ ID NO: 12721 - protein, 28 aa, Mycobacterium avium
VWVGLAYPWCDLMLLALAAGMLPILGWR

SEQ ID NO: 12722 - protein, 24 aa, Mycobacterium avium
VWWRQLAGMSYVWWALAVIVAAGV

SEQ ID NO: 12723 - protein, 20 aa, Mycobacterium avium
VYAGLLLLMRARLKRLPIAV

SEQ ID NO: 12724 - protein, 18 aa, Mycobacterium avium
VYASMAVTFLFGAPDMIV

SEQ ID NO: 12725 - protein, 19 aa, Mycobacterium avium
VYDMALVFRHRVRKDRLIS

SEQ ID NO: 12726 - protein, 18 aa, Mycobacterium avium
VYFVTYRWCIGLQRSDRA

SEQ ID NO: 12727 - protein, 27 aa, Mycobacterium avium
VYPGFPADVLYEFRLVSLAAQLVLWAG

SEQ ID NO: 12728 - protein, 23 aa, Mycobacterium avium
VYQQRFCGGVDFRAMSALQNGVA

SEQ ID NO: 12729 - protein, 22 aa, Mycobacterium avium
VYRSAVTMLLPLVTILLSLVIA

SEQ ID NO: 12730 - protein, 17 aa, Mycobacterium avium
WAAALVCAVLVAVAATW

SEQ ID NO: 12731 - protein, 17 aa, Mycobacterium avium
WADFGIAAGSWLPAVLW

SEQ ID NO: 12732 - protein, 21 aa, Mycobacterium avium
WAEEAWGRYWGWDPKETVSFV

SEQ ID NO: 12733 - protein, 25 aa, Mycobacterium avium
WAPTARLGSMYGYGISYAIASLSCT

SEQ ID NO: 12734 - protein, 19 aa, Mycobacterium avium
WAQNALSFVGFVPPDENDL

SEQ ID NO: 12735 - protein, 21 aa, Mycobacterium avium
WATPARWGFAASASTADLTKL

SEQ ID NO: 12736 - protein, 17 aa, Mycobacterium avium
WDGAPAVMSRGWGAAVG

SEQ ID NO: 12737 - protein, 19 aa, Mycobacterium avium
WDGGLGIWGAVALGAVGAW

SEQ ID NO: 12738 - protein, 18 aa, Mycobacterium avium
WDTLLFFAGLFVMVGALV

SEQ ID NO: 12739 - protein, 26 aa, Mycobacterium avium
WEKHCYDIPICWSLRNIFETLDGVDT

SEQ ID NO: 12740 - protein, 27 aa, Mycobacterium avium
WEKHCYDIPICWSLRSLFDALDGFDQL

SEQ ID NO: 12741 - protein, 19 aa, Mycobacterium avium
WFAVTALFRHPLGIPIPHT

SEQ ID NO: 12742 - protein, 18 aa, Mycobacterium avium
WFFLLKRYTVEGPLEHDA

SEQ ID NO: 12743 - protein, 26 aa, Mycobacterium avium
WGGALAGIALKVCWPTAPRWLGVPLY

SEQ ID NO: 12744 - protein, 17 aa, Mycobacterium avium
WGLGAALAMEKVPVERR

SEQ ID NO: 12745 - protein, 22 aa, Mycobacterium avium
WGLVACLPWAFVVIPLIDTGRP

SEQ ID NO: 12746 - protein, 18 aa, Mycobacterium avium
WGSQWALVRLPEDRRDAD

SEQ ID NO: 12747 - protein, 19 aa, Mycobacterium avium
WHASFSIAAGVLYFFFVLP

SEQ ID NO: 12748 - protein, 19 aa, Mycobacterium avium
WHFVISAPLTYGWLLVLMI

SEQ ID NO: 12749 - protein, 26 aa, Mycobacterium avium
WHQLMPRYTRPHVRLFTGRVNTGCGP

SEQ ID NO: 12750 - protein, 24 aa, Mycobacterium avium
WHQVKVVSAPSWFSDYVLSVGAVD

SEQ ID NO: 12751 - protein, 26 aa, Mycobacterium avium
WICAPLAIAVLWRWILAPTDGAVSAV

SEQ ID NO: 12752 - protein, 25 aa, Mycobacterium avium
WIPYGRADLVIGIVVVMVGATALMA

SEQ ID NO: 12753 - protein, 23 aa, Mycobacterium avium
WIRELRPHIDLYLLTDESIAAGD

SEQ ID NO: 12754 - protein, 20 aa, Mycobacterium avium
WIRRAHHRLSFQLSGAQLGI

SEQ ID NO: 12755 - protein, 24 aa, Mycobacterium avium
WISAVYHYPWPVSMWAEALAMAVP

SEQ ID NO: 12756 - protein, 17 aa, Mycobacterium avium
WKRDEVEHALALTDPGH

SEQ ID NO: 12757 - protein, 18 aa, Mycobacterium avium
WKSGVGYALAAVAVVAAV

SEQ ID NO: 12758 - protein, 17 aa, Mycobacterium avium
WLFVLGVSIAGLTAYAT

SEQ ID NO: 12759 - protein, 28 aa, Mycobacterium avium
WLLLAVFRGRLHPIGGLGVALGVTVLLF

SEQ ID NO: 12760 - protein, 19 aa, Mycobacterium avium
WLLSIARRVVADHIRHLQS

SEQ ID NO: 12761 - protein, 18 aa, Mycobacterium avium
WLLYAVPVLVVFLRPARL

SEQ ID NO: 12762 - protein, 25 aa, Mycobacterium avium
WLSSELMFFAGLFAMYFTARAQSGG

SEQ ID NO: 12763 - protein, 17 aa, Mycobacterium avium
WLVLPLTFIILVAVGSD

SEQ ID NO: 12764 - protein, 26 aa, Mycobacterium avium
WMDRPSYRFEHLLSFAYNGLGSARNT

SEQ ID NO: 12765 - protein, 20 aa, Mycobacterium avium
WMMLLNVLKPTGIVGDSTII

SEQ ID NO: 12766 - protein, 18 aa, Mycobacterium avium
WNALAKHEHWTVPDIEYV

SEQ ID NO: 12767 - protein, 17 aa, Mycobacterium avium
WNPEFLREGYAVQDTLR

SEQ ID NO: 12768 - protein, 18 aa, Mycobacterium avium
WPASSVLIAMASWAPPPA

SEQ ID NO: 12769 - protein, 19 aa, Mycobacterium avium
WPQESVLILLYGIIALGAV

SEQ ID NO: 12770 - protein, 19 aa, Mycobacterium avium
WPTALAAFVMIVFHLNILL

SEQ ID NO: 12771 - protein, 23 aa, Mycobacterium avium
WQIGRPWYLAWAGLVYIVAAVAT

SEQ ID NO: 12772 - protein, 18 aa, Mycobacterium avium
WRAAGMGRTAETYLAGPD

SEQ ID NO: 12773 - protein, 21 aa, Mycobacterium avium
WRAVSVRGPHGLTTVAIDLSD

SEQ ID NO: 12774 - protein, 20 aa, Mycobacterium avium
WRAYALPALVVLTAVVIYQT

SEQ ID NO: 12775 - protein, 22 aa, Mycobacterium avium
WREEGLRLTVAVNLSTTNLLDI

SEQ ID NO: 12776 - protein, 21 aa, Mycobacterium avium
WRHYNSLYFPYVVGVRAYAQN

SEQ ID NO: 12777 - protein, 21 aa, Mycobacterium avium
WRIALVDLVLWGAGTLLLTVL

SEQ ID NO: 12778 - protein, 23 aa, Mycobacterium avium
WRPIRSYFYWEKHCYDIPICWSL

SEQ ID NO: 12779 - protein, 23 aa, Mycobacterium avium
WRRLGLERQLLWAASRALVQLLL

SEQ ID NO: 12780 - protein, 18 aa, Mycobacterium avium
WRSRVRRLPDPDDPDHLA

SEQ ID NO: 12781 - protein, 21 aa, Mycobacterium avium
WRVTPGVAATGHFDAVHRVIG

SEQ ID NO: 12782 - protein, 25 aa, Mycobacterium avium
WSAGEFPLVIVMLALLVQWARSDRR

SEQ ID NO: 12783 - protein, 18 aa, Mycobacterium avium
WSLIPLVIGCVVLAGLLG

SEQ ID NO: 12784 - protein, 23 aa, Mycobacterium avium
WSLIWELLCYLVVAAIGVVGLGN

SEQ ID NO: 12785 - protein, 24 aa, Mycobacterium avium
WSPGTRLAMIALRGYLVVGALLLV

SEQ ID NO: 12786 - protein, 24 aa, Mycobacterium avium
WTAHLPRRRVLVASLTCLTASQLI

SEQ ID NO: 12787 - protein, 23 aa, Mycobacterium avium
WTDPVKAAALRDALAARKIENVM

SEQ ID NO: 12788 - protein, 21 aa, Mycobacterium avium
WVALCGASVLAVRSLARGHTT

SEQ ID NO: 12789 - protein, 22 aa, Mycobacterium avium
WVSLHLFGFPALDYTTPLFAFL

SEQ ID NO: 12790 - protein, 18 aa, Mycobacterium avium
WVTDVLLEIIMIVGALHF

SEQ ID NO: 12791 - protein, 26 aa, Mycobacterium avium
WWPLNMTWGGLPLFVPIGYISYFVLP

SEQ ID NO: 12792 - protein, 27 aa, Mycobacterium avium
WWRSDRLFCIAVGFLALVFAATTVSGV

SEQ ID NO: 12793 - protein, 20 aa, Mycobacterium avium
WYTENLRYYYLILPTVDGSL

SEQ ID NO: 12794 - protein, 24 aa, Mycobacterium avium
YAAMFTDVYGLRVGDDVRMAGVRV

SEQ ID NO: 12795 - protein, 17 aa, Mycobacterium avium
YAAMLFAVVPLRNALPG

SEQ ID NO: 12796 - protein, 17 aa, Mycobacterium avium
YAANLFAIVPLRNILPG

SEQ ID NO: 12797 - protein, 17 aa, Mycobacterium avium
YADLSGWFEVPGADVAR

SEQ ID NO: 12798 - protein, 25 aa, Mycobacterium avium
YADRRLTLGHGRLFALYVAGYCVGR

SEQ ID NO: 12799 - protein, 25 aa, Mycobacterium avium
YALLPVLWIFSLSLKPTSTVKDGKL

SEQ ID NO: 12800 - protein, 24 aa, Mycobacterium avium
YALRWPDPWPSTFGYHEFFHALTA

SEQ ID NO: 12801 - protein, 18 aa, Mycobacterium avium
YAPRRAATPLAYAVDLLA

SEQ ID NO: 12802 - protein, 19 aa, Mycobacterium avium
YDAFFPRLEEAIDYCDKFP

SEQ ID NO: 12803 - protein, 25 aa, Mycobacterium avium
YDSTDSLLRFAVRADATLTGLCGLA

SEQ ID NO: 12804 - protein, 24 aa, Mycobacterium avium
YEGNVVAVLGMPVGKITKINPRGG

SEQ ID NO: 12805 - protein, 21 aa, Mycobacterium avium
YEVAMGLSFAAVFLYAGSMST

SEQ ID NO: 12806 - protein, 19 aa, Mycobacterium avium
YFFLTRFFTGAGIGGEYAA

SEQ ID NO: 12807 - protein, 17 aa, Mycobacterium avium
YFLIGGFGAGSGRSRAA

SEQ ID NO: 12808 - protein, 29 aa, Mycobacterium avium
YFLPLDPWPRLFLGVTFLFLVSSAFTLAK

SEQ ID NO: 12809 - protein, 26 aa, Mycobacterium avium
YFQSLGVPCAVGMLVAVLAALTLAPA

SEQ ID NO: 12810 - protein, 20 aa, Mycobacterium avium
YGSGRLVRLTTFMVDVLAGV

SEQ ID NO: 12811 - protein, 21 aa, Mycobacterium avium
YKLGEKWTHPPILWAAVDEDV

SEQ ID NO: 12812 - protein, 18 aa, Mycobacterium avium
YKVPREVIFLDELPRNPT

SEQ ID NO: 12813 - protein, 42 aa, Mycobacterium avium
YLEPRPSRTARRWRRVGTTVARWPGPILVAALGLTLLVALPL

SEQ ID NO: 12814 - protein, 26 aa, Mycobacterium avium
YLERIFDPKVFVISFVFNVFVAALIV

SEQ ID NO: 12815 - protein, 17 aa, Mycobacterium avium
YLLLQTIVVAVWIVVNV

SEQ ID NO: 12816 - protein, 30 aa, Mycobacterium avium
YLPHAIRIFAVPIILGWLFVTVLVNVIVPT

SEQ ID NO: 12817 - protein, 19 aa, Mycobacterium avium
YLPPEAFDNPDFQTGLRMF

SEQ ID NO: 12818 - protein, 19 aa, Mycobacterium avium
YLPPEAFKSPDFARGLKNF

SEQ ID NO: 12819 - protein, 20 aa, Mycobacterium avium
YLRFRREAQNAAALNHPSIV

SEQ ID NO: 12820 - protein, 24 aa, Mycobacterium avium
YLWAFELTSALLITAAVGAMVLAH

SEQ ID NO: 12821 - protein, 21 aa, Mycobacterium avium
YLWHMPVLLGVHLAFDYLGCP

SEQ ID NO: 12822 - protein, 30 aa, Mycobacterium avium
YMMWTEGLARIWPPWEFYFWHHTIPAVVWV

SEQ ID NO: 12823 - protein, 23 aa, Mycobacterium avium
YNADGKLVAPVAYPSLYADQATD

SEQ ID NO: 12824 - protein, 23 aa, Mycobacterium avium
YNGWHAVAGLALFAPGLVFAARK

SEQ ID NO: 12825 - protein, 30 aa, Mycobacterium avium
YNWTGWPADSRWRPATAIVGAVVALGAIAT

SEQ ID NO: 12826 - protein, 20 aa, Mycobacterium avium
YPEDLFKVQRMLLAKYHVND

SEQ ID NO: 12827 - protein, 30 aa, Mycobacterium avium
YPLMSHLAARGWVCVSIGYRVSPRHTWPDH

SEQ ID NO: 12828 - protein, 25 aa, Mycobacterium avium
YPRLKAWRRGLIFAMFVFAAIFTPG

SEQ ID NO: 12829 - protein, 24 aa, Mycobacterium avium
YQALGAKIPKGVLLYGPPGTGKTL

SEQ ID NO: 12830 - protein, 17 aa, Mycobacterium avium
YQARVVDGVVEVRGEQQ

SEQ ID NO: 12831 - protein, 20 aa, Mycobacterium avium
YQLHALIGMVLFTLWPFTRL

SEQ ID NO: 12832 - protein, 19 aa, Mycobacterium avium
YQNLYWPAEYLIDATGQVR

SEQ ID NO: 12833 - protein, 20 aa, Mycobacterium avium
YQRSEALLANMLPGSIAERL

SEQ ID NO: 12834 - protein, 21 aa, Mycobacterium avium
YRAVLNFRRGWDIYNEHFDYV

SEQ ID NO: 12835 - protein, 19 aa, Mycobacterium avium
YRIDWERSALVNGLVPAQF

SEQ ID NO: 12836 - protein, 21 aa, Mycobacterium avium
YRPDEDLVRWGGRVDDPAGGP

SEQ ID NO: 12837 - protein, 20 aa, Mycobacterium avium
YRPELGVLYPSHLATGMRIY

SEQ ID NO: 12838 - protein, 20 aa, Mycobacterium avium
YRPTAMVVVPVMLSRILDTL

SEQ ID NO: 12839 - protein, 27 aa, Mycobacterium avium
YRQAIPTLLRTGLPNTLILTFSASVIG

SEQ ID NO: 12840 - protein, 21 aa, Mycobacterium avium
YSFGAGIGMAVRRRKFGRRGH

SEQ ID NO: 12841 - protein, 18 aa, Mycobacterium avium
YSFLPSWLSFLVDKENAR

SEQ ID NO: 12842 - protein, 23 aa, Mycobacterium avium
YSFLSFYPYWGFQGLTSHYANPL

SEQ ID NO: 12843 - protein, 18 aa, Mycobacterium avium
YSLFKAVVFVWIASTIQC

SEQ ID NO: 12844 - protein, 23 aa, Mycobacterium avium
YSPVLVCGLAIMGLGIGLTTTPL

SEQ ID NO: 12845 - protein, 24 aa, Mycobacterium avium
YTKPRLSWLDALYFTAETITTVGY

SEQ ID NO: 12846 - protein, 25 aa, Mycobacterium avium
YTRADCPRYGQLQGPSCFTAPTIAV

SEQ ID NO: 12847 - protein, 18 aa, Mycobacterium avium
YVDIAHRAALLYSFATLL

SEQ ID NO: 12848 - protein, 22 aa, Mycobacterium avium
YVFARPPLLGPSGRLFATGVTV

SEQ ID NO: 12849 - protein, 17 aa, Mycobacterium avium
YVFPLGVVVGGPFLPLA

SEQ ID NO: 12850 - protein, 17 aa, Mycobacterium avium
YVRAARPFIAFYNRCAS

SEQ ID NO: 12851 - protein, 24 aa, Mycobacterium avium
YVYSLDNKRLWSNLDCAPSNETLI

SEQ ID NO: 12852 - protein, 27 aa, Mycobacterium avium
YWEKHCYDIPVCIGLRSLFDTFDGFDQ

SEQ ID NO: 12853 - protein, 22 aa, Mycobacterium avium
YWRKPEETRRTFGGVLVNPSPG

SEQ ID NO: 12854 - protein, 17 aa, Mycobacterium avium
YYRTVWQSPTACAVAEP

SEQ ID NO: 12855 - protein, 26 aa, Mycobacterium avium
YYVAEYNGRISIVRGIQGSLLGVPLQ

SEQ ID NO: 12856 - protein, 33 aa, Mycobacterium avium
AAAALGRWAGFSVAWLYWYFWVIVVGFEAVAGG

SEQ ID NO: 12857 - protein, 23 aa, Mycobacterium avium
AAAGVVGLLAWVSRDRSPRLTAP

SEQ ID NO: 12858 - protein, 20 aa, Mycobacterium avium
AAAHRRVWRDREPQLASPDR

SEQ ID NO: 12859 - protein, 26 aa, Mycobacterium avium
AAAKRSALLHWSRRPESTQSKFWNRW

SEQ ID NO: 12860 - protein, 27 aa, Mycobacterium avium
AAALHRLDAIVLYLGFIVVAWLLGYLM

SEQ ID NO: 12861 - protein, 34 aa, Mycobacterium avium
AAALLVPAMRFRPFIRLTVEWVEVLAFIVLLPAA

SEQ ID NO: 12862 - protein, 17 aa, Mycobacterium avium
AAAPLLVRLMLGRTPQV

SEQ ID NO: 12863 - protein, 24 aa, Mycobacterium avium
AAAPRTAPAPSIVKPGGEANNLAA

SEQ ID NO: 12864 - protein, 17 aa, Mycobacterium avium
AAARTRGPFQGQWSTTT

SEQ ID NO: 12865 - protein, 19 aa, Mycobacterium avium
AAASWWLLEQPIRRWRPAR

SEQ ID NO: 12866 - protein, 24 aa, Mycobacterium avium
AADRRAATLIAHLAWLVLLLGSGA

SEQ ID NO: 12867 - protein, 17 aa, Mycobacterium avium
AAEVGTLARAIVHAADL

SEQ ID NO: 12868 - protein, 21 aa, Mycobacterium avium
AAFCYAAAVVTELGGPMSHAA

SEQ ID NO: 12869 - protein, 18 aa, Mycobacterium avium
AAFMTWRIGAEMPGQPGG

SEQ ID NO: 12870 - protein, 18 aa, Mycobacterium avium
AAGARFGLFEPRRAVSAR

SEQ ID NO: 12871 - protein, 21 aa, Mycobacterium avium
AAGATYWLVRRSLKSVDAIRA

SEQ ID NO: 12872 - protein, 24 aa, Mycobacterium avium
AAGGRWRRLRTLAVITGPGLIVMV

SEQ ID NO: 12873 - protein, 18 aa, Mycobacterium avium
AAGLRLAAARADVVPAIT

SEQ ID NO: 12874 - protein, 18 aa, Mycobacterium avium
AAGLRTGIIRAFGGTGGV

SEQ ID NO: 12875 - protein, 23 aa, Mycobacterium avium
AAGRMRVSVGWVRADSRRAVAVE

SEQ ID NO: 12876 - protein, 19 aa, Mycobacterium avium
AAGSWLPAVLWGVAFAVLV

SEQ ID NO: 12877 - protein, 25 aa, Mycobacterium avium
AAGTVLRPAATIAVLLAAVTVVTSN

SEQ ID NO: 12878 - protein, 24 aa, Mycobacterium avium
AAGYAWCYRRAGASARVAPAAYFA

SEQ ID NO: 12879 - protein, 19 aa, Mycobacterium avium
AAHCPAYFQLLVKSLLQPG

SEQ ID NO: 12880 - protein, 24 aa, Mycobacterium avium
AAIRIAHLRLGFGRSTPNRIAVSY

SEQ ID NO: 12881 - protein, 17 aa, Mycobacterium avium
AALFLVGFRPWAHRDGG

SEQ ID NO: 12882 - protein, 26 aa, Mycobacterium avium
AALIRARFPALTARQVMQRIEATAHH

SEQ ID NO: 12883 - protein, 20 aa, Mycobacterium avium
AALLRVWPFIALGALGWLAA

SEQ ID NO: 12884 - protein, 17 aa, Mycobacterium avium
AALTFNIPPGDRMAPGS

SEQ ID NO: 12885 - protein, 17 aa, Mycobacterium avium
AAPAQFAGPPPWGRPPP

SEQ ID NO: 12886 - protein, 21 aa, Mycobacterium avium
AAPIFGEWLIHAGWGTGPAVA

SEQ ID NO: 12887 - protein, 22 aa, Mycobacterium avium
AAQIPLYMGYAFRGFNTHGRAL

SEQ ID NO: 12888 - protein, 21 aa, Mycobacterium avium
AARAVLRAVVCQLAVLHAPDR

SEQ ID NO: 12889 - protein, 19 aa, Mycobacterium avium
AASGECLMWPDTTPESAKI

SEQ ID NO: 12890 - protein, 21 aa, Mycobacterium avium
AASYRWGHHVQRLVEHPDSEQ

SEQ ID NO: 12891 - protein, 25 aa, Mycobacterium avium
AATFALMCGFPLVLLGTWDALWSRV

SEQ ID NO: 12892 - protein, 17 aa, Mycobacterium avium
AATPLAYAVDLLAAVPS

SEQ ID NO: 12893 - protein, 24 aa, Mycobacterium avium
AAVFCVLAVLPLMVLTQLGIIVGL

SEQ ID NO: 12894 - protein, 19 aa, Mycobacterium avium
AAVLLPWNLYFGVGIPDSN

SEQ ID NO: 12895 - protein, 21 aa, Mycobacterium avium
AAVLVLLAGRRLWHRFRGQPD

SEQ ID NO: 12896 - protein, 18 aa, Mycobacterium avium
AAVQPYRAVVEKLQSKSS

SEQ ID NO: 12897 - protein, 19 aa, Mycobacterium avium
AAVRRTVMTAGRTVTFSAV

SEQ ID NO: 12898 - protein, 18 aa, Mycobacterium avium
ADALLAHDGLPPDQAPGR

SEQ ID NO: 12899 - protein, 18 aa, Mycobacterium avium
ADARPFVLLERFELNAWA

SEQ ID NO: 12900 - protein, 23 aa, Mycobacterium avium
ADFAHLYPFQVFMDLYGLPLQDR

SEQ ID NO: 12901 - protein, 22 aa, Mycobacterium avium
ADGWECQRALSVANNVIVDINA

SEQ ID NO: 12902 - protein, 22 aa, Mycobacterium avium
ADHPDQVVGWAGWLAAPDSTNP

SEQ ID NO: 12903 - protein, 20 aa, Mycobacterium avium
ADLRVAHPLISRTHLIVRYE

SEQ ID NO: 12904 - protein, 19 aa, Mycobacterium avium
ADMRITHPLISRAHLLLRY

SEQ ID NO: 12905 - protein, 19 aa, Mycobacterium avium
ADPAAGRFAVDVVLHDPAG

SEQ ID NO: 12906 - protein, 24 aa, Mycobacterium avium
ADPGRAGAIGLAIVAALAVLVTVF

SEQ ID NO: 12907 - protein, 25 aa, Mycobacterium avium
ADPNPPLPWWPWQIGPAPRVPGTAD

SEQ ID NO: 12908 - protein, 17 aa, Mycobacterium avium
ADPRRARDASGTGGQSV

SEQ ID NO: 12909 - protein, 23 aa, Mycobacterium avium
ADSAKKWVIWSAVIGVVVGIIYG

SEQ ID NO: 12910 - protein, 20 aa, Mycobacterium avium
ADTAIAIKRAEVRREAEIMW

SEQ ID NO: 12911 - protein, 20 aa, Mycobacterium avium
AEALTGHLFLVMLGGGALAA

SEQ ID NO: 12912 - protein, 20 aa, Mycobacterium avium
AEARLTLRLTAGLPLLHVEK

SEQ ID NO: 12913 - protein, 24 aa, Mycobacterium avium
AEFVCLIAPMFLAMYLRAFYSPRR

SEQ ID NO: 12914 - protein, 22 aa, Mycobacterium avium
AEKWNLPVILIVLLAVFGSLAA

SEQ ID NO: 12915 - protein, 20 aa, Mycobacterium avium
AELARPIPAIAMVPVAILLF

SEQ ID NO: 12916 - protein, 17 aa, Mycobacterium avium
AELGEPVGFSAGIAAGA

SEQ ID NO: 12917 - protein, 17 aa, Mycobacterium avium
AELTVLRTGLFRRPAYW

SEQ ID NO: 12918 - protein, 17 aa, Mycobacterium avium
AEMPRLNRWFMANINGL

SEQ ID NO: 12919 - protein, 32 aa, Mycobacterium avium
AEPTPWYRRPAMLIAWVVSVVVLIGLIVFGVI

SEQ ID NO: 12920 - protein, 17 aa, Mycobacterium avium
AEQVGAVALQFQAARLQ

SEQ ID NO: 12921 - protein, 25 aa, Mycobacterium avium
AERTIYRLIGVDARSEQTWGAYARG

SEQ ID NO: 12922 - protein, 18 aa, Mycobacterium avium
AESIRPVDLVGGGSPQNG

SEQ ID NO: 12923 - protein, 22 aa, Mycobacterium avium
AEVERIWLPFTIWLTAAAALLP

SEQ ID NO: 12924 - protein, 17 aa, Mycobacterium avium
AFADRAATVGTQKAGQP

SEQ ID NO: 12925 - protein, 25 aa, Mycobacterium avium
AFARPEQAVRCGIELQRALRRNANR

SEQ ID NO: 12926 - protein, 20 aa, Mycobacterium avium
AFCAAAFDPAGMTARQSMLP

SEQ ID NO: 12927 - protein, 17 aa, Mycobacterium avium
AFILTFFVTRSFVRFIR

SEQ ID NO: 12928 - protein, 25 aa, Mycobacterium avium
AFLLIRFGGVYPVIFIGVLLIGLME

SEQ ID NO: 12929 - protein, 28 aa, Mycobacterium avium
AFMLCYVAAAALTWARYVRPRRAPEPRT

SEQ ID NO: 12930 - protein, 24 aa, Mycobacterium avium
AFVDSLRWLAIAWVISAVCLFGVL

SEQ ID NO: 12931 - protein, 21 aa, Mycobacterium avium
AFVFARLCAEPVIARAIAFED

SEQ ID NO: 12932 - protein, 25 aa, Mycobacterium avium
AGAACALWLGIAGWALWAANSPGMG

SEQ ID NO: 12933 - protein, 17 aa, Mycobacterium avium
AGAAILLFGGRRTDRWG

SEQ ID NO: 12934 - protein, 19 aa, Mycobacterium avium
AGATLGLPSGAWRLDAGGE

SEQ ID NO: 12935 - protein, 17 aa, Mycobacterium avium
AGCAFWAVLTIVLAAWG

SEQ ID NO: 12936 - protein, 18 aa, Mycobacterium avium
AGDWTAMIGSADELAARG

SEQ ID NO: 12937 - protein, 17 aa, Mycobacterium avium
AGFGRAAAVTALMTAVI

SEQ ID NO: 12938 - protein, 23 aa, Mycobacterium avium
AGFLRRSVELMSFVAVPVAVVGA

SEQ ID NO: 12939 - protein, 34 aa, Mycobacterium avium
AGFVFSWLRRRSGSLIAPIALHWSLNGLGALAAA

SEQ ID NO: 12940 - protein, 26 aa, Mycobacterium avium
AGGLPWYKRTALVLSVAGAGAAVLIA

SEQ ID NO: 12941 - protein, 20 aa, Mycobacterium avium
AGGRYSVYIWALLAMAVARL

SEQ ID NO: 12942 - protein, 28 aa, Mycobacterium avium
AGIGGVFSRRWAKVWLPITAAVYTANGL

SEQ ID NO: 12943 - protein, 18 aa, Mycobacterium avium
AGLGVLFGLALFQVLLVA

SEQ ID NO: 12944 - protein, 21 aa, Mycobacterium avium
AGLIAAIGFEVFKQVASIYLR

SEQ ID NO: 12945 - protein, 24 aa, Mycobacterium avium
AGLLALAGLLGWTLSRPAVTADTA

SEQ ID NO: 12946 - protein, 26 aa, Mycobacterium avium
AGLLIVIGIELLKPAHIETALRNGDL

SEQ ID NO: 12947 - protein, 18 aa, Mycobacterium avium
AGLQLSSIGVTWTDQLEA

SEQ ID NO: 12948 - protein, 20 aa, Mycobacterium avium
AGLRDLGCMSLTMSEAAPFA

SEQ ID NO: 12949 - protein, 17 aa, Mycobacterium avium
AGLTLSNPAGGIVAVGL

SEQ ID NO: 12950 - protein, 20 aa, Mycobacterium avium
AGLVRLRYGALDFDAVPLGK

SEQ ID NO: 12951 - protein, 24 aa, Mycobacterium avium
AGMALGFLTVFGLFGALTVSAAGA

SEQ ID NO: 12952 - protein, 25 aa, Mycobacterium avium
AGNRVAAMLGGWLAVLAGAWFVVGG

SEQ ID NO: 12953 - protein, 23 aa, Mycobacterium avium
AGNWATSTWCFRRGAEDKIEANI

SEQ ID NO: 12954 - protein, 18 aa, Mycobacterium avium
AGPAVPHGPSLCLAAAAG

SEQ ID NO: 12955 - protein, 18 aa, Mycobacterium avium
AGPSGVRASFALAAAILA

SEQ ID NO: 12956 - protein, 23 aa, Mycobacterium avium
AGRPPRTESMGIPVAAHPPAPAA

SEQ ID NO: 12957 - protein, 18 aa, Mycobacterium avium
AGRQSAILVTAWAVSGGI

SEQ ID NO: 12958 - protein, 19 aa, Mycobacterium avium
AGRSRDFWGSAARLVKQLA

SEQ ID NO: 12959 - protein, 22 aa, Mycobacterium avium
AGRVRGGAVAAVLFAFVSGSLW

SEQ ID NO: 12960 - protein, 23 aa, Mycobacterium avium
AGSLLRLLVLALIMVPITAAVML

SEQ ID NO: 12961 - protein, 18 aa, Mycobacterium avium
AGTGWRVSGLLRIDEVAA

SEQ ID NO: 12962 - protein, 20 aa, Mycobacterium avium
AGTIRLASGVSFLVDPLRAN

SEQ ID NO: 12963 - protein, 25 aa, Mycobacterium avium
AGTNEWTRYGALMVTDAVIRVMVAA

SEQ ID NO: 12964 - protein, 25 aa, Mycobacterium avium
AGVVLACPVWFYQLWAFITPGLYQK

SEQ ID NO: 12965 - protein, 19 aa, Mycobacterium avium
AHKLCGRDVVVVSASGEEI

SEQ ID NO: 12966 - protein, 21 aa, Mycobacterium avium
AHLDLRIGVFNTLVLLLSSWS

SEQ ID NO: 12967 - protein, 17 aa, Mycobacterium avium
AHLRARHDLVLEAFTAV

SEQ ID NO: 12968 - protein, 26 aa, Mycobacterium avium
AHQKLCDTYRLAARAVQIETNGKNSD

SEQ ID NO: 12969 - protein, 25 aa, Mycobacterium avium
AHSARPPLRTARAIAAVAGLGAALA

SEQ ID NO: 12970 - protein, 22 aa, Mycobacterium avium
AHSVRVWLMLGVLLLSVLLSVR

SEQ ID NO: 12971 - protein, 22 aa, Mycobacterium avium
AHTETMPGWTARLDRDAASGTV

SEQ ID NO: 12972 - protein, 20 aa, Mycobacterium avium
AHVMSTYLSHDWGRDWGSLR

SEQ ID NO: 12973 - protein, 19 aa, Mycobacterium avium
AIAAFLWMANWRFVAQKTD

SEQ ID NO: 12974 - protein, 18 aa, Mycobacterium avium
AIAFAWIISVGPPGPPPP

SEQ ID NO: 12975 - protein, 24 aa, Mycobacterium avium
AIALVVSVSLLFARTDTTKLANPN

SEQ ID NO: 12976 - protein, 27 aa, Mycobacterium avium
AIERGEPWPPPAPEPAFKAAIAKASEA

SEQ ID NO: 12977 - protein, 17 aa, Mycobacterium avium
AIMSRFSPEEAQLTLID

SEQ ID NO: 12978 - protein, 24 aa, Mycobacterium avium
AIPYLCIGFAWTVFHADQSHRIQA

SEQ ID NO: 12979 - protein, 24 aa, Mycobacterium avium
AIRALRESRDWSLADLAAATGVSI

SEQ ID NO: 12980 - protein, 35 aa, Mycobacterium avium
AISAMLIYRLISWLLIAAVGWVVFFFVFRTENIAD

SEQ ID NO: 12981 - protein, 19 aa, Mycobacterium avium
AIVAATGWLGYLLGPPLIG

SEQ ID NO: 12982 - protein, 26 aa, Mycobacterium avium
AKASAWVGALMLGWWIGVLVYFLPRR

SEQ ID NO: 12983 - protein, 21 aa, Mycobacterium avium
AKGGIVFRVQQELGVPVKLVG

SEQ ID NO: 12984 - protein, 23 aa, Mycobacterium avium
AKIPTRLFAGAALPMAPGSSAGD

SEQ ID NO: 12985 - protein, 20 aa, Mycobacterium avium
AKLYPLLFLGPMLVLGIRTG

SEQ ID NO: 12986 - protein, 22 aa, Mycobacterium avium
AKPQTVHWSLRLDVSDVDGKLM

SEQ ID NO: 12987 - protein, 24 aa, Mycobacterium avium
AKPRPARPELVVLCDVSGSVAGFS

SEQ ID NO: 12988 - protein, 23 aa, Mycobacterium avium
AKRARGSPLRVMILLVLVTALAS

SEQ ID NO: 12989 - protein, 44 aa, Mycobacterium avium
AKRPPAWSLSNWPVRWKVLAIVLVPLMLATVFGVLRIHGAMANA

SEQ ID NO: 12990 - protein, 17 aa, Mycobacterium avium
AKTVGRLNIFGDVRRPR

SEQ ID NO: 12991 - protein, 25 aa, Mycobacterium avium
ALAASSLPYWLGDSLRAATAGVLAL

SEQ ID NO: 12992 - protein, 17 aa, Mycobacterium avium
ALACSRGVVAVLAYHNA

SEQ ID NO: 12993 - protein, 17 aa, Mycobacterium avium
ALAFVIDILPYVVVHGI

SEQ ID NO: 12994 - protein, 19 aa, Mycobacterium avium
ALAGLNLPAWGSLRLALPM

SEQ ID NO: 12995 - protein, 17 aa, Mycobacterium avium
ALAGLQLASERLRQATF

SEQ ID NO: 12996 - protein, 18 aa, Mycobacterium avium
ALALPISVVAAWRSRSWR

SEQ ID NO: 12997 - protein, 23 aa, Mycobacterium avium
ALARRWRIRLRHLAVAGVVVGFL

SEQ ID NO: 12998 - protein, 24 aa, Mycobacterium avium
ALDTCPWPPPTVFLMRHGANNTYT

SEQ ID NO: 12999 - protein, 24 aa, Mycobacterium avium
ALEPLRRLAVIVGIAVAIGCTTWL

SEQ ID NO: 13000 - protein, 34 aa, Mycobacterium avium
ALGDRRSGPGWLLFQWRWSIVALWFTAVFLLIMV

SEQ ID NO: 13001 - protein, 23 aa, Mycobacterium avium
ALGLRYALGARRWARLGMAGSAG

SEQ ID NO: 13002 - protein, 36 aa, Mycobacterium avium
ALGVRTAFRVPFLRNWKYSRAYLNWLADRLQKTKTR

SEQ ID NO: 13003 - protein, 21 aa, Mycobacterium avium
ALIGLVALVFAVVTSNELVAW

SEQ ID NO: 13004 - protein, 19 aa, Mycobacterium avium
ALKRLPTYATELGEVVGSG

SEQ ID NO: 13005 - protein, 17 aa, Mycobacterium avium
ALLILAVGYDTTRALVL

SEQ ID NO: 13006 - protein, 25 aa, Mycobacterium avium
ALLLIAVVLVLGFWQPGFFVTTKLD

SEQ ID NO: 13007 - protein, 19 aa, Mycobacterium avium
ALLPVLALLACWRTRKRGT

SEQ ID NO: 13008 - protein, 31 aa, Mycobacterium avium
ALLRALHVILGWRPVLLIPFTFALFTPLAVP

SEQ ID NO: 13009 - protein, 19 aa, Mycobacterium avium
ALLSAIGIAGMDRLVQRNV

SEQ ID NO: 13010 - protein, 24 aa, Mycobacterium avium
ALLVPVVDWLDRHGLPRGGAVALV

SEQ ID NO: 13011 - protein, 18 aa, Mycobacterium avium
ALLYKPFVRQIRTTRQMQ

SEQ ID NO: 13012 - protein, 24 aa, Mycobacterium avium
ALMSALCALYLGGILNPTTNLRHF

SEQ ID NO: 13013 - protein, 20 aa, Mycobacterium avium
ALRRMKAVALSFLIGATGLF

SEQ ID NO: 13014 - protein, 32 aa, Mycobacterium avium
ALSLAASGAMVFAILILLGRYINYTLDLAGIA

SEQ ID NO: 13015 - protein, 23 aa, Mycobacterium avium
ALTDPRYTAVLNHLISQNGRAAY

SEQ ID NO: 13016 - protein, 17 aa, Mycobacterium avium
ALTGFALWIVTLFVHGL

SEQ ID NO: 13017 - protein, 19 aa, Mycobacterium avium
ALVAVLVGGVYVLTSQAKT

SEQ ID NO: 13018 - protein, 18 aa, Mycobacterium avium
ALVDFYTERLIKPFERDT

SEQ ID NO: 13019 - protein, 44 aa, Mycobacterium avium
ALVFVRWWGQPAWSWAVLWRRGRRPIDWSAPITVANNRSGGGVR

SEQ ID NO: 13020 - protein, 33 aa, Mycobacterium avium
ALVVARCEYHPTPGCPQTRITGVPGPGPETRTA

SEQ ID NO: 13021 - protein, 17 aa, Mycobacterium avium
ALYPVELMPTWLHVLSK

SEQ ID NO: 13022 - protein, 21 aa, Mycobacterium avium
AMFDLWFPAALGARAVVTDED

SEQ ID NO: 13023 - protein, 18 aa, Mycobacterium avium
AMFWTVLVYVFIATVVAV

SEQ ID NO: 13024 - protein, 25 aa, Mycobacterium avium
AMGSADWSAVLARVGADPDGAHRAF

SEQ ID NO: 13025 - protein, 23 aa, Mycobacterium avium
AMLAFGAGLAWLAMDRRRIRQEQ

SEQ ID NO: 13026 - protein, 26 aa, Mycobacterium avium
AMLARAGVPPRQWQWPLGEIDKPFDM

SEQ ID NO: 13027 - protein, 25 aa, Mycobacterium avium
AMLARARWPLRAPRAAMVLWQAVAL

SEQ ID NO: 13028 - protein, 17 aa, Mycobacterium avium
AMRASDVLLALPGFLTS

SEQ ID NO: 13029 - protein, 31 aa, Mycobacterium avium
AMRPDCRLDVAGLWGVLRINRYTQMYGTARL

SEQ ID NO: 13030 - protein, 25 aa, Mycobacterium avium
AMTPMAALVLRFGLAAMVLAVWTAI

SEQ ID NO: 13031 - protein, 22 aa, Mycobacterium avium
AMVQDITRPLGIPIQHSSIPFQ

SEQ ID NO: 13032 - protein, 17 aa, Mycobacterium avium
ANALLVWLAEFALVVVG

SEQ ID NO: 13033 - protein, 26 aa, Mycobacterium avium
ANGLGMPIDLSWELWAYGVFAIAAVG

SEQ ID NO: 13034 - protein, 19 aa, Mycobacterium avium
ANLACVVCAIGLGGVAGVG

SEQ ID NO: 13035 - protein, 28 aa, Mycobacterium avium
ANLPAFLAANGPLLFFVAYQVFFNAVGW

SEQ ID NO: 13036 - protein, 17 aa, Mycobacterium avium
ANLVVRAVRTGHRQQVW

SEQ ID NO: 13037 - protein, 33 aa, Mycobacterium avium
ANPFPHRWAVMFLVAVGFWNFLGAGIFGFLINL

SEQ ID NO: 13038 - protein, 19 aa, Mycobacterium avium
ANSALTERIIEFARTQQAL

SEQ ID NO: 13039 - protein, 20 aa, Mycobacterium avium
ANVFTRINAILGVLLLIVLA

SEQ ID NO: 13040 - protein, 19 aa, Mycobacterium avium
APAAMPVHRGAISAWAVCD

SEQ ID NO: 13041 - protein, 25 aa, Mycobacterium avium
APARLDNARFLLPVVGVPPDRADDL

SEQ ID NO: 13042 - protein, 19 aa, Mycobacterium avium
APARPTPQYQPRPVEQPAP

SEQ ID NO: 13043 - protein, 25 aa, Mycobacterium avium
APAVVAWAALIGWVDLHGTWASWMA

SEQ ID NO: 13044 - protein, 38 aa, Mycobacterium avium
APDTSKPVGITMLWPLADRPRLAPGVPGGTIPVRLVDD

SEQ ID NO: 13045 - protein, 21 aa, Mycobacterium avium
APEGSWRQRVPGIFLDVTRFV

SEQ ID NO: 13046 - protein, 25 aa, Mycobacterium avium
APEPENYLVWAILCTVLCCLPLGIV

SEQ ID NO: 13047 - protein, 17 aa, Mycobacterium avium
APEQVPPHITRWAAAAV

SEQ ID NO: 13048 - protein, 18 aa, Mycobacterium avium
APFPDRSLLIFIVTVVIL

SEQ ID NO: 13049 - protein, 17 aa, Mycobacterium avium
APIEYVLHNAVLHVFFA

SEQ ID NO: 13050 - protein, 17 aa, Mycobacterium avium
APIGGPILGGWLIDTSS

SEQ ID NO: 13051 - protein, 19 aa, Mycobacterium avium
APLNWFPLYLGPALAVELV

SEQ ID NO: 13052 - protein, 26 aa, Mycobacterium avium
APMGPRLGALMIDWLISYGLAALAMR

SEQ ID NO: 13053 - protein, 22 aa, Mycobacterium avium
APNEPGQILVLLNVGAVFMGTA

SEQ ID NO: 13054 - protein, 18 aa, Mycobacterium avium
APPGRRGLFGSFTQLGSP

SEQ ID NO: 13055 - protein, 24 aa, Mycobacterium avium
APPSPGRWRALLLAAVAACAACGI

SEQ ID NO: 13056 - protein, 20 aa, Mycobacterium avium
APRLCCLAFGTGTGALLLLR

SEQ ID NO: 13057 - protein, 24 aa, Mycobacterium avium
APRPRPASLAFLGGWVLGLVGLTT

SEQ ID NO: 13058 - protein, 18 aa, Mycobacterium avium
APSAFSLAGPWVDVAAPG

SEQ ID NO: 13059 - protein, 19 aa, Mycobacterium avium
APSARRPGVPKAFDAVIAR

SEQ ID NO: 13060 - protein, 18 aa, Mycobacterium avium
AQALPPGRGLLLSADGDV

SEQ ID NO: 13061 - protein, 26 aa, Mycobacterium avium
AQATLLRWLWYGARREGLRLDGAEDD

SEQ ID NO: 13062 - protein, 26 aa, Mycobacterium avium
AQCVKAELLAASSWRVAVNAGADSTG

SEQ ID NO: 13063 - protein, 17 aa, Mycobacterium avium
AQILALLLPAAAFMGTA

SEQ ID NO: 13064 - protein, 19 aa, Mycobacterium avium
AQRPAVFIFNHRNQVDPVI

SEQ ID NO: 13065 - protein, 19 aa, Mycobacterium avium
AQSYPSWQDQLTAWLKQYT

SEQ ID NO: 13066 - protein, 26 aa, Mycobacterium avium
AQTTVAAGLAWYLAHDVLDHREPFFA

SEQ ID NO: 13067 - protein, 19 aa, Mycobacterium avium
ARAAITRMYRTVGRQQPNI

SEQ ID NO: 13068 - protein, 18 aa, Mycobacterium avium
ARAGLPVATVQMMSDLGA

SEQ ID NO: 13069 - protein, 22 aa, Mycobacterium avium
ARHYLYRHLVLFGDKYDSVMID

SEQ ID NO: 13070 - protein, 17 aa, Mycobacterium avium
ARIQLRLADPSESQMGH

SEQ ID NO: 13071 - protein, 19 aa, Mycobacterium avium
ARIRALRMPFYRTVTSMVI

SEQ ID NO: 13072 - protein, 18 aa, Mycobacterium avium
ARKITWGEMEKGRRRYLR

SEQ ID NO: 13073 - protein, 18 aa, Mycobacterium avium
ARLQLKIQPGPFRYLPSN

SEQ ID NO: 13074 - protein, 22 aa, Mycobacterium avium
ARLRPARAGATLGLPSGAWRLD

SEQ ID NO: 13075 - protein, 20 aa, Mycobacterium avium
ARLVLDGPLLPADWTVELNY

SEQ ID NO: 13076 - protein, 24 aa, Mycobacterium avium
ARLWLPTYLAWFLAGMMLTVLQEM

SEQ ID NO: 13077 - protein, 24 aa, Mycobacterium avium
ARMALAFYGPFAFVIGGTQHVIAN

SEQ ID NO: 13078 - protein, 24 aa, Mycobacterium avium
ARMRRIRLSLMIGGSMAMIPWLGY

SEQ ID NO: 13079 - protein, 18 aa, Mycobacterium avium
ARPMRTWTLIPALAGAGL

SEQ ID NO: 13080 - protein, 17 aa, Mycobacterium avium
ARPRWSNYTEVFALMPI

SEQ ID NO: 13081 - protein, 21 aa, Mycobacterium avium
ARRVYLAGIACYGLAAFPAFA

SEQ ID NO: 13082 - protein, 20 aa, Mycobacterium avium
ARSAALIGFAGSFGALGGVV

SEQ ID NO: 13083 - protein, 22 aa, Mycobacterium avium
ARSLHFLGLVAFVVFIVIHLSM

SEQ ID NO: 13084 - protein, 25 aa, Mycobacterium avium
ARSVTGIGAAGGWTRWSPVKFEVIG

SEQ ID NO: 13085 - protein, 31 aa, Mycobacterium avium
ARVRKYLTLMAFRIPALILAAVAYGAWHNGL

SEQ ID NO: 13086 - protein, 18 aa, Mycobacterium avium
ARVSELDGALAQTQHAVD

SEQ ID NO: 13087 - protein, 35 aa, Mycobacterium avium
ASGAPGGLWARRKWEVVRLVSPLALLALWQLGSAI

SEQ ID NO: 13088 - protein, 22 aa, Mycobacterium avium
ASGEFRHGLLIGVAIAAVAVIA

SEQ ID NO: 13089 - protein, 20 aa, Mycobacterium avium
ASLFAAIIGSISFWGSIIAF

SEQ ID NO: 13090 - protein, 20 aa, Mycobacterium avium
ASLHDARKAYEKGDYGAARA

SEQ ID NO: 13091 - protein, 19 aa, Mycobacterium avium
ASLILALLAFRHFGQGYAI

SEQ ID NO: 13092 - protein, 22 aa, Mycobacterium avium
ASLPLHAFFGVVLMGTRKVLGA

SEQ ID NO: 13093 - protein, 25 aa, Mycobacterium avium
ASLPVLRWSWAPVLLAASLTTLIPL

SEQ ID NO: 13094 - protein, 23 aa, Mycobacterium avium
ASRLRDRLGYVFGPPGWAPRSAG

SEQ ID NO: 13095 - protein, 21 aa, Mycobacterium avium
ASSLFRVSRLNCSITTSDGTV

SEQ ID NO: 13096 - protein, 24 aa, Mycobacterium avium
ATADRLRRMLPFVDRISGAVLVLV

SEQ ID NO: 13097 - protein, 25 aa, Mycobacterium avium
ATAFAMAGLLAWARRRPVLAGVLIG

SEQ ID NO: 13098 - protein, 22 aa, Mycobacterium avium
ATARAAARPEPREDVTATAAVP

SEQ ID NO: 13099 - protein, 25 aa, Mycobacterium avium
ATESGAWRRVAEWVAGRPALVAVAA

SEQ ID NO: 13100 - protein, 22 aa, Mycobacterium avium
ATFGEFLAWIIGWNLLLELAIG

SEQ ID NO: 13101 - protein, 25 aa, Mycobacterium avium
ATLVRAPRGWQRVGALSSRVGAFAI

SEQ ID NO: 13102 - protein, 26 aa, Mycobacterium avium
ATMHVAFSIWYLWSVMVLFMPQARYG

SEQ ID NO: 13103 - protein, 23 aa, Mycobacterium avium
ATPFPSQVFLTLFGLPMADRDRL

SEQ ID NO: 13104 - protein, 24 aa, Mycobacterium avium
ATTCAPVRSVLRAIPPLFGAVPTF

SEQ ID NO: 13105 - protein, 22 aa, Mycobacterium avium
ATTGGAWQWSASKNARLNTINA

SEQ ID NO: 13106 - protein, 23 aa, Mycobacterium avium
ATVAFPMYFLKSFAYAGVATVAF

SEQ ID NO: 13107 - protein, 20 aa, Mycobacterium avium
ATVIGLLTILGFSLYDTVIV

SEQ ID NO: 13108 - protein, 17 aa, Mycobacterium avium
ATVVLAMVVLRERVTRW

SEQ ID NO: 13109 - protein, 17 aa, Mycobacterium avium
ATVWLGFVASLPVFLVA

SEQ ID NO: 13110 - protein, 27 aa, Mycobacterium avium
AVAAWSVFRLFWLLYLGMTFGWLFGAM

SEQ ID NO: 13111 - protein, 24 aa, Mycobacterium avium
AVAFPGLPGMVFARLGASLLTAVV

SEQ ID NO: 13112 - protein, 21 aa, Mycobacterium avium
AVAGCAAALFVLLRAADRKGW

SEQ ID NO: 13113 - protein, 25 aa, Mycobacterium avium
AVAPIPVPIPLPIPGLGGPGFGGPP

SEQ ID NO: 13114 - protein, 22 aa, Mycobacterium avium
AVATAVIWTVALTRPAKMHEAA

SEQ ID NO: 13115 - protein, 18 aa, Mycobacterium avium
AVAVTLNYPFSRYDSLVL

SEQ ID NO: 13116 - protein, 18 aa, Mycobacterium avium
AVDVTLRTADGMRLGEPV

SEQ ID NO: 13117 - protein, 24 aa, Mycobacterium avium
AVGADYNLLLALRIKQEAAAGLRT

SEQ ID NO: 13118 - protein, 17 aa, Mycobacterium avium
AVGLAMFAFRYVIPADK

SEQ ID NO: 13119 - protein, 17 aa, Mycobacterium avium
AVHLQNGTSLLISKSLK

SEQ ID NO: 13120 - protein, 17 aa, Mycobacterium avium
AVIPAVAAVLSWIILGQ

SEQ ID NO: 13121 - protein, 25 aa, Mycobacterium avium
AVLALEIALAIGIRTTGTVALQPTP

SEQ ID NO: 13122 - protein, 21 aa, Mycobacterium avium
AVLIWPALGVILPVARVAALA

SEQ ID NO: 13123 - protein, 17 aa, Mycobacterium avium
AVLRDEADRAALLAPQI

SEQ ID NO: 13124 - protein, 22 aa, Mycobacterium avium
AVNEADYARMWVQAATTMGTYQ

SEQ ID NO: 13125 - protein, 22 aa, Mycobacterium avium
AVNEADYARMWVQAATTMSTYQ

SEQ ID NO: 13126 - protein, 24 aa, Mycobacterium avium
AVPLCLLSAALVLNLWVGYFPTVQ

SEQ ID NO: 13127 - protein, 18 aa, Mycobacterium avium
AVPTRNALVFGLVLTAGS

SEQ ID NO: 13128 - protein, 23 aa, Mycobacterium avium
AVQCKRLAKAVGVAAVQQVVAGA

SEQ ID NO: 13129 - protein, 18 aa, Mycobacterium avium
AVQRWLPYATVVVGVLLV

SEQ ID NO: 13130 - protein, 17 aa, Mycobacterium avium
AVRRAGLIVLLQGVAAL

SEQ ID NO: 13131 - protein, 17 aa, Mycobacterium avium
AVSELRELMATDYPNDG

SEQ ID NO: 13132 - protein, 19 aa, Mycobacterium avium
AVTGPRSWLLAAVAVLAGV

SEQ ID NO: 13133 - protein, 24 aa, Mycobacterium avium
AVVPQPGRHDWPFADRAFAAALPW

SEQ ID NO: 13134 - protein, 24 aa, Mycobacterium avium
AVVTQPGKHDWPFAAQAFATALPW

SEQ ID NO: 13135 - protein, 28 aa, Mycobacterium avium
AVVTSNELVAWVCIAASVVGVVLLILDA

SEQ ID NO: 13136 - protein, 25 aa, Mycobacterium avium
AVVVHPSWWPPARVRTVSAAAATLA

SEQ ID NO: 13137 - protein, 18 aa, Mycobacterium avium
AVYGRWSQKVGWHSAETS

SEQ ID NO: 13138 - protein, 19 aa, Mycobacterium avium
AWDGMPVEPVPPPPYAESG

SEQ ID NO: 13139 - protein, 26 aa, Mycobacterium avium
AWTNWLEIFLILVIGFSLPRTFGRMV

SEQ ID NO: 13140 - protein, 26 aa, Mycobacterium avium
AYLVTRWVQLPGLIGVTARWDFAPGT

SEQ ID NO: 13141 - protein, 26 aa, Mycobacterium avium
AYSEERLRPPPGYKDTTVPGIFARDT

SEQ ID NO: 13142 - protein, 25 aa, Mycobacterium avium
AYSEPRLQPPNGYKDTTVPGIWVPD

SEQ ID NO: 13143 - protein, 19 aa, Mycobacterium avium
AYVAGLILTVFSMRVAAAI

SEQ ID NO: 13144 - protein, 20 aa, Mycobacterium avium
CAALLAKLPTIWTAVGAVCF

SEQ ID NO: 13145 - protein, 19 aa, Mycobacterium avium
CAAPHAMEVTGTVNLAEKF

SEQ ID NO: 13146 - protein, 19 aa, Mycobacterium avium
CALLRRVADALPQRRPDAV

SEQ ID NO: 13147 - protein, 20 aa, Mycobacterium avium
CALVLALVYLQFRGDFTPKT

SEQ ID NO: 13148 - protein, 17 aa, Mycobacterium avium
CAVYLVFLAAVAIAAAM

SEQ ID NO: 13149 - protein, 22 aa, Mycobacterium avium
CFREPFWRFWLNAPAEDIFFIL

SEQ ID NO: 13150 - protein, 18 aa, Mycobacterium avium
CNAITVPPKQFWREFDIP

SEQ ID NO: 13151 - protein, 21 aa, Mycobacterium avium
CRSFSGGRFGADPPGSRRESI

SEQ ID NO: 13152 - protein, 17 aa, Mycobacterium avium
CRTANDMARFVASHPDM

SEQ ID NO: 13153 - protein, 24 aa, Mycobacterium avium
CRWAQAQPGVGAWVGYVGAAAEAG

SEQ ID NO: 13154 - protein, 30 aa, Mycobacterium avium
CTLNALPPRPEVRLLWALIAAAAMIEGALP

SEQ ID NO: 13155 - protein, 19 aa, Mycobacterium avium
CWMGVVIWITYVFNMTMFA

SEQ ID NO: 13156 - protein, 24 aa, Mycobacterium avium
CYASLRMSVRFIRRVAFTGYVVTV

SEQ ID NO: 13157 - protein, 19 aa, Mycobacterium avium
DAAEAVGFYRGERVERAQL

SEQ ID NO: 13158 - protein, 17 aa, Mycobacterium avium
DAARRTLNRPGFGLTDS

SEQ ID NO: 13159 - protein, 23 aa, Mycobacterium avium
DADGYAALARRAAADPALQSAMA

SEQ ID NO: 13160 - protein, 18 aa, Mycobacterium avium
DAGRSTWYTVDRPVYVAL

SEQ ID NO: 13161 - protein, 22 aa, Mycobacterium avium
DALEHLSRQALLEVAERENKVD

SEQ ID NO: 13162 - protein, 20 aa, Mycobacterium avium
DALGFLQDFFATAVFLGIAT

SEQ ID NO: 13163 - protein, 20 aa, Mycobacterium avium
DALLRLARRSAASGAALAGG

SEQ ID NO: 13164 - protein, 32 aa, Mycobacterium avium
DAMVAAPAHHWVKDLPDEPVWVRGDQARLHQL

SEQ ID NO: 13165 - protein, 17 aa, Mycobacterium avium
DAPAFKSMMHIGDKFNE

SEQ ID NO: 13166 - protein, 22 aa, Mycobacterium avium
DAPPTLLARQPLGGAVGGDVTA

SEQ ID NO: 13167 - protein, 18 aa, Mycobacterium avium
DASLWMRLPDLFAGIVCW

SEQ ID NO: 13168 - protein, 23 aa, Mycobacterium avium
DATRGLLRVPLRDGLYVREAMLV

SEQ ID NO: 13169 - protein, 33 aa, Mycobacterium avium
DDDQNSLLPRWLPGAPEHRGWVARIRADPGRAG

SEQ ID NO: 13170 - protein, 17 aa, Mycobacterium avium
DDLSIAFAIGERHELGP

SEQ ID NO: 13171 - protein, 17 aa, Mycobacterium avium
DDVEAMREMLLDLLTEN

SEQ ID NO: 13172 - protein, 23 aa, Mycobacterium avium
DEDGPAGWSMRLNVIDPPKPRRP

SEQ ID NO: 13173 - protein, 21 aa, Mycobacterium avium
DEFARRLPLMADRRDFSEPTA

SEQ ID NO: 13174 - protein, 20 aa, Mycobacterium avium
DEIPVLVLPTGKRIEFDLAS

SEQ ID NO: 13175 - protein, 25 aa, Mycobacterium avium
DEPPREWRMRIEVRSVGDDAKVSNV

SEQ ID NO: 13176 - protein, 21 aa, Mycobacterium avium
DFFLYATAAGLVFNKVFFPNE

SEQ ID NO: 13177 - protein, 38 aa, Mycobacterium avium
DFFRPMRSYFYWEKHCYDIPVCWSLRSVFDALDGIDTM

SEQ ID NO: 13178 - protein, 21 aa, Mycobacterium avium
DFTAVPLLWLLAIDIGLTILG

SEQ ID NO: 13179 - protein, 25 aa, Mycobacterium avium
DFWRPLRSYFYWEKHCYDIPICFSL

SEQ ID NO: 13180 - protein, 26 aa, Mycobacterium avium
DGLLPPRFARVNPRTMTPVNNTVIVA

SEQ ID NO: 13181 - protein, 20 aa, Mycobacterium avium
DGRYRRLWEGGRRDAVTVGT

SEQ ID NO: 13182 - protein, 20 aa, Mycobacterium avium
DGSAALAYRTRLGIAVVSGD

SEQ ID NO: 13183 - protein, 24 aa, Mycobacterium avium
DGSAWSAANARFDFYVRDIATRFD

SEQ ID NO: 13184 - protein, 25 aa, Mycobacterium avium
DGSRTRLATWVAVPGHTASPAGSIS

SEQ ID NO: 13185 - protein, 18 aa, Mycobacterium avium
DGSWIACQFVVNKHDGSG

SEQ ID NO: 13186 - protein, 22 aa, Mycobacterium avium
DGVRIPPRIIKATIAPDGTRTE

SEQ ID NO: 13187 - protein, 18 aa, Mycobacterium avium
DGYSRSGSGFGVVATSAW

SEQ ID NO: 13188 - protein, 17 aa, Mycobacterium avium
DIARADCQLVLADANSA

SEQ ID NO: 13189 - protein, 18 aa, Mycobacterium avium
DIRRGMAGAGLRFESVKG

SEQ ID NO: 13190 - protein, 23 aa, Mycobacterium avium
DIRYMKARMDDMLVQADLMRKQI

SEQ ID NO: 13191 - protein, 25 aa, Mycobacterium avium
DKWPEKLARISFWCMNIGLAWMVFA

SEQ ID NO: 13192 - protein, 21 aa, Mycobacterium avium
DLAELDRRLGWDAVSGTVQRW

SEQ ID NO: 13193 - protein, 23 aa, Mycobacterium avium
DLAYGLGLWWGVLRERNARALRP

SEQ ID NO: 13194 - protein, 25 aa, Mycobacterium avium
DLDRLRSLMRSVLCSLAVFHNPRDV

SEQ ID NO: 13195 - protein, 23 aa, Mycobacterium avium
DLEIAPGVVTTWMKLAIRDRIVP

SEQ ID NO: 13196 - protein, 20 aa, Mycobacterium avium
DLRHPVVVAVLFVVIAGIVV

SEQ ID NO: 13197 - protein, 21 aa, Mycobacterium avium
DLRRLLILCAAWMVIPTALVV

SEQ ID NO: 13198 - protein, 18 aa, Mycobacterium avium
DLSHAYTAVFVIAVALVV

SEQ ID NO: 13199 - protein, 17 aa, Mycobacterium avium
DLSHRGIFLDGSRVPTV

SEQ ID NO: 13200 - protein, 23 aa, Mycobacterium avium
DMDERLVAMIARIVEAYGKYSSS

SEQ ID NO: 13201 - protein, 17 aa, Mycobacterium avium
DNLFRLDHLAARLRRNS

SEQ ID NO: 13202 - protein, 22 aa, Mycobacterium avium
DNPWKWNVIGLLAIALAGAVVL

SEQ ID NO: 13203 - protein, 22 aa, Mycobacterium avium
DPATFARRRRNVLIGVGAGLAV

SEQ ID NO: 13204 - protein, 21 aa, Mycobacterium avium
DPDGGAAFVRRLVTLTTALLI

SEQ ID NO: 13205 - protein, 26 aa, Mycobacterium avium
DPDVRPRLILGAGLIALSVLGLRHLW

SEQ ID NO: 13206 - protein, 26 aa, Mycobacterium avium
DPEDMKARETVGWMRAELPKVSEAGT

SEQ ID NO: 13207 - protein, 29 aa, Mycobacterium avium
DPENFWRSAGLPAFRWPDPNGTRLPNGAP

SEQ ID NO: 13208 - protein, 17 aa, Mycobacterium avium
DPIAWWTTDLLFARPDW

SEQ ID NO: 13209 - protein, 19 aa, Mycobacterium avium
DPLLARAAAEVGTLARAIV

SEQ ID NO: 13210 - protein, 20 aa, Mycobacterium avium
DPRIGRQFLNAGLGFGGGCL

SEQ ID NO: 13211 - protein, 18 aa, Mycobacterium avium
DQRALGAAVRYAAVDKNA

SEQ ID NO: 13212 - protein, 22 aa, Mycobacterium avium
DRLKEMIKVRGFQVAPAEIEAV

SEQ ID NO: 13213 - protein, 20 aa, Mycobacterium avium
DRPAPAGGRRFWQRERTPLH

SEQ ID NO: 13214 - protein, 32 aa, Mycobacterium avium
DRRSRGGGTLINWRSPIAWLSRYRPGTHLANW

SEQ ID NO: 13215 - protein, 22 aa, Mycobacterium avium
DSGLRPRYPAVEVYRVDAGGDA

SEQ ID NO: 13216 - protein, 23 aa, Mycobacterium avium
DSRTVRWDDIDGLRFHRGSWARA

SEQ ID NO: 13217 - protein, 19 aa, Mycobacterium avium
DSTLAIAYRRLDADVPPPS

SEQ ID NO: 13218 - protein, 19 aa, Mycobacterium avium
DTADGLGCYGPPDRARAVM

SEQ ID NO: 13219 - protein, 22 aa, Mycobacterium avium
DTARWYLLKGRVDDARRALLRV

SEQ ID NO: 13220 - protein, 17 aa, Mycobacterium avium
DTIGEDWRLFGATTAVY

SEQ ID NO: 13221 - protein, 22 aa, Mycobacterium avium
DTRVQAAVPFYGIYDFTRFDDS

SEQ ID NO: 13222 - protein, 24 aa, Mycobacterium avium
DVAAGRRKALAFIEGRSVEQLVAL

SEQ ID NO: 13223 - protein, 26 aa, Mycobacterium avium
DVLSGWMLGTAWAFAVMLVGTWWDNT

SEQ ID NO: 13224 - protein, 20 aa, Mycobacterium avium
DVPGGFAAGLARALPVTGGQ

SEQ ID NO: 13225 - protein, 24 aa, Mycobacterium avium
DVPGMPRLLKWISPLIPLVAGPLP

SEQ ID NO: 13226 - protein, 19 aa, Mycobacterium avium
DVRTARIVTPRVMQLTLRA

SEQ ID NO: 13227 - protein, 19 aa, Mycobacterium avium
DWLLLRIPVGTVWSEEAAF

SEQ ID NO: 13228 - protein, 33 aa, Mycobacterium avium
DYAELPGCPGSVCAGKIKQAYGLAYQQSLNAQA

SEQ ID NO: 13229 - protein, 17 aa, Mycobacterium avium
DYGEIDGQMFLEMRLVE

SEQ ID NO: 13230 - protein, 19 aa, Mycobacterium avium
EAAIMAAWEKAGGDTSPLG

SEQ ID NO: 13231 - protein, 20 aa, Mycobacterium avium
EAAMKYFLLGAFSSAFFLYG

SEQ ID NO: 13232 - protein, 27 aa, Mycobacterium avium
EAAPAKLSRRSLVIGNAVIAFAVIGLA

SEQ ID NO: 13233 - protein, 20 aa, Mycobacterium avium
EAEGGMGPHGLMIGMTGSGK

SEQ ID NO: 13234 - protein, 26 aa, Mycobacterium avium
EAGYAYFAGRLGDWMRVDGENLGAAP

SEQ ID NO: 13235 - protein, 19 aa, Mycobacterium avium
EAIALIVVIVRYLEPFTTI

SEQ ID NO: 13236 - protein, 26 aa, Mycobacterium avium
EAITKRLPTVFGLIAVVTFMLLFLLT

SEQ ID NO: 13237 - protein, 26 aa, Mycobacterium avium
EATGRGRWALCLVDGSPLRATQSLSE

SEQ ID NO: 13238 - protein, 29 aa, Mycobacterium avium
EATRVGKRFLVIDLPRPRSVQLLLTPLIL

SEQ ID NO: 13239 - protein, 28 aa, Mycobacterium avium
EDYRRVEIAGLPECSLLGAAAGGAIHLF

SEQ ID NO: 13240 - protein, 20 aa, Mycobacterium avium
EEPRLRACPRTRRIRRIARR

SEQ ID NO: 13241 - protein, 23 aa, Mycobacterium avium
EFGRSHYPVMVFIHTALLAGCLV

SEQ ID NO: 13242 - protein, 19 aa, Mycobacterium avium
EGSLGRLVVELADDADDAA

SEQ ID NO: 13243 - protein, 25 aa, Mycobacterium avium
EIGQFTRWLVSFLVGRLDRIAPFRL

SEQ ID NO: 13244 - protein, 18 aa, Mycobacterium avium
EIGVPIFFVLSGYLLFRP

SEQ ID NO: 13245 - protein, 24 aa, Mycobacterium avium
EITGMTCASCAARIEKKLNKLDGV

SEQ ID NO: 13246 - protein, 24 aa, Mycobacterium avium
EKAMAANSVNFVWITDFQPYQPQL

SEQ ID NO: 13247 - protein, 18 aa, Mycobacterium avium
EKLAALLTQPGKTYDVSS

SEQ ID NO: 13248 - protein, 24 aa, Mycobacterium avium
ELDRFPRGNLLGIPGAPERMVQNP

SEQ ID NO: 13249 - protein, 20 aa, Mycobacterium avium
ELGIILALLMGWQFTAAEFV

SEQ ID NO: 13250 - protein, 18 aa, Mycobacterium avium
ELLEDFEQFGYYLVHNPA

SEQ ID NO: 13251 - protein, 26 aa, Mycobacterium avium
EMIALPLSFLVLIWVFGGLLAAALPM

SEQ ID NO: 13252 - protein, 19 aa, Mycobacterium avium
EMPSFDWPTAVVSGGRDLI

SEQ ID NO: 13253 - protein, 23 aa, Mycobacterium avium
ENLNRYGLAAARGLDDVGQMAWF

SEQ ID NO: 13254 - protein, 23 aa, Mycobacterium avium
EPAPRRPWSMLLAGGALAGIAAV

SEQ ID NO: 13255 - protein, 27 aa, Mycobacterium avium
EPDVVSWKLKPGVVSTMTAQARYTDPN

SEQ ID NO: 13256 - protein, 24 aa, Mycobacterium avium
EPPNRVRIGLMGIVVTVLVIGVGQ

SEQ ID NO: 13257 - protein, 24 aa, Mycobacterium avium
EPRGWWAQLSWLPQRPVLVPGTVD

SEQ ID NO: 13258 - protein, 21 aa, Mycobacterium avium
EPRNWRLKVTVTDEGGQYKMS

SEQ ID NO: 13259 - protein, 25 aa, Mycobacterium avium
EPSINISASLTWGGERYRYPTNLPK

SEQ ID NO: 13260 - protein, 23 aa, Mycobacterium avium
EPSLPAFRHDLSVLPTVSNAYAD

SEQ ID NO: 13261 - protein, 23 aa, Mycobacterium avium
EPTLHGCTGCVGDRIMVDKVSYR

SEQ ID NO: 13262 - protein, 21 aa, Mycobacterium avium
EQIMPLLVVAVMSQLVFSGGM

SEQ ID NO: 13263 - protein, 17 aa, Mycobacterium avium
EQLRDASTMRVQVADDP

SEQ ID NO: 13264 - protein, 31 aa, Mycobacterium avium
EQVRISRFQTLLLKWAMMVLLGLLTSAVYLA

SEQ ID NO: 13265 - protein, 24 aa, Mycobacterium avium
ERALRMVVAPALRLGPPDQQALVS

SEQ ID NO: 13266 - protein, 18 aa, Mycobacterium avium
ERDSPTWSPRFIDHLVGD

SEQ ID NO: 13267 - protein, 25 aa, Mycobacterium avium
ERFGRGWAWLSAFTLFASAIGALLT

SEQ ID NO: 13268 - protein, 19 aa, Mycobacterium avium
ERRAGAPMMARFHGMWSLG

SEQ ID NO: 13269 - protein, 30 aa, Mycobacterium avium
ERRKRPWRRYLRRSVLPLLLVASLAVSGFL

SEQ ID NO: 13270 - protein, 25 aa, Mycobacterium avium
ESAELCAQYLAPILDAIKFNYPPFG

SEQ ID NO: 13271 - protein, 21 aa, Mycobacterium avium
ESAQAGFWSALSLPPLLLGLL

SEQ ID NO: 13272 - protein, 23 aa, Mycobacterium avium
ESCAAERDWAAAIRHRLRAVARQ

SEQ ID NO: 13273 - protein, 52 aa, Mycobacterium avium
ESESKARSRRRLRLPSWSVAWKAAVIALICAFVAASGYMMWERHQTSERNQR

SEQ ID NO: 13274 - protein, 23 aa, Mycobacterium avium
ESGRSASGLTQWSVVIDAPPSSV

SEQ ID NO: 13275 - protein, 23 aa, Mycobacterium avium
ESQGREGFVWVGLREPNQTEMQE

SEQ ID NO: 13276 - protein, 33 aa, Mycobacterium avium
ESVAPKRPSTWRHLPAILLVASLVLFTIAMAGP

SEQ ID NO: 13277 - protein, 26 aa, Mycobacterium avium
ETATRRFLVDAAHELRTPIAGMQVAA

SEQ ID NO: 13278 - protein, 18 aa, Mycobacterium avium
ETFWEFLPRSVFGSLRSA

SEQ ID NO: 13279 - protein, 38 aa, Mycobacterium avium
ETLGAGRGRPTWRVLLIGLGVIVAWLLIVMLLARLFAS

SEQ ID NO: 13280 - protein, 23 aa, Mycobacterium avium
ETPEGRSVVVFAKQHFGLRARTP

SEQ ID NO: 13281 - protein, 25 aa, Mycobacterium avium
ETTRGRIALRWARIAVLIVTGLVTL

SEQ ID NO: 13282 - protein, 17 aa, Mycobacterium avium
EVAESIDMRTFPGSEYG

SEQ ID NO: 13283 - protein, 20 aa, Mycobacterium avium
EVLAVPMVAVVLFLVFGGAV

SEQ ID NO: 13284 - protein, 22 aa, Mycobacterium avium
EVTEYFLVGSFTSWLLALGGIG

SEQ ID NO: 13285 - protein, 19 aa, Mycobacterium avium
EVVEITGAVLTKLDGTAKG

SEQ ID NO: 13286 - protein, 19 aa, Mycobacterium avium
EWRRDRNLVYFLFASALFR

SEQ ID NO: 13287 - protein, 37 aa, Mycobacterium avium
EYLDLPRLWQILLIAGMFMWIAIIWRGIRGRLKGESK

SEQ ID NO: 13288 - protein, 24 aa, Mycobacterium avium
FAACGIIGLGAALLIAALLLTTYT

SEQ ID NO: 13289 - protein, 21 aa, Mycobacterium avium
FAFGTGRLWPNGVLAAAIFAA

SEQ ID NO: 13290 - protein, 17 aa, Mycobacterium avium
FAGRVAAVLACRRTVPA

SEQ ID NO: 13291 - protein, 27 aa, Mycobacterium avium
FAHQSAWLRIFAVGLMFAGVTTTALLV

SEQ ID NO: 13292 - protein, 25 aa, Mycobacterium avium
FAIVPWLHRFGDLVAPLTFLGAAYV

SEQ ID NO: 13293 - protein, 26 aa, Mycobacterium avium
FAPDGRFPWPTALVFTAGVLLAALRP

SEQ ID NO: 13294 - protein, 17 aa, Mycobacterium avium
FAPNFTVLVILRLLYGI

SEQ ID NO: 13295 - protein, 17 aa, Mycobacterium avium
FAPRYTRLVAGVFSALT

SEQ ID NO: 13296 - protein, 18 aa, Mycobacterium avium
FAPVAWGVLIGFVALYLI

SEQ ID NO: 13297 - protein, 17 aa, Mycobacterium avium
FATGWSAFGLRMALVPL

SEQ ID NO: 13298 - protein, 23 aa, Mycobacterium avium
FAVACALSALASVRVDRKREDER

SEQ ID NO: 13299 - protein, 38 aa, Mycobacterium avium
FDPKRAIDVRGWRKVGTAVVRWPKPIIVVTAAIAVIGF

SEQ ID NO: 13300 - protein, 36 aa, Mycobacterium avium
FDPKRAIGFGRWRRIGTAIVRWPAPILTATIAVALV

SEQ ID NO: 13301 - protein, 32 aa, Mycobacterium avium
FDPNSKFTVSLLWPGDRAWRQGGDRRMLCGLQ

SEQ ID NO: 13302 - protein, 25 aa, Mycobacterium avium
FDVMARRASAHAARWRTGRFTYRPD

SEQ ID NO: 13303 - protein, 17 aa, Mycobacterium avium
FERQAKRGRLWRRVGTA

SEQ ID NO: 13304 - protein, 19 aa, Mycobacterium avium
FFEFLTDLLDGWVAYFADH

SEQ ID NO: 13305 - protein, 36 aa, Mycobacterium avium
FFLIGHALGVPGWITQRLWWALLLTVGFWGLLRVAE

SEQ ID NO: 13306 - protein, 21 aa, Mycobacterium avium
FFNAVGWPTWGAILTAPFLLP

SEQ ID NO: 13307 - protein, 22 aa, Mycobacterium avium
FFPQRRKGFALGLTGGVGNLGA

SEQ ID NO: 13308 - protein, 20 aa, Mycobacterium avium
FFVAYQVFFNAVGWPTWGAI

SEQ ID NO: 13309 - protein, 17 aa, Mycobacterium avium
FFVTRSFVRFIRHRAET

SEQ ID NO: 13310 - protein, 25 aa, Mycobacterium avium
FGAVPTFWLGLVVLQVFSVQLGLIS

SEQ ID NO: 13311 - protein, 17 aa, Mycobacterium avium
FGFLINLLIVFGVSFEF

SEQ ID NO: 13312 - protein, 22 aa, Mycobacterium avium
FGFNLYWRVRYALQSSGGAAQF

SEQ ID NO: 13313 - protein, 28 aa, Mycobacterium avium
FGGLLSEWDWRAIFWVGVPVGVLGTVWG

SEQ ID NO: 13314 - protein, 25 aa, Mycobacterium avium
FGLGLALLAWFGFYLYKISHGNVEE

SEQ ID NO: 13315 - protein, 26 aa, Mycobacterium avium
FGSPYAVYLFYVFKIAGYVAGAAAVI

SEQ ID NO: 13316 - protein, 27 aa, Mycobacterium avium
FGSRTGMGFGRDLRAAMFEHVITFSER

SEQ ID NO: 13317 - protein, 17 aa, Mycobacterium avium
FGSWIGFSFAFGQVMQV

SEQ ID NO: 13318 - protein, 37 aa, Mycobacterium avium
FIVPSIVALLGRWFWWPSPLPRRGVARVVKTVEPQPL

SEQ ID NO: 13319 - protein, 29 aa, Mycobacterium avium
FKAIVANLLPYQVLQPWVDAAFKKRGIDP

SEQ ID NO: 13320 - protein, 18 aa, Mycobacterium avium
FKLIPSVFAQRSRALELG

SEQ ID NO: 13321 - protein, 20 aa, Mycobacterium avium
FKLVGSAVAAIFVIGVVALV

SEQ ID NO: 13322 - protein, 20 aa, Mycobacterium avium
FLCVALLVYFALLGRVAIAM

SEQ ID NO: 13323 - protein, 26 aa, Mycobacterium avium
FLDRLRARHGWLDHLIRAYQRFDDRN

SEQ ID NO: 13324 - protein, 22 aa, Mycobacterium avium
FLHYRGWAIPVAFVIAQGTATV

SEQ ID NO: 13325 - protein, 19 aa, Mycobacterium avium
FLIAAPVAGWLADRFGARP

SEQ ID NO: 13326 - protein, 19 aa, Mycobacterium avium
FLLAKVIDRVMGFRVSAED

SEQ ID NO: 13327 - protein, 18 aa, Mycobacterium avium
FLLSGYLFYWVVIGVDPT

SEQ ID NO: 13328 - protein, 22 aa, Mycobacterium avium
FLPGIIGVTIGRWRVDRNPPPR

SEQ ID NO: 13329 - protein, 17 aa, Mycobacterium avium
FLPGSPPAGAWVDQALV

SEQ ID NO: 13330 - protein, 20 aa, Mycobacterium avium
FLSLTAAFGALVWIFQDGHL

SEQ ID NO: 13331 - protein, 26 aa, Mycobacterium avium
FMHVMGRWNWWAPKPLAWLHDRFGIS

SEQ ID NO: 13332 - protein, 25 aa, Mycobacterium avium
FPGKRAPTVQLCRDPKGYVPIGRNP

SEQ ID NO: 13333 - protein, 21 aa, Mycobacterium avium
FPPEIHSALLSSGPGPGPLLA

SEQ ID NO: 13334 - protein, 20 aa, Mycobacterium avium
FPPSRLQAYTTPYTAQFHNP

SEQ ID NO: 13335 - protein, 23 aa, Mycobacterium avium
FQKRYELEWQYRAWGLEMIEMNV

SEQ ID NO: 13336 - protein, 19 aa, Mycobacterium avium
FQRGQIMVCSYVLRTGGSY

SEQ ID NO: 13337 - protein, 22 aa, Mycobacterium avium
FQRPGMLLFGLVPLALLALYLV

SEQ ID NO: 13338 - protein, 18 aa, Mycobacterium avium
FQWQEFVRQGAFMAGTAV

SEQ ID NO: 13339 - protein, 17 aa, Mycobacterium avium
FQYWSWANLACVVCAIG

SEQ ID NO: 13340 - protein, 27 aa, Mycobacterium avium
FRAIDRLGPELSVREIAEEAGTAKPKI

SEQ ID NO: 13341 - protein, 21 aa, Mycobacterium avium
FRGLPEVVIILLIGLGIGPIV

SEQ ID NO: 13342 - protein, 17 aa, Mycobacterium avium
FSFAGLVATSFPLQLPW

SEQ ID NO: 13343 - protein, 18 aa, Mycobacterium avium
FSPQGWSMHPSLSMFLSR

SEQ ID NO: 13344 - protein, 26 aa, Mycobacterium avium
FSQAYWQLMLCRVFSGVGSTMFYVSA

SEQ ID NO: 13345 - protein, 17 aa, Mycobacterium avium
FSSKWTKGIRYWQAGYT

SEQ ID NO: 13346 - protein, 26 aa, Mycobacterium avium
FTAFAVGLMALWLAGLRWRRHGVRAA

SEQ ID NO: 13347 - protein, 18 aa, Mycobacterium avium
FTEVGAWWSEPIVFQKAV

SEQ ID NO: 13348 - protein, 21 aa, Mycobacterium avium
FTPKTKLTMVATRAGLVMETG

SEQ ID NO: 13349 - protein, 28 aa, Mycobacterium avium
FTRLWPTVICLLGYAVSFALLAVSISRG

SEQ ID NO: 13350 - protein, 18 aa, Mycobacterium avium
FVALIAFVMLLVSIHSVF

SEQ ID NO: 13351 - protein, 18 aa, Mycobacterium avium
FVAPPALRPSAAAPSVMA

SEQ ID NO: 13352 - protein, 21 aa, Mycobacterium avium
FVLAVAPGWFGVLVALRVTAG

SEQ ID NO: 13353 - protein, 28 aa, Mycobacterium avium
FVLIGVGLAVIFSYVWGVRVGGLFTALG

SEQ ID NO: 13354 - protein, 27 aa, Mycobacterium avium
FVLLRAADRKGWRRRLHAYSEQHRFAL

SEQ ID NO: 13355 - protein, 29 aa, Mycobacterium avium
FVLTWAVALLIWRYGRIEERWAGADPRAG

SEQ ID NO: 13356 - protein, 20 aa, Mycobacterium avium
FVSGSLWGVFAVLTKEVMAR

SEQ ID NO: 13357 - protein, 19 aa, Mycobacterium avium
FYLPPDIFDNADFKKAMSQ

SEQ ID NO: 13358 - protein, 20 aa, Mycobacterium avium
FYLYATASALVFKPLFFPNI

SEQ ID NO: 13359 - protein, 24 aa, Mycobacterium avium
GAADRPGMRHDFELTVGHGAHVSH

SEQ ID NO: 13360 - protein, 18 aa, Mycobacterium avium
GAALASAHAPLFASSTAA

SEQ ID NO: 13361 - protein, 17 aa, Mycobacterium avium
GAASSVAEWVRSQRGSV

SEQ ID NO: 13362 - protein, 25 aa, Mycobacterium avium
GAEALRLKGYLLMCRNSRRDYADFA

SEQ ID NO: 13363 - protein, 18 aa, Mycobacterium avium
GAITLWLGLVANVGQVLN

SEQ ID NO: 13364 - protein, 24 aa, Mycobacterium avium
GALAGAFGEFFYKDPRRISAAITL

SEQ ID NO: 13365 - protein, 33 aa, Mycobacterium avium
GANSRLVKRGGPAAGHRSDPHWTRPEDSDADLD

SEQ ID NO: 13366 - protein, 24 aa, Mycobacterium avium
GANVGRLVLIAAIGTILAVRAGDL

SEQ ID NO: 13367 - protein, 25 aa, Mycobacterium avium
GAPMMARFHGMWSLGTLAGALIGAA

SEQ ID NO: 13368 - protein, 20 aa, Mycobacterium avium
GARSRDAWRLRWKQNPLPGG

SEQ ID NO: 13369 - protein, 22 aa, Mycobacterium avium
GARWRDCRLAKSIAARQASAGC

SEQ ID NO: 13370 - protein, 18 aa, Mycobacterium avium
GARYRAFDLMEAGPDRTA

SEQ ID NO: 13371 - protein, 24 aa, Mycobacterium avium
GATRWEVVRTVTLPFGRSGYISGG

SEQ ID NO: 13372 - protein, 29 aa, Mycobacterium avium
GATYCLSFSRLPWFNTMGAPVAIGMLVVV

SEQ ID NO: 13373 - protein, 25 aa, Mycobacterium avium
GAVALGAVGAWIGCRRHGIPLPAFA

SEQ ID NO: 13374 - protein, 24 aa, Mycobacterium avium
GAVLAIGLVRWYFGHGQRSTTAAG

SEQ ID NO: 13375 - protein, 22 aa, Mycobacterium avium
GAVSRTRWLASHLVIALAGSGV

SEQ ID NO: 13376 - protein, 18 aa, Mycobacterium avium
GAVVVPFSTFVTVRELRE

SEQ ID NO: 13377 - protein, 20 aa, Mycobacterium avium
GCFALSFLAIGALRLEGAGK

SEQ ID NO: 13378 - protein, 17 aa, Mycobacterium avium
GCFIVFSTLELHGVRSL

SEQ ID NO: 13379 - protein, 24 aa, Mycobacterium avium
GCLAGLVAVGWVWHSFTGRVRRLA

SEQ ID NO: 13380 - protein, 25 aa, Mycobacterium avium
GDEYLVRCAAFWRQVAPAGAVLARF

SEQ ID NO: 13381 - protein, 20 aa, Mycobacterium avium
GDGLSDCDAHGTLVASMIGA

SEQ ID NO: 13382 - protein, 18 aa, Mycobacterium avium
GDLFLLNFLTIVTEFIGI

SEQ ID NO: 13383 - protein, 19 aa, Mycobacterium avium
GDRLWIRFIPDTEHRSQVI

SEQ ID NO: 13384 - protein, 22 aa, Mycobacterium avium
GDRRMLCGLQLPGANNQQQVFK

SEQ ID NO: 13385 - protein, 19 aa, Mycobacterium avium
GDSIGWTWMHYLPPTPGFA

SEQ ID NO: 13386 - protein, 18 aa, Mycobacterium avium
GDVVVPWVLSARSAEALT

SEQ ID NO: 13387 - protein, 23 aa, Mycobacterium avium
GEARGFAGFPIGGRFLRADNPVL

SEQ ID NO: 13388 - protein, 26 aa, Mycobacterium avium
GEDIFARGGPYLARGAADLVPTAELL

SEQ ID NO: 13389 - protein, 19 aa, Mycobacterium avium
GEDRPSLHGTLGHLEGIQQ

SEQ ID NO: 13390 - protein, 18 aa, Mycobacterium avium
GEERQLRAALANIVVSVV

SEQ ID NO: 13391 - protein, 17 aa, Mycobacterium avium
GEIDGQMFLEMRLVEGT

SEQ ID NO: 13392 - protein, 33 aa, Mycobacterium avium
GELDAGFRQRLWRECRAVTRLQEPHVLPLHDFG

SEQ ID NO: 13393 - protein, 22 aa, Mycobacterium avium
GELRSAHLLSPAPRPSIMRRGV

SEQ ID NO: 13394 - protein, 34 aa, Mycobacterium avium
GEMRSWPAPLSILLALWAVRAVAHWLQARLGQRG

SEQ ID NO: 13395 - protein, 17 aa, Mycobacterium avium
GEPEHPAPTLALAAGPA

SEQ ID NO: 13396 - protein, 25 aa, Mycobacterium avium
GERDRLPIELAIAVLVLVVLLVVYR

SEQ ID NO: 13397 - protein, 18 aa, Mycobacterium avium
GETEYGLKAVPLGGFCDI

SEQ ID NO: 13398 - protein, 22 aa, Mycobacterium avium
GETPRSGWAAVVGAGLFLGFTA

SEQ ID NO: 13399 - protein, 21 aa, Mycobacterium avium
GEVAVFVFFGLVAVLGTEYTQ

SEQ ID NO: 13400 - protein, 19 aa, Mycobacterium avium
GEYWLDLAQSLLRILTGFG

SEQ ID NO: 13401 - protein, 24 aa, Mycobacterium avium
GFFPLMGIGAFSMLAFSGRFGRAR

SEQ ID NO: 13402 - protein, 18 aa, Mycobacterium avium
GFGTPLVMHVMYGVKIAL

SEQ ID NO: 13403 - protein, 23 aa, Mycobacterium avium
GFSHFTLLLVHALRQQFSRVRVF

SEQ ID NO: 13404 - protein, 18 aa, Mycobacterium avium
GFSPALSTALGWAIFHTL

SEQ ID NO: 13405 - protein, 25 aa, Mycobacterium avium
GFTRAGALWSSLIAGFVILILLLIF

SEQ ID NO: 13406 - protein, 17 aa, Mycobacterium avium
GFWVSLGIFCLLAALWV

SEQ ID NO: 13407 - protein, 19 aa, Mycobacterium avium
GGGFERGFEAGRDAAFADA

SEQ ID NO: 13408 - protein, 20 aa, Mycobacterium avium
GGGGFPGFPGGGGHGGGGFP

SEQ ID NO: 13409 - protein, 26 aa, Mycobacterium avium
GGGLGFLLGLADQWLFSRISGDMMNF

SEQ ID NO: 13410 - protein, 17 aa, Mycobacterium avium
GGGRPWLIVGYFAVLAA

SEQ ID NO: 13411 - protein, 29 aa, Mycobacterium avium
GGLPLMLGALWASARLARRADSTAAEANS

SEQ ID NO: 13412 - protein, 21 aa, Mycobacterium avium
GGPILGGWLIDTSSWRWIFLI

SEQ ID NO: 13413 - protein, 22 aa, Mycobacterium avium
GGPPRAVIMVAVALAVTTIGVI

SEQ ID NO: 13414 - protein, 25 aa, Mycobacterium avium
GGQRKRASVALELLTQPSLLLLDEP

SEQ ID NO: 13415 - protein, 19 aa, Mycobacterium avium
GGRGDGWRSVPRAVYAFDV

SEQ ID NO: 13416 - protein, 22 aa, Mycobacterium avium
GGRMSDRWQYLVVLAACLVVTA

SEQ ID NO: 13417 - protein, 27 aa, Mycobacterium avium
GGRPILRILVRRHRVVGTWPLVAPMLA

SEQ ID NO: 13418 - protein, 27 aa, Mycobacterium avium
GGRRTDRWGHWLGCATAVAAFVVGVGL

SEQ ID NO: 13419 - protein, 18 aa, Mycobacterium avium
GGVAGWVFGYAGIFWLAA

SEQ ID NO: 13420 - protein, 20 aa, Mycobacterium avium
GGVAMMMFGGRFGGQQQMSR

SEQ ID NO: 13421 - protein, 20 aa, Mycobacterium avium
GHATDLLFNGVVGRQLPAGI

SEQ ID NO: 13422 - protein, 29 aa, Mycobacterium avium
GHHSDLDWLWWFGAGWLAVAVVGAGVILW

SEQ ID NO: 13423 - protein, 23 aa, Mycobacterium avium
GHLPLLCCLVAFILTFFVTRSFV

SEQ ID NO: 13424 - protein, 19 aa, Mycobacterium avium
GHRPYLPHAIRIFAVPIIL

SEQ ID NO: 13425 - protein, 29 aa, Mycobacterium avium
GHVRPLYGPGLRFLIPLLDKMIRVDQRLV

SEQ ID NO: 13426 - protein, 23 aa, Mycobacterium avium
GHYRILELLGRGGMGRVYRAYDA

SEQ ID NO: 13427 - protein, 17 aa, Mycobacterium avium
GIIERPERLIIVLVGAG

SEQ ID NO: 13428 - protein, 24 aa, Mycobacterium avium
GIPEEFSDKVFVIFQRLHGREVYA

SEQ ID NO: 13429 - protein, 24 aa, Mycobacterium avium
GKPLVPRWLRFVLASDRAGSAWYI

SEQ ID NO: 13430 - protein, 24 aa, Mycobacterium avium
GKRGFLPPFVTWFAALLFAVIPIR

SEQ ID NO: 13431 - protein, 19 aa, Mycobacterium avium
GKRRKGKRGGRRGAGDGSR

SEQ ID NO: 13432 - protein, 18 aa, Mycobacterium avium
GKSTLAWIMAGLTVPTTG

SEQ ID NO: 13433 - protein, 17 aa, Mycobacterium avium
GLAALFLASSLYSTATF

SEQ ID NO: 13434 - protein, 25 aa, Mycobacterium avium
GLEKLESLPGGLLLVGSGVDVAPLK

SEQ ID NO: 13435 - protein, 18 aa, Mycobacterium avium
GLFRRPAYWLSMLIVLGF

SEQ ID NO: 13436 - protein, 21 aa, Mycobacterium avium
GLFYLIWNYGYRQGTTGSSVG

SEQ ID NO: 13437 - protein, 18 aa, Mycobacterium avium
GLHGGGWAGLLCLLAGSS

SEQ ID NO: 13438 - protein, 17 aa, Mycobacterium avium
GLLCGIGSVVAIVLGAI

SEQ ID NO: 13439 - protein, 25 aa, Mycobacterium avium
GLPRSEFAVSLALVLLMLPVIVRAT

SEQ ID NO: 13440 - protein, 17 aa, Mycobacterium avium
GLSGSPLPIPWSVLSLF

SEQ ID NO: 13441 - protein, 18 aa, Mycobacterium avium
GLTGLFYVVTYIGFGLPL

SEQ ID NO: 13442 - protein, 17 aa, Mycobacterium avium
GLTPWIAAPLLFIGFMF

SEQ ID NO: 13443 - protein, 19 aa, Mycobacterium avium
GLVAHVADRLLGLGALTAH

SEQ ID NO: 13444 - protein, 17 aa, Mycobacterium avium
GLVELWLGIAAEQRPLE

SEQ ID NO: 13445 - protein, 21 aa, Mycobacterium avium
GLVLPRAMFWTVLVYVFIATV

SEQ ID NO: 13446 - protein, 17 aa, Mycobacterium avium
GMAESMASFSPTAPTGA

SEQ ID NO: 13447 - protein, 17 aa, Mycobacterium avium
GMKVRRYFVGFGPTLWS

SEQ ID NO: 13448 - protein, 26 aa, Mycobacterium avium
GMTWTLPVLGAWVIVSTWILPGVVLT

SEQ ID NO: 13449 - protein, 23 aa, Mycobacterium avium
GNEALAVPIWWAYAAAQILITAG

SEQ ID NO: 13450 - protein, 25 aa, Mycobacterium avium
GNPHGPRLTFALGPQQGHAGHPGRP

SEQ ID NO: 13451 - protein, 23 aa, Mycobacterium avium
GNQAPYWVCAVYLVLLALVGAGA

SEQ ID NO: 13452 - protein, 22 aa, Mycobacterium avium
GPAMGSALFAYGHFGDVDAGYL

SEQ ID NO: 13453 - protein, 25 aa, Mycobacterium avium
GPDFGKASPVGLLIVVLLLISTLFL

SEQ ID NO: 13454 - protein, 21 aa, Mycobacterium avium
GPDRFWLSAGQAFVSGVVVDW

SEQ ID NO: 13455 - protein, 20 aa, Mycobacterium avium
GPDRPVVVSVVGLVHTPGLV

SEQ ID NO: 13456 - protein, 22 aa, Mycobacterium avium
GPERFYDMVRKFGLGQRTNVGL

SEQ ID NO: 13457 - protein, 30 aa, Mycobacterium avium
GPGGRPGCWQKITRDLWPAPYLVMDTGASL

SEQ ID NO: 13458 - protein, 24 aa, Mycobacterium avium
GPGRLLCRPAMRAIGRISYSWYLW

SEQ ID NO: 13459 - protein, 24 aa, Mycobacterium avium
GPLLGIPGAPAFLGRPLAAADTAW

SEQ ID NO: 13460 - protein, 31 aa, Mycobacterium avium
GPMSHAAVVAREFGFPCVVDVQGATKSLPPG

SEQ ID NO: 13461 - protein, 21 aa, Mycobacterium avium
GPRAPQLWLPPLDEPIPLSAM

SEQ ID NO: 13462 - protein, 17 aa, Mycobacterium avium
GPREWLLAALHSRFSRL

SEQ ID NO: 13463 - protein, 39 aa, Mycobacterium avium
GPRGWIRPRRELTTGLWRRSGIRIVRRPRAHLVASVLVL

SEQ ID NO: 13464 - protein, 25 aa, Mycobacterium avium
GPRRLGRLMSILSIPMLLAPIGGPI

SEQ ID NO: 13465 - protein, 17 aa, Mycobacterium avium
GPTVTRYEVELGPGVKV

SEQ ID NO: 13466 - protein, 17 aa, Mycobacterium avium
GPVELFAGLLRSQRWWW

SEQ ID NO: 13467 - protein, 19 aa, Mycobacterium avium
GPVGLRRQLRTLAGFGSMF

SEQ ID NO: 13468 - protein, 20 aa, Mycobacterium avium
GQAGPLMEIMQILKANNIPL

SEQ ID NO: 13469 - protein, 19 aa, Mycobacterium avium
GQLTIAVAFVAMWTSFADL

SEQ ID NO: 13470 - protein, 19 aa, Mycobacterium avium
GQLWRSFELYALVFCGVAG

SEQ ID NO: 13471 - protein, 21 aa, Mycobacterium avium
GQPPPAWQAPQPGGWPGQQPG

SEQ ID NO: 13472 - protein, 23 aa, Mycobacterium avium
GQPVGFGMSVVRALAHFVDAIIC

SEQ ID NO: 13473 - protein, 18 aa, Mycobacterium avium
GQTATRWAQDTLRTSDLG

SEQ ID NO: 13474 - protein, 24 aa, Mycobacterium avium
GRDGLLRLAMRADAAISGLVGLAG

SEQ ID NO: 13475 - protein, 20 aa, Mycobacterium avium
GRFLWACFREPFWRFWLNAP

SEQ ID NO: 13476 - protein, 18 aa, Mycobacterium avium
GRHGRGILLTALGYGITV

SEQ ID NO: 13477 - protein, 17 aa, Mycobacterium avium
GRIFVGNTFPFAGYTGG

SEQ ID NO: 13478 - protein, 30 aa, Mycobacterium avium
GRISAFARWVVRTPWPLFWLSMMQADIIGA

SEQ ID NO: 13479 - protein, 36 aa, Mycobacterium avium
GRLKDLLINCGYPLIERFPLMLGTAGAVLAIGLVRW

SEQ ID NO: 13480 - protein, 18 aa, Mycobacterium avium
GRLLLCGVYTAVAVVALI

SEQ ID NO: 13481 - protein, 30 aa, Mycobacterium avium
GRLYRRIGASVVRWPVPILVASSAIVMVGA

SEQ ID NO: 13482 - protein, 18 aa, Mycobacterium avium
GRNIWRYVVQIVPAHARE

SEQ ID NO: 13483 - protein, 23 aa, Mycobacterium avium
GRPAVAAPGRIVLLTSGTTGKPK

SEQ ID NO: 13484 - protein, 19 aa, Mycobacterium avium
GRPHVSAWVRYHTEKRLRR

SEQ ID NO: 13485 - protein, 18 aa, Mycobacterium avium
GRRGLFGSFTQLGSPAGM

SEQ ID NO: 13486 - protein, 18 aa, Mycobacterium avium
GRRTKRLAGKAWAVAAMV

SEQ ID NO: 13487 - protein, 23 aa, Mycobacterium avium
GRRVVSLPWRLANVADLPAVDAP

SEQ ID NO: 13488 - protein, 30 aa, Mycobacterium avium
GRVEFAHVSFAYRPGIRVIDDLSLVAEPGS

SEQ ID NO: 13489 - protein, 27 aa, Mycobacterium avium
GRYFYVKWWKLVLVLLAVWAASAVVGL

SEQ ID NO: 13490 - protein, 18 aa, Mycobacterium avium
GSAVPIVAEHKVFFCVAA

SEQ ID NO: 13491 - protein, 23 aa, Mycobacterium avium
GSFRRWERAMFIFIAITLLQIPM

SEQ ID NO: 13492 - protein, 24 aa, Mycobacterium avium
GSGAHPGLRLDWPDDGTIGASGFR

SEQ ID NO: 13493 - protein, 25 aa, Mycobacterium avium
GSLGILRLVAVFGPVHYFAQPVVSL

SEQ ID NO: 13494 - protein, 20 aa, Mycobacterium avium
GSLSRLRGGCRVAKEQLSAN

SEQ ID NO: 13495 - protein, 17 aa, Mycobacterium avium
GSRARYLARTGPQPPPP

SEQ ID NO: 13496 - protein, 19 aa, Mycobacterium avium
GSSPLWSGRVFVEARPLSV

SEQ ID NO: 13497 - protein, 24 aa, Mycobacterium avium
GSTLPAVVRWARLPADVAHAEELQ

SEQ ID NO: 13498 - protein, 27 aa, Mycobacterium avium
GTACGLSVLMWQDLIGLGVQWIVLPLS

SEQ ID NO: 13499 - protein, 18 aa, Mycobacterium avium
GTEVRRLAPEQVPPHITR

SEQ ID NO: 13500 - protein, 19 aa, Mycobacterium avium
GTEWARFTRKVMPRDRIYD

SEQ ID NO: 13501 - protein, 19 aa, Mycobacterium avium
GTIGVISMVLFYIQAPTLL

SEQ ID NO: 13502 - protein, 22 aa, Mycobacterium avium
GTLPATVFVAFQLMFAIITVAL

SEQ ID NO: 13503 - protein, 18 aa, Mycobacterium avium
GTRSLLYFGGRGDAGLSQ

SEQ ID NO: 13504 - protein, 25 aa, Mycobacterium avium
GTSINLRCVCLAPLNAHHDTLAMVV

SEQ ID NO: 13505 - protein, 18 aa, Mycobacterium avium
GTVVVGWVISLIMVNPFL

SEQ ID NO: 13506 - protein, 26 aa, Mycobacterium avium
GVAAPFIWLAWLLRIPAVFVESVTRI

SEQ ID NO: 13507 - protein, 18 aa, Mycobacterium avium
GVLPLARRVVAPPVPAEE

SEQ ID NO: 13508 - protein, 20 aa, Mycobacterium avium
GVLRWSWRLMNYRFPMNSTD

SEQ ID NO: 13509 - protein, 19 aa, Mycobacterium avium
GVPQLQLYISPAMLVLMAV

SEQ ID NO: 13510 - protein, 23 aa, Mycobacterium avium
GVQEFPGPWALVPVGAAMLMILV

SEQ ID NO: 13511 - protein, 24 aa, Mycobacterium avium
GVTPHPRFPHLIPGGDYIMSGDGL

SEQ ID NO: 13512 - protein, 25 aa, Mycobacterium avium
GVTVALCLLGGVFGISLGKHVTQSG

SEQ ID NO: 13513 - protein, 18 aa, Mycobacterium avium
GVVTVLWVLYGYSVAFGD

SEQ ID NO: 13514 - protein, 20 aa, Mycobacterium avium
GWTRRIFYRLTHVLDPLIAL

SEQ ID NO: 13515 - protein, 19 aa, Mycobacterium avium
GWWRQRLVEHVDRLGIGSA

SEQ ID NO: 13516 - protein, 18 aa, Mycobacterium avium
GYLAIALPVGTLGLLASR

SEQ ID NO: 13517 - protein, 20 aa, Mycobacterium avium
GYPLPWALPVAMWALAAASL

SEQ ID NO: 13518 - protein, 24 aa, Mycobacterium avium
GYQKCGDPAWIDRAMNLNIWAGAA

SEQ ID NO: 13519 - protein, 23 aa, Mycobacterium avium
GYTMGFGSLGWVYASESFPSRLR

SEQ ID NO: 13520 - protein, 17 aa, Mycobacterium avium
GYVEVEFTVDRGVKVPA

SEQ ID NO: 13521 - protein, 17 aa, Mycobacterium avium
GYYYCARVGHCLVGVVP

SEQ ID NO: 13522 - protein, 29 aa, Mycobacterium avium
HAAPMAALLKWLGIPQFVVFDWLFWIFSI

SEQ ID NO: 13523 - protein, 17 aa, Mycobacterium avium
HAGAAPIFGEWLIHAGW

SEQ ID NO: 13524 - protein, 19 aa, Mycobacterium avium
HALNKVWRRHMLAVHDLDP

SEQ ID NO: 13525 - protein, 24 aa, Mycobacterium avium
HAPELRIAGLLPEVIAESQRRQRA

SEQ ID NO: 13526 - protein, 23 aa, Mycobacterium avium
HDLGFRLVERWQFNLVQVFEATR

SEQ ID NO: 13527 - protein, 17 aa, Mycobacterium avium
HDLHVWTLSPGKDMCTA

SEQ ID NO: 13528 - protein, 26 aa, Mycobacterium avium
HDMRIPRNRAVIMLVIDMSQSMRATD

SEQ ID NO: 13529 - protein, 19 aa, Mycobacterium avium
HDPWWLVLGKALAIFVFLM

SEQ ID NO: 13530 - protein, 25 aa, Mycobacterium avium
HEFLRKRLPHLTKRQRFWVSLYYPL

SEQ ID NO: 13531 - protein, 22 aa, Mycobacterium avium
HFLCSAIQAGSRLGYQDSAELC

SEQ ID NO: 13532 - protein, 17 aa, Mycobacterium avium
HFSEARMNPDLLMIESD

SEQ ID NO: 13533 - protein, 26 aa, Mycobacterium avium
HFVDAIICFIGFLFPLWDSKRQTLAD

SEQ ID NO: 13534 - protein, 23 aa, Mycobacterium avium
HFYTPWSWLPRIVTQFTAGALAC

SEQ ID NO: 13535 - protein, 27 aa, Mycobacterium avium
HGGALHRAGLLAALPLSLIAVAAAAVM

SEQ ID NO: 13536 - protein, 24 aa, Mycobacterium avium
HGNHEPGWVVAPGMQGTDVQPFTA

SEQ ID NO: 13537 - protein, 26 aa, Mycobacterium avium
HGTARWPWVVGVAAIVAAIALVVSVS

SEQ ID NO: 13538 - protein, 28 aa, Mycobacterium avium
HGWFRLVPPTEFWSRAPSGLAVGAAAAG

SEQ ID NO: 13539 - protein, 18 aa, Mycobacterium avium
HHRLPQLPPVITIPQVPT

SEQ ID NO: 13540 - protein, 23 aa, Mycobacterium avium
HLEIGQPLATEFVWGRQYGENTI

SEQ ID NO: 13541 - protein, 26 aa, Mycobacterium avium
HLPEIRYSMILFNWFGVCLVPILTLI

SEQ ID NO: 13542 - protein, 22 aa, Mycobacterium avium
HLTELRTRLLISLAAIALTTIF

SEQ ID NO: 13543 - protein, 18 aa, Mycobacterium avium
HMFGPEADLAVAIQRITR

SEQ ID NO: 13544 - protein, 19 aa, Mycobacterium avium
HMTPGQRRKQAWLRELAGW

SEQ ID NO: 13545 - protein, 18 aa, Mycobacterium avium
HPAPGRLEAIWRGSVVVL

SEQ ID NO: 13546 - protein, 26 aa, Mycobacterium avium
HPATLRRFCKRFAPYNFREHMMQPSY

SEQ ID NO: 13547 - protein, 25 aa, Mycobacterium avium
HPIAARGDIGWGFGDHGLLTNIGVT

SEQ ID NO: 13548 - protein, 18 aa, Mycobacterium avium
HPLISRAHLLLRYDQGKW

SEQ ID NO: 13549 - protein, 25 aa, Mycobacterium avium
HPLPPRRVAAPAIPPIPGLNEPIPG

SEQ ID NO: 13550 - protein, 23 aa, Mycobacterium avium
HPRPADLPRIWELINATRDDALA

SEQ ID NO: 13551 - protein, 17 aa, Mycobacterium avium
HQARWRGDHPLLICDAE

SEQ ID NO: 13552 - protein, 24 aa, Mycobacterium avium
HRAAARAGPRWSIAATAAAGWVCS

SEQ ID NO: 13553 - protein, 19 aa, Mycobacterium avium
HRSMVIKVSIFAAAMLLVS

SEQ ID NO: 13554 - protein, 25 aa, Mycobacterium avium
HRSPRYLRFGWAAAKLDDIANYPAA

SEQ ID NO: 13555 - protein, 24 aa, Mycobacterium avium
HSAAPLFHNIAGWLMQRENVPLSP

SEQ ID NO: 13556 - protein, 26 aa, Mycobacterium avium
HSLHWKITEAPLFYGGYAVLLAVSAA

SEQ ID NO: 13557 - protein, 19 aa, Mycobacterium avium
HTMMFQEMVNRVGADVPGM

SEQ ID NO: 13558 - protein, 19 aa, Mycobacterium avium
HTRRTEIGIMRLVGASRWY

SEQ ID NO: 13559 - protein, 18 aa, Mycobacterium avium
HVALAEKLFNRWGARAVF

SEQ ID NO: 13560 - protein, 20 aa, Mycobacterium avium
HVPDRLAVVRVDPGESLSDV

SEQ ID NO: 13561 - protein, 25 aa, Mycobacterium avium
HVTWSIRVMIAILWFSAGMAIVSSL

SEQ ID NO: 13562 - protein, 19 aa, Mycobacterium avium
HWERARSAALIGFAGSFGA

SEQ ID NO: 13563 - protein, 26 aa, Mycobacterium avium
HWFSERRLGIPFGFGVIFAITGMTAV

SEQ ID NO: 13564 - protein, 21 aa, Mycobacterium avium
HYLLLAVPAFLPAVIVVAVVL

SEQ ID NO: 13565 - protein, 28 aa, Mycobacterium avium
HYTVADFWRFWVVHLWVEDFLELFTTVM

SEQ ID NO: 13566 - protein, 22 aa, Mycobacterium avium
IAADDFWYLWHQMVSQPGVVDP

SEQ ID NO: 13567 - protein, 19 aa, Mycobacterium avium
IAAFKIIMLALWWGAATSK

SEQ ID NO: 13568 - protein, 19 aa, Mycobacterium avium
IAAGVLYFFFVLPRWPELM

SEQ ID NO: 13569 - protein, 37 aa, Mycobacterium avium
IAALLAIGVVLGWPLWWVSACSVLVLLIVEGVLINFW

SEQ ID NO: 13570 - protein, 27 aa, Mycobacterium avium
IAAVVALEIALAISIRPTVALRPSPNE

SEQ ID NO: 13571 - protein, 18 aa, Mycobacterium avium
IAEAVEGMLARIGKEQQR

SEQ ID NO: 13572 - protein, 40 aa, Mycobacterium avium
IAGACLCLTAARLPYFQTMGLPCAIAMVVIVLAALTLAPA

SEQ ID NO: 13573 - protein, 19 aa, Mycobacterium avium
IAGCVAAVLAVRQDGIFTT

SEQ ID NO: 13574 - protein, 28 aa, Mycobacterium avium
IAGPLGLCFLPAFVCLGIVPVVAGLAGD

SEQ ID NO: 13575 - protein, 21 aa, Mycobacterium avium
IALFICCGVGKGSVFKLIPSV

SEQ ID NO: 13576 - protein, 18 aa, Mycobacterium avium
IALICGDILYAPTATGML

SEQ ID NO: 13577 - protein, 20 aa, Mycobacterium avium
IALRGFTFGIDFNGGTTVSM

SEQ ID NO: 13578 - protein, 17 aa, Mycobacterium avium
IALVVAVGFGLATDYEV

SEQ ID NO: 13579 - protein, 28 aa, Mycobacterium avium
IANDIAKYFAIIPAMFVALFPGLDLINV

SEQ ID NO: 13580 - protein, 17 aa, Mycobacterium avium
IAPGDRAAALALAESYS

SEQ ID NO: 13581 - protein, 18 aa, Mycobacterium avium
IAPHAKIVASIREAENQH

SEQ ID NO: 13582 - protein, 22 aa, Mycobacterium avium
IAQLAASCRRITEGNFAETIVA

SEQ ID NO: 13583 - protein, 27 aa, Mycobacterium avium
IAQLTSRGGSFVFRHRAGNVVMLVAMV

SEQ ID NO: 13584 - protein, 25 aa, Mycobacterium avium
IARFNGRTGYHLGLRAGINTGNVVS

SEQ ID NO: 13585 - protein, 28 aa, Mycobacterium avium
IARGRVGSAGMLRRVFVIASAITAVLSL

SEQ ID NO: 13586 - protein, 24 aa, Mycobacterium avium
IARHGRYTGVSGWFAISSTGSPSP

SEQ ID NO: 13587 - protein, 17 aa, Mycobacterium avium
IAVALVLIGHGGIPGVS

SEQ ID NO: 13588 - protein, 19 aa, Mycobacterium avium
IAVAYRLYATAPIPRVAPL

SEQ ID NO: 13589 - protein, 24 aa, Mycobacterium avium
IAVHPRLRVHWVARRDEKSLAAAL

SEQ ID NO: 13590 - protein, 18 aa, Mycobacterium avium
IAVILSFVASQFTTTFLL

SEQ ID NO: 13591 - protein, 20 aa, Mycobacterium avium
IAVIVLVDWISERTRLPSAT

SEQ ID NO: 13592 - protein, 20 aa, Mycobacterium avium
ICGLSFLPPVVFAVVAVVVT

SEQ ID NO: 13593 - protein, 17 aa, Mycobacterium avium
IDGQMFLEMRLVEGTDL

SEQ ID NO: 13594 - protein, 17 aa, Mycobacterium avium
IDGVPFIDMQLVDDGGS

SEQ ID NO: 13595 - protein, 31 aa, Mycobacterium avium
IDPEDFWRSAGLPAYRFPDPNGTRFPNGAPP

SEQ ID NO: 13596 - protein, 18 aa, Mycobacterium avium
IDVVKRSLNVLSETFDQT

SEQ ID NO: 13597 - protein, 19 aa, Mycobacterium avium
IEALGRVDTVCFDKTGTLT

SEQ ID NO: 13598 - protein, 21 aa, Mycobacterium avium
IELAIGMAIGMAAQTARRAHD

SEQ ID NO: 13599 - protein, 17 aa, Mycobacterium avium
IFEHLEYAMPMRTFGWP

SEQ ID NO: 13600 - protein, 23 aa, Mycobacterium avium
IFSTSRLRPWGTTHIQRFALAAV

SEQ ID NO: 13601 - protein, 20 aa, Mycobacterium avium
IFVGNTFPFAGYTGGGNKQI

SEQ ID NO: 13602 - protein, 18 aa, Mycobacterium avium
IGALLPLIAILLPPPTWR

SEQ ID NO: 13603 - protein, 17 aa, Mycobacterium avium
IGDWQRRHCATGGTVEV

SEQ ID NO: 13604 - protein, 17 aa, Mycobacterium avium
IGGLGSWFTQGYQTGKS

SEQ ID NO: 13605 - protein, 24 aa, Mycobacterium avium
IGGRELGVLPLLPVLLMVWATARN

SEQ ID NO: 13606 - protein, 17 aa, Mycobacterium avium
IGIMRLVGASRWYTQLP

SEQ ID NO: 13607 - protein, 17 aa, Mycobacterium avium
IGLALILFSGRRWVTTL

SEQ ID NO: 13608 - protein, 19 aa, Mycobacterium avium
IGLHLAMVWFQKHTQFPGP

SEQ ID NO: 13609 - protein, 25 aa, Mycobacterium avium
IGLTCPRWRSLAFVPLGVAAFVVGG

SEQ ID NO: 13610 - protein, 20 aa, Mycobacterium avium
IGSASFWTFGIIAMVTLLAK

SEQ ID NO: 13611 - protein, 22 aa, Mycobacterium avium
IGSPGSRVIAAAAFALSPRVLT

SEQ ID NO: 13612 - protein, 24 aa, Mycobacterium avium
IGSYLWWRSRRTYLLTVAGDSLTI

SEQ ID NO: 13613 - protein, 20 aa, Mycobacterium avium
IGTRIELRLGDPADSEIDRR

SEQ ID NO: 13614 - protein, 18 aa, Mycobacterium avium
IGVGQSFTSVPMLFAKPS

SEQ ID NO: 13615 - protein, 19 aa, Mycobacterium avium
IGVLPRWQTAAILGVLAVI

SEQ ID NO: 13616 - protein, 17 aa, Mycobacterium avium
IIAEFVCLIAPMFLAMY

SEQ ID NO: 13617 - protein, 17 aa, Mycobacterium avium
IIALGVLVFLAAAVFGI

SEQ ID NO: 13618 - protein, 18 aa, Mycobacterium avium
IIAVARWFGLSGKLGSLL

SEQ ID NO: 13619 - protein, 17 aa, Mycobacterium avium
IIPASFLPRKPPSPPAG

SEQ ID NO: 13620 - protein, 21 aa, Mycobacterium avium
IKSYFYWEKHCFDIPLCWAFR

SEQ ID NO: 13621 - protein, 17 aa, Mycobacterium avium
IKVSIFAAAMLLVSAGL

SEQ ID NO: 13622 - protein, 19 aa, Mycobacterium avium
ILALILKYTMGLRLNPEAE

SEQ ID NO: 13623 - protein, 18 aa, Mycobacterium avium
ILALWAAVAGAFVSVLYR

SEQ ID NO: 13624 - protein, 18 aa, Mycobacterium avium
ILFWTLPVALVLWIASFF

SEQ ID NO: 13625 - protein, 21 aa, Mycobacterium avium
INLLIVFGVSFEFPLLIVMLN

SEQ ID NO: 13626 - protein, 22 aa, Mycobacterium avium
INLRESPGLMILGRQGCGKTLS

SEQ ID NO: 13627 - protein, 22 aa, Mycobacterium avium
INNARDFLRIDIIIFGLTIYAL

SEQ ID NO: 13628 - protein, 20 aa, Mycobacterium avium
INPRGGYVEVEFTVDRGVKV

SEQ ID NO: 13629 - protein, 23 aa, Mycobacterium avium
IPAPLLATMFDFFYQPGKMPASL

SEQ ID NO: 13630 - protein, 31 aa, Mycobacterium avium
IPDPRISRAHLILRFEQGRWLAIDNGSLNGT

SEQ ID NO: 13631 - protein, 17 aa, Mycobacterium avium
IPEDLQLSTVIFQTTIS

SEQ ID NO: 13632 - protein, 17 aa, Mycobacterium avium
IPIAVGMILLVIPLGNL

SEQ ID NO: 13633 - protein, 17 aa, Mycobacterium avium
IPIEVNFTQRVAVDVTL

SEQ ID NO: 13634 - protein, 17 aa, Mycobacterium avium
IPIVAFMTVGGPAMGSA

SEQ ID NO: 13635 - protein, 27 aa, Mycobacterium avium
IPLPGSAPKSLWLSAFAHPERDKRVAT

SEQ ID NO: 13636 - protein, 21 aa, Mycobacterium avium
IPLQSAYCGAKHAVNGFTESV

SEQ ID NO: 13637 - protein, 24 aa, Mycobacterium avium
IPLYAVAVLMSFIAAKLLTIYVYG

SEQ ID NO: 13638 - protein, 17 aa, Mycobacterium avium
IPPRLGGKLRTSRQINW

SEQ ID NO: 13639 - protein, 23 aa, Mycobacterium avium
IPVDDWSVALALALRTFPMLIDE

SEQ ID NO: 13640 - protein, 23 aa, Mycobacterium avium
IQQWRRLSLRTASIAGWGGLALI

SEQ ID NO: 13641 - protein, 23 aa, Mycobacterium avium
IRADFAPALLVLMVLVVATLASV

SEQ ID NO: 13642 - protein, 18 aa, Mycobacterium avium
IREVALLRVVHRSKCGYL

SEQ ID NO: 13643 - protein, 24 aa, Mycobacterium avium
IRPQRLDGLWGILFAPVLHESWQH

SEQ ID NO: 13644 - protein, 17 aa, Mycobacterium avium
IRPVDLVGGGSPQNGPV

SEQ ID NO: 13645 - protein, 20 aa, Mycobacterium avium
IRTYFYWEKHCYDIPVCIGL

SEQ ID NO: 13646 - protein, 37 aa, Mycobacterium avium
ISAVCLFGVLLAFRFLTPWGRQFWRITRGYFVGAHSV

SEQ ID NO: 13647 - protein, 18 aa, Mycobacterium avium
ISIPCPAVATLPADGGLV

SEQ ID NO: 13648 - protein, 25 aa, Mycobacterium avium
ISMVLYIGCWWRHLNPPPAAAPAQP

SEQ ID NO: 13649 - protein, 21 aa, Mycobacterium avium
ISPTPRPATVITVAPAGTTLS

SEQ ID NO: 13650 - protein, 24 aa, Mycobacterium avium
ISTRAPQALFVWIALAGMAIAILL

SEQ ID NO: 13651 - protein, 18 aa, Mycobacterium avium
ISTVYLGFVRWKIRLKGG

SEQ ID NO: 13652 - protein, 27 aa, Mycobacterium avium
ISVVAAWRSRSWRPVLLAVVAGAGVPV

SEQ ID NO: 13653 - protein, 17 aa, Mycobacterium avium
ITEFPVVVAALFALVIA

SEQ ID NO: 13654 - protein, 23 aa, Mycobacterium avium
ITFLPACLGILGRHVDALGVRTA

SEQ ID NO: 13655 - protein, 31 aa, Mycobacterium avium
ITRSFRLVRRGFWRVLGIRALAFLVTAVVAN

SEQ ID NO: 13656 - protein, 17 aa, Mycobacterium avium
IVGLGFGLLAVRAARPI

SEQ ID NO: 13657 - protein, 18 aa, Mycobacterium avium
IVVTRYLTVPAEDAGPRV

SEQ ID NO: 13658 - protein, 21 aa, Mycobacterium avium
IWDRPERRSGIPALDGLRAIA

SEQ ID NO: 13659 - protein, 23 aa, Mycobacterium avium
IWQYIFGIQLYWMVLPMSVIVLL

SEQ ID NO: 13660 - protein, 24 aa, Mycobacterium avium
IYALACVLFECLTGSAPYRADSAG

SEQ ID NO: 13661 - protein, 26 aa, Mycobacterium avium
IYNYTWLVLMLPFGMIGVTVLTVVMP

SEQ ID NO: 13662 - protein, 18 aa, Mycobacterium avium
KADVKPVWQSLRHADTWI

SEQ ID NO: 13663 - protein, 18 aa, Mycobacterium avium
KANGYRLVTVSELLGPRA

SEQ ID NO: 13664 - protein, 19 aa, Mycobacterium avium
KAVEPITVCLAGDTRDSYS

SEQ ID NO: 13665 - protein, 21 aa, Mycobacterium avium
KAVNLPAFFASFMFLFVATGI

SEQ ID NO: 13666 - protein, 17 aa, Mycobacterium avium
KDLDLSAFVVFSSMAGI

SEQ ID NO: 13667 - protein, 21 aa, Mycobacterium avium
KDLLSGFFILAERQYGFGDLV

SEQ ID NO: 13668 - protein, 18 aa, Mycobacterium avium
KDPRRISAAITLLLEPMA

SEQ ID NO: 13669 - protein, 18 aa, Mycobacterium avium
KEREFHLALVGALTVAAL

SEQ ID NO: 13670 - protein, 23 aa, Mycobacterium avium
KFGAAQLDWGALVIVGGVATLIA

SEQ ID NO: 13671 - protein, 19 aa, Mycobacterium avium
KFRGARGAIQATLDRDLPI

SEQ ID NO: 13672 - protein, 17 aa, Mycobacterium avium
KGIGFLINNARDFLRID

SEQ ID NO: 13673 - protein, 24 aa, Mycobacterium avium
KGPSRWGAHMQLHVSAGMGTSPYA

SEQ ID NO: 13674 - protein, 17 aa, Mycobacterium avium
KHGFRPVTEFGAPFREP

SEQ ID NO: 13675 - protein, 19 aa, Mycobacterium avium
KIIMLALWWGAATSKLNHH

SEQ ID NO: 13676 - protein, 22 aa, Mycobacterium avium
KKPKKRRLRRKKAGEEVETAET

SEQ ID NO: 13677 - protein, 18 aa, Mycobacterium avium
KLIEWPDVVGVSFPVGHR

SEQ ID NO: 13678 - protein, 24 aa, Mycobacterium avium
KLSGDLNLFGLVLPRAMFWTVLVY

SEQ ID NO: 13679 - protein, 19 aa, Mycobacterium avium
KLVVFWSVLAMFTVMIIVV

SEQ ID NO: 13680 - protein, 22 aa, Mycobacterium avium
KNEMRTLGIAMVQDITRPLGIP

SEQ ID NO: 13681 - protein, 28 aa, Mycobacterium avium
KPGNAVLEWLRLPGDVILIAGGVLPFVW

SEQ ID NO: 13682 - protein, 31 aa, Mycobacterium avium
KPPPRRQPHRTLVAWISFAAAVLAVGALAGG

SEQ ID NO: 13683 - protein, 18 aa, Mycobacterium avium
KQLAPQRRTAIAVITLGI

SEQ ID NO: 13684 - protein, 28 aa, Mycobacterium avium
KRFGPLPPPRAVAIITQIASALDAAHAA

SEQ ID NO: 13685 - protein, 19 aa, Mycobacterium avium
KRITARWIPYGRADLVIGI

SEQ ID NO: 13686 - protein, 23 aa, Mycobacterium avium
KRKKELSDVLVLVSRYTASLTEA

SEQ ID NO: 13687 - protein, 21 aa, Mycobacterium avium
KRLAVPVKWLLAIPHVLVCWS

SEQ ID NO: 13688 - protein, 17 aa, Mycobacterium avium
KRQRFWVSLYYPLTMRL

SEQ ID NO: 13689 - protein, 26 aa, Mycobacterium avium
KRRFLRDPVSVLLIFIIVFALIIAGF

SEQ ID NO: 13690 - protein, 19 aa, Mycobacterium avium
KRWGHQWMVVTCWMGVVIW

SEQ ID NO: 13691 - protein, 21 aa, Mycobacterium avium
KSELLRTIALGMMARNSPDVL

SEQ ID NO: 13692 - protein, 18 aa, Mycobacterium avium
KSLLRQAAPTADQVNDVF

SEQ ID NO: 13693 - protein, 27 aa, Mycobacterium avium
KTALRSACCACDGAVVVHPSWWPPARV

SEQ ID NO: 13694 - protein, 19 aa, Mycobacterium avium
KTGDVMPATYIGIWQTLSD

SEQ ID NO: 13695 - protein, 24 aa, Mycobacterium avium
KTYPANYFRSFAIRKQGVAVIDVP

SEQ ID NO: 13696 - protein, 24 aa, Mycobacterium avium
KVEGLKIDGDHIVVKFSIGTNTIG

SEQ ID NO: 13697 - protein, 22 aa, Mycobacterium avium
KVENVMLVSAFLAAAALAQAVG

SEQ ID NO: 13698 - protein, 23 aa, Mycobacterium avium
KVHRHWGFGGGPHRCLGSHLARI

SEQ ID NO: 13699 - protein, 23 aa, Mycobacterium avium
LAAACYFWPVLAVGIGAILLLLL

SEQ ID NO: 13700 - protein, 17 aa, Mycobacterium avium
LAAAITLGVLSLGSALA

SEQ ID NO: 13701 - protein, 30 aa, Mycobacterium avium
LAAAVFLVGWRGVRWWRRGLAVLSIPLCVL

SEQ ID NO: 13702 - protein, 17 aa, Mycobacterium avium
LAADALPQFGPRQLGPG

SEQ ID NO: 13703 - protein, 25 aa, Mycobacterium avium
LAAGRLRFTTDYDMAAGFADVHFLG

SEQ ID NO: 13704 - protein, 25 aa, Mycobacterium avium
LAAGVLGPWVLRVAFGPQYQAGSAL

SEQ ID NO: 13705 - protein, 18 aa, Mycobacterium avium
LAAIAVIVLVDWISERTR

SEQ ID NO: 13706 - protein, 22 aa, Mycobacterium avium
LAALRVNWALGVQVFDYTGETS

SEQ ID NO: 13707 - protein, 18 aa, Mycobacterium avium
LAARWDRRHRLRVVLLLG

SEQ ID NO: 13708 - protein, 17 aa, Mycobacterium avium
LAARYGCPALQSTQVPA

SEQ ID NO: 13709 - protein, 17 aa, Mycobacterium avium
LAATLWHPHIVGVHDRG

SEQ ID NO: 13710 - protein, 21 aa, Mycobacterium avium
LAAYAVWKFRGARGAIQATLD

SEQ ID NO: 13711 - protein, 18 aa, Mycobacterium avium
LAFGLMAALLLDATVVRM

SEQ ID NO: 13712 - protein, 17 aa, Mycobacterium avium
LAFRGVLHGALNRAWGF

SEQ ID NO: 13713 - protein, 25 aa, Mycobacterium avium
LAGGARLLLPIALGALLGGSAAAGT

SEQ ID NO: 13714 - protein, 17 aa, Mycobacterium avium
LAGIGVALVIWGSAVVA

SEQ ID NO: 13715 - protein, 23 aa, Mycobacterium avium
LAGLARFVWATVIIWIVGGFGTW

SEQ ID NO: 13716 - protein, 17 aa, Mycobacterium avium
LALASWLLGGYIAAAVA

SEQ ID NO: 13717 - protein, 18 aa, Mycobacterium avium
LALCALAAALALLAGLLL

SEQ ID NO: 13718 - protein, 20 aa, Mycobacterium avium
LALGWWQWTRFQSVSGSFQN

SEQ ID NO: 13719 - protein, 35 aa, Mycobacterium avium
LALLMLVAAIHWRARGWLKRVLPAALVAAVAVTVL

SEQ ID NO: 13720 - protein, 17 aa, Mycobacterium avium
LALVRPSLKHVMHDAYI

SEQ ID NO: 13721 - protein, 18 aa, Mycobacterium avium
LAPLALRLTLSIPALRRN

SEQ ID NO: 13722 - protein, 17 aa, Mycobacterium avium
LAPQLFQPFLDYLWGFR

SEQ ID NO: 13723 - protein, 25 aa, Mycobacterium avium
LAPSGFSVFGVFWGAFGLVTGAANG

SEQ ID NO: 13724 - protein, 18 aa, Mycobacterium avium
LARYGPRAPQLWLPPLDE

SEQ ID NO: 13725 - protein, 24 aa, Mycobacterium avium
LATGCLRVRASLTISPDDLVSGEI

SEQ ID NO: 13726 - protein, 20 aa, Mycobacterium avium
LAVAVPAGWVQLHVVDADGY

SEQ ID NO: 13727 - protein, 19 aa, Mycobacterium avium
LAVGAEWGGAAVLSVEHAP

SEQ ID NO: 13728 - protein, 18 aa, Mycobacterium avium
LAVLSCYDIRQHRLPNAL

SEQ ID NO: 13729 - protein, 19 aa, Mycobacterium avium
LAVTFALVSTIGWGWTLLV

SEQ ID NO: 13730 - protein, 17 aa, Mycobacterium avium
LAWMTVDALVWVPRMYY

SEQ ID NO: 13731 - protein, 26 aa, Mycobacterium avium
LCAVAPNILLLILFRVVQGVGGGMLL

SEQ ID NO: 13732 - protein, 26 aa, Mycobacterium avium
LDATVVRMFLVPSVMKLLGDDCWWAP

SEQ ID NO: 13733 - protein, 20 aa, Mycobacterium avium
LDDAIAPALGGFVTVLRETL

SEQ ID NO: 13734 - protein, 18 aa, Mycobacterium avium
LDDPRWIGMLAAVLTVSG

SEQ ID NO: 13735 - protein, 19 aa, Mycobacterium avium
LDGLLAAAHAGAWEGPSAE

SEQ ID NO: 13736 - protein, 20 aa, Mycobacterium avium
LDGYCLYPESPLRLVNGTVN

SEQ ID NO: 13737 - protein, 18 aa, Mycobacterium avium
LDHLAARLRRNSANLLVL

SEQ ID NO: 13738 - protein, 23 aa, Mycobacterium avium
LDPRTLWRNPVMFIVEIGAAWST

SEQ ID NO: 13739 - protein, 17 aa, Mycobacterium avium
LDQLDGHRMRRLIPANW

SEQ ID NO: 13740 - protein, 17 aa, Mycobacterium avium
LDRLRHLVLPSLTLALA

SEQ ID NO: 13741 - protein, 26 aa, Mycobacterium avium
LDTASIVGWLWPLWDSRRRTFADMLA

SEQ ID NO: 13742 - protein, 25 aa, Mycobacterium avium
LDVGRRGTQHLGLLVLRAGLGVVLG

SEQ ID NO: 13743 - protein, 17 aa, Mycobacterium avium
LEAQIRAGADIKSLSDG

SEQ ID NO: 13744 - protein, 18 aa, Mycobacterium avium
LEELCPRSLYLRDGALQT

SEQ ID NO: 13745 - protein, 33 aa, Mycobacterium avium
LEKLPGAFRVIGRAGGIYGDFYNFYLCDISIKV

SEQ ID NO: 13746 - protein, 32 aa, Mycobacterium avium
LEQMRKRFGSTLGYRLVIYPTYAALDRPDPSD

SEQ ID NO: 13747 - protein, 19 aa, Mycobacterium avium
LEQPIRRWRPARVPLLPLA

SEQ ID NO: 13748 - protein, 18 aa, Mycobacterium avium
LEVGLILTVFTMRIAAAI

SEQ ID NO: 13749 - protein, 19 aa, Mycobacterium avium
LEYAMPMRTFGWPRDLPRA

SEQ ID NO: 13750 - protein, 18 aa, Mycobacterium avium
LFAAMVFSALDHRFGWSS

SEQ ID NO: 13751 - protein, 24 aa, Mycobacterium avium
LFAVDWRVALVLFVPVLVYLVLTS

SEQ ID NO: 13752 - protein, 19 aa, Mycobacterium avium
LFGALLIGGAVFGTAMLMK

SEQ ID NO: 13753 - protein, 17 aa, Mycobacterium avium
LFIGSVLAFMLGSLLCA

SEQ ID NO: 13754 - protein, 17 aa, Mycobacterium avium
LFLPMGASKPIRLQGAF

SEQ ID NO: 13755 - protein, 23 aa, Mycobacterium avium
LFQPFLDYLWGFRTFDTARGPGH

SEQ ID NO: 13756 - protein, 26 aa, Mycobacterium avium
LFRKGADFTAAMAFEIGSTNLVVELG

SEQ ID NO: 13757 - protein, 33 aa, Mycobacterium avium
LFSGTPHRALVWLGWLTAATAIGWAIDTATARI

SEQ ID NO: 13758 - protein, 26 aa, Mycobacterium avium
LFVIVDWRMHAAILPPSVFSPGPLKW

SEQ ID NO: 13759 - protein, 25 aa, Mycobacterium avium
LGAEGRLGWPLWTAYIGVFALTVLV

SEQ ID NO: 13760 - protein, 26 aa, Mycobacterium avium
LGALLGGLVWPFLLLPQLGMIRGAAA

SEQ ID NO: 13761 - protein, 26 aa, Mycobacterium avium
LGALLRRLQPDWSMTFVERLDAVAAE

SEQ ID NO: 13762 - protein, 19 aa, Mycobacterium avium
LGAVGIWKAGMFHVLIAVA

SEQ ID NO: 13763 - protein, 19 aa, Mycobacterium avium
LGAWPHWTFTALGAGVIGA

SEQ ID NO: 13764 - protein, 17 aa, Mycobacterium avium
LGCGAGILAGRMAIGRL

SEQ ID NO: 13765 - protein, 20 aa, Mycobacterium avium
LGCLHWREVRELARGARSRD

SEQ ID NO: 13766 - protein, 21 aa, Mycobacterium avium
LGERRIYIGGLLIVAVSTAAC

SEQ ID NO: 13767 - protein, 21 aa, Mycobacterium avium
LGEVLPLLVPVILAAVLFNGS

SEQ ID NO: 13768 - protein, 18 aa, Mycobacterium avium
LGFTHILAYDHVVGADPR

SEQ ID NO: 13769 - protein, 18 aa, Mycobacterium avium
LGGMLLSGMLTVIVGRAV

SEQ ID NO: 13770 - protein, 20 aa, Mycobacterium avium
LGGQHPVGFSPNGVPEHTVA

SEQ ID NO: 13771 - protein, 22 aa, Mycobacterium avium
LGGSRRAIFTGALRVGRDHIAS

SEQ ID NO: 13772 - protein, 24 aa, Mycobacterium avium
LGLLWWMMVCWAQPVRNRPDRREF

SEQ ID NO: 13773 - protein, 22 aa, Mycobacterium avium
LGLMRAIICQLTFSHGPDHVRM

SEQ ID NO: 13774 - protein, 18 aa, Mycobacterium avium
LGNLNARKVVVLVNPTTN

SEQ ID NO: 13775 - protein, 18 aa, Mycobacterium avium
LGQPTAWLVAPIGAPGRA

SEQ ID NO: 13776 - protein, 25 aa, Mycobacterium avium
LGQTARLYIRPVLNSMPAQSGEPKP

SEQ ID NO: 13777 - protein, 21 aa, Mycobacterium avium
LGRDDVCYVSMPLFHSNAVLV

SEQ ID NO: 13778 - protein, 25 aa, Mycobacterium avium
LGRRDLSVAFGWSMFNWIADVACLG

SEQ ID NO: 13779 - protein, 23 aa, Mycobacterium avium
LGSLLQWMFYVGLLITVADVLIA

SEQ ID NO: 13780 - protein, 28 aa, Mycobacterium avium
LGSRYFRFLPRRLVERIVPKPGTGPSPS

SEQ ID NO: 13781 - protein, 19 aa, Mycobacterium avium
LGTTVEWYDFFLYATAAGL

SEQ ID NO: 13782 - protein, 17 aa, Mycobacterium avium
LGVGTLGLWLESLWISA

SEQ ID NO: 13783 - protein, 25 aa, Mycobacterium avium
LGWRNVRRRNLGWRMWYGGPWFSTR

SEQ ID NO: 13784 - protein, 17 aa, Mycobacterium avium
LHYLRRIIESGAFRLEP

SEQ ID NO: 13785 - protein, 17 aa, Mycobacterium avium
LIAEMTMGAGALVMIGG

SEQ ID NO: 13786 - protein, 23 aa, Mycobacterium avium
LIAVAVAVLVDFAAKRTREARRA

SEQ ID NO: 13787 - protein, 22 aa, Mycobacterium avium
LIEEFQVLYAARRLRPNQTPRS

SEQ ID NO: 13788 - protein, 19 aa, Mycobacterium avium
LIFGWLAFLLVFGIFVRRV

SEQ ID NO: 13789 - protein, 20 aa, Mycobacterium avium
LIGHLSEWVGLSGALVTIPV

SEQ ID NO: 13790 - protein, 19 aa, Mycobacterium avium
LIIWVTFAPMLRRAARLPA

SEQ ID NO: 13791 - protein, 26 aa, Mycobacterium avium
LILYNPAGLLSFFLSNPVYTLALTTP

SEQ ID NO: 13792 - protein, 17 aa, Mycobacterium avium
LISTLFLLRSMNRQLRK

SEQ ID NO: 13793 - protein, 17 aa, Mycobacterium avium
LIVGLALAVALVAVMTV

SEQ ID NO: 13794 - protein, 17 aa, Mycobacterium avium
LIYGTAAALVFPAVFFP

SEQ ID NO: 13795 - protein, 21 aa, Mycobacterium avium
LKAVIYGAIVAVIACQKGLFT

SEQ ID NO: 13796 - protein, 21 aa, Mycobacterium avium
LKEGFETSVFLLAAAETSHGS

SEQ ID NO: 13797 - protein, 25 aa, Mycobacterium avium
LKKLRANGIRRIVMLTGDHPDIAAV

SEQ ID NO: 13798 - protein, 22 aa, Mycobacterium avium
LKRERDAVELDLRANVASMSAT

SEQ ID NO: 13799 - protein, 26 aa, Mycobacterium avium
LKREVVELRRCVNPLSSAFHRIQTEN

SEQ ID NO: 13800 - protein, 19 aa, Mycobacterium avium
LLAFRHFGQGYAILLLAIW

SEQ ID NO: 13801 - protein, 17 aa, Mycobacterium avium
LLALWLLTRATGQPLTV

SEQ ID NO: 13802 - protein, 20 aa, Mycobacterium avium
LLDFLRATALTVVLLGLGAL

SEQ ID NO: 13803 - protein, 23 aa, Mycobacterium avium
LLFAHHGWLPLVVAITVINGIAE

SEQ ID NO: 13804 - protein, 17 aa, Mycobacterium avium
LLFGGRRTDRWGHWLGC

SEQ ID NO: 13805 - protein, 22 aa, Mycobacterium avium
LLFPVVQPWYLLWAIIPLAAWA

SEQ ID NO: 13806 - protein, 17 aa, Mycobacterium avium
LLGARVWADRPVAALLL

SEQ ID NO: 13807 - protein, 19 aa, Mycobacterium avium
LLGAVVFAAVKLATSSPAH

SEQ ID NO: 13808 - protein, 28 aa, Mycobacterium avium
LLGDDCWWAPRWARRLQNKIGLGEIDLP

SEQ ID NO: 13809 - protein, 21 aa, Mycobacterium avium
LLICAAIALWLSRSAPLGPSE

SEQ ID NO: 13810 - protein, 24 aa, Mycobacterium avium
LLLACLLATLGLWRWSQGTVSVAT

SEQ ID NO: 13811 - protein, 26 aa, Mycobacterium avium
LLLDGRKLLWWTLSRFTTLRNLPFRY

SEQ ID NO: 13812 - protein, 19 aa, Mycobacterium avium
LLLDLGVWIGWSTRLIFDT

SEQ ID NO: 13813 - protein, 18 aa, Mycobacterium avium
LLNENLAAGRLRFTTDYD

SEQ ID NO: 13814 - protein, 18 aa, Mycobacterium avium
LLNRQWRALVPAFAIPIL

SEQ ID NO: 13815 - protein, 28 aa, Mycobacterium avium
LLQGHWSLLVGYGCLPWVATAMLGLRTG

SEQ ID NO: 13816 - protein, 18 aa, Mycobacterium avium
LLSNITWGNGSIVVGGGT

SEQ ID NO: 13817 - protein, 25 aa, Mycobacterium avium
LLSSFKVPSVWLVLRSDDDLPRGVT

SEQ ID NO: 13818 - protein, 24 aa, Mycobacterium avium
LLSSLIVGAGWPLIVEQISVKPNA

SEQ ID NO: 13819 - protein, 33 aa, Mycobacterium avium
LLTVLRLLQGFAVGAEWAGSVLLSAEYAPTDRR

SEQ ID NO: 13820 - protein, 18 aa, Mycobacterium avium
LLVAFLCVALLVYFALLG

SEQ ID NO: 13821 - protein, 18 aa, Mycobacterium avium
LLVGAALVLIFLIVTAML

SEQ ID NO: 13822 - protein, 18 aa, Mycobacterium avium
LLVIGSLIGTVAGIAAGA

SEQ ID NO: 13823 - protein, 20 aa, Mycobacterium avium
LLVRRKRAFFVPIIGCLAQV

SEQ ID NO: 13824 - protein, 19 aa, Mycobacterium avium
LLWNGRRSQINLADHAVTN

SEQ ID NO: 13825 - protein, 17 aa, Mycobacterium avium
LMELCFDSTGPAMLPAL

SEQ ID NO: 13826 - protein, 25 aa, Mycobacterium avium
LMISRPRPGPSLLAYWIGGLTVCVP

SEQ ID NO: 13827 - protein, 30 aa, Mycobacterium avium
LMLLPLVYGALYLWAFWDPFGHTNKMPVAL

SEQ ID NO: 13828 - protein, 19 aa, Mycobacterium avium
LMVCGSSALLAPPAAADRN

SEQ ID NO: 13829 - protein, 21 aa, Mycobacterium avium
LNAAFRYALVRLRDAAEAVGF

SEQ ID NO: 13830 - protein, 17 aa, Mycobacterium avium
LNAGEVIQRVVERDSPT

SEQ ID NO: 13831 - protein, 23 aa, Mycobacterium avium
LNAHGPKAFVLVGAVAVVIVATI

SEQ ID NO: 13832 - protein, 21 aa, Mycobacterium avium
LNDNRVDAIVGWHQAGGNLAT

SEQ ID NO: 13833 - protein, 17 aa, Mycobacterium avium
LNGYRMPVVDIHDGQSI

SEQ ID NO: 13834 - protein, 27 aa, Mycobacterium avium
LNLPAWGSLRLALPMTGNGDAAFLAGE

SEQ ID NO: 13835 - protein, 17 aa, Mycobacterium avium
LNPCGFAMLPAYLLLVV

SEQ ID NO: 13836 - protein, 37 aa, Mycobacterium avium
LNPGGWPFPPVPFVNGLASFFGQLGFSPALSTALGWA

SEQ ID NO: 13837 - protein, 18 aa, Mycobacterium avium
LNRMVDIRSNPALRAQIQ

SEQ ID NO: 13838 - protein, 17 aa, Mycobacterium avium
LPAAAIALFQAVVLYCV

SEQ ID NO: 13839 - protein, 25 aa, Mycobacterium avium
LPDDIAVTYPAHWESAAVEALGAAL

SEQ ID NO: 13840 - protein, 31 aa, Mycobacterium avium
LPFLLLFRLTCYYYRGAYYRTVWQSPTACAV

SEQ ID NO: 13841 - protein, 27 aa, Mycobacterium avium
LPGKQPRPAIGPLRRTGLSGMLRGGRS

SEQ ID NO: 13842 - protein, 17 aa, Mycobacterium avium
LPGRPDLSGSAPTSLRQ

SEQ ID NO: 13843 - protein, 17 aa, Mycobacterium avium
LPIGQGLSMTLLQMTGM

SEQ ID NO: 13844 - protein, 28 aa, Mycobacterium avium
LPIIKPAVVVALLFRTLDAFRIFDNIYV

SEQ ID NO: 13845 - protein, 21 aa, Mycobacterium avium
LPLAHLLGGGGFALHLDSRQV

SEQ ID NO: 13846 - protein, 18 aa, Mycobacterium avium
LPMLAQIPVFLGLYHVLR

SEQ ID NO: 13847 - protein, 17 aa, Mycobacterium avium
LPPDTGKADRARVVAQV

SEQ ID NO: 13848 - protein, 17 aa, Mycobacterium avium
LPPEAFTNPEFKRGLKL

SEQ ID NO: 13849 - protein, 18 aa, Mycobacterium avium
LPPGTSVRLCMAAVNRDD

SEQ ID NO: 13850 - protein, 27 aa, Mycobacterium avium
LPPPGFPPDRPEGFEQPGNVDPFDQEA

SEQ ID NO: 13851 - protein, 17 aa, Mycobacterium avium
LPRRSWLRAASEDTSGA

SEQ ID NO: 13852 - protein, 21 aa, Mycobacterium avium
LPTGLRLVIDNAIANAVKHGN

SEQ ID NO: 13853 - protein, 19 aa, Mycobacterium avium
LPTTIGFLIAAPVAGWLAD

SEQ ID NO: 13854 - protein, 26 aa, Mycobacterium avium
LPVLALMVVAVWLLGVGTLKDLALVQ

SEQ ID NO: 13855 - protein, 18 aa, Mycobacterium avium
LPVLHGLTPTALNATVEL

SEQ ID NO: 13856 - protein, 17 aa, Mycobacterium avium
LPYPKWLPPPAPPEGIN

SEQ ID NO: 13857 - protein, 18 aa, Mycobacterium avium
LQALLGAPHWNSDDKAVL

SEQ ID NO: 13858 - protein, 19 aa, Mycobacterium avium
LQGPGVVITGFVNRVGDPR

SEQ ID NO: 13859 - protein, 20 aa, Mycobacterium avium
LQKWKGCAGQTVTVTNKSKT

SEQ ID NO: 13860 - protein, 25 aa, Mycobacterium avium
LQLASALCRHYWPLALLAATMSRHF

SEQ ID NO: 13861 - protein, 21 aa, Mycobacterium avium
LQPRVSIGLDQTRFGRSVHSV

SEQ ID NO: 13862 - protein, 19 aa, Mycobacterium avium
LQRGQEVGFTLSAPLRALT

SEQ ID NO: 13863 - protein, 18 aa, Mycobacterium avium
LQVRSRRAATPPDAAGAD

SEQ ID NO: 13864 - protein, 26 aa, Mycobacterium avium
LQWPLFAWFCVYAYRKFVRYEEEPPR

SEQ ID NO: 13865 - protein, 18 aa, Mycobacterium avium
LRAAGGRFAEFWRQQHEA

SEQ ID NO: 13866 - protein, 18 aa, Mycobacterium avium
LRAAVDAIRLSRRTLATI

SEQ ID NO: 13867 - protein, 18 aa, Mycobacterium avium
LRALAYAATGGRALPDDI

SEQ ID NO: 13868 - protein, 21 aa, Mycobacterium avium
LRALKPWEGPRHFVLIDDIGD

SEQ ID NO: 13869 - protein, 19 aa, Mycobacterium avium
LRAVAVIAVVLYHAGIPGI

SEQ ID NO: 13870 - protein, 26 aa, Mycobacterium avium
LREGLACAVLRRPDHRETYDAMFDLW

SEQ ID NO: 13871 - protein, 21 aa, Mycobacterium avium
LRESLPLIGFLIVGLLYCRAD

SEQ ID NO: 13872 - protein, 23 aa, Mycobacterium avium
LRETLVAGGWEWVVLAVTAVVVI

SEQ ID NO: 13873 - protein, 23 aa, Mycobacterium avium
LREVLRYDLPASLVVFLVALPLS

SEQ ID NO: 13874 - protein, 25 aa, Mycobacterium avium
LRGGSLTFLDCVYFSAVSLSTTGYG

SEQ ID NO: 13875 - protein, 17 aa, Mycobacterium avium
LRGKNTRGWFLASAGAD

SEQ ID NO: 13876 - protein, 25 aa, Mycobacterium avium
LRLAAWDVVCTVALLVLLALLATAT

SEQ ID NO: 13877 - protein, 18 aa, Mycobacterium avium
LRLICAVVGGGLLCASFP

SEQ ID NO: 13878 - protein, 21 aa, Mycobacterium avium
LRLVARTLPGKQFEVGRQLRV

SEQ ID NO: 13879 - protein, 20 aa, Mycobacterium avium
LRMATRTTAALGLSLLALWL

SEQ ID NO: 13880 - protein, 25 aa, Mycobacterium avium
LRPYGPRPAVRQLLLWEDGDPAVAP

SEQ ID NO: 13881 - protein, 23 aa, Mycobacterium avium
LRQLILGGIDARLWQAIIVLAAI

SEQ ID NO: 13882 - protein, 17 aa, Mycobacterium avium
LRTGIIRAFGGTGGVVT

SEQ ID NO: 13883 - protein, 18 aa, Mycobacterium avium
LRTLAGFGSMFPVAAGAV

SEQ ID NO: 13884 - protein, 17 aa, Mycobacterium avium
LRVGRDRWFNLLWLIPI

SEQ ID NO: 13885 - protein, 19 aa, Mycobacterium avium
LRVLGQFGSTVCIGLLLDT

SEQ ID NO: 13886 - protein, 25 aa, Mycobacterium avium
LSADWFGMAVLVAWGALGALGALRW

SEQ ID NO: 13887 - protein, 18 aa, Mycobacterium avium
LSAFVVFSSMAGIVGTPG

SEQ ID NO: 13888 - protein, 18 aa, Mycobacterium avium
LSASAADVYPALREFIDR

SEQ ID NO: 13889 - protein, 23 aa, Mycobacterium avium
LSASRWADIRPALRDQIGTRIEL

SEQ ID NO: 13890 - protein, 20 aa, Mycobacterium avium
LSAVSSRAGVEIAVDDNGSG

SEQ ID NO: 13891 - protein, 20 aa, Mycobacterium avium
LSDRMGRRTLLIVGLVTSGA

SEQ ID NO: 13892 - protein, 27 aa, Mycobacterium avium
LSERSRQGWKIQRWRSRVRNHTIVIGY

SEQ ID NO: 13893 - protein, 17 aa, Mycobacterium avium
LSIAFAIGERHELGPVP

SEQ ID NO: 13894 - protein, 17 aa, Mycobacterium avium
LSLLALWLLTRATGQPL

SEQ ID NO: 13895 - protein, 19 aa, Mycobacterium avium
LSLTVPGHNGFRVPAPAAG

SEQ ID NO: 13896 - protein, 25 aa, Mycobacterium avium
LSNVLRYGYYPALIVGLTIAVMILY

SEQ ID NO: 13897 - protein, 24 aa, Mycobacterium avium
LSPARLRTMLRRRVAPPARPDVDS

SEQ ID NO: 13898 - protein, 25 aa, Mycobacterium avium
LSQHSPALFAGRLIVGLGVGLAISA

SEQ ID NO: 13899 - protein, 24 aa, Mycobacterium avium
LSRYRPGTHLANWRRVGLATWIAD

SEQ ID NO: 13900 - protein, 27 aa, Mycobacterium avium
LSVLIWQDLFGIRIHWIVAALSVIILL

SEQ ID NO: 13901 - protein, 24 aa, Mycobacterium avium
LSVTAGVLIVCFVAGVVIASVCRR

SEQ ID NO: 13902 - protein, 19 aa, Mycobacterium avium
LTAGLPLLHVEKPQYEGTQ

SEQ ID NO: 13903 - protein, 20 aa, Mycobacterium avium
LTDLLDGWVAYFADHPHERA

SEQ ID NO: 13904 - protein, 27 aa, Mycobacterium avium
LTGFWIRRARRLLPALVLMVLTVAAAR

SEQ ID NO: 13905 - protein, 23 aa, Mycobacterium avium
LTGITCFVGFLASYLFNVYFQRG

SEQ ID NO: 13906 - protein, 22 aa, Mycobacterium avium
LTGTALGWLVSRGWRQPTAVLP

SEQ ID NO: 13907 - protein, 28 aa, Mycobacterium avium
LTIPKPVPRRDMVPIWVAAGGLFGALLI

SEQ ID NO: 13908 - protein, 23 aa, Mycobacterium avium
LTIVLAAWGWFALLLEITGAVAV

SEQ ID NO: 13909 - protein, 25 aa, Mycobacterium avium
LTLLMPVFRWQRRDNLLAESDPAAT

SEQ ID NO: 13910 - protein, 17 aa, Mycobacterium avium
LTLNGWVAFNLPRTVTA

SEQ ID NO: 13911 - protein, 22 aa, Mycobacterium avium
LTPAQRACVWFFAIVSVLFLAQ

SEQ ID NO: 13912 - protein, 26 aa, Mycobacterium avium
LTPGLPMPGLPMPAGPAVAPAPAEVS

SEQ ID NO: 13913 - protein, 17 aa, Mycobacterium avium
LTPPGTFTAIPPYWQQT

SEQ ID NO: 13914 - protein, 27 aa, Mycobacterium avium
LTRMMKVELPLAVPVLIAGLRVVVVTN

SEQ ID NO: 13915 - protein, 17 aa, Mycobacterium avium
LTTAIAAVLARPSGGRK

SEQ ID NO: 13916 - protein, 17 aa, Mycobacterium avium
LTVLIIFTLNILLAEFG

SEQ ID NO: 13917 - protein, 26 aa, Mycobacterium avium
LVAARAGSVPVIRSSVLTLFEQRPTE

SEQ ID NO: 13918 - protein, 19 aa, Mycobacterium avium
LVALWRLDQLDGHRMRRLI

SEQ ID NO: 13919 - protein, 23 aa, Mycobacterium avium
LVARYKLVVGRRIRSATMVADAK

SEQ ID NO: 13920 - protein, 25 aa, Mycobacterium avium
LVASLAVSGFLGWRQWQEHQVKAAG

SEQ ID NO: 13921 - protein, 20 aa, Mycobacterium avium
LVFHGGAPPLQFWQALDTAL

SEQ ID NO: 13922 - protein, 33 aa, Mycobacterium avium
LVGGCARIPYTLGIAAFGGRKWTTFSAVVLLIP

SEQ ID NO: 13923 - protein, 19 aa, Mycobacterium avium
LVHHCHREQWPVAGPVLGR

SEQ ID NO: 13924 - protein, 26 aa, Mycobacterium avium
LVIGCVVLAGLLGMCSLQLHNRPGPI

SEQ ID NO: 13925 - protein, 25 aa, Mycobacterium avium
LVIRGDRVLVGFSMPGKTIGAQSRA

SEQ ID NO: 13926 - protein, 19 aa, Mycobacterium avium
LVKAGLIGVVLAVMVILVG

SEQ ID NO: 13927 - protein, 21 aa, Mycobacterium avium
LVKRGWMVLVVVVVVGVAGFC

SEQ ID NO: 13928 - protein, 24 aa, Mycobacterium avium
LVLALGAGYLRWSAGSADDLAQAR

SEQ ID NO: 13929 - protein, 28 aa, Mycobacterium avium
LVLATLWWVVGLVMLRAISPPFLDFIES

SEQ ID NO: 13930 - protein, 22 aa, Mycobacterium avium
LVLLWRLVRRDSPQPAISGFFG

SEQ ID NO: 13931 - protein, 18 aa, Mycobacterium avium
LVMRPDLSTLRRIPWLPG

SEQ ID NO: 13932 - protein, 25 aa, Mycobacterium avium
LVNGLRLGLANAWLFVVAAELIASS

SEQ ID NO: 13933 - protein, 18 aa, Mycobacterium avium
LVPVSWQLGLAALGGLPL

SEQ ID NO: 13934 - protein, 26 aa, Mycobacterium avium
LVRGTLRILLPISIVGAVLLVAGGAI

SEQ ID NO: 13935 - protein, 18 aa, Mycobacterium avium
LVRLRDAAEAVGFYRGER

SEQ ID NO: 13936 - protein, 19 aa, Mycobacterium avium
LVSDATAALAMLRGTPGFP

SEQ ID NO: 13937 - protein, 25 aa, Mycobacterium avium
LVSPARWYWAVIAAFVIFAGTNSWG

SEQ ID NO: 13938 - protein, 18 aa, Mycobacterium avium
LVSRSWAMAFATLVSRLT

SEQ ID NO: 13939 - protein, 22 aa, Mycobacterium avium
LVTGLAGCFVFSLIRPNGTAGT

SEQ ID NO: 13940 - protein, 18 aa, Mycobacterium avium
LVVGMGMTLIVAALAARR

SEQ ID NO: 13941 - protein, 17 aa, Mycobacterium avium
LVVSEWIRGGSLQEVAD

SEQ ID NO: 13942 - protein, 17 aa, Mycobacterium avium
LWIGVAVVAVLFAWGGW

SEQ ID NO: 13943 - protein, 31 aa, Mycobacterium avium
LWMRLPDLFAGIVCWLLLSREVLPRLGPAVA

SEQ ID NO: 13944 - protein, 20 aa, Mycobacterium avium
LWVTRRGRTPRQRWMSWFAL

SEQ ID NO: 13945 - protein, 17 aa, Mycobacterium avium
LYAVGLSGLSARGSASS

SEQ ID NO: 13946 - protein, 23 aa, Mycobacterium avium
LYHLATDWRTYWGPGGAGFGAAV

SEQ ID NO: 13947 - protein, 18 aa, Mycobacterium avium
LYIACLAVTYLTCQVVAN

SEQ ID NO: 13948 - protein, 22 aa, Mycobacterium avium
LYLGMTFGWLFGAMVFQVVLWG

SEQ ID NO: 13949 - protein, 24 aa, Mycobacterium avium
LYLWHWPLLIFWLSYSGHKHAGFV

SEQ ID NO: 13950 - protein, 18 aa, Mycobacterium avium
MAEVYLALHPRLPRRDVI

SEQ ID NO: 13951 - protein, 22 aa, Mycobacterium avium
MAGCGLYAMIGFPLDDIWHRIF

SEQ ID NO: 13952 - protein, 18 aa, Mycobacterium avium
MALGFVLALFVVYSGHVT

SEQ ID NO: 13953 - protein, 20 aa, Mycobacterium avium
MALKRRLRRKWSAATTAERG

SEQ ID NO: 13954 - protein, 35 aa, Mycobacterium avium
MALRRKFSASGFLPDVRRYGATYANYVGKPLSYVL

SEQ ID NO: 13955 - protein, 24 aa, Mycobacterium avium
MANARPGTNGSQFFMVYKDSQLPP

SEQ ID NO: 13956 - protein, 21 aa, Mycobacterium avium
MAVSTWWLRRHCGYRTPVAFV

SEQ ID NO: 13957 - protein, 19 aa, Mycobacterium avium
MCRNGRGFVTAVFAVTLLG

SEQ ID NO: 13958 - protein, 20 aa, Mycobacterium avium
MCSAGGWIHGQRQSLLQNAT

SEQ ID NO: 13959 - protein, 17 aa, Mycobacterium avium
MDAFDYFIVVLVYADIA

SEQ ID NO: 13960 - protein, 23 aa, Mycobacterium avium
MEVMGVSVIRRLVVPRFAAAIMV

SEQ ID NO: 13961 - protein, 17 aa, Mycobacterium avium
MFAFRYVIPADKWPEKL

SEQ ID NO: 13962 - protein, 20 aa, Mycobacterium avium
MFDKRLDVLTTDTAVRMDPP

SEQ ID NO: 13963 - protein, 22 aa, Mycobacterium avium
MFGPYHLKRLLGRGGMGEVYEA

SEQ ID NO: 13964 - protein, 22 aa, Mycobacterium avium
MGALCAAIAIIAVVLPHGGGLG

SEQ ID NO: 13965 - protein, 17 aa, Mycobacterium avium
MGGTCAVDLTVMHPELF

SEQ ID NO: 13966 - protein, 19 aa, Mycobacterium avium
MGILTWIFVDGHLSGVLNF

SEQ ID NO: 13967 - protein, 22 aa, Mycobacterium avium
MGPDARQVLVTGPFGGEGTTTT

SEQ ID NO: 13968 - protein, 20 aa, Mycobacterium avium
MHIFTAPINVIFKRLPNGLG

SEQ ID NO: 13969 - protein, 25 aa, Mycobacterium avium
MHSAWESGASWVAWVIGVISVPVDG

SEQ ID NO: 13970 - protein, 17 aa, Mycobacterium avium
MIAPCTAGLALAATIGA

SEQ ID NO: 13971 - protein, 19 aa, Mycobacterium avium
MKAMMRLGHNFHEFDSNST

SEQ ID NO: 13972 - protein, 27 aa, Mycobacterium avium
MLAGLPAGYPLRGIVHAAGILDDGLLS

SEQ ID NO: 13973 - protein, 20 aa, Mycobacterium avium
MLFVEPRSATLAVVDVSDGS

SEQ ID NO: 13974 - protein, 23 aa, Mycobacterium avium
MMAAVWLSALLVFAARRQSRWPW

SEQ ID NO: 13975 - protein, 19 aa, Mycobacterium avium
MNFPVAFRLSPLALACTAG

SEQ ID NO: 13976 - protein, 19 aa, Mycobacterium avium
MPARRTGPVVVDRHSDTEV

SEQ ID NO: 13977 - protein, 18 aa, Mycobacterium avium
MPQARYGFTTGDKLLVGA

SEQ ID NO: 13978 - protein, 24 aa, Mycobacterium avium
MQFICSAIQAGSRLGYQESAELCA

SEQ ID NO: 13979 - protein, 40 aa, Mycobacterium avium
MQIRRIDPWSTLKVSLLLSVALFFVWMIAVAFLYLVLGGM

SEQ ID NO: 13980 - protein, 26 aa, Mycobacterium avium
MSRLNSRLLKSWVRRYTLRRGALLFG

SEQ ID NO: 13981 - protein, 25 aa, Mycobacterium avium
MSSSGRGGLQFMLIIWLQGIWLPLH

SEQ ID NO: 13982 - protein, 24 aa, Mycobacterium avium
MTADELYARVGFVLQETQLVHGTV

SEQ ID NO: 13983 - protein, 24 aa, Mycobacterium avium
MTLFSVLFALLWLSALAVFQTRST

SEQ ID NO: 13984 - protein, 19 aa, Mycobacterium avium
MVAVVLFLVFGGAVAAGLP

SEQ ID NO: 13985 - protein, 26 aa, Mycobacterium avium
MVFVICVAALLVAQMFVRPIRRLQAG

SEQ ID NO: 13986 - protein, 23 aa, Mycobacterium avium
MVYGGKISFCLYMVHELVHTSWG

SEQ ID NO: 13987 - protein, 20 aa, Mycobacterium avium
NAAISALVLPSAFRPVPDPN

SEQ ID NO: 13988 - protein, 23 aa, Mycobacterium avium
NAARWLGGAALVLAALGIAIALV

SEQ ID NO: 13989 - protein, 22 aa, Mycobacterium avium
NAHEAIEILALLNVAAVIIGTA

SEQ ID NO: 13990 - protein, 19 aa, Mycobacterium avium
NALNVWRLVLASGVILQHS

SEQ ID NO: 13991 - protein, 21 aa, Mycobacterium avium
NALPGSPPFGSWVDITVVIWV

SEQ ID NO: 13992 - protein, 17 aa, Mycobacterium avium
NALRYAPNCVVRVNAGQ

SEQ ID NO: 13993 - protein, 21 aa, Mycobacterium avium
NAPVLLCRLTDAWVVIMAAAM

SEQ ID NO: 13994 - protein, 19 aa, Mycobacterium avium
NDLLWSFFSALAMATGVMV

SEQ ID NO: 13995 - protein, 17 aa, Mycobacterium avium
NDRLLLALMPESVLQRY

SEQ ID NO: 13996 - protein, 17 aa, Mycobacterium avium
NEARWVRGAVPFEGDVG

SEQ ID NO: 13997 - protein, 22 aa, Mycobacterium avium
NELHLRVLLICASVIGGTVVVG

SEQ ID NO: 13998 - protein, 27 aa, Mycobacterium avium
NESGYRLRVKMALAEGQYKISKLDQVT

SEQ ID NO: 13999 - protein, 24 aa, Mycobacterium avium
NESPCTVNSFASLIGQKYFDNTKC

SEQ ID NO: 14000 - protein, 30 aa, Mycobacterium avium
NGCVLLAEMLFLRWLLDGRVGRQWWAGVAI

SEQ ID NO: 14001 - protein, 19 aa, Mycobacterium avium
NHSMGWCFLFADGNTSAAG

SEQ ID NO: 14002 - protein, 23 aa, Mycobacterium avium
NIGIEALTGFLAAFINVRIAAPV

SEQ ID NO: 14003 - protein, 20 aa, Mycobacterium avium
NIVAAVLCHRLVELIGVGLI

SEQ ID NO: 14004 - protein, 34 aa, Mycobacterium avium
NLRLPKVSARVLVIAALAAVFVFIAAVAGVQLYR

SEQ ID NO: 14005 - protein, 19 aa, Mycobacterium avium
NLSQAWTLRADEVIQNVTV

SEQ ID NO: 14006 - protein, 17 aa, Mycobacterium avium
NPLPCAGAVTGPFGGPG

SEQ ID NO: 14007 - protein, 29 aa, Mycobacterium avium
NPNPLVPVPIPIPVPIPGWNPPYNPPYTP

SEQ ID NO: 14008 - protein, 29 aa, Mycobacterium avium
NQSALRLKGRLLFMPGVMVTSVPWQLSSS

SEQ ID NO: 14009 - protein, 19 aa, Mycobacterium avium
NRLYFAFLALLPFVLAGLT

SEQ ID NO: 14010 - protein, 17 aa, Mycobacterium avium
NSAGVLLLWSWLVLPLA

SEQ ID NO: 14011 - protein, 18 aa, Mycobacterium avium
NTALRWAQNALSFVGFVP

SEQ ID NO: 14012 - protein, 18 aa, Mycobacterium avium
NTQPWRWRIDPAGLHLYA

SEQ ID NO: 14013 - protein, 20 aa, Mycobacterium avium
NTVDTAIRWGGTTLVQPVAT

SEQ ID NO: 14014 - protein, 24 aa, Mycobacterium avium
NTVPWRPGPIRALLATRPAAFRSL

SEQ ID NO: 14015 - protein, 24 aa, Mycobacterium avium
NVEGLAALIFSRYLWAFELTSALL

SEQ ID NO: 14016 - protein, 18 aa, Mycobacterium avium
NVIFKRLPNGLGPLLPIE

SEQ ID NO: 14017 - protein, 21 aa, Mycobacterium avium
NVSSVALIWFGGLRIDHGQMQ

SEQ ID NO: 14018 - protein, 19 aa, Mycobacterium avium
NWFGVCLVPILTLIVLQIR

SEQ ID NO: 14019 - protein, 17 aa, Mycobacterium avium
NWGVAGWSMGGTCAVDL

SEQ ID NO: 14020 - protein, 18 aa, Mycobacterium avium
NYWHPPAQPPYWQQPAHG

SEQ ID NO: 14021 - protein, 20 aa, Mycobacterium avium
PAAHRVWLPPLGRPPELRTL

SEQ ID NO: 14022 - protein, 17 aa, Mycobacterium avium
PAALWLWVMLTGTAVAV

SEQ ID NO: 14023 - protein, 27 aa, Mycobacterium avium
PADIERFARRFGCVVQDGFGSTEGGVA

SEQ ID NO: 14024 - protein, 24 aa, Mycobacterium avium
PADPRLVEVLGWLLYAVPVLVVFL

SEQ ID NO: 14025 - protein, 17 aa, Mycobacterium avium
PAFLAFPATMLVSTVAA

SEQ ID NO: 14026 - protein, 24 aa, Mycobacterium avium
PAGTLHYWQAWVFIAVFTVATIVP

SEQ ID NO: 14027 - protein, 30 aa, Mycobacterium avium
PAHPKKFSWHWWWLMAAIPVAVLLVLLIWV

SEQ ID NO: 14028 - protein, 19 aa, Mycobacterium avium
PAILYWEGLNISFREIRAN

SEQ ID NO: 14029 - protein, 19 aa, Mycobacterium avium
PAKPIAVNIIDFGADPDRT

SEQ ID NO: 14030 - protein, 17 aa, Mycobacterium avium
PALDAVYLPPGRSAYVR

SEQ ID NO: 14031 - protein, 21 aa, Mycobacterium avium
PALDYTTPLFAFLFLAALGVD

SEQ ID NO: 14032 - protein, 22 aa, Mycobacterium avium
PALFPTNVRYGALAISYNISIS

SEQ ID NO: 14033 - protein, 32 aa, Mycobacterium avium
PALGVPLFVVLGCASGLCLREGLIDLEAAAPQ

SEQ ID NO: 14034 - protein, 23 aa, Mycobacterium avium
PAPEPPKGPGLIERMITSKLRAQ

SEQ ID NO: 14035 - protein, 23 aa, Mycobacterium avium
PAPGRPAPPLPAFVAPPDLGANC

SEQ ID NO: 14036 - protein, 28 aa, Mycobacterium avium
PARAARLRLALNVPYLLLVLAFVGFDAV

SEQ ID NO: 14037 - protein, 17 aa, Mycobacterium avium
PARRNPLLTGLAWAIYA

SEQ ID NO: 14038 - protein, 20 aa, Mycobacterium avium
PARWSLVAVCVVIVLVAGQL

SEQ ID NO: 14039 - protein, 17 aa, Mycobacterium avium
PATTAVGPFYCPVDQTA

SEQ ID NO: 14040 - protein, 17 aa, Mycobacterium avium
PATVIARHGRYTGVSGW

SEQ ID NO: 14041 - protein, 20 aa, Mycobacterium avium
PAVFFPRLGPTVATIASMAT

SEQ ID NO: 14042 - protein, 27 aa, Mycobacterium avium
PDGAVGRALCLAVDPDLLVTVNAMTAG

SEQ ID NO: 14043 - protein, 18 aa, Mycobacterium avium
PDGFAVQVDRRVRVLGDG

SEQ ID NO: 14044 - protein, 25 aa, Mycobacterium avium
PDLDWQSVWDRGWTLAAAAEDKPVE

SEQ ID NO: 14045 - protein, 18 aa, Mycobacterium avium
PDRVCALLRRVADALPQR

SEQ ID NO: 14046 - protein, 19 aa, Mycobacterium avium
PDTALARGAALASAHAPLF

SEQ ID NO: 14047 - protein, 18 aa, Mycobacterium avium
PDTLWTLIGGPRMWRRRP

SEQ ID NO: 14048 - protein, 23 aa, Mycobacterium avium
PDYRVVAALPLAYAIIVSGALLR

SEQ ID NO: 14049 - protein, 19 aa, Mycobacterium avium
PEDLVAWEAGNKLIARRNL

SEQ ID NO: 14050 - protein, 26 aa, Mycobacterium avium
PEDSEPRRRPVLLVGSGLAVVGISAV

SEQ ID NO: 14051 - protein, 21 aa, Mycobacterium avium
PEFANPVQFICGGSFETAGGP

SEQ ID NO: 14052 - protein, 26 aa, Mycobacterium avium
PEGYPIKASARYGLYYTPGSDLYRDT

SEQ ID NO: 14053 - protein, 17 aa, Mycobacterium avium
PEHPAPTLALAAGPAAG

SEQ ID NO: 14054 - protein, 20 aa, Mycobacterium avium
PELFGPLGAGIGGQVLAGSI

SEQ ID NO: 14055 - protein, 20 aa, Mycobacterium avium
PELLAPALLLAAAPFAAVGG

SEQ ID NO: 14056 - protein, 32 aa, Mycobacterium avium
PELPRVIPPSFLRRAMPYVLVILIVGMIVALF

SEQ ID NO: 14057 - protein, 18 aa, Mycobacterium avium
PEMALARGAALASANAPL

SEQ ID NO: 14058 - protein, 28 aa, Mycobacterium avium
PEPGRPRARRNVKVVPIVLISLLLISGA

SEQ ID NO: 14059 - protein, 20 aa, Mycobacterium avium
PERFRQALFRALASLVEIWM

SEQ ID NO: 14060 - protein, 19 aa, Mycobacterium avium
PETALARGAALAAANAPLF

SEQ ID NO: 14061 - protein, 20 aa, Mycobacterium avium
PFCGGLRMTHDLLHGELWAA

SEQ ID NO: 14062 - protein, 26 aa, Mycobacterium avium
PFDNGLRPEPIIALGSLVTYVLIERS

SEQ ID NO: 14063 - protein, 17 aa, Mycobacterium avium
PFGPVVSVFGHRTPLQL

SEQ ID NO: 14064 - protein, 24 aa, Mycobacterium avium
PFGWYYDLLALWAHVSTTSIWMRL

SEQ ID NO: 14065 - protein, 18 aa, Mycobacterium avium
PGAGSLFWVSDTGVRYGI

SEQ ID NO: 14066 - protein, 18 aa, Mycobacterium avium
PGCECGSVPLARRLFGEG

SEQ ID NO: 14067 - protein, 18 aa, Mycobacterium avium
PGFNLLNIAKAWQYSTGN

SEQ ID NO: 14068 - protein, 18 aa, Mycobacterium avium
PGHNGFRVPAPAAGTPDE

SEQ ID NO: 14069 - protein, 17 aa, Mycobacterium avium
PGLTPGLPMPGLPMPAG

SEQ ID NO: 14070 - protein, 19 aa, Mycobacterium avium
PGMQRLRLLQISYGVVVTV

SEQ ID NO: 14071 - protein, 33 aa, Mycobacterium avium
PGPPGQRPSGNRVWWVVGTLIAVGVLALAGGIA

SEQ ID NO: 14072 - protein, 18 aa, Mycobacterium avium
PGRAELRALLVVVAGSAV

SEQ ID NO: 14073 - protein, 26 aa, Mycobacterium avium
PGRPGGRNVWPWVNWGLALATVPAAA

SEQ ID NO: 14074 - protein, 27 aa, Mycobacterium avium
PGSAVQAPWPLLRTFAAGPALSREAAL

SEQ ID NO: 14075 - protein, 20 aa, Mycobacterium avium
PGSPCSYTPAADGLPRPDNP

SEQ ID NO: 14076 - protein, 21 aa, Mycobacterium avium
PGVTPFVRVRIDQVTPDVVTT

SEQ ID NO: 14077 - protein, 19 aa, Mycobacterium avium
PHLFDRDGVDFATGPPPPA

SEQ ID NO: 14078 - protein, 25 aa, Mycobacterium avium
PHVEHALNFWGQRFTSSGVESYDHR

SEQ ID NO: 14079 - protein, 18 aa, Mycobacterium avium
PIGISGLAGAVSTIGAVA

SEQ ID NO: 14080 - protein, 20 aa, Mycobacterium avium
PIGRNPWRGPPVPYDTPVTN

SEQ ID NO: 14081 - protein, 33 aa, Mycobacterium avium
PIRSYFYWEKHCYDIPVCWALRSVFNALDGIDQ

SEQ ID NO: 14082 - protein, 18 aa, Mycobacterium avium
PITRWELGPELPGRPGCA

SEQ ID NO: 14083 - protein, 36 aa, Mycobacterium avium
PKCLVKEIQKLSGLSINHFIAVDFAGFAKMVDALGG

SEQ ID NO: 14084 - protein, 26 aa, Mycobacterium avium
PKLTRRSRILILIALGVIALLLAGPR

SEQ ID NO: 14085 - protein, 20 aa, Mycobacterium avium
PKPPAPRIEMADMAFIAALK

SEQ ID NO: 14086 - protein, 17 aa, Mycobacterium avium
PKVEAFYWATITFSQTL

SEQ ID NO: 14087 - protein, 19 aa, Mycobacterium avium
PLALPLASLVFLGAFIPLV

SEQ ID NO: 14088 - protein, 20 aa, Mycobacterium avium
PLAPHGLPGHLVGFVEALRG

SEQ ID NO: 14089 - protein, 34 aa, Mycobacterium avium
PLARLYRRGKVPVIRLGHLLVFFVRALVAVPLAL

SEQ ID NO: 14090 - protein, 19 aa, Mycobacterium avium
PLESYNKTWLGFVAVAVVA

SEQ ID NO: 14091 - protein, 24 aa, Mycobacterium avium
PLGDRIGRHRVLVVTILMMTVSTT

SEQ ID NO: 14092 - protein, 32 aa, Mycobacterium avium
PLGVVVGGPFLPLAIILYWFANNIWTFGQQHY

SEQ ID NO: 14093 - protein, 18 aa, Mycobacterium avium
PLIGWAMLSAARFPVVLV

SEQ ID NO: 14094 - protein, 20 aa, Mycobacterium avium
PLLFIGFMFGLLLLTGTTIR

SEQ ID NO: 14095 - protein, 19 aa, Mycobacterium avium
PLPSHRLILGAMLATTVFV

SEQ ID NO: 14096 - protein, 18 aa, Mycobacterium avium
PLRFLARATNLWNSELPF

SEQ ID NO: 14097 - protein, 18 aa, Mycobacterium avium
PLSVPVFTGYGLSGGAFL

SEQ ID NO: 14098 - protein, 25 aa, Mycobacterium avium
PLVLAGLLLYVCLAVAVTALVTLST

SEQ ID NO: 14099 - protein, 21 aa, Mycobacterium avium
PMGVPLEWNVFMIFGVLSLFV

SEQ ID NO: 14100 - protein, 28 aa, Mycobacterium avium
PMLLRVGARASYLLGLAVFGVASLVCGA

SEQ ID NO: 14101 - protein, 27 aa, Mycobacterium avium
PNNTESRWKLGLYAAGRASQMRRLRAP

SEQ ID NO: 14102 - protein, 17 aa, Mycobacterium avium
PNRFIFWAYARRGDSDP

SEQ ID NO: 14103 - protein, 17 aa, Mycobacterium avium
PNRPVHRRAAPEETEPF

SEQ ID NO: 14104 - protein, 25 aa, Mycobacterium avium
PPADEFPGEDFPAGGDHEDAVEPFD

SEQ ID NO: 14105 - protein, 18 aa, Mycobacterium avium
PPAPAGRSRDFWGSAARL

SEQ ID NO: 14106 - protein, 23 aa, Mycobacterium avium
PPAQRSRVFERFVRLDTDRARSG

SEQ ID NO: 14107 - protein, 17 aa, Mycobacterium avium
PPERANRARLVKGPEVT

SEQ ID NO: 14108 - protein, 17 aa, Mycobacterium avium
PPFGSWVDITVVIWVLV

SEQ ID NO: 14109 - protein, 27 aa, Mycobacterium avium
PPGEPKSPRWLWIAAGAAVLLVVALVI

SEQ ID NO: 14110 - protein, 17 aa, Mycobacterium avium
PPLDEPIPLSAMLARAG

SEQ ID NO: 14111 - protein, 21 aa, Mycobacterium avium
PPLKFAQLVGLIFAVLGAAGF

SEQ ID NO: 14112 - protein, 27 aa, Mycobacterium avium
PPPPPDHRARNIAIGFLGTVAAGVLVL

SEQ ID NO: 14113 - protein, 28 aa, Mycobacterium avium
PPQPPRSRTWPAVALAAVAVLLGGAALV

SEQ ID NO: 14114 - protein, 26 aa, Mycobacterium avium
PQAVDAWLGLCQTYGWAPGVMGASTQ

SEQ ID NO: 14115 - protein, 23 aa, Mycobacterium avium
PQDAIRWTALVVLTAIGLGLIFP

SEQ ID NO: 14116 - protein, 26 aa, Mycobacterium avium
PQPDLPCRRGRQIAPELAGVWTAGFV

SEQ ID NO: 14117 - protein, 21 aa, Mycobacterium avium
PQWKTIVHIVFPIAMPGIVSG

SEQ ID NO: 14118 - protein, 24 aa, Mycobacterium avium
PRAEPRTAQKFIITGSFLSLFAAM

SEQ ID NO: 14119 - protein, 41 aa, Mycobacterium avium
PRAPDYYKRAELCRERLGPVLRRLTVNYPPLMFHPLNTITA

SEQ ID NO: 14120 - protein, 24 aa, Mycobacterium avium
PRESDIWLLGAIGPRMVYSTNLDA

SEQ ID NO: 14121 - protein, 18 aa, Mycobacterium avium
PRGTLAMANARPGTNGSQ

SEQ ID NO: 14122 - protein, 28 aa, Mycobacterium avium
PRGVLPSVPRWLWIFLGVVGVTAALAGG

SEQ ID NO: 14123 - protein, 18 aa, Mycobacterium avium
PRLARTIRVLALPIVLGW

SEQ ID NO: 14124 - protein, 33 aa, Mycobacterium avium
PRLGGKLRTSRQINWGWILALVVIVLALAAIAI

SEQ ID NO: 14125 - protein, 27 aa, Mycobacterium avium
PRLGPPPAMPPSLAWWASSLQLSGLSS

SEQ ID NO: 14126 - protein, 23 aa, Mycobacterium avium
PRLMSRAQFVAHLSTIMMAVIIG

SEQ ID NO: 14127 - protein, 17 aa, Mycobacterium avium
PRLPGRPDLSGSAPTSL

SEQ ID NO: 14128 - protein, 17 aa, Mycobacterium avium
PRPATVRRLPPPGSAAR

SEQ ID NO: 14129 - protein, 23 aa, Mycobacterium avium
PRPHLRGLRRSRLPAELITEIGP

SEQ ID NO: 14130 - protein, 18 aa, Mycobacterium avium
PRRGVAIVNSPLVHIGGV

SEQ ID NO: 14131 - protein, 18 aa, Mycobacterium avium
PRRQRRELATPWWEASPA

SEQ ID NO: 14132 - protein, 20 aa, Mycobacterium avium
PRRSKRRLIVGLALAVALVA

SEQ ID NO: 14133 - protein, 19 aa, Mycobacterium avium
PRRVWATVMTVLIGVLTTV

SEQ ID NO: 14134 - protein, 26 aa, Mycobacterium avium
PRRWVLLKGRLVASVASAFVMAVTGV

SEQ ID NO: 14135 - protein, 17 aa, Mycobacterium avium
PRSVQLLLTPLILAPFA

SEQ ID NO: 14136 - protein, 18 aa, Mycobacterium avium
PSHDSGPPTLTWTAITEQ

SEQ ID NO: 14137 - protein, 17 aa, Mycobacterium avium
PSLHGTLGHLEGIQQAL

SEQ ID NO: 14138 - protein, 21 aa, Mycobacterium avium
PSLLPRGAIFQGLVSGISGAI

SEQ ID NO: 14139 - protein, 19 aa, Mycobacterium avium
PSTHLETFAAASPITHVNP

SEQ ID NO: 14140 - protein, 18 aa, Mycobacterium avium
PSTLFGMSEVLGAGSPEA

SEQ ID NO: 14141 - protein, 19 aa, Mycobacterium avium
PSVAFRPVRLFAISVAITA

SEQ ID NO: 14142 - protein, 23 aa, Mycobacterium avium
PTDGHGTIDRWVDVPDRLLQRYT

SEQ ID NO: 14143 - protein, 22 aa, Mycobacterium avium
PTPKLSIDYAIFVIAIIGAAES

SEQ ID NO: 14144 - protein, 26 aa, Mycobacterium avium
PTQAARYGGGYGEYGGYEDRPPPEPP

SEQ ID NO: 14145 - protein, 20 aa, Mycobacterium avium
PTSYWGLKGLIGVNAVAADP

SEQ ID NO: 14146 - protein, 26 aa, Mycobacterium avium
PTTVSHFLPPVLRKLTIYLPQSPSTA

SEQ ID NO: 14147 - protein, 17 aa, Mycobacterium avium
PTYLRLFVRVGHTAGLV

SEQ ID NO: 14148 - protein, 18 aa, Mycobacterium avium
PVAGTALMALAFLLMSRM

SEQ ID NO: 14149 - protein, 19 aa, Mycobacterium avium
PVAGWLADRFGARPFAVAG

SEQ ID NO: 14150 - protein, 17 aa, Mycobacterium avium
PVGVLGTVWGMRSLHEL

SEQ ID NO: 14151 - protein, 19 aa, Mycobacterium avium
PVIGTWLHWALFGGDFPCG

SEQ ID NO: 14152 - protein, 26 aa, Mycobacterium avium
PVLERHAAEMIAALADRGECEVMADF

SEQ ID NO: 14153 - protein, 18 aa, Mycobacterium avium
PVLMDWAVGLAFPCQQPM

SEQ ID NO: 14154 - protein, 18 aa, Mycobacterium avium
PVPGSSPIHELWAGTKLL

SEQ ID NO: 14155 - protein, 27 aa, Mycobacterium avium
PVSLILWRTFRPGFGQFYAWVSTPAAI

SEQ ID NO: 14156 - protein, 20 aa, Mycobacterium avium
PVVDVWTGWADRAGQRPWSE

SEQ ID NO: 14157 - protein, 22 aa, Mycobacterium avium
PWRHLPIAVSLLSLVLLTIALA

SEQ ID NO: 14158 - protein, 18 aa, Mycobacterium avium
PWVDAAFKKRGIDPEDFW

SEQ ID NO: 14159 - protein, 17 aa, Mycobacterium avium
PYAGTWLLSSSVLADHV

SEQ ID NO: 14160 - protein, 22 aa, Mycobacterium avium
QAAGLAVWAGISWARGKRRRAA

SEQ ID NO: 14161 - protein, 19 aa, Mycobacterium avium
QAICQRYGVAYNRGPLLRQ

SEQ ID NO: 14162 - protein, 17 aa, Mycobacterium avium
QAIGRLGNYFNQELYGR

SEQ ID NO: 14163 - protein, 20 aa, Mycobacterium avium
QALNVPLPWSKVLSSTKPGI

SEQ ID NO: 14164 - protein, 21 aa, Mycobacterium avium
QAPYWVCAVYLVFLAAVAIAA

SEQ ID NO: 14165 - protein, 24 aa, Mycobacterium avium
QAQLRAGSWWSGPDVYVVVDDYDL

SEQ ID NO: 14166 - protein, 31 aa, Mycobacterium avium
QATATEWLNRLRALAHRTCVAPLPYAQADLD

SEQ ID NO: 14167 - protein, 30 aa, Mycobacterium avium
QDPPARPWRPGVWAAVPALAAGAVIAGAAG

SEQ ID NO: 14168 - protein, 19 aa, Mycobacterium avium
QDYLRSIFRAAAPGAALYI

SEQ ID NO: 14169 - protein, 20 aa, Mycobacterium avium
QELYQARGLMEYGSVLGHGA

SEQ ID NO: 14170 - protein, 19 aa, Mycobacterium avium
QFALFRLSVKLPDADTVSF

SEQ ID NO: 14171 - protein, 21 aa, Mycobacterium avium
QFDALHFAKPIFGPAARALAQ

SEQ ID NO: 14172 - protein, 31 aa, Mycobacterium avium
QFLARRTAMALTRWRVRMEVEPGRRQNLAVV

SEQ ID NO: 14173 - protein, 22 aa, Mycobacterium avium
QGALLVGVFFWFAVVGGATVVM

SEQ ID NO: 14174 - protein, 18 aa, Mycobacterium avium
QGIWLPLHGYRFESTPLW

SEQ ID NO: 14175 - protein, 25 aa, Mycobacterium avium
QHCVTAFAAVGWRSRVRRLPDPDDP

SEQ ID NO: 14176 - protein, 19 aa, Mycobacterium avium
QHHRWAAAVTLSLVLAWFV

SEQ ID NO: 14177 - protein, 17 aa, Mycobacterium avium
QIMPLLVVSIMSQLVFS

SEQ ID NO: 14178 - protein, 18 aa, Mycobacterium avium
QISQPWVDAAFKKRGIDP

SEQ ID NO: 14179 - protein, 28 aa, Mycobacterium avium
QLARVCPRRWPLRGAVGAADRQAVHVAL

SEQ ID NO: 14180 - protein, 22 aa, Mycobacterium avium
QLEAAALRDALAARRIDNVMLV

SEQ ID NO: 14181 - protein, 27 aa, Mycobacterium avium
QLGEDYLRLAALGAYGSFFNIYFCSVT

SEQ ID NO: 14182 - protein, 24 aa, Mycobacterium avium
QLLETIVMLALQFVIHRTLYLIWL

SEQ ID NO: 14183 - protein, 21 aa, Mycobacterium avium
QLLLLPVAWYLAVGSHQPGFG

SEQ ID NO: 14184 - protein, 20 aa, Mycobacterium avium
QLLYLRVPALNALFPDYRGS

SEQ ID NO: 14185 - protein, 17 aa, Mycobacterium avium
QLRKELRDNPKQTRVFI

SEQ ID NO: 14186 - protein, 18 aa, Mycobacterium avium
QLVAFGILTVISLLVLGI

SEQ ID NO: 14187 - protein, 25 aa, Mycobacterium avium
QLVVLLCGGLVGPIFLVVYFTLGLG

SEQ ID NO: 14188 - protein, 19 aa, Mycobacterium avium
QMYGDAAGLSRAVLNLLDN

SEQ ID NO: 14189 - protein, 17 aa, Mycobacterium avium
QPELERLIDEGKFRSDV

SEQ ID NO: 14190 - protein, 20 aa, Mycobacterium avium
QPGKMPASLADYLRGLIQER

SEQ ID NO: 14191 - protein, 18 aa, Mycobacterium avium
QPNLRWPVEESTYLLTAH

SEQ ID NO: 14192 - protein, 23 aa, Mycobacterium avium
QPSPAPWPLLTLLPAGPELSRPN

SEQ ID NO: 14193 - protein, 17 aa, Mycobacterium avium
QQFSRVRVFAFIDTTDE

SEQ ID NO: 14194 - protein, 27 aa, Mycobacterium avium
QQRDDWAWLKAAFVIAGIALATAGLIW

SEQ ID NO: 14195 - protein, 23 aa, Mycobacterium avium
QRAPLHIWVIVALVMVPVLVACV

SEQ ID NO: 14196 - protein, 22 aa, Mycobacterium avium
QRIDAAEAMAFVRQRRDENDGS

SEQ ID NO: 14197 - protein, 24 aa, Mycobacterium avium
QRKPVARPAHRWVMVPDDGPPPPA

SEQ ID NO: 14198 - protein, 18 aa, Mycobacterium avium
QRLAIARAVIRRPAIYLF

SEQ ID NO: 14199 - protein, 21 aa, Mycobacterium avium
QRRALRAGLSVRPMIVTLIGY

SEQ ID NO: 14200 - protein, 18 aa, Mycobacterium avium
QRRMEVLAVPMVAVVLFL

SEQ ID NO: 14201 - protein, 19 aa, Mycobacterium avium
QRYGVAYNRGPLLRQFGTV

SEQ ID NO: 14202 - protein, 25 aa, Mycobacterium avium
QSAIPRQSLAPGFWGNVLHDLSHAY

SEQ ID NO: 14203 - protein, 24 aa, Mycobacterium avium
QSLLPRLQVGIAEHSFVDTVRALD

SEQ ID NO: 14204 - protein, 18 aa, Mycobacterium avium
QTRWAAALVCAVLVAVAA

SEQ ID NO: 14205 - protein, 21 aa, Mycobacterium avium
QVKAFYGYDRPLWVQYFAQLN

SEQ ID NO: 14206 - protein, 19 aa, Mycobacterium avium
QVWRCLRCGEFTVGPAHRR

SEQ ID NO: 14207 - protein, 18 aa, Mycobacterium avium
RAAAPRVVVLSRLVPHKQ

SEQ ID NO: 14208 - protein, 26 aa, Mycobacterium avium
RAADLLEWLALAALVPLTCWIAGLYG

SEQ ID NO: 14209 - protein, 18 aa, Mycobacterium avium
RAAGLPLPAGAGVTVTDT

SEQ ID NO: 14210 - protein, 23 aa, Mycobacterium avium
RADGVFVVGCGTDIVAVKPALEA

SEQ ID NO: 14211 - protein, 23 aa, Mycobacterium avium
RAELPGCVMVSVSHRPTVEQHHD

SEQ ID NO: 14212 - protein, 19 aa, Mycobacterium avium
RAEVRREAEIMWAEHQLTQ

SEQ ID NO: 14213 - protein, 17 aa, Mycobacterium avium
RAGDLPLLLGALFANGL

SEQ ID NO: 14214 - protein, 20 aa, Mycobacterium avium
RAGRRFYWATSVIGIVCFAF

SEQ ID NO: 14215 - protein, 20 aa, Mycobacterium avium
RAGYMSNYFRWFGSPEDPFG

SEQ ID NO: 14216 - protein, 21 aa, Mycobacterium avium
RAKQARTRRILLIAAGSIVAV

SEQ ID NO: 14217 - protein, 17 aa, Mycobacterium avium
RANWGVAGWSMGGTCAV

SEQ ID NO: 14218 - protein, 20 aa, Mycobacterium avium
RAQLWQRFTPIIANYRRYVR

SEQ ID NO: 14219 - protein, 23 aa, Mycobacterium avium
RASDVLLALPGFLTSVWIVTAYG

SEQ ID NO: 14220 - protein, 23 aa, Mycobacterium avium
RASLRELLIPLVPAAVIALALIV

SEQ ID NO: 14221 - protein, 17 aa, Mycobacterium avium
RATVFVVVLGFLIQITG

SEQ ID NO: 14222 - protein, 18 aa, Mycobacterium avium
RCGEFTVGPAHRRGPAED

SEQ ID NO: 14223 - protein, 21 aa, Mycobacterium avium
RCTRLFRPVFYYLAFWAVTLT

SEQ ID NO: 14224 - protein, 19 aa, Mycobacterium avium
RDAELRWHAAHSDRPPPPP

SEQ ID NO: 14225 - protein, 21 aa, Mycobacterium avium
RDEVEARLALGQPSGQAASPY

SEQ ID NO: 14226 - protein, 20 aa, Mycobacterium avium
RDGGTWLLWNGRRSQINLAD

SEQ ID NO: 14227 - protein, 18 aa, Mycobacterium avium
RDIVLGVVRDGRLLRIDA

SEQ ID NO: 14228 - protein, 23 aa, Mycobacterium avium
RDPLRTGIFGVVLVVCVVLIAFG

SEQ ID NO: 14229 - protein, 19 aa, Mycobacterium avium
RDQLSGVRVVRAFAREDFE

SEQ ID NO: 14230 - protein, 18 aa, Mycobacterium avium
RDRLDRLLASPIARVLAH

SEQ ID NO: 14231 - protein, 17 aa, Mycobacterium avium
RDRWFNLLWLIPIGFAL

SEQ ID NO: 14232 - protein, 17 aa, Mycobacterium avium
RDVAGWFAISSDGPPAP

SEQ ID NO: 14233 - protein, 26 aa, Mycobacterium avium
RDYRTERLWSAIGLVPQRGYLFSGTV

SEQ ID NO: 14234 - protein, 18 aa, Mycobacterium avium
REGVAFGLYTMTGRAVSF

SEQ ID NO: 14235 - protein, 33 aa, Mycobacterium avium
REKIPRFIRTFAVPIIIGWIALIAVLNVVVPQL

SEQ ID NO: 14236 - protein, 18 aa, Mycobacterium avium
RELARLRPPAPWPAPGYP

SEQ ID NO: 14237 - protein, 20 aa, Mycobacterium avium
REPRNIWVMIGVPALIVALI

SEQ ID NO: 14238 - protein, 21 aa, Mycobacterium avium
REQPWTPIVIILVITAVKILG

SEQ ID NO: 14239 - protein, 26 aa, Mycobacterium avium
RESTDILKRWKRGVMSTVGDVAAQNV

SEQ ID NO: 14240 - protein, 20 aa, Mycobacterium avium
RETTLPWGLEIFYRRDPSGY

SEQ ID NO: 14241 - protein, 18 aa, Mycobacterium avium
RETWLIMRLAVIDNAQAL

SEQ ID NO: 14242 - protein, 23 aa, Mycobacterium avium
REVLGPWVNRAWLNWVAGLIVGT

SEQ ID NO: 14243 - protein, 20 aa, Mycobacterium avium
REYWLASGAARPARPTPKRA

SEQ ID NO: 14244 - protein, 26 aa, Mycobacterium avium
RFALELRTSLLVLFALAALAVATQVS

SEQ ID NO: 14245 - protein, 21 aa, Mycobacterium avium
RFESTPLWAGIYMLPTTIGFL

SEQ ID NO: 14246 - protein, 17 aa, Mycobacterium avium
RFGFLITALCLFTAVFI

SEQ ID NO: 14247 - protein, 18 aa, Mycobacterium avium
RGALLFGKLLPVGIGVVV

SEQ ID NO: 14248 - protein, 18 aa, Mycobacterium avium
RGAPIVFRSASPADLFML

SEQ ID NO: 14249 - protein, 23 aa, Mycobacterium avium
RGATLMPDGRLTGRAVKLLGANQ

SEQ ID NO: 14250 - protein, 23 aa, Mycobacterium avium
RGEFNGHLWISMDYVEGTDASRL

SEQ ID NO: 14251 - protein, 21 aa, Mycobacterium avium
RGELGEWIITRGLRIVMVLIA

SEQ ID NO: 14252 - protein, 26 aa, Mycobacterium avium
RGEPLPWQDLRAAFTERGWLDLTHTR

SEQ ID NO: 14253 - protein, 18 aa, Mycobacterium avium
RGFRVPGYPVTPVLSIMA

SEQ ID NO: 14254 - protein, 19 aa, Mycobacterium avium
RGGDPYTRKAGCAARAKFS

SEQ ID NO: 14255 - protein, 25 aa, Mycobacterium avium
RGGTPRFGTDTAFDDAVRGMRTRLL

SEQ ID NO: 14256 - protein, 17 aa, Mycobacterium avium
RGPRLGPPPAMPPSLAW

SEQ ID NO: 14257 - protein, 17 aa, Mycobacterium avium
RGPVIAVAGRFVHTAIH

SEQ ID NO: 14258 - protein, 34 aa, Mycobacterium avium
RGRLWRRVGTAVVRWPAPVLAVSAAVVLVGMIAL

SEQ ID NO: 14259 - protein, 24 aa, Mycobacterium avium
RGRPLRLAVAVAVLDIFANITMLA

SEQ ID NO: 14260 - protein, 25 aa, Mycobacterium avium
RGRTPRQRWMSWFALLTIPTPFLAN

SEQ ID NO: 14261 - protein, 19 aa, Mycobacterium avium
RGSDGVVIPGSYRNRHRAV

SEQ ID NO: 14262 - protein, 17 aa, Mycobacterium avium
RGSGYGLGLSTRTQVTG

SEQ ID NO: 14263 - protein, 25 aa, Mycobacterium avium
RGSQQLRPGSTLPLGQSTTPYQIYD

SEQ ID NO: 14264 - protein, 23 aa, Mycobacterium avium
RGVLPRPVARAGLATAALAGSAT

SEQ ID NO: 14265 - protein, 17 aa, Mycobacterium avium
RHLVLPSLTLALAAAAG

SEQ ID NO: 14266 - protein, 21 aa, Mycobacterium avium
RHPHWKRLIGPVLVLILGTGL

SEQ ID NO: 14267 - protein, 26 aa, Mycobacterium avium
RHQVSGWRFVMRRIASGIALHDTRML

SEQ ID NO: 14268 - protein, 17 aa, Mycobacterium avium
RHRRLPAVVPGGDYVST

SEQ ID NO: 14269 - protein, 26 aa, Mycobacterium avium
RIAATLRRPVLRLGRPAPAELEPVLS

SEQ ID NO: 14270 - protein, 18 aa, Mycobacterium avium
RIASRVGTGVGFAKDQVF

SEQ ID NO: 14271 - protein, 19 aa, Mycobacterium avium
RIGGVIGETLKLAATATAF

SEQ ID NO: 14272 - protein, 24 aa, Mycobacterium avium
RIGVKPIMWTGCALLIGASVPAFL

SEQ ID NO: 14273 - protein, 18 aa, Mycobacterium avium
RILPGFYVCMIVTAFVFA

SEQ ID NO: 14274 - protein, 25 aa, Mycobacterium avium
RILRRFSIDELPQFINVIKGDMSVV

SEQ ID NO: 14275 - protein, 23 aa, Mycobacterium avium
RIRTAIGPSQAWYTENLRYYYLI

SEQ ID NO: 14276 - protein, 19 aa, Mycobacterium avium
RITGRQAVWALLLAAAVAV

SEQ ID NO: 14277 - protein, 20 aa, Mycobacterium avium
RKAKAPKVVRPRLTERLAAR

SEQ ID NO: 14278 - protein, 21 aa, Mycobacterium avium
RKETLRLIAQIGMGTGAMAVI

SEQ ID NO: 14279 - protein, 17 aa, Mycobacterium avium
RKIKIGMWRQANVAKVG

SEQ ID NO: 14280 - protein, 18 aa, Mycobacterium avium
RKPAAPDRSSHRRPVTYP

SEQ ID NO: 14281 - protein, 17 aa, Mycobacterium avium
RKTVLVAALLVMGLVTT

SEQ ID NO: 14282 - protein, 21 aa, Mycobacterium avium
RKVSFLPGMRYYAGNWDTTLW

SEQ ID NO: 14283 - protein, 23 aa, Mycobacterium avium
RKYRWLVFAGWLLALVPAVYLAL

SEQ ID NO: 14284 - protein, 17 aa, Mycobacterium avium
RLALVLVAPAAILMLAV

SEQ ID NO: 14285 - protein, 22 aa, Mycobacterium avium
RLAQLPLRRGVLIGAAQILALL

SEQ ID NO: 14286 - protein, 20 aa, Mycobacterium avium
RLAVVLLCTAALAAAVATGY

SEQ ID NO: 14287 - protein, 26 aa, Mycobacterium avium
RLAWSLTVLVAVAWIARGIFLGRPVT

SEQ ID NO: 14288 - protein, 21 aa, Mycobacterium avium
RLDALDVRRLLRRALRRAQPV

SEQ ID NO: 14289 - protein, 22 aa, Mycobacterium avium
RLELWRSDMVRMLTYGETDARV

SEQ ID NO: 14290 - protein, 20 aa, Mycobacterium avium
RLETSCYNPVFGANREARVF

SEQ ID NO: 14291 - protein, 26 aa, Mycobacterium avium
RLFALYVAGYCVGRFCVELLRDDTAT

SEQ ID NO: 14292 - protein, 26 aa, Mycobacterium avium
RLLGACRRAKEQLSTAVAVTVAGAPG

SEQ ID NO: 14293 - protein, 17 aa, Mycobacterium avium
RLMGVIFGTMFFLMFTP

SEQ ID NO: 14294 - protein, 19 aa, Mycobacterium avium
RLMWRLCKINGKPSRYRSE

SEQ ID NO: 14295 - protein, 24 aa, Mycobacterium avium
RLRDFLAARALRILPGYYVCLIVT

SEQ ID NO: 14296 - protein, 17 aa, Mycobacterium avium
RLRHLFFDVITANANGV

SEQ ID NO: 14297 - protein, 33 aa, Mycobacterium avium
RLSYPKRWGYRPAALGLFAFVWMELASPNPAAP

SEQ ID NO: 14298 - protein, 20 aa, Mycobacterium avium
RLTSTRIRDVLRNGAIIRRF

SEQ ID NO: 14299 - protein, 19 aa, Mycobacterium avium
RLVEDLLLLARLDSGRPLE

SEQ ID NO: 14300 - protein, 31 aa, Mycobacterium avium
RLVHTLIFTALRIAFLAVLVGTTLEVLSERS

SEQ ID NO: 14301 - protein, 19 aa, Mycobacterium avium
RLVVPRFAAAIMVGVALTG

SEQ ID NO: 14302 - protein, 22 aa, Mycobacterium avium
RMARARLGVENAYAREYDVVPS

SEQ ID NO: 14303 - protein, 19 aa, Mycobacterium avium
RMPFYRTVTSMVIWCIGGV

SEQ ID NO: 14304 - protein, 17 aa, Mycobacterium avium
RNALCGLYDGVQDKRSD

SEQ ID NO: 14305 - protein, 19 aa, Mycobacterium avium
RNALFDAFGPKGADGKPSK

SEQ ID NO: 14306 - protein, 17 aa, Mycobacterium avium
RNARTALDIVADIANPR

SEQ ID NO: 14307 - protein, 17 aa, Mycobacterium avium
RNDWIALSIASAVCAAA

SEQ ID NO: 14308 - protein, 17 aa, Mycobacterium avium
RNFGMVFLAALLVGILT

SEQ ID NO: 14309 - protein, 24 aa, Mycobacterium avium
RNRRLRLATDLSYGVYIYAFPVQQ

SEQ ID NO: 14310 - protein, 24 aa, Mycobacterium avium
RNYFTYRDVLGFIYAQAKFQVLGK

SEQ ID NO: 14311 - protein, 21 aa, Mycobacterium avium
RPAEEAVQFLAEVAVARRGEV

SEQ ID NO: 14312 - protein, 18 aa, Mycobacterium avium
RPAGLALLPANRVELGFL

SEQ ID NO: 14313 - protein, 21 aa, Mycobacterium avium
RPAYWLSMLIVLGFQVPVDGW

SEQ ID NO: 14314 - protein, 25 aa, Mycobacterium avium
RPDRREFAGALAFVAGFSVLVRPEL

SEQ ID NO: 14315 - protein, 19 aa, Mycobacterium avium
RPEGLVLVGSGVDVPLIKP

SEQ ID NO: 14316 - protein, 30 aa, Mycobacterium avium
RPGRPRWLRLPGRRAIAAGAGILLASASLG

SEQ ID NO: 14317 - protein, 18 aa, Mycobacterium avium
RPGVPKAFDAVIARGMAK

SEQ ID NO: 14318 - protein, 17 aa, Mycobacterium avium
RPLGPTPRYAVIPRWGL

SEQ ID NO: 14319 - protein, 19 aa, Mycobacterium avium
RPLILLPLVLPPVVGGIAL

SEQ ID NO: 14320 - protein, 21 aa, Mycobacterium avium
RPLPPEIYDALHAGDESSGGY

SEQ ID NO: 14321 - protein, 32 aa, Mycobacterium avium
RPPPEPPTPWYRRPAALVAFGALGVLLLGAVV

SEQ ID NO: 14322 - protein, 26 aa, Mycobacterium avium
RPPPKRRVWPIVAAVVAVLVVIAGGV

SEQ ID NO: 14323 - protein, 22 aa, Mycobacterium avium
RPPRRLRLLLSVAATVLALDIV

SEQ ID NO: 14324 - protein, 22 aa, Mycobacterium avium
RPTARRVWRSDPILRLIRGGRC

SEQ ID NO: 14325 - protein, 19 aa, Mycobacterium avium
RPVVEWLERRAQDGTLAAA

SEQ ID NO: 14326 - protein, 24 aa, Mycobacterium avium
RQEFPWPVLEEAARRGFYSPLFYR

SEQ ID NO: 14327 - protein, 28 aa, Mycobacterium avium
RQILAGPWRWSSGPPIWVAAVAPAQSGV

SEQ ID NO: 14328 - protein, 22 aa, Mycobacterium avium
RQRFVTAWAGFRGAVSLAAAVA

SEQ ID NO: 14329 - protein, 24 aa, Mycobacterium avium
RQSSWWPYAALFAVAAAALLWLGR

SEQ ID NO: 14330 - protein, 22 aa, Mycobacterium avium
RQSTRQGIQFLALQFQATRCDK

SEQ ID NO: 14331 - protein, 21 aa, Mycobacterium avium
RQVLNAALPWSLTMVTTQPGA

SEQ ID NO: 14332 - protein, 23 aa, Mycobacterium avium
RRCTRATVGGVRFSAFVIATVGA

SEQ ID NO: 14333 - protein, 18 aa, Mycobacterium avium
RRDMGVGELLGMVQAGLS

SEQ ID NO: 14334 - protein, 17 aa, Mycobacterium avium
RRFGGGALAVYVDGQPV

SEQ ID NO: 14335 - protein, 25 aa, Mycobacterium avium
RRFLQSAGLRRARHLRNHIIVVGLG

SEQ ID NO: 14336 - protein, 19 aa, Mycobacterium avium
RRGFVTRHQVSGWRFVMRR

SEQ ID NO: 14337 - protein, 19 aa, Mycobacterium avium
RRGWLEALLGHFCDPTVGL

SEQ ID NO: 14338 - protein, 27 aa, Mycobacterium avium
RRHCGYRTPVAFVLRLLVPTGASVVVA

SEQ ID NO: 14339 - protein, 18 aa, Mycobacterium avium
RRHRQLRAALTPLVQERV

SEQ ID NO: 14340 - protein, 19 aa, Mycobacterium avium
RRKQAWLRELAGWEPDLVV

SEQ ID NO: 14341 - protein, 18 aa, Mycobacterium avium
RRLWFRTDLSYGMYIYAY

SEQ ID NO: 14342 - protein, 24 aa, Mycobacterium avium
RRPSFLRPPLAPNYGRVARAVHSP

SEQ ID NO: 14343 - protein, 23 aa, Mycobacterium avium
RRPTRRLKPRPAPAAPVAEEHDS

SEQ ID NO: 14344 - protein, 23 aa, Mycobacterium avium
RRQETWLMILLGVGFGLGVALTL

SEQ ID NO: 14345 - protein, 29 aa, Mycobacterium avium
RRQVRLVIADRAYFLFLAVLPFVMGALSL

SEQ ID NO: 14346 - protein, 22 aa, Mycobacterium avium
RRRLAPPVARKGTIVIEPPPEL

SEQ ID NO: 14347 - protein, 27 aa, Mycobacterium avium
RRRRRALRWGLIFTAGCAFWAVLTIVL

SEQ ID NO: 14348 - protein, 19 aa, Mycobacterium avium
RRRRRLHRYTDAPVAQSPW

SEQ ID NO: 14349 - protein, 44 aa, Mycobacterium avium
RRTGLSGMLRGGRSRFGFGTLAVLLCLLLGIAIVTQVRQTESGD

SEQ ID NO: 14350 - protein, 24 aa, Mycobacterium avium
RRTQHNVYIPWSMTVTPISQSDVG

SEQ ID NO: 14351 - protein, 17 aa, Mycobacterium avium
RSAALALLALFVVQFPI

SEQ ID NO: 14352 - protein, 17 aa, Mycobacterium avium
RSACTSSGCAATGTRLD

SEQ ID NO: 14353 - protein, 19 aa, Mycobacterium avium
RSASCLAAALFLAAAPAVS

SEQ ID NO: 14354 - protein, 20 aa, Mycobacterium avium
RSGSGFGVVATSAWGALNLV

SEQ ID NO: 14355 - protein, 23 aa, Mycobacterium avium
RSLAELWPYASGTLCRPDGDNAT

SEQ ID NO: 14356 - protein, 24 aa, Mycobacterium avium
RSLQARATRRALLLTALGGLLIAG

SEQ ID NO: 14357 - protein, 27 aa, Mycobacterium avium
RSPLSRIPRRWVIAALGVLVVAAGLAV

SEQ ID NO: 14358 - protein, 19 aa, Mycobacterium avium
RTAFTLAAGLLFGPLLGVA

SEQ ID NO: 14359 - protein, 17 aa, Mycobacterium avium
RTAGRISGFGWAAGYVG

SEQ ID NO: 14360 - protein, 23 aa, Mycobacterium avium
RTDDLRPIPVFGSDELARLTESF

SEQ ID NO: 14361 - protein, 18 aa, Mycobacterium avium
RTDTFLGRKNMAIQPRGA

SEQ ID NO: 14362 - protein, 24 aa, Mycobacterium avium
RTEFLRLLSNIAWGNGSIVVGGGT

SEQ ID NO: 14363 - protein, 22 aa, Mycobacterium avium
RTEILGRLGPYRVNSTVNGSDV

SEQ ID NO: 14364 - protein, 28 aa, Mycobacterium avium
RTLVIPALFTLVGDRIWWPNNPSRHERS

SEQ ID NO: 14365 - protein, 21 aa, Mycobacterium avium
RTRVGLMGALVTVLVVGVGQS

SEQ ID NO: 14366 - protein, 32 aa, Mycobacterium avium
RTVPGPGSAGWLRLGVLTALIATALALLINRR

SEQ ID NO: 14367 - protein, 28 aa, Mycobacterium avium
RVAAAPTMRLGHMLVFFVRAVLAVPTVL

SEQ ID NO: 14368 - protein, 17 aa, Mycobacterium avium
RVATAVVVLTALMVSTS

SEQ ID NO: 14369 - protein, 24 aa, Mycobacterium avium
RVEYWLPGYAVPLALAATALTAVA

SEQ ID NO: 14370 - protein, 26 aa, Mycobacterium avium
RVITRRLAIALVVLFAAAVIVYADRS

SEQ ID NO: 14371 - protein, 19 aa, Mycobacterium avium
RVLRLRLAAWDVVCTVALL

SEQ ID NO: 14372 - protein, 17 aa, Mycobacterium avium
RVPALNALFPDYRGSVL

SEQ ID NO: 14373 - protein, 21 aa, Mycobacterium avium
RVPVVEIHDGCAINIGNPDGP

SEQ ID NO: 14374 - protein, 17 aa, Mycobacterium avium
RVRSLLLLLVLGSAAIA

SEQ ID NO: 14375 - protein, 20 aa, Mycobacterium avium
RVVKRQGQESFNFGEFFAYT

SEQ ID NO: 14376 - protein, 18 aa, Mycobacterium avium
RVVQGLAVGAEWGGAAVL

SEQ ID NO: 14377 - protein, 22 aa, Mycobacterium avium
RWLAEFEPMHQVFLGTRSLLYF

SEQ ID NO: 14378 - protein, 24 aa, Mycobacterium avium
RWLIPGWTGRVLVWALAIGAVLLI

SEQ ID NO: 14379 - protein, 19 aa, Mycobacterium avium
RWLWLVKWCVLAVPHYPIL

SEQ ID NO: 14380 - protein, 17 aa, Mycobacterium avium
RWLYSIAAIPGYLLLGD

SEQ ID NO: 14381 - protein, 21 aa, Mycobacterium avium
RYLIGQLRLSAPDRMRMLREF

SEQ ID NO: 14382 - protein, 25 aa, Mycobacterium avium
RYQQVIPMHECRSAKQLAAVIDQLL

SEQ ID NO: 14383 - protein, 18 aa, Mycobacterium avium
RYRVGHVVLVSRTGAQAA

SEQ ID NO: 14384 - protein, 18 aa, Mycobacterium avium
RYVLVPALVGLVLIAAFI

SEQ ID NO: 14385 - protein, 23 aa, Mycobacterium avium
RYWGPPAKPGLILFRRAGAPAAL

SEQ ID NO: 14386 - protein, 23 aa, Mycobacterium avium
SAAPARPKLADWVTLTITVAAGA

SEQ ID NO: 14387 - protein, 20 aa, Mycobacterium avium
SACIMVFVAVWFALRDTQRA

SEQ ID NO: 14388 - protein, 24 aa, Mycobacterium avium
SALVFVGFRASRKLPTERYPYGYE

SEQ ID NO: 14389 - protein, 20 aa, Mycobacterium avium
SAPVAPRITTEYVEVGGMTL

SEQ ID NO: 14390 - protein, 19 aa, Mycobacterium avium
SARFGWRRPQTLLVVGLVV

SEQ ID NO: 14391 - protein, 17 aa, Mycobacterium avium
SATEWWLGPEPDSPRLM

SEQ ID NO: 14392 - protein, 24 aa, Mycobacterium avium
SATTFPWVFLFPAGVLVLILVCAN

SEQ ID NO: 14393 - protein, 27 aa, Mycobacterium avium
SAVRAEIRWAFTPPRTWLMGVVANVIA

SEQ ID NO: 14394 - protein, 21 aa, Mycobacterium avium
SAYKIPRRFASLRRADVPLLS

SEQ ID NO: 14395 - protein, 26 aa, Mycobacterium avium
SAYLLAKVCVYTVFAIVQSAIVTTIA

SEQ ID NO: 14396 - protein, 19 aa, Mycobacterium avium
SAYPRPLPEPGPSANGTGR

SEQ ID NO: 14397 - protein, 18 aa, Mycobacterium avium
SDEFLDMDSGFGVPPDYG

SEQ ID NO: 14398 - protein, 17 aa, Mycobacterium avium
SDGSWTLLIRNRRTGEK

SEQ ID NO: 14399 - protein, 17 aa, Mycobacterium avium
SDLGDYDALLAVATTDR

SEQ ID NO: 14400 - protein, 19 aa, Mycobacterium avium
SDVCKHCTHAGCLDVCPTG

SEQ ID NO: 14401 - protein, 19 aa, Mycobacterium avium
SEAELLDWIHGAADANQPV

SEQ ID NO: 14402 - protein, 23 aa, Mycobacterium avium
SEALFKTCFYAVIAALAVAPLAL

SEQ ID NO: 14403 - protein, 22 aa, Mycobacterium avium
SEAPEFIIATIFASRGKGTTAI

SEQ ID NO: 14404 - protein, 21 aa, Mycobacterium avium
SEAVSALLLYIGKIGTFSQLG

SEQ ID NO: 14405 - protein, 25 aa, Mycobacterium avium
SELPAPRPIALGLFNAIPEAPSLSA

SEQ ID NO: 14406 - protein, 23 aa, Mycobacterium avium
SEPEPRWPKSPPQPKRAPGPERS

SEQ ID NO: 14407 - protein, 24 aa, Mycobacterium avium
SFFNIYFCSVTIKINGPAGSDILL

SEQ ID NO: 14408 - protein, 18 aa, Mycobacterium avium
SFGVLMLRIEETALGAVI

SEQ ID NO: 14409 - protein, 17 aa, Mycobacterium avium
SFLSLFAAMVFSALDHR

SEQ ID NO: 14410 - protein, 25 aa, Mycobacterium avium
SFLYMCASGSFIGFAFAFGQVIAHN

SEQ ID NO: 14411 - protein, 20 aa, Mycobacterium avium
SFPLQLPWLPLLAPLGALAI

SEQ ID NO: 14412 - protein, 21 aa, Mycobacterium avium
SGAALLAIIAFRGEVTALIQL

SEQ ID NO: 14413 - protein, 20 aa, Mycobacterium avium
SGAGTAWLYFKEYLPDKRTD

SEQ ID NO: 14414 - protein, 19 aa, Mycobacterium avium
SGAQWGYRMVLPQLILMPV

SEQ ID NO: 14415 - protein, 23 aa, Mycobacterium avium
SGATELLRALGISDPRELDVDRL

SEQ ID NO: 14416 - protein, 25 aa, Mycobacterium avium
SGFVVYRLHGIFGVHPGSFGGGTSG

SEQ ID NO: 14417 - protein, 26 aa, Mycobacterium avium
SGGFPRWFPSSLRRQLLFGVLAVVSV

SEQ ID NO: 14418 - protein, 21 aa, Mycobacterium avium
SGGFRAMYFPGMIAAVQGDTP

SEQ ID NO: 14419 - protein, 33 aa, Mycobacterium avium
SGLVGRSGLVYDMWGGAVSLAYQMHSGSPQPGI

SEQ ID NO: 14420 - protein, 19 aa, Mycobacterium avium
SGPFFKAIVANLLPYQVLQ

SEQ ID NO: 14421 - protein, 30 aa, Mycobacterium avium
SGPWLPARWRHWWWALLLAFVPIHLVVSAI

SEQ ID NO: 14422 - protein, 26 aa, Mycobacterium avium
SGSPLPIPWSVLSLFAKGPTLSRADA

SEQ ID NO: 14423 - protein, 27 aa, Mycobacterium avium
SGVFTRYVKPGLWPWLVTSAVVLIGLA

SEQ ID NO: 14424 - protein, 20 aa, Mycobacterium avium
SGYADRAGAMVPRAGSDVVH

SEQ ID NO: 14425 - protein, 25 aa, Mycobacterium avium
SGYLLAGTHSWRWMLGLACVPAVLL

SEQ ID NO: 14426 - protein, 17 aa, Mycobacterium avium
SHVAAPCHVYFEVAAGV

SEQ ID NO: 14427 - protein, 20 aa, Mycobacterium avium
SIDILVALRVKVASDQSQNE

SEQ ID NO: 14428 - protein, 17 aa, Mycobacterium avium
SIDWSAAFVDSLRWLAI

SEQ ID NO: 14429 - protein, 20 aa, Mycobacterium avium
SILIRGLMNYTFWVPNGSPE

SEQ ID NO: 14430 - protein, 36 aa, Mycobacterium avium
SIMACGYILASLHWYTWIAFSGWVLLALIFYFVWGR

SEQ ID NO: 14431 - protein, 17 aa, Mycobacterium avium
SIPLGGLPVPAPGQLPA

SEQ ID NO: 14432 - protein, 19 aa, Mycobacterium avium
SKPAFEVLAPFVVDGGPTV

SEQ ID NO: 14433 - protein, 21 aa, Mycobacterium avium
SLAAANARLGAPRTVEMASTH

SEQ ID NO: 14434 - protein, 17 aa, Mycobacterium avium
SLAFAMQAGCRFTAQLG

SEQ ID NO: 14435 - protein, 24 aa, Mycobacterium avium
SLFMAIAIAVTWMVYATLRRDVAG

SEQ ID NO: 14436 - protein, 17 aa, Mycobacterium avium
SLFSVALMAAMTLGAGT

SEQ ID NO: 14437 - protein, 18 aa, Mycobacterium avium
SLGGWVAFELERRGRARS

SEQ ID NO: 14438 - protein, 32 aa, Mycobacterium avium
SLLTAVVMGWVWSRWGRPEWITRALPASRAPA

SEQ ID NO: 14439 - protein, 24 aa, Mycobacterium avium
SLPDAKGALASWLPPGAAAVADYP

SEQ ID NO: 14440 - protein, 18 aa, Mycobacterium avium
SLTAFLAYFTQILMAVLM

SEQ ID NO: 14441 - protein, 27 aa, Mycobacterium avium
SLYRIGALCPYCMVVWVVTIALLVVVA

SEQ ID NO: 14442 - protein, 25 aa, Mycobacterium avium
SMLQRKLRVGFAKAGRLMDLMETRG

SEQ ID NO: 14443 - protein, 21 aa, Mycobacterium avium
SMSAHFTFGLALLAGLYVAAS

SEQ ID NO: 14444 - protein, 24 aa, Mycobacterium avium
SNRPEFLAVLLAIWRLAATAVLIS

SEQ ID NO: 14445 - protein, 18 aa, Mycobacterium avium
SNRRVVGVWVVFVLALAS

SEQ ID NO: 14446 - protein, 22 aa, Mycobacterium avium
SPCILPVLPVILLSGMDGDRRG

SEQ ID NO: 14447 - protein, 17 aa, Mycobacterium avium
SPIVGVMFSMFLLAFAG

SEQ ID NO: 14448 - protein, 17 aa, Mycobacterium avium
SPKKSWEGLAGSLVLGI

SEQ ID NO: 14449 - protein, 21 aa, Mycobacterium avium
SPPAGAWVDQALVLWVLIALV

SEQ ID NO: 14450 - protein, 21 aa, Mycobacterium avium
SPPELHSALLSSGPGPASLLA

SEQ ID NO: 14451 - protein, 19 aa, Mycobacterium avium
SPSRSALGYGGKLGVRDVL

SEQ ID NO: 14452 - protein, 17 aa, Mycobacterium avium
SPVRAGVVGAVLVPLRP

SEQ ID NO: 14453 - protein, 19 aa, Mycobacterium avium
SQLRPGGFPPALDRVIAKG

SEQ ID NO: 14454 - protein, 18 aa, Mycobacterium avium
SRESLFWVSDNGVRFGIA

SEQ ID NO: 14455 - protein, 19 aa, Mycobacterium avium
SRFAALGPRLVESTRKLGE

SEQ ID NO: 14456 - protein, 19 aa, Mycobacterium avium
SRGKWDTLRAMGFDDDHIG

SEQ ID NO: 14457 - protein, 22 aa, Mycobacterium avium
SRHFRRVVLVAAVMDGVVDWLR

SEQ ID NO: 14458 - protein, 19 aa, Mycobacterium avium
SRHHIWRITLRTLSKSWDD

SEQ ID NO: 14459 - protein, 20 aa, Mycobacterium avium
SRIDAGLPLELHDVDVAAVL

SEQ ID NO: 14460 - protein, 27 aa, Mycobacterium avium
SRLQTRAVWRLVNFLLEGVVFLLIGHQ

SEQ ID NO: 14461 - protein, 20 aa, Mycobacterium avium
SRLTSAWYRLPAPDDGHPLV

SEQ ID NO: 14462 - protein, 18 aa, Mycobacterium avium
SRMKITMENVGGRWLASK

SEQ ID NO: 14463 - protein, 22 aa, Mycobacterium avium
SRPHAPWARWRYSTQPEKMRRA

SEQ ID NO: 14464 - protein, 20 aa, Mycobacterium avium
SRPRARRRASRAAGPAKSES

SEQ ID NO: 14465 - protein, 27 aa, Mycobacterium avium
SRPRWSRRRLFVVIALAVMLVLAGLTV

SEQ ID NO: 14466 - protein, 27 aa, Mycobacterium avium
SRRRLRRRLSGGLLLLIALTIAGGLAA

SEQ ID NO: 14467 - protein, 36 aa, Mycobacterium avium
SRVKRPLIPRMVRAFAIPIIFFWGLLAVTTNTFMPQ

SEQ ID NO: 14468 - protein, 19 aa, Mycobacterium avium
SSAVGFLCVVMARVAPNTV

SEQ ID NO: 14469 - protein, 18 aa, Mycobacterium avium
SSDFLLPGILAVTAVCST

SEQ ID NO: 14470 - protein, 26 aa, Mycobacterium avium
SSLRLWPDRRLSRRGVEIVSRRAPRG

SEQ ID NO: 14471 - protein, 19 aa, Mycobacterium avium
SSLVEMLRGTDSWTPYVAP

SEQ ID NO: 14472 - protein, 17 aa, Mycobacterium avium
SSPLGGLLAVAALLLIT

SEQ ID NO: 14473 - protein, 21 aa, Mycobacterium avium
SSTPAFGAFMLCYVAAAALTW

SEQ ID NO: 14474 - protein, 26 aa, Mycobacterium avium
SSWFHAAGPVGAWVDTALRTFIGAGV

SEQ ID NO: 14475 - protein, 24 aa, Mycobacterium avium
SSYPRLIRVAMMYNDKIGYGPTVR

SEQ ID NO: 14476 - protein, 20 aa, Mycobacterium avium
STAYLLAKIVVFCVFAVAQA

SEQ ID NO: 14477 - protein, 23 aa, Mycobacterium avium
STFAVNLLVALAMAAGTDYAIFF

SEQ ID NO: 14478 - protein, 20 aa, Mycobacterium avium
STGLPARLLPVALSVAGIGV

SEQ ID NO: 14479 - protein, 18 aa, Mycobacterium avium
STRSRFEHRAVIVGADGA

SEQ ID NO: 14480 - protein, 17 aa, Mycobacterium avium
STVQCYYGFYAAGGPEG

SEQ ID NO: 14481 - protein, 26 aa, Mycobacterium avium
SVISWVSVVIIGIWVMLQIASILQFS

SEQ ID NO: 14482 - protein, 24 aa, Mycobacterium avium
SVLAWDGQIAWWLDMVVFGIYQVT

SEQ ID NO: 14483 - protein, 17 aa, Mycobacterium avium
SVLCRRVQTPADIALAL

SEQ ID NO: 14484 - protein, 19 aa, Mycobacterium avium
SVLCYRYLDAKAEDRLDRG

SEQ ID NO: 14485 - protein, 24 aa, Mycobacterium avium
SVLIRRPLVGYAWSWAGGRGDGWR

SEQ ID NO: 14486 - protein, 25 aa, Mycobacterium avium
SVNALVPFYAIGVFTGFAMAGYGMT

SEQ ID NO: 14487 - protein, 24 aa, Mycobacterium avium
SVPNDWPTQRLVGGPGSARVQVTS

SEQ ID NO: 14488 - protein, 31 aa, Mycobacterium avium
SVPRQGRLSGLTRWGPWLSLGSAALCGVGAL

SEQ ID NO: 14489 - protein, 24 aa, Mycobacterium avium
SVSAEFVLGLALALVMHRTLVGKG

SEQ ID NO: 14490 - protein, 23 aa, Mycobacterium avium
SVSSFGEFEFWFAGIKVATIVIF

SEQ ID NO: 14491 - protein, 23 aa, Mycobacterium avium
SVSYLDVCDQILLIAPGGKTAFC

SEQ ID NO: 14492 - protein, 21 aa, Mycobacterium avium
SVWGILSWILILLLPAGTLHY

SEQ ID NO: 14493 - protein, 19 aa, Mycobacterium avium
SWIGFSFAFGQVMQVNFLE

SEQ ID NO: 14494 - protein, 19 aa, Mycobacterium avium
SYGGPVPGPPGQRPSGNRV

SEQ ID NO: 14495 - protein, 18 aa, Mycobacterium avium
SYLDVCDQVLLMAPGGKT

SEQ ID NO: 14496 - protein, 20 aa, Mycobacterium avium
SYLSRVMRTAADWANVLINM

SEQ ID NO: 14497 - protein, 25 aa, Mycobacterium avium
SYSWYLWHWPVLLLMPALLGEPAGL

SEQ ID NO: 14498 - protein, 31 aa, Mycobacterium avium
SYVRISTELPRTVTFKVLKRQLAAQGVDCGD

SEQ ID NO: 14499 - protein, 17 aa, Mycobacterium avium
TAAGLVFNKVFFPNESS

SEQ ID NO: 14500 - protein, 17 aa, Mycobacterium avium
TAALYVRVGDDLHPVLN

SEQ ID NO: 14501 - protein, 25 aa, Mycobacterium avium
TADDRLFCNSPFFWIGGFAFGLLAT

SEQ ID NO: 14502 - protein, 24 aa, Mycobacterium avium
TADIYPRYTCDYGTPRRPSSSADY

SEQ ID NO: 14503 - protein, 31 aa, Mycobacterium avium
TAELLEGIEIIPPRYIEYRGGRFPELDVPAV

SEQ ID NO: 14504 - protein, 18 aa, Mycobacterium avium
TAHELRSPLTAMRTNLEV

SEQ ID NO: 14505 - protein, 19 aa, Mycobacterium avium
TAILWKLSGDLNLFGLVLP

SEQ ID NO: 14506 - protein, 20 aa, Mycobacterium avium
TAKEFGRRGANVALLARGAA

SEQ ID NO: 14507 - protein, 22 aa, Mycobacterium avium
TALCGYAVIYLAARDLAPSGFS

SEQ ID NO: 14508 - protein, 23 aa, Mycobacterium avium
TALRELALLWLADQVDTALAKYR

SEQ ID NO: 14509 - protein, 23 aa, Mycobacterium avium
TAPEVPAAFDAVIARGMAKDPER

SEQ ID NO: 14510 - protein, 17 aa, Mycobacterium avium
TAQPSGLLDVIWSPIAL

SEQ ID NO: 14511 - protein, 25 aa, Mycobacterium avium
TARSPRTGMALSIAALVPIGAALAL

SEQ ID NO: 14512 - protein, 20 aa, Mycobacterium avium
TASALVFKPLFFPNISPSAG

SEQ ID NO: 14513 - protein, 17 aa, Mycobacterium avium
TASRMLFVLAERGEAPA

SEQ ID NO: 14514 - protein, 20 aa, Mycobacterium avium
TAVFCGFAVLQSAIVTAIVV

SEQ ID NO: 14515 - protein, 25 aa, Mycobacterium avium
TAWLKQYTQNFAWPVSKDLNPGGWP

SEQ ID NO: 14516 - protein, 17 aa, Mycobacterium avium
TAWMPFDNGLRPEPIIA

SEQ ID NO: 14517 - protein, 18 aa, Mycobacterium avium
TCFAFFFIGGLMALLMRT

SEQ ID NO: 14518 - protein, 25 aa, Mycobacterium avium
TDAVPFPSFKQGEGLILQLPSPTVV

SEQ ID NO: 14519 - protein, 20 aa, Mycobacterium avium
TDEGRRWMAAAGIALAVAAA

SEQ ID NO: 14520 - protein, 19 aa, Mycobacterium avium
TDPAIRFVVLALLAVDGVL

SEQ ID NO: 14521 - protein, 28 aa, Mycobacterium avium
TDPLTGLLNRAGWEIATADLLSRTRSAT

SEQ ID NO: 14522 - protein, 20 aa, Mycobacterium avium
TEFFSRLPSALAVGAAAAGV

SEQ ID NO: 14523 - protein, 20 aa, Mycobacterium avium
TEGACGFAVVAGTRVLLDGF

SEQ ID NO: 14524 - protein, 26 aa, Mycobacterium avium
TELPARRWELPVLRWVDGGRGNRRVI

SEQ ID NO: 14525 - protein, 22 aa, Mycobacterium avium
TEPGLVLRGFVERVGDRAPLVA

SEQ ID NO: 14526 - protein, 21 aa, Mycobacterium avium
TEPVAVVGMGCRYPGGVDSPE

SEQ ID NO: 14527 - protein, 21 aa, Mycobacterium avium
TFLTVEAWAFLQLGARQQSGD

SEQ ID NO: 14528 - protein, 22 aa, Mycobacterium avium
TFVVPYPPGFPVLVPGQVVSKE

SEQ ID NO: 14529 - protein, 31 aa, Mycobacterium avium
TGAAAWLHAAVWWKALLALVVAVAMTVGVNY

SEQ ID NO: 14530 - protein, 24 aa, Mycobacterium avium
TGAITGQVGRLWGLTSALMTDDRT

SEQ ID NO: 14531 - protein, 17 aa, Mycobacterium avium
TGASCPPGVVGELVNTA

SEQ ID NO: 14532 - protein, 18 aa, Mycobacterium avium
TGDKRAAPKLGIDLQGGT

SEQ ID NO: 14533 - protein, 17 aa, Mycobacterium avium
TGFICHVGWEVTADIAH

SEQ ID NO: 14534 - protein, 20 aa, Mycobacterium avium
TGFLRLGSTVGHVVVSGTVA

SEQ ID NO: 14535 - protein, 22 aa, Mycobacterium avium
TGGRRRARHSGADEAWDGMPVE

SEQ ID NO: 14536 - protein, 20 aa, Mycobacterium avium
TGLFRTVYVLPWICAPLAIA

SEQ ID NO: 14537 - protein, 31 aa, Mycobacterium avium
TGPAAFLGFGWRIPFLLSIFLVAVGLFVRLR

SEQ ID NO: 14538 - protein, 24 aa, Mycobacterium avium
TGPEEPDMALARGAALASANAPLF

SEQ ID NO: 14539 - protein, 17 aa, Mycobacterium avium
TGQGRPASVATQLLLGP

SEQ ID NO: 14540 - protein, 23 aa, Mycobacterium avium
TGRAVSFVAPWLFSVFVDAFGAV

SEQ ID NO: 14541 - protein, 26 aa, Mycobacterium avium
TGSNRLLMGLGWPVVVLVSIVVARRS

SEQ ID NO: 14542 - protein, 23 aa, Mycobacterium avium
TGSRWEMDPTLLVSAEVTSQNPF

SEQ ID NO: 14543 - protein, 17 aa, Mycobacterium avium
TGVECCGYLLAVDVDMN

SEQ ID NO: 14544 - protein, 20 aa, Mycobacterium avium
TGVGWTGYHTALGRIIISHA

SEQ ID NO: 14545 - protein, 27 aa, Mycobacterium avium
THMDDRKIHLVIARRPLAALGAGVAAL

SEQ ID NO: 14546 - protein, 26 aa, Mycobacterium avium
TIRRLSVPILLVWVAVAAISNIAVPN

SEQ ID NO: 14547 - protein, 20 aa, Mycobacterium avium
TIVACGLAALFLASSLYSTA

SEQ ID NO: 14548 - protein, 25 aa, Mycobacterium avium
TKIRGRLPALLGLALLEAVVVAAIA

SEQ ID NO: 14549 - protein, 24 aa, Mycobacterium avium
TKRPAARRRPVVLLRPVPGSSPIH

SEQ ID NO: 14550 - protein, 21 aa, Mycobacterium avium
TKSLPCHAGYLSVSGKDNTVT

SEQ ID NO: 14551 - protein, 18 aa, Mycobacterium avium
TLALAVAVPAGWVQLHVV

SEQ ID NO: 14552 - protein, 17 aa, Mycobacterium avium
TLALFGYAAIYAYLAPW

SEQ ID NO: 14553 - protein, 19 aa, Mycobacterium avium
TLATIKTNLVWAFGYNLAA

SEQ ID NO: 14554 - protein, 25 aa, Mycobacterium avium
TLIFDAGICLVLFALPAMALTIALL

SEQ ID NO: 14555 - protein, 32 aa, Mycobacterium avium
TLISVPRRVRRVFMVLGGLVSVVGLVLSACTV

SEQ ID NO: 14556 - protein, 24 aa, Mycobacterium avium
TLLLEPMAGLALFLVVTACVAGAK

SEQ ID NO: 14557 - protein, 18 aa, Mycobacterium avium
TLPPGWKPGSQAVAPPKL

SEQ ID NO: 14558 - protein, 22 aa, Mycobacterium avium
TLSESFLQRWILPLSNAGIFLA

SEQ ID NO: 14559 - protein, 31 aa, Mycobacterium avium
TLSLAAGWRSWRWRLLWLPSAAVLGVTTAVG

SEQ ID NO: 14560 - protein, 25 aa, Mycobacterium avium
TMREALRVRAYRSALLSNFATGWSA

SEQ ID NO: 14561 - protein, 25 aa, Mycobacterium avium
TMREARAGDRYLLCSDGLSDPVSDE

SEQ ID NO: 14562 - protein, 27 aa, Mycobacterium avium
TNYWVMSHMLPLFRRMQALIDGVNRVM

SEQ ID NO: 14563 - protein, 18 aa, Mycobacterium avium
TPAPYGPLFLWIGRGISA

SEQ ID NO: 14564 - protein, 24 aa, Mycobacterium avium
TPDRVDAVLRAKVDGAWNLHELTK

SEQ ID NO: 14565 - protein, 19 aa, Mycobacterium avium
TPNAGLRLAVMGLVAVVAV

SEQ ID NO: 14566 - protein, 20 aa, Mycobacterium avium
TPPAIRRWGRYATANGALAA

SEQ ID NO: 14567 - protein, 19 aa, Mycobacterium avium
TPTKVRMVLVEGESADGVT

SEQ ID NO: 14568 - protein, 18 aa, Mycobacterium avium
TQRFGLGRDDVCYVSMPL

SEQ ID NO: 14569 - protein, 17 aa, Mycobacterium avium
TRFPLIIQNTHRYFFYI

SEQ ID NO: 14570 - protein, 19 aa, Mycobacterium avium
TRIGQDVAELLRRSETLVN

SEQ ID NO: 14571 - protein, 18 aa, Mycobacterium avium
TRLGVCTVPVSLLVAVLA

SEQ ID NO: 14572 - protein, 23 aa, Mycobacterium avium
TRLTLITLIPIVAFMTVGGPAMG

SEQ ID NO: 14573 - protein, 20 aa, Mycobacterium avium
TRNRTVLVIAHRLHTITRAD

SEQ ID NO: 14574 - protein, 21 aa, Mycobacterium avium
TRPSTFLWLIAAVGTLLVVAG

SEQ ID NO: 14575 - protein, 18 aa, Mycobacterium avium
TRQLERPVALLAGIGDHA

SEQ ID NO: 14576 - protein, 23 aa, Mycobacterium avium
TRSPRLVALPLWTWLLTVAVISM

SEQ ID NO: 14577 - protein, 25 aa, Mycobacterium avium
TSAALLTWRLLRPSWGEWRTAGAAA

SEQ ID NO: 14578 - protein, 17 aa, Mycobacterium avium
TSRWKRWLYSIAAIPGY

SEQ ID NO: 14579 - protein, 25 aa, Mycobacterium avium
TSSYRRPLLGTGFCGGLTTFSTMQV

SEQ ID NO: 14580 - protein, 24 aa, Mycobacterium avium
TSVPMLFAKPSYYGQFTDSGGINT

SEQ ID NO: 14581 - protein, 17 aa, Mycobacterium avium
TSVVIGLMLQNSVGQIV

SEQ ID NO: 14582 - protein, 20 aa, Mycobacterium avium
TTAALGLSLLALWLLTRATG

SEQ ID NO: 14583 - protein, 18 aa, Mycobacterium avium
TTAGWKTLALFGYAAIYA

SEQ ID NO: 14584 - protein, 19 aa, Mycobacterium avium
TTAIRCHRGGREAPFAELT

SEQ ID NO: 14585 - protein, 19 aa, Mycobacterium avium
TTAQPGYPHYFGGGYHNGI

SEQ ID NO: 14586 - protein, 18 aa, Mycobacterium avium
TTGLRLSQIGLFVLLTTY

SEQ ID NO: 14587 - protein, 18 aa, Mycobacterium avium
TTHIQRFALAAVIAVALL

SEQ ID NO: 14588 - protein, 20 aa, Mycobacterium avium
TTLLEDWRDNLRWPPASALV

SEQ ID NO: 14589 - protein, 18 aa, Mycobacterium avium
TTMVRSSLWIGVAVVAVL

SEQ ID NO: 14590 - protein, 24 aa, Mycobacterium avium
TTPLRRLDLLIAYGTAFSIAAAAQ

SEQ ID NO: 14591 - protein, 20 aa, Mycobacterium avium
TTPYYARMHKWIKRAVLVCL

SEQ ID NO: 14592 - protein, 28 aa, Mycobacterium avium
TTSIRSGLAVPRPLPAVIGEATQAAQTG

SEQ ID NO: 14593 - protein, 25 aa, Mycobacterium avium
TVATACPFCRVMVTDGVNDRQEEAG

SEQ ID NO: 14594 - protein, 23 aa, Mycobacterium avium
TVCVSWLPFYHDMGLVQGVIAPI

SEQ ID NO: 14595 - protein, 23 aa, Mycobacterium avium
TVELPINLRSGLLTVTQGERTIA

SEQ ID NO: 14596 - protein, 17 aa, Mycobacterium avium
TVFAEHMHRCARALAEH

SEQ ID NO: 14597 - protein, 19 aa, Mycobacterium avium
TVFSMRVAAAIGFLQMKRW

SEQ ID NO: 14598 - protein, 18 aa, Mycobacterium avium
TVFSRSGVGAVLLQAVSS

SEQ ID NO: 14599 - protein, 19 aa, Mycobacterium avium
TVLLTRGRHTNVSQEDQVR

SEQ ID NO: 14600 - protein, 17 aa, Mycobacterium avium
TVLPFSWQGVALHASGA

SEQ ID NO: 14601 - protein, 26 aa, Mycobacterium avium
TVPMTTEWIHVPLLPVPIPVPVPQKQ

SEQ ID NO: 14602 - protein, 25 aa, Mycobacterium avium
TVQRWKAIRGEAGWMTTYAYPPQAI

SEQ ID NO: 14603 - protein, 24 aa, Mycobacterium avium
TVVHLRLSLVPVLIGLAIALPLGM

SEQ ID NO: 14604 - protein, 20 aa, Mycobacterium avium
TVYVLPWICAPLAIAVLWRW

SEQ ID NO: 14605 - protein, 25 aa, Mycobacterium avium
TWMIARVSLVPTLLVSIPFTVLVAF

SEQ ID NO: 14606 - protein, 24 aa, Mycobacterium avium
TYREIRPAHQVRWTVLLDGPVRIS

SEQ ID NO: 14607 - protein, 23 aa, Mycobacterium avium
TYSSIGIWAPILLVIARIFQGLS

SEQ ID NO: 14608 - protein, 18 aa, Mycobacterium avium
TYSYWFEPNPGWSRLFAP

SEQ ID NO: 14609 - protein, 26 aa, Mycobacterium avium
VAAAIAVAVGAIWLGRRLLHGRQQNP

SEQ ID NO: 14610 - protein, 26 aa, Mycobacterium avium
VAAFLAVTGVRGWLVARRVERRIILL

SEQ ID NO: 14611 - protein, 24 aa, Mycobacterium avium
VAAFRTVPSLAWVPLLLLWFGIDE

SEQ ID NO: 14612 - protein, 21 aa, Mycobacterium avium
VAAPCHVYFEVAAGVTLFVLA

SEQ ID NO: 14613 - protein, 18 aa, Mycobacterium avium
VAAVLSWIILGQRPDQGV

SEQ ID NO: 14614 - protein, 29 aa, Mycobacterium avium
VAAVPRGPSRLGRGWLAAIAAVLVLCAAG

SEQ ID NO: 14615 - protein, 17 aa, Mycobacterium avium
VACGIALGAGVAAVARR

SEQ ID NO: 14616 - protein, 22 aa, Mycobacterium avium
VACSIGATLGNGGWATLLNSAK

SEQ ID NO: 14617 - protein, 24 aa, Mycobacterium avium
VADRLPGVRLDWFTAEHTATARQA

SEQ ID NO: 14618 - protein, 20 aa, Mycobacterium avium
VAEALGIGSPGSRVIAAAAF

SEQ ID NO: 14619 - protein, 20 aa, Mycobacterium avium
VAFVVLVTFLLPALRDGAPA

SEQ ID NO: 14620 - protein, 44 aa, Mycobacterium avium
VAGCLPAVIWWACHRPNRLWWRYTGWWLVALVLATLWWVVGLVM

SEQ ID NO: 14621 - protein, 24 aa, Mycobacterium avium
VAGDGPFWRRLLSPAGFTAVSHVF

SEQ ID NO: 14622 - protein, 25 aa, Mycobacterium avium
VAGGSFRRWERLMFLLIAVNVLIFP

SEQ ID NO: 14623 - protein, 27 aa, Mycobacterium avium
VAGLLKRRWPAVVVFILLVVFSALVAY

SEQ ID NO: 14624 - protein, 17 aa, Mycobacterium avium
VAGRGLWSAALQLASAL

SEQ ID NO: 14625 - protein, 17 aa, Mycobacterium avium
VALALGFLGCPKIVAVP

SEQ ID NO: 14626 - protein, 17 aa, Mycobacterium avium
VALGVVFPLYLNTFSAI

SEQ ID NO: 14627 - protein, 24 aa, Mycobacterium avium
VALILALRFHRSAALALLALFVVQ

SEQ ID NO: 14628 - protein, 21 aa, Mycobacterium avium
VALRGVRIGRIESLQITDNGV

SEQ ID NO: 14629 - protein, 17 aa, Mycobacterium avium
VALVRWGPYQLSMVGTG

SEQ ID NO: 14630 - protein, 27 aa, Mycobacterium avium
VAPKAPWIPQSSFRPSFGGNVGPVGSQ

SEQ ID NO: 14631 - protein, 27 aa, Mycobacterium avium
VAQRWASPFWQFWDLALLWLAQLHGGN

SEQ ID NO: 14632 - protein, 40 aa, Mycobacterium avium
VARVKRLLDRIAAYERYWLYPGAENLAIFRAHLESLSTVR

SEQ ID NO: 14633 - protein, 23 aa, Mycobacterium avium
VASHELRTPLTAMRTNLEVLSTL

SEQ ID NO: 14634 - protein, 19 aa, Mycobacterium avium
VASLCWVLVFAARFVVQGL

SEQ ID NO: 14635 - protein, 21 aa, Mycobacterium avium
VASVLPVWLLLAPRDYLSTFM

SEQ ID NO: 14636 - protein, 17 aa, Mycobacterium avium
VATIAGLIGFVLSVATP

SEQ ID NO: 14637 - protein, 23 aa, Mycobacterium avium
VAVAVGAIVLWPSRQHVDIPMPL

SEQ ID NO: 14638 - protein, 25 aa, Mycobacterium avium
VAVWLGRPLIWLSFNNEKLNAAFRY

SEQ ID NO: 14639 - protein, 25 aa, Mycobacterium avium
VAVWRGRRPGPLVAEELPVVVRASE

SEQ ID NO: 14640 - protein, 21 aa, Mycobacterium avium
VAWGVLIGFVALYLIGSLAGF

SEQ ID NO: 14641 - protein, 25 aa, Mycobacterium avium
VCCVLSFVVGFAMLGAMTFLPTYMQ

SEQ ID NO: 14642 - protein, 17 aa, Mycobacterium avium
VDCAAPHAMEVTGTVNL

SEQ ID NO: 14643 - protein, 17 aa, Mycobacterium avium
VDGELILFWTLPVALVL

SEQ ID NO: 14644 - protein, 17 aa, Mycobacterium avium
VDHWLNVLFVTLIIRSG

SEQ ID NO: 14645 - protein, 27 aa, Mycobacterium avium
VDKLYTDRHIRLWVVYVDTFSGQTATR

SEQ ID NO: 14646 - protein, 25 aa, Mycobacterium avium
VDLAAPWFIGAAMGLQVLGTFSVGQ

SEQ ID NO: 14647 - protein, 18 aa, Mycobacterium avium
VDLARGYLAIALPVGTLG

SEQ ID NO: 14648 - protein, 24 aa, Mycobacterium avium
VDNKVGYGLVDPVAALTFNIPPGD

SEQ ID NO: 14649 - protein, 22 aa, Mycobacterium avium
VDNPRYVIGIMMDNPERNADGT

SEQ ID NO: 14650 - protein, 23 aa, Mycobacterium avium
VDRGLGWKTLRDAGPVVFMNGHY

SEQ ID NO: 14651 - protein, 18 aa, Mycobacterium avium
VDVPRRLGSRPAAMARPA

SEQ ID NO: 14652 - protein, 22 aa, Mycobacterium avium
VEAGFWGKLVNWVMRKPLAFAI

SEQ ID NO: 14653 - protein, 33 aa, Mycobacterium avium
VEAMARAVGYGAPITIAVPAYWSDDQFAALREE

SEQ ID NO: 14654 - protein, 19 aa, Mycobacterium avium
VEGMLARIGKEQQRTKAAL

SEQ ID NO: 14655 - protein, 21 aa, Mycobacterium avium
VEGRVALSVPNDWPTQRLVGG

SEQ ID NO: 14656 - protein, 30 aa, Mycobacterium avium
VEGVGLWLLKRWGEYFAVIATSVFLPLEIH

SEQ ID NO: 14657 - protein, 22 aa, Mycobacterium avium
VEGVLINFWLLRRDSVSLGTDD

SEQ ID NO: 14658 - protein, 19 aa, Mycobacterium avium
VEHKPRLARTIRVLALPIV

SEQ ID NO: 14659 - protein, 18 aa, Mycobacterium avium
VEIGKQLLITRGALTTFS

SEQ ID NO: 14660 - protein, 27 aa, Mycobacterium avium
VEIWRSVRALPDFWRLLQVRVASQFGD

SEQ ID NO: 14661 - protein, 29 aa, Mycobacterium avium
VELFAGLLRSQRWWWGAVLLLASIGLQAA

SEQ ID NO: 14662 - protein, 22 aa, Mycobacterium avium
VEPRLWNMSTVLPILQDTTIVA

SEQ ID NO: 14663 - protein, 27 aa, Mycobacterium avium
VFAYARRLLRRWRHDVLTANAISLATP

SEQ ID NO: 14664 - protein, 20 aa, Mycobacterium avium
VFEGGHRLTSTGVTWTDPTG

SEQ ID NO: 14665 - protein, 17 aa, Mycobacterium avium
VFFGLPLLLAAIVLMQV

SEQ ID NO: 14666 - protein, 18 aa, Mycobacterium avium
VFGNPGAVATINYVDINV

SEQ ID NO: 14667 - protein, 18 aa, Mycobacterium avium
VFVGFAFAGMPLVAEIGV

SEQ ID NO: 14668 - protein, 20 aa, Mycobacterium avium
VGAKLRFNYDDSLDVVGVHF

SEQ ID NO: 14669 - protein, 23 aa, Mycobacterium avium
VGALAGGVAVLFVQQRDAQAKQS

SEQ ID NO: 14670 - protein, 24 aa, Mycobacterium avium
VGASLVGWWALSRVLERLRGIPDV

SEQ ID NO: 14671 - protein, 18 aa, Mycobacterium avium
VGAVKVAPAHYGVFSAIP

SEQ ID NO: 14672 - protein, 20 aa, Mycobacterium avium
VGAVYFGSRTGMGFGRDLRA

SEQ ID NO: 14673 - protein, 26 aa, Mycobacterium avium
VGDGDRAHWDWLKWLPHNRHPTHDDA

SEQ ID NO: 14674 - protein, 19 aa, Mycobacterium avium
VGFAAIVFLVVRYVVPPVR

SEQ ID NO: 14675 - protein, 24 aa, Mycobacterium avium
VGFALAFLVARSFSSGCAALTGVE

SEQ ID NO: 14676 - protein, 25 aa, Mycobacterium avium
VGGIVALAWALAFIRPHADKRPEVG

SEQ ID NO: 14677 - protein, 17 aa, Mycobacterium avium
VGHCGDFYTAGPGNQLL

SEQ ID NO: 14678 - protein, 24 aa, Mycobacterium avium
VGKPVAGCPVRILDRNNRPVGPRV

SEQ ID NO: 14679 - protein, 24 aa, Mycobacterium avium
VGKSYCRCGGFLTGVGDFDAAFFG

SEQ ID NO: 14680 - protein, 21 aa, Mycobacterium avium
VGLAGIPLVGWLAEVSGTTTA

SEQ ID NO: 14681 - protein, 28 aa, Mycobacterium avium
VGNRGTWLVRRFRVAAEGIADDEVAPAD

SEQ ID NO: 14682 - protein, 18 aa, Mycobacterium avium
VGRRLPLMVDVMFYSVVG

SEQ ID NO: 14683 - protein, 18 aa, Mycobacterium avium
VGSMFGPYHLKRLLGRGG

SEQ ID NO: 14684 - protein, 17 aa, Mycobacterium avium
VGTLGLWLESLWISAVY

SEQ ID NO: 14685 - protein, 18 aa, Mycobacterium avium
VGVGQSFTSVPMLFATPT

SEQ ID NO: 14686 - protein, 17 aa, Mycobacterium avium
VGVVRLGQRRCLVQELP

SEQ ID NO: 14687 - protein, 17 aa, Mycobacterium avium
VHHFGLFAAVGAAMAAL

SEQ ID NO: 14688 - protein, 18 aa, Mycobacterium avium
VHNFVDWRLRVGGLVENP

SEQ ID NO: 14689 - protein, 25 aa, Mycobacterium avium
VHRSEILLADALRALAYAATGGRAL

SEQ ID NO: 14690 - protein, 21 aa, Mycobacterium avium
VHTRDMSRWVSVRMPEISVVN

SEQ ID NO: 14691 - protein, 19 aa, Mycobacterium avium
VIAGGVGVWLVIRPKPEPP

SEQ ID NO: 14692 - protein, 19 aa, Mycobacterium avium
VIDILPYVVVHGIGTAILV

SEQ ID NO: 14693 - protein, 19 aa, Mycobacterium avium
VIDRILIGACAAIYLALLG

SEQ ID NO: 14694 - protein, 26 aa, Mycobacterium avium
VIELPPGYLPLRIPIEVNFTQRVAVD

SEQ ID NO: 14695 - protein, 32 aa, Mycobacterium avium
VILCGPGRYGLDARRGWAHRPFIGSFVALLAG

SEQ ID NO: 14696 - protein, 22 aa, Mycobacterium avium
VILQHSWPLTGRKVHPPYDQLF

SEQ ID NO: 14697 - protein, 21 aa, Mycobacterium avium
VIPARWSLVAVCVVVVAAASR

SEQ ID NO: 14698 - protein, 22 aa, Mycobacterium avium
VIRLHWPALMPLGYLNLAVWLI

SEQ ID NO: 14699 - protein, 18 aa, Mycobacterium avium
VIVVPVLVALLLSALLVP

SEQ ID NO: 14700 - protein, 17 aa, Mycobacterium avium
VKFEVIGKFIGGMPLLL

SEQ ID NO: 14701 - protein, 18 aa, Mycobacterium avium
VKGLGIAAGAKRPGAKKA

SEQ ID NO: 14702 - protein, 21 aa, Mycobacterium avium
VLAGLRPGERVLVHTATGGVG

SEQ ID NO: 14703 - protein, 28 aa, Mycobacterium avium
VLAIAAWLAVLVCADFILLQVVTGAWTW

SEQ ID NO: 14704 - protein, 29 aa, Mycobacterium avium
VLAVRPELLPALSGQNWAALPGLQTNPNA

SEQ ID NO: 14705 - protein, 18 aa, Mycobacterium avium
VLAVVWFFLLKRYTVEGP

SEQ ID NO: 14706 - protein, 21 aa, Mycobacterium avium
VLCAITHGLLWSVIAPIATRL

SEQ ID NO: 14707 - protein, 35 aa, Mycobacterium avium
VLDLEPRGPLPTEIYWRRRGLAVGIAVVVIGVVAA

SEQ ID NO: 14708 - protein, 25 aa, Mycobacterium avium
VLDVPQPLAYCLPGVRSRVVVSEGT

SEQ ID NO: 14709 - protein, 19 aa, Mycobacterium avium
VLERVAPPHPSRWRHVPTI

SEQ ID NO: 14710 - protein, 17 aa, Mycobacterium avium
VLEYGRPGPGGDIVPAG

SEQ ID NO: 14711 - protein, 18 aa, Mycobacterium avium
VLFLPYSLLGPFAGALMD

SEQ ID NO: 14712 - protein, 23 aa, Mycobacterium avium
VLGIRTGRLGAWARTAVVAVATW

SEQ ID NO: 14713 - protein, 20 aa, Mycobacterium avium
VLGLCGGVSWQGHLCGAIAG

SEQ ID NO: 14714 - protein, 26 aa, Mycobacterium avium
VLGLIGVALGWGWADAVAGIVVTGFI

SEQ ID NO: 14715 - protein, 20 aa, Mycobacterium avium
VLGTVWGMRSLHELGVRTPG

SEQ ID NO: 14716 - protein, 17 aa, Mycobacterium avium
VLIAGPLGLCFLPAFVC

SEQ ID NO: 14717 - protein, 17 aa, Mycobacterium avium
VLITKFAAGAWIALFAM

SEQ ID NO: 14718 - protein, 23 aa, Mycobacterium avium
VLLSVRLSVLLSFQSNDLYTALQ

SEQ ID NO: 14719 - protein, 26 aa, Mycobacterium avium
VLLWQYILGLKLHWMVLAMAVILLLA

SEQ ID NO: 14720 - protein, 23 aa, Mycobacterium avium
VLMLGQCRVLFAMARDGLLPRAL

SEQ ID NO: 14721 - protein, 17 aa, Mycobacterium avium
VLSWTVVVPVLAVVVLA

SEQ ID NO: 14722 - protein, 23 aa, Mycobacterium avium
VLVAELTAGFALTVPIVTATSAL

SEQ ID NO: 14723 - protein, 23 aa, Mycobacterium avium
VLVLCAAGIGAGGYLALRYHHES

SEQ ID NO: 14724 - protein, 26 aa, Mycobacterium avium
VLVLGWRTARRWRRGAAVLAVPLCLL

SEQ ID NO: 14725 - protein, 26 aa, Mycobacterium avium
VMVAALAGLSGWLGYRAYQQHDAQAR

SEQ ID NO: 14726 - protein, 23 aa, Mycobacterium avium
VMVSLAELWRSVGVVPDAVIGHS

SEQ ID NO: 14727 - protein, 26 aa, Mycobacterium avium
VMWIGYRHGWGWLARMDWSLLNGTRD

SEQ ID NO: 14728 - protein, 18 aa, Mycobacterium avium
VNALRALLIGTPFNPVDI

SEQ ID NO: 14729 - protein, 18 aa, Mycobacterium avium
VNFDYRVFALLIFLNALG

SEQ ID NO: 14730 - protein, 19 aa, Mycobacterium avium
VNIGLAYGIHVVITTPSWL

SEQ ID NO: 14731 - protein, 19 aa, Mycobacterium avium
VPAAIMLWLLLRLPESPRW

SEQ ID NO: 14732 - protein, 19 aa, Mycobacterium avium
VPARVNAVVMFQVTDPRKA

SEQ ID NO: 14733 - protein, 17 aa, Mycobacterium avium
VPDPNTPTGSRWEMDPT

SEQ ID NO: 14734 - protein, 23 aa, Mycobacterium avium
VPEARAALDAVRFRITGRGPRPR

SEQ ID NO: 14735 - protein, 18 aa, Mycobacterium avium
VPEPVLPHEDWVLTRPRL

SEQ ID NO: 14736 - protein, 27 aa, Mycobacterium avium
VPHTPEFRWLMSSDVCKHCTHAGCLDV

SEQ ID NO: 14737 - protein, 20 aa, Mycobacterium avium
VPLAAGFMALVFIASMVAGI

SEQ ID NO: 14738 - protein, 23 aa, Mycobacterium avium
VPLPLAIQAPRLFAGEIAFGDVT

SEQ ID NO: 14739 - protein, 21 aa, Mycobacterium avium
VPLSLLATRVIVRRSQRLFVA

SEQ ID NO: 14740 - protein, 18 aa, Mycobacterium avium
VPPKQFWREFDIPREVKK

SEQ ID NO: 14741 - protein, 26 aa, Mycobacterium avium
VPQLDAGPFLSYGIQWIAFGILAPIG

SEQ ID NO: 14742 - protein, 18 aa, Mycobacterium avium
VPVSIALLLSWRFAPRAL

SEQ ID NO: 14743 - protein, 23 aa, Mycobacterium avium
VQEMTVRLGIVTGRGHGSLIRER

SEQ ID NO: 14744 - protein, 18 aa, Mycobacterium avium
VQPALWLLIFGTTFSHLH

SEQ ID NO: 14745 - protein, 25 aa, Mycobacterium avium
VRAGGKRLGAVWFNLLQTSLAAGLS

SEQ ID NO: 14746 - protein, 21 aa, Mycobacterium avium
VRLRWDPYPFILLNLAFSTQA

SEQ ID NO: 14747 - protein, 17 aa, Mycobacterium avium
VRPLWLLLTQALPRSLH

SEQ ID NO: 14748 - protein, 24 aa, Mycobacterium avium
VRRDADCAVHTDIRPARLLADPAA

SEQ ID NO: 14749 - protein, 17 aa, Mycobacterium avium
VRRFLTAVHALRQIERA

SEQ ID NO: 14750 - protein, 23 aa, Mycobacterium avium
VRRPRAHLVASVLVLIILASCAG

SEQ ID NO: 14751 - protein, 25 aa, Mycobacterium avium
VRSSEQIMPLFVVTVMAQLVLCGGM

SEQ ID NO: 14752 - protein, 19 aa, Mycobacterium avium
VRVASWRGWGPDRREIAAG

SEQ ID NO: 14753 - protein, 18 aa, Mycobacterium avium
VRVTRWVATIAGLIGFVL

SEQ ID NO: 14754 - protein, 17 aa, Mycobacterium avium
VRVVRAFAREDFERDRF

SEQ ID NO: 14755 - protein, 18 aa, Mycobacterium avium
VRYAGVVFPVIGWWLYDI

SEQ ID NO: 14756 - protein, 17 aa, Mycobacterium avium
VSAIVGAFAAHRGYRQW

SEQ ID NO: 14757 - protein, 23 aa, Mycobacterium avium
VSGFDPATLWGRQTGRDRLRAPL

SEQ ID NO: 14758 - protein, 18 aa, Mycobacterium avium
VSGLHLIATFSTLAAAFV

SEQ ID NO: 14759 - protein, 29 aa, Mycobacterium avium
VSHPASPAKRAWLPIAIAVIAVVVVVVVL

SEQ ID NO: 14760 - protein, 22 aa, Mycobacterium avium
VSKGLFYGGGWAQLERQAVGAF

SEQ ID NO: 14761 - protein, 31 aa, Mycobacterium avium
VSLAPTLLVAIPFTVLVSFTLNILLRELGAA

SEQ ID NO: 14762 - protein, 26 aa, Mycobacterium avium
VSLGIFCLLAALWVTRFMADVYLTQR

SEQ ID NO: 14763 - protein, 25 aa, Mycobacterium avium
VSNLLRTVLGLTRIHPALLHSLSLA

SEQ ID NO: 14764 - protein, 38 aa, Mycobacterium avium
VSPAVLRWSRNRMAFLAALLFMMALCFATTNGWWYVSS

SEQ ID NO: 14765 - protein, 25 aa, Mycobacterium avium
VSQRGRWSCAVNHLLHLAMSAAMIL

SEQ ID NO: 14766 - protein, 21 aa, Mycobacterium avium
VSRLLPDRMLIGIDDLERETS

SEQ ID NO: 14767 - protein, 25 aa, Mycobacterium avium
VSRTDGVVLHWITDYWNHFSLMVQK

SEQ ID NO: 14768 - protein, 22 aa, Mycobacterium avium
VSRVALFWVAFILTRPLGATVG

SEQ ID NO: 14769 - protein, 24 aa, Mycobacterium avium
VSVVGWVFAVRALLLMAFPHAFMA

SEQ ID NO: 14770 - protein, 28 aa, Mycobacterium avium
VSYMRYPVFLGFDIVGGIAWGGGATLAG

SEQ ID NO: 14771 - protein, 19 aa, Mycobacterium avium
VTADIAHRLLDGVDPDIVT

SEQ ID NO: 14772 - protein, 21 aa, Mycobacterium avium
VTAEQLAPWLLDAELAIEWVA

SEQ ID NO: 14773 - protein, 22 aa, Mycobacterium avium
VTGGLVAFIFLLARTAMSKFTP

SEQ ID NO: 14774 - protein, 26 aa, Mycobacterium avium
VTGPVARLALVGSRGTDVIDQSVVDL

SEQ ID NO: 14775 - protein, 17 aa, Mycobacterium avium
VTIRCALVVGRNVDNWV

SEQ ID NO: 14776 - protein, 22 aa, Mycobacterium avium
VTLLVCDRLAIAAAPFLMAEVF

SEQ ID NO: 14777 - protein, 19 aa, Mycobacterium avium
VTMGVAWSVLYIPIGGVGT

SEQ ID NO: 14778 - protein, 27 aa, Mycobacterium avium
VVAHWVWGPGGWLARLGVLDYAGGLVV

SEQ ID NO: 14779 - protein, 20 aa, Mycobacterium avium
VVATSAWGALNLVAGLGELF

SEQ ID NO: 14780 - protein, 18 aa, Mycobacterium avium
VVCAIGLGGVAGVGRVFD

SEQ ID NO: 14781 - protein, 26 aa, Mycobacterium avium
VVFGDFRFGPESTYHATFVDVSRLKA

SEQ ID NO: 14782 - protein, 24 aa, Mycobacterium avium
VVFPLPVDIITPFLRNPELLQGVV

SEQ ID NO: 14783 - protein, 26 aa, Mycobacterium avium
VVFVGRLGDMFGRVRIYNAGFAVFTV

SEQ ID NO: 14784 - protein, 24 aa, Mycobacterium avium
VVGASLGALWAWIAPPIRAVVALT

SEQ ID NO: 14785 - protein, 20 aa, Mycobacterium avium
VVGVWVVFVLALASWLLGGY

SEQ ID NO: 14786 - protein, 17 aa, Mycobacterium avium
VVIALVVAVGFGLATDY

SEQ ID NO: 14787 - protein, 26 aa, Mycobacterium avium
VVLALSGIVPWWFVVVLLVRDGLLAA

SEQ ID NO: 14788 - protein, 26 aa, Mycobacterium avium
VVLGAGLIGYGIFRWHTRHRHSESPA

SEQ ID NO: 14789 - protein, 17 aa, Mycobacterium avium
VVNELRAAGAEALEVND

SEQ ID NO: 14790 - protein, 25 aa, Mycobacterium avium
VVSEFPADRGWDLAGLFDADPDAVG

SEQ ID NO: 14791 - protein, 32 aa, Mycobacterium avium
VVTFSEPYPAWKELFNNILPAHIVKDVPGGFA

SEQ ID NO: 14792 - protein, 17 aa, Mycobacterium avium
VVTMLALLVLSTPTFVI

SEQ ID NO: 14793 - protein, 21 aa, Mycobacterium avium
VVVFLVTWPLVYLASKSPTLA

SEQ ID NO: 14794 - protein, 18 aa, Mycobacterium avium
VVVLRGREAPPSAVPPGV

SEQ ID NO: 14795 - protein, 18 aa, Mycobacterium avium
VVVPAFMHVMGRWNWWAP

SEQ ID NO: 14796 - protein, 18 aa, Mycobacterium avium
VWLLSAVTVCVFGVAPRF

SEQ ID NO: 14797 - protein, 23 aa, Mycobacterium avium
VWPFIALGALGWLAAVGAAFLVP

SEQ ID NO: 14798 - protein, 33 aa, Mycobacterium avium
VYAGAFGLAGGLGWKLWDQRAVAQAGQAAQRTA

SEQ ID NO: 14799 - protein, 18 aa, Mycobacterium avium
VYFSHALNKVWRRHMLAV

SEQ ID NO: 14800 - protein, 22 aa, Mycobacterium avium
VYLRVPALNAVFPNYRGSTLEA

SEQ ID NO: 14801 - protein, 23 aa, Mycobacterium avium
WAARLASVSVDWWATAVAGVIVA

SEQ ID NO: 14802 - protein, 23 aa, Mycobacterium avium
WAERRGRGDERWCEVPVGAKPNG

SEQ ID NO: 14803 - protein, 18 aa, Mycobacterium avium
WAFFSHQVAFLFTFPNNI

SEQ ID NO: 14804 - protein, 25 aa, Mycobacterium avium
WAIFHTLMIFWPFMQAAIQMAVVLA

SEQ ID NO: 14805 - protein, 17 aa, Mycobacterium avium
WAPASPWATPPPLVMAL

SEQ ID NO: 14806 - protein, 17 aa, Mycobacterium avium
WAVGLAFPCQQPMLHVN

SEQ ID NO: 14807 - protein, 17 aa, Mycobacterium avium
WCVSAIVGAFAAHRGYR

SEQ ID NO: 14808 - protein, 20 aa, Mycobacterium avium
WDEVKQSLTQLAVQLGPTAG

SEQ ID NO: 14809 - protein, 17 aa, Mycobacterium avium
WDGPAWSISAEWLAYVL

SEQ ID NO: 14810 - protein, 17 aa, Mycobacterium avium
WDTLRAMGFDDDHIGDS

SEQ ID NO: 14811 - protein, 22 aa, Mycobacterium avium
WEAGNKLIARRNLIWSIATMHV

SEQ ID NO: 14812 - protein, 27 aa, Mycobacterium avium
WEKHCFDIPLCWAFRSLWDTIDHIDHL

SEQ ID NO: 14813 - protein, 26 aa, Mycobacterium avium
WEKHCYDIPICFSLRSIFDALDGVDE

SEQ ID NO: 14814 - protein, 17 aa, Mycobacterium avium
WEVACYLAVAAIGVAGL

SEQ ID NO: 14815 - protein, 24 aa, Mycobacterium avium
WFGELGYRSVFSTVLVTRFVVFLI

SEQ ID NO: 14816 - protein, 19 aa, Mycobacterium avium
WGALVIVGGVATLIALGTK

SEQ ID NO: 14817 - protein, 22 aa, Mycobacterium avium
WGETLTKGWQRLLGTMLGVPAG

SEQ ID NO: 14818 - protein, 20 aa, Mycobacterium avium
WGVRVGGLFTALGVTSVVIG

SEQ ID NO: 14819 - protein, 19 aa, Mycobacterium avium
WHAPWPLNMWAGANTGWWP

SEQ ID NO: 14820 - protein, 26 aa, Mycobacterium avium
WHRAARIIGALSMLAAVLSFGFNLYW

SEQ ID NO: 14821 - protein, 17 aa, Mycobacterium avium
WIITRGLRIVMVLIAAV

SEQ ID NO: 14822 - protein, 26 aa, Mycobacterium avium
WKRYGRAALVVAVYAGAFGLAGGLGW

SEQ ID NO: 14823 - protein, 19 aa, Mycobacterium avium
WLAGLRWRRHGVRAALEPL

SEQ ID NO: 14824 - protein, 26 aa, Mycobacterium avium
WLIDTSSWRWIFLINVPIGLLTVALA

SEQ ID NO: 14825 - protein, 18 aa, Mycobacterium avium
WLPQRPVLVPGTVDDNLR

SEQ ID NO: 14826 - protein, 20 aa, Mycobacterium avium
WLTPARWGYAAGASSIDFPS

SEQ ID NO: 14827 - protein, 19 aa, Mycobacterium avium
WLVPARWGFAASASTVNLR

SEQ ID NO: 14828 - protein, 17 aa, Mycobacterium avium
WMANWRFVAQKTDYFTQ

SEQ ID NO: 14829 - protein, 17 aa, Mycobacterium avium
WMIAVAFLYLVLGGMGV

SEQ ID NO: 14830 - protein, 20 aa, Mycobacterium avium
WMLGLACVPAVLLLPLVFRM

SEQ ID NO: 14831 - protein, 22 aa, Mycobacterium avium
WMTVDALVWVPRMYYLYGNPNR

SEQ ID NO: 14832 - protein, 17 aa, Mycobacterium avium
WNVFMIFGVLSLFVAHT

SEQ ID NO: 14833 - protein, 20 aa, Mycobacterium avium
WPLAESGVRSGLAPAERDSS

SEQ ID NO: 14834 - protein, 20 aa, Mycobacterium avium
WPVVVLVSIVVARRSGSDRP

SEQ ID NO: 14835 - protein, 27 aa, Mycobacterium avium
WQRFWRITMPMLRPTTFFVLVTGIVSS

SEQ ID NO: 14836 - protein, 25 aa, Mycobacterium avium
WRERRDLFSGFAWLAVVALAVAGAC

SEQ ID NO: 14837 - protein, 20 aa, Mycobacterium avium
WRGDHPLLICDAERISYAEA

SEQ ID NO: 14838 - protein, 17 aa, Mycobacterium avium
WRNLRFARSDMPADTVA

SEQ ID NO: 14839 - protein, 18 aa, Mycobacterium avium
WRNPLSYDPLGRVPPPEP

SEQ ID NO: 14840 - protein, 19 aa, Mycobacterium avium
WRRHAWAGRLFVAPNMVAV

SEQ ID NO: 14841 - protein, 19 aa, Mycobacterium avium
WSISAEWLAYVLFAGMVLV

SEQ ID NO: 14842 - protein, 17 aa, Mycobacterium avium
WSRTALRDVSFTVHEGD

SEQ ID NO: 14843 - protein, 19 aa, Mycobacterium avium
WTALRNFRSGTTVQELPEH

SEQ ID NO: 14844 - protein, 23 aa, Mycobacterium avium
WTDHVEAAMLRDALIAYKVENVM

SEQ ID NO: 14845 - protein, 17 aa, Mycobacterium avium
WTVALTRPAKMHEAAVC

SEQ ID NO: 14846 - protein, 20 aa, Mycobacterium avium
WVAAGGLFGALLIGGAVFGT

SEQ ID NO: 14847 - protein, 18 aa, Mycobacterium avium
WVIGSLLLILAMFEGYFG

SEQ ID NO: 14848 - protein, 18 aa, Mycobacterium avium
WWEYEFKGKPGGVRRLPR

SEQ ID NO: 14849 - protein, 32 aa, Mycobacterium avium
WWQTFWRITLPSIRWGLTYGIVLTIARSLGEY

SEQ ID NO: 14850 - protein, 22 aa, Mycobacterium avium
WYRSTKYVLRRAVPVGLSVVAL

SEQ ID NO: 14851 - protein, 28 aa, Mycobacterium avium
YAAMAADIYKWGEFGMLPSLNARRTPDR

SEQ ID NO: 14852 - protein, 19 aa, Mycobacterium avium
YAGAFGLSILFWQHLIGLH

SEQ ID NO: 14853 - protein, 19 aa, Mycobacterium avium
YAHARGLLHRDVKPANILL

SEQ ID NO: 14854 - protein, 23 aa, Mycobacterium avium
YAPEEVFLMLSVAGVSAYALTPW

SEQ ID NO: 14855 - protein, 17 aa, Mycobacterium avium
YARPVVEWLERRAQDGT

SEQ ID NO: 14856 - protein, 18 aa, Mycobacterium avium
YASALAWVMFAVLLVLTV

SEQ ID NO: 14857 - protein, 17 aa, Mycobacterium avium
YAVIPRWGLADRVEPPP

SEQ ID NO: 14858 - protein, 20 aa, Mycobacterium avium
YAVPVLVVFLRPARLAATPR

SEQ ID NO: 14859 - protein, 26 aa, Mycobacterium avium
YAYGVVFTLFPIRAGLTLSNPAGGIV

SEQ ID NO: 14860 - protein, 19 aa, Mycobacterium avium
YDMAAGFADVHFLGVGTPQ

SEQ ID NO: 14861 - protein, 26 aa, Mycobacterium avium
YDVVPSRLRRPGAVVLEIDDEDPIFE

SEQ ID NO: 14862 - protein, 23 aa, Mycobacterium avium
YEDGFKRKKIVDVLRESLQNVPH

SEQ ID NO: 14863 - protein, 21 aa, Mycobacterium avium
YEHYFRTFLRPEDVGWSVFEV

SEQ ID NO: 14864 - protein, 27 aa, Mycobacterium avium
YETVKGDASMAWMLLGAVVLAGAVLAG

SEQ ID NO: 14865 - protein, 17 aa, Mycobacterium avium
YGNAYACDLNATGFFPG

SEQ ID NO: 14866 - protein, 25 aa, Mycobacterium avium
YGSLVMVFQWGWLRDLGFAQISSID

SEQ ID NO: 14867 - protein, 18 aa, Mycobacterium avium
YHSRIAAQAADAGEGKAN

SEQ ID NO: 14868 - protein, 17 aa, Mycobacterium avium
YHVTIGLTSPADDSAAQ

SEQ ID NO: 14869 - protein, 21 aa, Mycobacterium avium
YIYATRAGKFVVWDRILSDLR

SEQ ID NO: 14870 - protein, 17 aa, Mycobacterium avium
YKDDYKAAGVPMLPAVA

SEQ ID NO: 14871 - protein, 18 aa, Mycobacterium avium
YKIPELFGPLGAGIGGQV

SEQ ID NO: 14872 - protein, 17 aa, Mycobacterium avium
YLGGVLRGDLGRAYSGL

SEQ ID NO: 14873 - protein, 17 aa, Mycobacterium avium
YLLWAIIPLAAWATRTG

SEQ ID NO: 14874 - protein, 17 aa, Mycobacterium avium
YNFLNLLGLGPATGIIS

SEQ ID NO: 14875 - protein, 21 aa, Mycobacterium avium
YPEFPSRRPAPSGSQESPASA

SEQ ID NO: 14876 - protein, 24 aa, Mycobacterium avium
YPGELLRLIAEMGMGTGALAVIGG

SEQ ID NO: 14877 - protein, 23 aa, Mycobacterium avium
YPPKPPVGAALWKLMERARQIGL

SEQ ID NO: 14878 - protein, 21 aa, Mycobacterium avium
YPVELMPTWLHVLSKINPLSY

SEQ ID NO: 14879 - protein, 19 aa, Mycobacterium avium
YQHDIKFIIAVTLLVVLLT

SEQ ID NO: 14880 - protein, 17 aa, Mycobacterium avium
YRDGRVAGALHVGVSIG

SEQ ID NO: 14881 - protein, 36 aa, Mycobacterium avium
YRFGAPRPGDVIVFKGPPSWNLGYKSIRSNNTALRW

SEQ ID NO: 14882 - protein, 22 aa, Mycobacterium avium
YRKETIRLIAEMTMGAGALVMI

SEQ ID NO: 14883 - protein, 23 aa, Mycobacterium avium
YRRAGLLLSDARRAGRLVNDMLD

SEQ ID NO: 14884 - protein, 28 aa, Mycobacterium avium
YRTVTSMVIWCIGGVVFIIASWSVARFA

SEQ ID NO: 14885 - protein, 17 aa, Mycobacterium avium
YRWTFAQVQGAPPKITL

SEQ ID NO: 14886 - protein, 18 aa, Mycobacterium avium
YRYRIRVLITATVAAGVI

SEQ ID NO: 14887 - protein, 20 aa, Mycobacterium avium
YSLVAGIPLAHWEFYMALAY

SEQ ID NO: 14888 - protein, 19 aa, Mycobacterium avium
YSPTRLEAFRDRKRTGPQQ

SEQ ID NO: 14889 - protein, 17 aa, Mycobacterium avium
YTAVFVIAVALVVCTII

SEQ ID NO: 14890 - protein, 19 aa, Mycobacterium avium
YVLHRAWVGPMILVVLDDP

SEQ ID NO: 14891 - protein, 17 aa, Mycobacterium avium
YVLLPGRPLPPAGHSTP

SEQ ID NO: 14892 - protein, 18 aa, Mycobacterium avium
YVREAMLVAAAWLALFAL

SEQ ID NO: 14893 - protein, 18 aa, Mycobacterium avium
YVRRTIIFNGWNWSVTQI

SEQ ID NO: 14894 - protein, 22 aa, Mycobacterium avium
YWFEPNPGWSRLFAPGGEVKQY

SEQ ID NO: 14895 - protein, 18 aa, Mycobacterium avium
YWVGRLVLERGVAVIYLL

SEQ ID NO: 14896 - protein, 24 aa, Mycobacterium avium
AAAACLVAALGVATLIARHARTHD

SEQ ID NO: 14897 - protein, 19 aa, Mycobacterium avium
AAADLFAVVGLLFLGTVAL

SEQ ID NO: 14898 - protein, 22 aa, Mycobacterium avium
AAAGVVGLLAWVSRDRSPRLTA

SEQ ID NO: 14899 - protein, 17 aa, Mycobacterium avium
AAAHLPYLAWLQQASAD

SEQ ID NO: 14900 - protein, 24 aa, Mycobacterium avium
AAAKRSALLHWSRRPESTQPKFWN

SEQ ID NO: 14901 - protein, 26 aa, Mycobacterium avium
AAALHRLDAIVLYLGFIVAAWLLGYL

SEQ ID NO: 14902 - protein, 17 aa, Mycobacterium avium
AAALPALPTLFVIVDEF

SEQ ID NO: 14903 - protein, 17 aa, Mycobacterium avium
AAANWLGALGFAALAVY

SEQ ID NO: 14904 - protein, 24 aa, Mycobacterium avium
AAAPALVCCLALILALPDLVWGVG

SEQ ID NO: 14905 - protein, 18 aa, Mycobacterium avium
AAAPLLVRLMLGRTPQVN

SEQ ID NO: 14906 - protein, 18 aa, Mycobacterium avium
AAAPRTAPAPSIVKSGGE

SEQ ID NO: 14907 - protein, 17 aa, Mycobacterium avium
AAARIGMGWPLTVLAAL

SEQ ID NO: 14908 - protein, 29 aa, Mycobacterium avium
AAAVFLVGWRGVRWWRRGLAVLSIPLCVL

SEQ ID NO: 14909 - protein, 18 aa, Mycobacterium avium
AAAVGLVILMRYRGLGWT

SEQ ID NO: 14910 - protein, 25 aa, Mycobacterium avium
AAAVLRLKPGYGMPTMAEVREHFER

SEQ ID NO: 14911 - protein, 25 aa, Mycobacterium avium
AADLLEWLALAALVPLTCWIAGLYG

SEQ ID NO: 14912 - protein, 17 aa, Mycobacterium avium
AAEICDLTAAAGRTSAA

SEQ ID NO: 14913 - protein, 23 aa, Mycobacterium avium
AAEKWNLPVILIVLLAVFGSLAA

SEQ ID NO: 14914 - protein, 22 aa, Mycobacterium avium
AAFCYAAAVVTELGGPMSHAAV

SEQ ID NO: 14915 - protein, 25 aa, Mycobacterium avium
AAFLAVTGVRGWLVARRVERRIILL

SEQ ID NO: 14916 - protein, 17 aa, Mycobacterium avium
AAFLVGVALFTFASGLC

SEQ ID NO: 14917 - protein, 18 aa, Mycobacterium avium
AAFLVGVALFTFASGLCG

SEQ ID NO: 14918 - protein, 18 aa, Mycobacterium avium
AAFMTWRIGAEMPGQPAG

SEQ ID NO: 14919 - protein, 20 aa, Mycobacterium avium
AAGAKLRFNYDDSLDVVGVH

SEQ ID NO: 14920 - protein, 18 aa, Mycobacterium avium
AAGAPWFAVSPLMHAAGM

SEQ ID NO: 14921 - protein, 17 aa, Mycobacterium avium
AAGARFGLFEPRRAVSA

SEQ ID NO: 14922 - protein, 22 aa, Mycobacterium avium
AAGATYWLVRRSLKSVDAIRAR

SEQ ID NO: 14923 - protein, 27 aa, Mycobacterium avium
AAGGLPWYKRTALVLSVAGAGAAVLIA

SEQ ID NO: 14924 - protein, 21 aa, Mycobacterium avium
AAGGLRPDLAVGEPVLISDHL

SEQ ID NO: 14925 - protein, 23 aa, Mycobacterium avium
AAGGRWRQLRTLAVITGPGLIVM

SEQ ID NO: 14926 - protein, 20 aa, Mycobacterium avium
AAGLAVWAGISWARGKRRRA

SEQ ID NO: 14927 - protein, 31 aa, Mycobacterium avium
AAGLLVFAGMSWRARPKLAITPDGLAVRGWY

SEQ ID NO: 14928 - protein, 34 aa, Mycobacterium avium
AAGLLVFAGMSWRARPKLAITPGGLAVRGWYRTQ

SEQ ID NO: 14929 - protein, 20 aa, Mycobacterium avium
AAGLRTGIIRAFGGTGGVVT

SEQ ID NO: 14930 - protein, 25 aa, Mycobacterium avium
AAGRWPLPALVPATLVFGLLLGAIV

SEQ ID NO: 14931 - protein, 25 aa, Mycobacterium avium
AAGRWPLPALVPATLVFGLLVGAIV

SEQ ID NO: 14932 - protein, 21 aa, Mycobacterium avium
AAGVLGALAIIIAVLIVINSR

SEQ ID NO: 14933 - protein, 19 aa, Mycobacterium avium
AAHRRVWRDREPQLASPDR

SEQ ID NO: 14934 - protein, 26 aa, Mycobacterium avium
AAHSARPPLRPARAIAAVAGLGAALA

SEQ ID NO: 14935 - protein, 17 aa, Mycobacterium avium
AAIACADLSMLSKAEVE

SEQ ID NO: 14936 - protein, 17 aa, Mycobacterium avium
AAKFTLEVYPRYLKLIP

SEQ ID NO: 14937 - protein, 18 aa, Mycobacterium avium
AALAGMTLVALSANVPAA

SEQ ID NO: 14938 - protein, 17 aa, Mycobacterium avium
AALAVFWVLAKLEVIVV

SEQ ID NO: 14939 - protein, 25 aa, Mycobacterium avium
AALEPLRRLAVIVGIAVAIGCTTWL

SEQ ID NO: 14940 - protein, 21 aa, Mycobacterium avium
AALHGRMTWVTAGLLLVVPVF

SEQ ID NO: 14941 - protein, 18 aa, Mycobacterium avium
AALTFNIPPGDRMAPGSQ

SEQ ID NO: 14942 - protein, 18 aa, Mycobacterium avium
AALVLWCAIRVVPLDVYW

SEQ ID NO: 14943 - protein, 19 aa, Mycobacterium avium
AAMKYFLLGAFSSAFFLYG

SEQ ID NO: 14944 - protein, 19 aa, Mycobacterium avium
AAMRARIGVVSREERLHRR

SEQ ID NO: 14945 - protein, 23 aa, Mycobacterium avium
AAPALVCCLALILALPDLVWGVG

SEQ ID NO: 14946 - protein, 20 aa, Mycobacterium avium
AAPGLPGFAIGTVLRIIRAD

SEQ ID NO: 14947 - protein, 20 aa, Mycobacterium avium
AAPGLPGFAIGTVLRITRAD

SEQ ID NO: 14948 - protein, 24 aa, Mycobacterium avium
AAPNEPGQILVLLNVGAVFMGTAL

SEQ ID NO: 14949 - protein, 22 aa, Mycobacterium avium
AAPRIEFDEVVFRYDGASAPVL

SEQ ID NO: 14950 - protein, 20 aa, Mycobacterium avium
AAQIPLYMGYAFRGFNTHGR

SEQ ID NO: 14951 - protein, 22 aa, Mycobacterium avium
AARFVNWVALQVSRQLTTGFVE

SEQ ID NO: 14952 - protein, 22 aa, Mycobacterium avium
AARPRVARIIHRLSVPIILGWL

SEQ ID NO: 14953 - protein, 17 aa, Mycobacterium avium
AARRGRRPAADAGAARR

SEQ ID NO: 14954 - protein, 20 aa, Mycobacterium avium
AARRIYLNAFDMACVGHQSA

SEQ ID NO: 14955 - protein, 17 aa, Mycobacterium avium
AARRRGKALSGLGVAAL

SEQ ID NO: 14956 - protein, 19 aa, Mycobacterium avium
AARSAVYARSFTRRAEEPK

SEQ ID NO: 14957 - protein, 19 aa, Mycobacterium avium
AASAFLWPRSLQARATRRA

SEQ ID NO: 14958 - protein, 21 aa, Mycobacterium avium
AATIRRRLHFLSHVQKVTGVS

SEQ ID NO: 14959 - protein, 18 aa, Mycobacterium avium
AATPLAYAVDLLAAVPSI

SEQ ID NO: 14960 - protein, 18 aa, Mycobacterium avium
AATVWLGFVASLPVFLVA

SEQ ID NO: 14961 - protein, 24 aa, Mycobacterium avium
AAVFCVLAVLPLVVLTQLGIIVGL

SEQ ID NO: 14962 - protein, 17 aa, Mycobacterium avium
AAVGLVILMRYRGLGWA

SEQ ID NO: 14963 - protein, 17 aa, Mycobacterium avium
AAVGLVILMRYRGLGWT

SEQ ID NO: 14964 - protein, 19 aa, Mycobacterium avium
AAVGLWVAARLPWVVIRSF

SEQ ID NO: 14965 - protein, 26 aa, Mycobacterium avium
AAVLAARFVNWVALQVSRQLTTGFVE

SEQ ID NO: 14966 - protein, 25 aa, Mycobacterium avium
AAVLAARFVNWVALQVSRQPTTGFV

SEQ ID NO: 14967 - protein, 17 aa, Mycobacterium avium
AAVLRMLPQFIWRRMPR

SEQ ID NO: 14968 - protein, 31 aa, Mycobacterium avium
AAVPPPRRKRLFTRSRLFPTAAVVIAAAALL

SEQ ID NO: 14969 - protein, 34 aa, Mycobacterium avium
AAVPPPRRKRLFTRSRLFPTAAVVIAAAALLPVG

SEQ ID NO: 14970 - protein, 17 aa, Mycobacterium avium
AAVRFGRARRRGRRADR

SEQ ID NO: 14971 - protein, 21 aa, Mycobacterium avium
AAWAAAVLWFAIKVVPLDVYW

SEQ ID NO: 14972 - protein, 22 aa, Mycobacterium avium
ACALWLGIAGWALWAANSPGMG

SEQ ID NO: 14973 - protein, 17 aa, Mycobacterium avium
ACDRYGRALARSSEQYR

SEQ ID NO: 14974 - protein, 19 aa, Mycobacterium avium
ACIMVFVAVWFALRDTQRA

SEQ ID NO: 14975 - protein, 25 aa, Mycobacterium avium
ACRWAQAQPGVGAWVGYVGAAAEAG

SEQ ID NO: 14976 - protein, 25 aa, Mycobacterium avium
ACYASLRMSVRFIRRVAFTGYVVTV

SEQ ID NO: 14977 - protein, 19 aa, Mycobacterium avium
ADADYVALCHWNANVDNAW

SEQ ID NO: 14978 - protein, 18 aa, Mycobacterium avium
ADALLAHDGLAPDQKPGR

SEQ ID NO: 14979 - protein, 20 aa, Mycobacterium avium
ADCTGKVGVIGFCMGGGFAL

SEQ ID NO: 14980 - protein, 24 aa, Mycobacterium avium
ADFQLRSVPLLSRVGADRADQLRT

SEQ ID NO: 14981 - protein, 19 aa, Mycobacterium avium
ADFVPARFVLANSAEVGVP

SEQ ID NO: 14982 - protein, 26 aa, Mycobacterium avium
ADGLGMPIDLSWELWAYGVFAIAAVG

SEQ ID NO: 14983 - protein, 17 aa, Mycobacterium avium
ADIKATTVFGGKYVSLT

SEQ ID NO: 14984 - protein, 20 aa, Mycobacterium avium
ADKTRRWAHNLAGFTDQMVT

SEQ ID NO: 14985 - protein, 18 aa, Mycobacterium avium
ADLPPCPAAGTGPGPAAL

SEQ ID NO: 14986 - protein, 21 aa, Mycobacterium avium
ADLRVAHPLISRTHLIVRYEQ

SEQ ID NO: 14987 - protein, 18 aa, Mycobacterium avium
ADMIRLIIRDEAVHGYYI

SEQ ID NO: 14988 - protein, 21 aa, Mycobacterium avium
ADPAERITNAFFGRMAVRVDF

SEQ ID NO: 14989 - protein, 24 aa, Mycobacterium avium
ADPNPPLPWWPWQIGPAPRVPGTA

SEQ ID NO: 14990 - protein, 19 aa, Mycobacterium avium
ADRLLGLGALTAHGGGAGS

SEQ ID NO: 14991 - protein, 19 aa, Mycobacterium avium
ADRLLGLGALTAHGGGASS

SEQ ID NO: 14992 - protein, 19 aa, Mycobacterium avium
ADRLLGLSALTAHGGGAGS

SEQ ID NO: 14993 - protein, 17 aa, Mycobacterium avium
ADRPVHPVTLWRGRLSV

SEQ ID NO: 14994 - protein, 23 aa, Mycobacterium avium
ADSGLRPRYPAVEVYRVDAGGDA

SEQ ID NO: 14995 - protein, 21 aa, Mycobacterium avium
ADTAIAIKRAEVRREAEIMWA

SEQ ID NO: 14996 - protein, 27 aa, Mycobacterium avium
ADTKYPEFMQWLARLNSAAVEFVNGIG

SEQ ID NO: 14997 - protein, 20 aa, Mycobacterium avium
ADTNGALLLNMPADNLALDA

SEQ ID NO: 14998 - protein, 18 aa, Mycobacterium avium
ADYARMWVQAATTMTTYQ

SEQ ID NO: 14999 - protein, 20 aa, Mycobacterium avium
AEARAAAARERLSRLRAAAG

SEQ ID NO: 15000 - protein, 20 aa, Mycobacterium avium
AEIDDAFRWSEENPNLQRKA

SEQ ID NO: 15001 - protein, 19 aa, Mycobacterium avium
AELARPIPAIAMVPVAILL

SEQ ID NO: 15002 - protein, 32 aa, Mycobacterium avium
AEMAGALKNVFAIAVGMGYSLGIALVIARALR

SEQ ID NO: 15003 - protein, 18 aa, Mycobacterium avium
AEMPRLNRWFMANINGLG

SEQ ID NO: 15004 - protein, 20 aa, Mycobacterium avium
AEPELRRWDAAVTSLIRHGL

SEQ ID NO: 15005 - protein, 34 aa, Mycobacterium avium
AEPTPWYRRPAMLIAWVVSVVVLIGLIVFGVIEL

SEQ ID NO: 15006 - protein, 18 aa, Mycobacterium avium
AEPVLLWGDARVGNVLYR

SEQ ID NO: 15007 - protein, 22 aa, Mycobacterium avium
AERRGRGDERWCEVPVGAKPNG

SEQ ID NO: 15008 - protein, 18 aa, Mycobacterium avium
AERYLGIIDRVRAAMPHA

SEQ ID NO: 15009 - protein, 27 aa, Mycobacterium avium
AETWTHYSGWWVFDMVMLVLFGVAAAG

SEQ ID NO: 15010 - protein, 28 aa, Mycobacterium avium
AETWTHYSGWWVFDMVMLVLFGVAAAGV

SEQ ID NO: 15011 - protein, 20 aa, Mycobacterium avium
AEVVEITGAVLTKLDGTAKG

SEQ ID NO: 15012 - protein, 17 aa, Mycobacterium avium
AEWWRLASMLGAILALH

SEQ ID NO: 15013 - protein, 23 aa, Mycobacterium avium
AFALAGIIAFEFNMGVTRQSSWW

SEQ ID NO: 15014 - protein, 26 aa, Mycobacterium avium
AFARPEQAVRCGIELQRALRRNANRK

SEQ ID NO: 15015 - protein, 20 aa, Mycobacterium avium
AFASFRRWIRIGRLAGVGRL

SEQ ID NO: 15016 - protein, 26 aa, Mycobacterium avium
AFDDLLVRYRKSWSDLAAVVTVGGGA

SEQ ID NO: 15017 - protein, 17 aa, Mycobacterium avium
AFFTADHAVLWAGVAFL

SEQ ID NO: 15018 - protein, 29 aa, Mycobacterium avium
AFGLLLLIVFCFIELRAPQPMVNVRLFRS

SEQ ID NO: 15019 - protein, 21 aa, Mycobacterium avium
AFLPAVIVVAVVLYVALRDRR

SEQ ID NO: 15020 - protein, 31 aa, Mycobacterium avium
AFLSFNLNLNWPPPCTTGFLPIQQQRAASYE

SEQ ID NO: 15021 - protein, 18 aa, Mycobacterium avium
AFLYLVLGGMGVWSKLNS

SEQ ID NO: 15022 - protein, 22 aa, Mycobacterium avium
AFNWFKRRFYLDPVDDLRPSWI

SEQ ID NO: 15023 - protein, 18 aa, Mycobacterium avium
AFSSKWTKGIRYWQAGYT

SEQ ID NO: 15024 - protein, 18 aa, Mycobacterium avium
AGAACALWLGIAGWALWA

SEQ ID NO: 15025 - protein, 29 aa, Mycobacterium avium
AGAAKATFLRWAWYAARREELHLDGADDD

SEQ ID NO: 15026 - protein, 39 aa, Mycobacterium avium
AGACLCLTAARLPYFQTMGLPCAIAMVVIVLAALTLAPA

SEQ ID NO: 15027 - protein, 25 aa, Mycobacterium avium
AGALALRLLTIGGCVLLYLTPLILG

SEQ ID NO: 15028 - protein, 27 aa, Mycobacterium avium
AGALLCALTLRLLMVVIHRNDDQYDHD

SEQ ID NO: 15029 - protein, 25 aa, Mycobacterium avium
AGAMVPRPGSDVVHMAGVPVGVATC

SEQ ID NO: 15030 - protein, 19 aa, Mycobacterium avium
AGASASVLACDVADRDAVA

SEQ ID NO: 15031 - protein, 20 aa, Mycobacterium avium
AGEYWLDLAQSLLRILTGFG

SEQ ID NO: 15032 - protein, 19 aa, Mycobacterium avium
AGFATDWLGAGSVRRFGVR

SEQ ID NO: 15033 - protein, 18 aa, Mycobacterium avium
AGFGRAGAVTALMTAVIL

SEQ ID NO: 15034 - protein, 18 aa, Mycobacterium avium
AGGAARCLISTMTAMIRG

SEQ ID NO: 15035 - protein, 20 aa, Mycobacterium avium
AGIGCVGGGLGFLLGLADQW

SEQ ID NO: 15036 - protein, 18 aa, Mycobacterium avium
AGIGCVGGGLGLLLGLAD

SEQ ID NO: 15037 - protein, 18 aa, Mycobacterium avium
AGILAGRMAIGRLPRAVT

SEQ ID NO: 15038 - protein, 17 aa, Mycobacterium avium
AGILVWLLPAGRDLDAF

SEQ ID NO: 15039 - protein, 21 aa, Mycobacterium avium
AGLARFVWATVIIWIVGGFGT

SEQ ID NO: 15040 - protein, 34 aa, Mycobacterium avium
AGLEPAPAAGRSWARTCGYAALIGVVPAGLLILI

SEQ ID NO: 15041 - protein, 27 aa, Mycobacterium avium
AGLGVFCVGGALAIGVLGKRAADREVV

SEQ ID NO: 15042 - protein, 24 aa, Mycobacterium avium
AGLIAAIGFEVFKQVASIYLRTVL

SEQ ID NO: 15043 - protein, 27 aa, Mycobacterium avium
AGLIGWSAACALAYLRGFGRKPAWVLA

SEQ ID NO: 15044 - protein, 18 aa, Mycobacterium avium
AGLLALLVSKGVAKFKAP

SEQ ID NO: 15045 - protein, 25 aa, Mycobacterium avium
AGLPSGYPLRGIVHAAGILDDGLLS

SEQ ID NO: 15046 - protein, 20 aa, Mycobacterium avium
AGLTAPAAWAHAARVATDPA

SEQ ID NO: 15047 - protein, 30 aa, Mycobacterium avium
AGLTCGRALRAGWMLAARGTGGAARSIGRA

SEQ ID NO: 15048 - protein, 18 aa, Mycobacterium avium
AGLVELWLGIAAEQRPLE

SEQ ID NO: 15049 - protein, 20 aa, Mycobacterium avium
AGLVRLRYGALDFDAVPLGR

SEQ ID NO: 15050 - protein, 17 aa, Mycobacterium avium
AGMFHVLIAIAVILTVI

SEQ ID NO: 15051 - protein, 20 aa, Mycobacterium avium
AGMLAIWSRQTVPAGHPGPG

SEQ ID NO: 15052 - protein, 23 aa, Mycobacterium avium
AGPDGRPTIHLPLEDPYQAPEGY

SEQ ID NO: 15053 - protein, 23 aa, Mycobacterium avium
AGPDRTAAMLAEIVGLLQEGVLT

SEQ ID NO: 15054 - protein, 24 aa, Mycobacterium avium
AGPDRTAAMLAEIVGLLRAGVLTP

SEQ ID NO: 15055 - protein, 25 aa, Mycobacterium avium
AGPGGLSWLSPLGWSLLVKPYAGDR

SEQ ID NO: 15056 - protein, 27 aa, Mycobacterium avium
AGPGSALRAVWRAGLRLWVPSLALTAA

SEQ ID NO: 15057 - protein, 21 aa, Mycobacterium avium
AGPILGGWLIDTSSWRWIFLI

SEQ ID NO: 15058 - protein, 18 aa, Mycobacterium avium
AGPTVPHGPSLCLAAAAG

SEQ ID NO: 15059 - protein, 22 aa, Mycobacterium avium
AGRGPGARWIAMNDVTAGNAGA

SEQ ID NO: 15060 - protein, 23 aa, Mycobacterium avium
AGRGPGARWIAMNDVTAGNAGAL

SEQ ID NO: 15061 - protein, 24 aa, Mycobacterium avium
AGRLQGALAGWVHRHGLWPWALAL

SEQ ID NO: 15062 - protein, 23 aa, Mycobacterium avium
AGRLQGALVGWVHRHGLWPWALA

SEQ ID NO: 15063 - protein, 19 aa, Mycobacterium avium
AGRRFYWATSVIGIVCFAF

SEQ ID NO: 15064 - protein, 18 aa, Mycobacterium avium
AGRTVFRVRLPLIDGPGT

SEQ ID NO: 15065 - protein, 26 aa, Mycobacterium avium
AGRVPEKMTFLLAGGVRLTAAAPDGS

SEQ ID NO: 15066 - protein, 25 aa, Mycobacterium avium
AGRVPEKMTFLLAGGVRLTATAPDG

SEQ ID NO: 15067 - protein, 23 aa, Mycobacterium avium
AGRYFERRSKRTAGAALRALLAL

SEQ ID NO: 15068 - protein, 17 aa, Mycobacterium avium
AGSMIGTTIEWYDFYLY

SEQ ID NO: 15069 - protein, 20 aa, Mycobacterium avium
AGSSPLWSGRVFVEARPLSV

SEQ ID NO: 15070 - protein, 21 aa, Mycobacterium avium
AGSVPVIRSSVLTLFEQRPTE

SEQ ID NO: 15071 - protein, 18 aa, Mycobacterium avium
AGSWLPAVLWGVAFAVLV

SEQ ID NO: 15072 - protein, 18 aa, Mycobacterium avium
AGTEVRRLALAIINAATA

SEQ ID NO: 15073 - protein, 17 aa, Mycobacterium avium
AGTGWRVSGLLRIDEVA

SEQ ID NO: 15074 - protein, 17 aa, Mycobacterium avium
AGTRGVVSLAAIFAVPV

SEQ ID NO: 15075 - protein, 17 aa, Mycobacterium avium
AGVPVGVATCWEVIFDR

SEQ ID NO: 15076 - protein, 17 aa, Mycobacterium avium
AGVPWLLVSGPLNRTDE

SEQ ID NO: 15077 - protein, 17 aa, Mycobacterium avium
AGYAWCYRRAGTSARVA

SEQ ID NO: 15078 - protein, 19 aa, Mycobacterium avium
AGYMSNYFRWFGSPEDPFG

SEQ ID NO: 15079 - protein, 19 aa, Mycobacterium avium
AHAAPLRDRLSDWAETNFD

SEQ ID NO: 15080 - protein, 17 aa, Mycobacterium avium
AHGARRGIMIGMALSAI

SEQ ID NO: 15081 - protein, 18 aa, Mycobacterium avium
AHKLCGRDVVVVSASGEE

SEQ ID NO: 15082 - protein, 19 aa, Mycobacterium avium
AHLLQPLVMGRAVSIHPLA

SEQ ID NO: 15083 - protein, 17 aa, Mycobacterium avium
AHRDLWLTTVLQAITVA

SEQ ID NO: 15084 - protein, 20 aa, Mycobacterium avium
AHSALTERIIEFARTQQALR

SEQ ID NO: 15085 - protein, 20 aa, Mycobacterium avium
AHTRRTEIGIMRLVGASRWY

SEQ ID NO: 15086 - protein, 47 aa, Mycobacterium avium
AIAFGAGYMGWAWLDPGSFCSWVTEPVRRRWLTWSRYTRTWESTCTL

SEQ ID NO: 15087 - protein, 18 aa, Mycobacterium avium
AIALIVVIVRYLEPFTTI

SEQ ID NO: 15088 - protein, 26 aa, Mycobacterium avium
AIAVKVDWPHFWSLITSPSSRTALLL

SEQ ID NO: 15089 - protein, 26 aa, Mycobacterium avium
AIAVKVDWPHFWWLITSPSSRTALLL

SEQ ID NO: 15090 - protein, 21 aa, Mycobacterium avium
AICGLSFLPPVVFAVVAVVVT

SEQ ID NO: 15091 - protein, 27 aa, Mycobacterium avium
AIERGEPWPPPAPEPAFKAAIARASEA

SEQ ID NO: 15092 - protein, 24 aa, Mycobacterium avium
AIGADYNLLLALRIKQEAAAGLRT

SEQ ID NO: 15093 - protein, 19 aa, Mycobacterium avium
AIGDWQRRHCATGGTVEVR

SEQ ID NO: 15094 - protein, 27 aa, Mycobacterium avium
AIHCLPVRRDGRFVVALGMGGMGYSFG

SEQ ID NO: 15095 - protein, 23 aa, Mycobacterium avium
AIIGSISFWGSIIAFGKLQEIIS

SEQ ID NO: 15096 - protein, 23 aa, Mycobacterium avium
AIIGSISFWGSIIAFGKLQEVIS

SEQ ID NO: 15097 - protein, 19 aa, Mycobacterium avium
AIILYWFANNIWTFGQQHY

SEQ ID NO: 15098 - protein, 18 aa, Mycobacterium avium
AILYWEGLNISFREIRAN

SEQ ID NO: 15099 - protein, 23 aa, Mycobacterium avium
AIRIAHLRLGFGRSTPNRIAVSY

SEQ ID NO: 15100 - protein, 23 aa, Mycobacterium avium
AIRVTPKFTRMVVAALFGVLALM

SEQ ID NO: 15101 - protein, 22 aa, Mycobacterium avium
AIRVTPKFTRMVVVALFGVLAL

SEQ ID NO: 15102 - protein, 36 aa, Mycobacterium avium
AISAMLIYRLISWLLIAAVGWVVFFFVFRTENIADS

SEQ ID NO: 15103 - protein, 17 aa, Mycobacterium avium
AISAWLLTRWLIPGWTG

SEQ ID NO: 15104 - protein, 24 aa, Mycobacterium avium
AIVPWLHRFGDLVAPLTFLGAAYV

SEQ ID NO: 15105 - protein, 27 aa, Mycobacterium avium
AIYNYTWLVLMLPFGMIGVTVLTVVMP

SEQ ID NO: 15106 - protein, 26 aa, Mycobacterium avium
AKASAWVGALVLGWWIGVLVYFLPRR

SEQ ID NO: 15107 - protein, 20 aa, Mycobacterium avium
AKELVIATKMSGEWSKDEVL

SEQ ID NO: 15108 - protein, 24 aa, Mycobacterium avium
AKFKAPEQVVLWDALPKNDAGKVL

SEQ ID NO: 15109 - protein, 22 aa, Mycobacterium avium
AKGGIVFRVQQELGVPVKLVGL

SEQ ID NO: 15110 - protein, 24 aa, Mycobacterium avium
AKGLSRPRVVTVHILRNSLIPVVT

SEQ ID NO: 15111 - protein, 25 aa, Mycobacterium avium
AKGRRTVWIPWALGPAATVLRMLPQ

SEQ ID NO: 15112 - protein, 25 aa, Mycobacterium avium
AKIALYVLGGWLFAWSTRGIGGFTE

SEQ ID NO: 15113 - protein, 23 aa, Mycobacterium avium
AKIPTRLFAGAALPMAQGSSAAD

SEQ ID NO: 15114 - protein, 22 aa, Mycobacterium avium
AKKLRSPALLATVFGLVTVVGL

SEQ ID NO: 15115 - protein, 17 aa, Mycobacterium avium
AKLILMAIALICAAAVF

SEQ ID NO: 15116 - protein, 18 aa, Mycobacterium avium
AKRARGSPLRVMILLVLV

SEQ ID NO: 15117 - protein, 45 aa, Mycobacterium avium
AKRPPAWSLSNWPVRWKVLAIVLVPLMLATVFGVLRIHGAMANAA

SEQ ID NO: 15118 - protein, 30 aa, Mycobacterium avium
AKSEYFTGTGLKGWFQRWFFTAVGQVPIDR

SEQ ID NO: 15119 - protein, 23 aa, Mycobacterium avium
AKSPVMCAYWSKPAKAASSSVNL

SEQ ID NO: 15120 - protein, 18 aa, Mycobacterium avium
ALAALPLPTLDDLSRALV

SEQ ID NO: 15121 - protein, 26 aa, Mycobacterium avium
ALAASSLPYWLGDSLRAATAGVLALL

SEQ ID NO: 15122 - protein, 25 aa, Mycobacterium avium
ALADARLAWVLGAAMLLIAIAFAAL

SEQ ID NO: 15123 - protein, 20 aa, Mycobacterium avium
ALAEHVDWSLIDVIRGTPGA

SEQ ID NO: 15124 - protein, 31 aa, Mycobacterium avium
ALAGLNLPAWGSLRLALPMTGNGDAAFLAGE

SEQ ID NO: 15125 - protein, 31 aa, Mycobacterium avium
ALALPISVVAAWRYRSWRPVLLAVVAGAGVP

SEQ ID NO: 15126 - protein, 17 aa, Mycobacterium avium
ALAPTLRHRDFSGDVID

SEQ ID NO: 15127 - protein, 18 aa, Mycobacterium avium
ALASRAGDHVDFLAHDRV

SEQ ID NO: 15128 - protein, 21 aa, Mycobacterium avium
ALCAAIEILAAVIPFAQGLGV

SEQ ID NO: 15129 - protein, 17 aa, Mycobacterium avium
ALDEVKAALDSRGPASG

SEQ ID NO: 15130 - protein, 18 aa, Mycobacterium avium
ALFGMLLRDTRWWLGGLG

SEQ ID NO: 15131 - protein, 17 aa, Mycobacterium avium
ALFSAVSVFCRRVQTPD

SEQ ID NO: 15132 - protein, 18 aa, Mycobacterium avium
ALFTFLLTPAFVGASALI

SEQ ID NO: 15133 - protein, 24 aa, Mycobacterium avium
ALGLRYALGARRWARLGMAGSAGG

SEQ ID NO: 15134 - protein, 19 aa, Mycobacterium avium
ALGVLLAGLVNDGRLTTEI

SEQ ID NO: 15135 - protein, 27 aa, Mycobacterium avium
ALHVILGWRPVLLIPFTFALFTPLAVP

SEQ ID NO: 15136 - protein, 18 aa, Mycobacterium avium
ALIGLVALVFAVVTSNEL

SEQ ID NO: 15137 - protein, 26 aa, Mycobacterium avium
ALILALGAGYLRWSAGSADDLAQARA

SEQ ID NO: 15138 - protein, 24 aa, Mycobacterium avium
ALIPLCYVAFLGLEAYFCYFVIRN

SEQ ID NO: 15139 - protein, 17 aa, Mycobacterium avium
ALLALLLCTVFELDHSY

SEQ ID NO: 15140 - protein, 17 aa, Mycobacterium avium
ALLDRFPGAGVFLQVDR

SEQ ID NO: 15141 - protein, 21 aa, Mycobacterium avium
ALLGALWAWIVPPVRAVVALT

SEQ ID NO: 15142 - protein, 23 aa, Mycobacterium avium
ALLGWAVGEVIWAVYDVRPEFEH

SEQ ID NO: 15143 - protein, 22 aa, Mycobacterium avium
ALLPANRVELGFLLIAGVIAFA

SEQ ID NO: 15144 - protein, 19 aa, Mycobacterium avium
ALLRALHVILGWRPVLLIP

SEQ ID NO: 15145 - protein, 18 aa, Mycobacterium avium
ALLSAIGIAGMDRLVQRN

SEQ ID NO: 15146 - protein, 21 aa, Mycobacterium avium
ALLVNRWPLAESGVRSGLAPA

SEQ ID NO: 15147 - protein, 32 aa, Mycobacterium avium
ALLVPTMRFRPFIRLTVEWVEVLAFIVLLPAA

SEQ ID NO: 15148 - protein, 25 aa, Mycobacterium avium
ALLVPVVDWLDRHGLPRGGAVALVL

SEQ ID NO: 15149 - protein, 17 aa, Mycobacterium avium
ALLYKPFVRQIRTTRQM

SEQ ID NO: 15150 - protein, 17 aa, Mycobacterium avium
ALMDMWAPGLIGFPIFM

SEQ ID NO: 15151 - protein, 22 aa, Mycobacterium avium
ALNVRAGDRLRLQTPHGPREAA

SEQ ID NO: 15152 - protein, 23 aa, Mycobacterium avium
ALNVRAGDRLRLQTPHGPREAAV

SEQ ID NO: 15153 - protein, 17 aa, Mycobacterium avium
ALPAKDRAAQVFPQTVP

SEQ ID NO: 15154 - protein, 23 aa, Mycobacterium avium
ALPSRVFGWLALVFGVGFSTLAL

SEQ ID NO: 15155 - protein, 18 aa, Mycobacterium avium
ALQFQHWHWAALALTAPV

SEQ ID NO: 15156 - protein, 19 aa, Mycobacterium avium
ALRGFTFGIDFNGGTTVSM

SEQ ID NO: 15157 - protein, 18 aa, Mycobacterium avium
ALRGKNTRGWFLASAGAD

SEQ ID NO: 15158 - protein, 21 aa, Mycobacterium avium
ALRRMKAVALSFLIGATGLFL

SEQ ID NO: 15159 - protein, 23 aa, Mycobacterium avium
ALTDPRYTAVLNHLISQTGRAAY

SEQ ID NO: 15160 - protein, 34 aa, Mycobacterium avium
ALTLGSWAVAAGWAFALAMIDGWQRGFAGRLTTR

SEQ ID NO: 15161 - protein, 17 aa, Mycobacterium avium
ALTRSRPAATIWCAAYG

SEQ ID NO: 15162 - protein, 18 aa, Mycobacterium avium
ALVAEVVLWLGRYRSRTM

SEQ ID NO: 15163 - protein, 17 aa, Mycobacterium avium
ALVDFYTERLIKPVERD

SEQ ID NO: 15164 - protein, 21 aa, Mycobacterium avium
ALVEPTILLAVFALSIPAGSA

SEQ ID NO: 15165 - protein, 18 aa, Mycobacterium avium
ALVIWGSAVVAGFESVTK

SEQ ID NO: 15166 - protein, 24 aa, Mycobacterium avium
ALVLPGAGMPGEFVATTLAIWNPY

SEQ ID NO: 15167 - protein, 17 aa, Mycobacterium avium
ALVPLFVSDVMGRGIGT

SEQ ID NO: 15168 - protein, 19 aa, Mycobacterium avium
ALVSRSWAMAFATLVSRLT

SEQ ID NO: 15169 - protein, 20 aa, Mycobacterium avium
ALVTRRWALAWIALAGTAIA

SEQ ID NO: 15170 - protein, 34 aa, Mycobacterium avium
ALVVARCEYHPTPGCPQTRITGVPGPGPETSTAN

SEQ ID NO: 15171 - protein, 19 aa, Mycobacterium avium
ALYNPRSWWQSIIVWFAAA

SEQ ID NO: 15172 - protein, 31 aa, Mycobacterium avium
AMFNLPPSFPIVVLACGIWSAVWASNHRHRV

SEQ ID NO: 15173 - protein, 24 aa, Mycobacterium avium
AMGAGRRFILRMVLAEAAGIGCVG

SEQ ID NO: 15174 - protein, 22 aa, Mycobacterium avium
AMGRAGVTVVHRGATAPHREQY

SEQ ID NO: 15175 - protein, 27 aa, Mycobacterium avium
AMNLAGGRPRLIWYAPHFVEGESSSKA

SEQ ID NO: 15176 - protein, 27 aa, Mycobacterium avium
AMNLAGGRPRLVWYAPHFVEGESSSKA

SEQ ID NO: 15177 - protein, 28 aa, Mycobacterium avium
AMNLAGGRPRLVWYAPHFVEGESSSKAT

SEQ ID NO: 15178 - protein, 17 aa, Mycobacterium avium
AMPAHPKKFSWHWWWLM

SEQ ID NO: 15179 - protein, 32 aa, Mycobacterium avium
AMRPDCRLDVAGLWGVLRINRYTQMYGAARLT

SEQ ID NO: 15180 - protein, 25 aa, Mycobacterium avium
AMTPMAALVLRFGLAAMVLAVWTVI

SEQ ID NO: 15181 - protein, 20 aa, Mycobacterium avium
AMVAAPTHHWVKDLPDEPVW

SEQ ID NO: 15182 - protein, 20 aa, Mycobacterium avium
ANGPLLFFVAYQVFFNAVGW

SEQ ID NO: 15183 - protein, 23 aa, Mycobacterium avium
ANLACVVCAIGLGGVAGVGRVFD

SEQ ID NO: 15184 - protein, 19 aa, Mycobacterium avium
ANVFTRINAILGVLLLIVL

SEQ ID NO: 15185 - protein, 22 aa, Mycobacterium avium
APAESFPAWLGPFVRHQPVSRV

SEQ ID NO: 15186 - protein, 22 aa, Mycobacterium avium
APAESFPAWMAPFIRNQPVSQV

SEQ ID NO: 15187 - protein, 24 aa, Mycobacterium avium
APAEVFPGWLQPVVRYSPISPTIE

SEQ ID NO: 15188 - protein, 21 aa, Mycobacterium avium
APAGLSAPVLDEFADAPRAPM

SEQ ID NO: 15189 - protein, 17 aa, Mycobacterium avium
APARILLVALGFGYFYA

SEQ ID NO: 15190 - protein, 25 aa, Mycobacterium avium
APARSRPRILSGLGAAAVIAAAAAP

SEQ ID NO: 15191 - protein, 25 aa, Mycobacterium avium
APARSRPRLLSGLGAAAVIAAAAAP

SEQ ID NO: 15192 - protein, 26 aa, Mycobacterium avium
APARSRPRLLSGLGAAAVIAAAAAPL

SEQ ID NO: 15193 - protein, 25 aa, Mycobacterium avium
APAVVAWAALIGWIDLHGTWASWMA

SEQ ID NO: 15194 - protein, 26 aa, Mycobacterium avium
APDRFIPVAMLPFWDIEESVKEIHRV

SEQ ID NO: 15195 - protein, 25 aa, Mycobacterium avium
APDRVCATLSRVARALPQVKPGTVT

SEQ ID NO: 15196 - protein, 28 aa, Mycobacterium avium
APEDRFDRCRAFAAAVRRECDGAAAIGP

SEQ ID NO: 15197 - protein, 26 aa, Mycobacterium avium
APEDRFDRCRAFAAAVSRECDGAAAI

SEQ ID NO: 15198 - protein, 20 aa, Mycobacterium avium
APEHHEFKQAAVMSDLPGEL

SEQ ID NO: 15199 - protein, 22 aa, Mycobacterium avium
APEVPAAFDAVIARGMAKDPER

SEQ ID NO: 15200 - protein, 25 aa, Mycobacterium avium
APFGWYYDLLALWAHVSTTSIWMRL

SEQ ID NO: 15201 - protein, 18 aa, Mycobacterium avium
APGRTAPPLPAFVAPPDL

SEQ ID NO: 15202 - protein, 17 aa, Mycobacterium avium
APIEYVLHNAVLHVFYA

SEQ ID NO: 15203 - protein, 30 aa, Mycobacterium avium
APKRTSTWRHLPAILLVASLVLFTIAMAGP

SEQ ID NO: 15204 - protein, 20 aa, Mycobacterium avium
APLNWFPLYLGPALAVELVA

SEQ ID NO: 15205 - protein, 23 aa, Mycobacterium avium
APPAAEVPIRVELAPGGPVPARS

SEQ ID NO: 15206 - protein, 17 aa, Mycobacterium avium
APPDLGVNCQYRAVPDP

SEQ ID NO: 15207 - protein, 22 aa, Mycobacterium avium
APPGRRGLFGSFTQLGSPAGML

SEQ ID NO: 15208 - protein, 24 aa, Mycobacterium avium
APPSPGRWRVLLLAAVAACAACGI

SEQ ID NO: 15209 - protein, 24 aa, Mycobacterium avium
APRPRPASLAFLGGWVLGLVGLTA

SEQ ID NO: 15210 - protein, 18 aa, Mycobacterium avium
APRPSIMRRGVGRAFDDI

SEQ ID NO: 15211 - protein, 18 aa, Mycobacterium avium
APTAVRMVLVEGENGDGA

SEQ ID NO: 15212 - protein, 23 aa, Mycobacterium avium
APVAIALAMLFAPFAGADDYTDQ

SEQ ID NO: 15213 - protein, 17 aa, Mycobacterium avium
APVAWGVLIGFVALYLI

SEQ ID NO: 15214 - protein, 25 aa, Mycobacterium avium
APVWGRRCDWSRGVDVHAGRAGDQP

SEQ ID NO: 15215 - protein, 30 aa, Mycobacterium avium
APYRAPRVFQVAAWVAIVAGIVFIVAVIFF

SEQ ID NO: 15216 - protein, 30 aa, Mycobacterium avium
APYRTPRVFQVAAWVAIVAGIVFIVAVIFF

SEQ ID NO: 15217 - protein, 27 aa, Mycobacterium avium
AQCVKAELLAASSWRVAVNAGTDSTGR

SEQ ID NO: 15218 - protein, 23 aa, Mycobacterium avium
AQLNRVLAHLVRTARVETATGFT

SEQ ID NO: 15219 - protein, 23 aa, Mycobacterium avium
AQPVRVASWRGWGPDRREIAAGP

SEQ ID NO: 15220 - protein, 18 aa, Mycobacterium avium
AQRPAVFIFNHRNQVDPV

SEQ ID NO: 15221 - protein, 24 aa, Mycobacterium avium
AQRPLKWRLMLTVGEPGDPTHDAT

SEQ ID NO: 15222 - protein, 26 aa, Mycobacterium avium
AQRSRLTEVLSRIYGHPVSVQLQIDT

SEQ ID NO: 15223 - protein, 26 aa, Mycobacterium avium
AQRTRLTEVLSRIYGHPVSVQLQIDT

SEQ ID NO: 15224 - protein, 28 aa, Mycobacterium avium
AQRWASPFWQLWDLALLWLAQLHGGNGL

SEQ ID NO: 15225 - protein, 20 aa, Mycobacterium avium
ARAAGLPLPAGAGVTVTDTP

SEQ ID NO: 15226 - protein, 18 aa, Mycobacterium avium
ARAAITRMYRTVGRQQPN

SEQ ID NO: 15227 - protein, 24 aa, Mycobacterium avium
ARAASGRRRYGWLALTTALLGWAV

SEQ ID NO: 15228 - protein, 25 aa, Mycobacterium avium
ARAGGKRLGAVWFNLLQTSLAAGLS

SEQ ID NO: 15229 - protein, 17 aa, Mycobacterium avium
ARDRAAAALRTAALQRL

SEQ ID NO: 15230 - protein, 29 aa, Mycobacterium avium
ARDVAVRGAAFCLVALTLAAAAGAVRARL

SEQ ID NO: 15231 - protein, 17 aa, Mycobacterium avium
ARFHPVLYWATIVASTT

SEQ ID NO: 15232 - protein, 22 aa, Mycobacterium avium
ARGRALGTVCTYVMTSHVLPDR

SEQ ID NO: 15233 - protein, 20 aa, Mycobacterium avium
ARGSPLRVMILLVLVTALAS

SEQ ID NO: 15234 - protein, 20 aa, Mycobacterium avium
ARHYLYRHLVLFGDKYDSVM

SEQ ID NO: 15235 - protein, 20 aa, Mycobacterium avium
ARIRALRMPFYRTVTSMVIW

SEQ ID NO: 15236 - protein, 18 aa, Mycobacterium avium
ARLLRACGEIDGLERVRF

SEQ ID NO: 15237 - protein, 19 aa, Mycobacterium avium
ARLQLKIQPGPFRYLPSNL

SEQ ID NO: 15238 - protein, 26 aa, Mycobacterium avium
ARLRPARAGATLGLPSGAWRLDAGGE

SEQ ID NO: 15239 - protein, 17 aa, Mycobacterium avium
ARLRPPAPWPAPGYPPA

SEQ ID NO: 15240 - protein, 30 aa, Mycobacterium avium
ARLRPPAPWPAPGYPPAWPGSGPAPQWPAP

SEQ ID NO: 15241 - protein, 25 aa, Mycobacterium avium
ARLWLPTYLAWFLAGMMLKVLQEMG

SEQ ID NO: 15242 - protein, 17 aa, Mycobacterium avium
ARMDDMLVQADLMRKQI

SEQ ID NO: 15243 - protein, 22 aa, Mycobacterium avium
ARMLYCLTRALIALAATMAAGW

SEQ ID NO: 15244 - protein, 18 aa, Mycobacterium avium
ARMLYRMVLHPLMLGFVI

SEQ ID NO: 15245 - protein, 17 aa, Mycobacterium avium
ARMNPDLLMIESDHDMR

SEQ ID NO: 15246 - protein, 19 aa, Mycobacterium avium
ARNYIPLRGTGKVAYLQSL

SEQ ID NO: 15247 - protein, 19 aa, Mycobacterium avium
ARPMRTWTLIPALAGAGLV

SEQ ID NO: 15248 - protein, 25 aa, Mycobacterium avium
ARPPVRLGAGIARPATERAPHTPAT

SEQ ID NO: 15249 - protein, 25 aa, Mycobacterium avium
ARPPVRLGAGVARPATERAPHAPAT

SEQ ID NO: 15250 - protein, 25 aa, Mycobacterium avium
ARPPVRLGAGVARPATERAPHTPAT

SEQ ID NO: 15251 - protein, 20 aa, Mycobacterium avium
ARPYALSMMAAVWLSALLVF

SEQ ID NO: 15252 - protein, 21 aa, Mycobacterium avium
ARPYALSMMAAVWLSALLVFA

SEQ ID NO: 15253 - protein, 20 aa, Mycobacterium avium
ARPYALSMMAAVWLSVLLVF

SEQ ID NO: 15254 - protein, 26 aa, Mycobacterium avium
ARQAVWPERMFSLLAGFVEAGESFEV

SEQ ID NO: 15255 - protein, 18 aa, Mycobacterium avium
ARQRTAMVAAERLEQMLA

SEQ ID NO: 15256 - protein, 19 aa, Mycobacterium avium
ARQRTAMVAAERLEQMLAS

SEQ ID NO: 15257 - protein, 19 aa, Mycobacterium avium
ARRAYPRGGGGDMGAMLGG

SEQ ID NO: 15258 - protein, 18 aa, Mycobacterium avium
ARRRRRGTATDRAYRYEY

SEQ ID NO: 15259 - protein, 18 aa, Mycobacterium avium
ARRRSGPPRGRRRALPIL

SEQ ID NO: 15260 - protein, 30 aa, Mycobacterium avium
ARRRSGPPRGRRRALPILLRTGAAALGSTV

SEQ ID NO: 15261 - protein, 28 aa, Mycobacterium avium
ARSARPGLCARLRLRPGRDRRGDHRTGP

SEQ ID NO: 15262 - protein, 20 aa, Mycobacterium avium
ARSGSGLGLALVAQQAELHG

SEQ ID NO: 15263 - protein, 17 aa, Mycobacterium avium
ARTGWYLALVAASAALT

SEQ ID NO: 15264 - protein, 19 aa, Mycobacterium avium
ARVAAALRSAEPVGATPRA

SEQ ID NO: 15265 - protein, 21 aa, Mycobacterium avium
ARVAAALRSAEPVGATPRAAH

SEQ ID NO: 15266 - protein, 19 aa, Mycobacterium avium
ARVIMRPVPGVAVGGAERF

SEQ ID NO: 15267 - protein, 18 aa, Mycobacterium avium
ARVSELDGALAQTQQAVD

SEQ ID NO: 15268 - protein, 24 aa, Mycobacterium avium
ARVVALRSRLLVRLSGRGGMVSLA

SEQ ID NO: 15269 - protein, 25 aa, Mycobacterium avium
ARVVALRSRLLVRLSGRGGMVSLAC

SEQ ID NO: 15270 - protein, 25 aa, Mycobacterium avium
ARWSRGKMLAGLRCHSDAGSQFTSI

SEQ ID NO: 15271 - protein, 30 aa, Mycobacterium avium
ARYRALVLSRLRLVSIGVPVAIGLLAGIIA

SEQ ID NO: 15272 - protein, 30 aa, Mycobacterium avium
ARYRALVLSRLRLVSVGVPVAIGLLAGIIA

SEQ ID NO: 15273 - protein, 18 aa, Mycobacterium avium
ASAFLWPRSLQARATRRA

SEQ ID NO: 15274 - protein, 22 aa, Mycobacterium avium
ASEAGRLLRRWRRDPVVAVQAL

SEQ ID NO: 15275 - protein, 19 aa, Mycobacterium avium
ASFGNKWMWSPIVVTPPVV

SEQ ID NO: 15276 - protein, 19 aa, Mycobacterium avium
ASFVRGARAVEYLRRRQQA

SEQ ID NO: 15277 - protein, 25 aa, Mycobacterium avium
ASGPFFKVVLHNLALYQISQPWVDA

SEQ ID NO: 15278 - protein, 19 aa, Mycobacterium avium
ASHELRTPLTAMRTNLEVL

SEQ ID NO: 15279 - protein, 22 aa, Mycobacterium avium
ASLAAANARLGAPRTVEMAPTH

SEQ ID NO: 15280 - protein, 20 aa, Mycobacterium avium
ASLHDARKAYEKGDYGAART

SEQ ID NO: 15281 - protein, 19 aa, Mycobacterium avium
ASLPLHAFFGVVLMGTRKV

SEQ ID NO: 15282 - protein, 23 aa, Mycobacterium avium
ASLPVLRWSWAPVLVAASLTTLI

SEQ ID NO: 15283 - protein, 17 aa, Mycobacterium avium
ASLWMRLPDLFAGIVCW

SEQ ID NO: 15284 - protein, 33 aa, Mycobacterium avium
ASSEISIAVPAHWKPGTVQALRDALRTHLGFVR

SEQ ID NO: 15285 - protein, 36 aa, Mycobacterium avium
ASSGRCAWWSPRRCGWARRISRRWCRTPESSGTGPT

SEQ ID NO: 15286 - protein, 24 aa, Mycobacterium avium
ASSLLRLLVLALIMVPITAAVMLR

SEQ ID NO: 15287 - protein, 19 aa, Mycobacterium avium
ASVIMEFGLTMPIAREVDA

SEQ ID NO: 15288 - protein, 28 aa, Mycobacterium avium
ASVISWVSVVIIGIWVMLQIASILQFSV

SEQ ID NO: 15289 - protein, 24 aa, Mycobacterium avium
ATADRLRRMVPFVDRISGAVLVLV

SEQ ID NO: 15290 - protein, 25 aa, Mycobacterium avium
ATAFAMAGLLAWARRRPVLAGVLVG

SEQ ID NO: 15291 - protein, 18 aa, Mycobacterium avium
ATAGLIWFAVSRNRKHRK

SEQ ID NO: 15292 - protein, 24 aa, Mycobacterium avium
ATAGRRAAALGAELPEAARAELVS

SEQ ID NO: 15293 - protein, 24 aa, Mycobacterium avium
ATAGRRAAALGAELPEAVRAELVS

SEQ ID NO: 15294 - protein, 23 aa, Mycobacterium avium
ATARAAARPEPRADATATAAVPP

SEQ ID NO: 15295 - protein, 33 aa, Mycobacterium avium
ATDSYKMSGGQGFAIPIGRAMAVANQIRSGAGS

SEQ ID NO: 15296 - protein, 25 aa, Mycobacterium avium
ATESGAWRRVAEWVAGRPALAAVAA

SEQ ID NO: 15297 - protein, 23 aa, Mycobacterium avium
ATGCLRVRASLTISPDDLVSGEI

SEQ ID NO: 15298 - protein, 24 aa, Mycobacterium avium
ATKSARGRLRIPRRPGRPRWLRLP

SEQ ID NO: 15299 - protein, 25 aa, Mycobacterium avium
ATKSARGRLRLPRRPGRPRWLRLPG

SEQ ID NO: 15300 - protein, 23 aa, Mycobacterium avium
ATKSARGRLRLPRRPGRSRWLRL

SEQ ID NO: 15301 - protein, 18 aa, Mycobacterium avium
ATLAGHWALPRWGSHRLI

SEQ ID NO: 15302 - protein, 19 aa, Mycobacterium avium
ATLALATIVRRVEIESLSD

SEQ ID NO: 15303 - protein, 20 aa, Mycobacterium avium
ATLSLRWLSTLIYLGGLATV

SEQ ID NO: 15304 - protein, 19 aa, Mycobacterium avium
ATTAGWKTLALFGYAAIYA

SEQ ID NO: 15305 - protein, 23 aa, Mycobacterium avium
ATTCAPVRSVLRAIPPLFGAVPT

SEQ ID NO: 15306 - protein, 23 aa, Mycobacterium avium
ATTFPWVFLFPAGVLVLILVCAN

SEQ ID NO: 15307 - protein, 21 aa, Mycobacterium avium
ATTGGAWQWSASKNARLNTIN

SEQ ID NO: 15308 - protein, 24 aa, Mycobacterium avium
ATVAFPMYFLKSFAYAGVATVAFV

SEQ ID NO: 15309 - protein, 18 aa, Mycobacterium avium
ATVIGLLTILGFSLYDTV

SEQ ID NO: 15310 - protein, 20 aa, Mycobacterium avium
ATVSVAGFPAVNSDIQRLLS

SEQ ID NO: 15311 - protein, 17 aa, Mycobacterium avium
ATYRSPVLWLVPLLVVA

SEQ ID NO: 15312 - protein, 22 aa, Mycobacterium avium
AVAAIAVRGWLLRALAGLLAVA

SEQ ID NO: 15313 - protein, 18 aa, Mycobacterium avium
AVAAIFVIGVVALVVSLA

SEQ ID NO: 15314 - protein, 35 aa, Mycobacterium avium
AVAAWSVFRLFWLVYLGMTFGWLFGAMVFQVVLWG

SEQ ID NO: 15315 - protein, 17 aa, Mycobacterium avium
AVAELIPSLVDMLGAGD

SEQ ID NO: 15316 - protein, 21 aa, Mycobacterium avium
AVAGCAAALFVLLRAVDRKGW

SEQ ID NO: 15317 - protein, 17 aa, Mycobacterium avium
AVAGSWRAGGARFDPAR

SEQ ID NO: 15318 - protein, 18 aa, Mycobacterium avium
AVAGSWRAGGARFDPARA

SEQ ID NO: 15319 - protein, 18 aa, Mycobacterium avium
AVALAFASFRRWIRIGRL

SEQ ID NO: 15320 - protein, 24 aa, Mycobacterium avium
AVALGAVGAWIGCRRHGIPLPAFA

SEQ ID NO: 15321 - protein, 19 aa, Mycobacterium avium
AVALTFVWLGMVLAISFLE

SEQ ID NO: 15322 - protein, 17 aa, Mycobacterium avium
AVAVWCVSAIVGAFAAH

SEQ ID NO: 15323 - protein, 19 aa, Mycobacterium avium
AVFFPRLGPTVATIASMAT

SEQ ID NO: 15324 - protein, 21 aa, Mycobacterium avium
AVFGGLLWWVVFGLHDEPLAA

SEQ ID NO: 15325 - protein, 26 aa, Mycobacterium avium
AVGGWFFGWLTDRCGSLAAPLLAHLA

SEQ ID NO: 15326 - protein, 18 aa, Mycobacterium avium
AVGVVRLGQRRCLVQELP

SEQ ID NO: 15327 - protein, 22 aa, Mycobacterium avium
AVHPVAMLGFMVLISAAFVAAT

SEQ ID NO: 15328 - protein, 18 aa, Mycobacterium avium
AVIFFTGFILGHRGGHHG

SEQ ID NO: 15329 - protein, 19 aa, Mycobacterium avium
AVIFFTGFILGHRGGHHGH

SEQ ID NO: 15330 - protein, 26 aa, Mycobacterium avium
AVINSALPRWLWTRGSALVSAMWGVA

SEQ ID NO: 15331 - protein, 27 aa, Mycobacterium avium
AVINSALPRWLWTRGSALVSAMWGVAT

SEQ ID NO: 15332 - protein, 18 aa, Mycobacterium avium
AVIPAVAAALSWIILGQR

SEQ ID NO: 15333 - protein, 30 aa, Mycobacterium avium
AVLIVWRRDLRAIVGLLAWQGVALAAIPLV

SEQ ID NO: 15334 - protein, 17 aa, Mycobacterium avium
AVLMTGLAQINRDSVDA

SEQ ID NO: 15335 - protein, 18 aa, Mycobacterium avium
AVLTWLAVLSCYDIRQHR

SEQ ID NO: 15336 - protein, 20 aa, Mycobacterium avium
AVLVCADFILLQVVTGAWTW

SEQ ID NO: 15337 - protein, 27 aa, Mycobacterium avium
AVLVRHCVRRFGGISGDVLGAAIELTA

SEQ ID NO: 15338 - protein, 28 aa, Mycobacterium avium
AVLWAVYSTRWWLSGLLVGLAAGIKLTP

SEQ ID NO: 15339 - protein, 24 aa, Mycobacterium avium
AVLWAVYSTRWWVSALLVGLAAGI

SEQ ID NO: 15340 - protein, 24 aa, Mycobacterium avium
AVLWAVYSTRWWVSGLLVGLAAGI

SEQ ID NO: 15341 - protein, 28 aa, Mycobacterium avium
AVMDSFYLPLVVRRRITFLAKSEYFTGT

SEQ ID NO: 15342 - protein, 18 aa, Mycobacterium avium
AVNEADYARMWVQAATTM

SEQ ID NO: 15343 - protein, 20 aa, Mycobacterium avium
AVNLPAFFASFMFLFVATGI

SEQ ID NO: 15344 - protein, 24 aa, Mycobacterium avium
AVPLCSLSAALVLNLWVGYFPTVQ

SEQ ID NO: 15345 - protein, 26 aa, Mycobacterium avium
AVPRGPSRLGRGWLAAIAAVLVLCAA

SEQ ID NO: 15346 - protein, 22 aa, Mycobacterium avium
AVQCKRLAKAVGVAAVQQVVAG

SEQ ID NO: 15347 - protein, 22 aa, Mycobacterium avium
AVQYRLPMTFVLFNNNAHAMCV

SEQ ID NO: 15348 - protein, 23 aa, Mycobacterium avium
AVQYRLPMTFVLFNNNAHAMCVT

SEQ ID NO: 15349 - protein, 23 aa, Mycobacterium avium
AVRGKVILIDFWAYSCINCQRAI

SEQ ID NO: 15350 - protein, 17 aa, Mycobacterium avium
AVTARVVPSNVFAVSSV

SEQ ID NO: 15351 - protein, 19 aa, Mycobacterium avium
AVTGPRSWLLAAVTVLAGV

SEQ ID NO: 15352 - protein, 25 aa, Mycobacterium avium
AVVPQPGRHDWPFADRAFAAALPWL

SEQ ID NO: 15353 - protein, 27 aa, Mycobacterium avium
AVVTSNELVAWVCIAASVVGVVLLILD

SEQ ID NO: 15354 - protein, 19 aa, Mycobacterium avium
AVWLLSAVTVCVFGVAPRF

SEQ ID NO: 15355 - protein, 17 aa, Mycobacterium avium
AVYAFDVASLCWVLVFA

SEQ ID NO: 15356 - protein, 19 aa, Mycobacterium avium
AVYGRWSQKIGWHSAEAST

SEQ ID NO: 15357 - protein, 19 aa, Mycobacterium avium
AWALARVIMRPVPGVAVGG

SEQ ID NO: 15358 - protein, 19 aa, Mycobacterium avium
AWGSCGKPFDGMEVRIVDP

SEQ ID NO: 15359 - protein, 20 aa, Mycobacterium avium
AWGVLIGFVALYLIGSLAGF

SEQ ID NO: 15360 - protein, 17 aa, Mycobacterium avium
AWLLTRWLIPGWTGRVL

SEQ ID NO: 15361 - protein, 23 aa, Mycobacterium avium
AWPWRLVFLVGVSALFAQQAVIV

SEQ ID NO: 15362 - protein, 18 aa, Mycobacterium avium
AWSVCMRMTLSGFYSHPW

SEQ ID NO: 15363 - protein, 24 aa, Mycobacterium avium
AYAPEEVFLMLSVAGVSAYALTPW

SEQ ID NO: 15364 - protein, 26 aa, Mycobacterium avium
AYGSLVMVFQWGWLRDLGFAQISSID

SEQ ID NO: 15365 - protein, 18 aa, Mycobacterium avium
AYGVVFTLFPIRPGLTLS

SEQ ID NO: 15366 - protein, 26 aa, Mycobacterium avium
AYPWHSPRDYWLLGIAAAVLIVLFGW

SEQ ID NO: 15367 - protein, 22 aa, Mycobacterium avium
AYRYLSRRLECALLGHDPAVAG

SEQ ID NO: 15368 - protein, 22 aa, Mycobacterium avium
AYRYLSRRLECALLGQDPAAAG

SEQ ID NO: 15369 - protein, 25 aa, Mycobacterium avium
AYSEERLRPPPGYKDTTVPGIFARD

SEQ ID NO: 15370 - protein, 24 aa, Mycobacterium avium
AYSEPRLQPPNGYKDTTVPGIWVP

SEQ ID NO: 15371 - protein, 19 aa, Mycobacterium avium
CAALLAKLPTIWTAVGAVC

SEQ ID NO: 15372 - protein, 18 aa, Mycobacterium avium
CADLSMLSKAEVERIWLP

SEQ ID NO: 15373 - protein, 19 aa, Mycobacterium avium
CASVIGGTVVVGWVISLIM

SEQ ID NO: 15374 - protein, 25 aa, Mycobacterium avium
CAVAPNILLLILFRVVQGVGGGMLL

SEQ ID NO: 15375 - protein, 26 aa, Mycobacterium avium
CAVVLRRLRAALALALACAPCNELVT

SEQ ID NO: 15376 - protein, 25 aa, Mycobacterium avium
CAVVLRRLRAALVLALACAPCNELV

SEQ ID NO: 15377 - protein, 26 aa, Mycobacterium avium
CAVVLRRLRAALVLALACAPCNELVT

SEQ ID NO: 15378 - protein, 21 aa, Mycobacterium avium
CCPVTPMLCRYCDSGTGFAVA

SEQ ID NO: 15379 - protein, 25 aa, Mycobacterium avium
CGFAMLPAYLLLVVRGAGARAPGVA

SEQ ID NO: 15380 - protein, 25 aa, Mycobacterium avium
CGFAMLPAYLLLVVRGAGTRAPGVA

SEQ ID NO: 15381 - protein, 17 aa, Mycobacterium avium
CGLDRPAEFVAGSPIQV

SEQ ID NO: 15382 - protein, 18 aa, Mycobacterium avium
CGNAAMVLGVPDPADINA

SEQ ID NO: 15383 - protein, 18 aa, Mycobacterium avium
CGNAAMVLGVPNPADINA

SEQ ID NO: 15384 - protein, 24 aa, Mycobacterium avium
CHREQWPVAGPVLGRLGWFVESTL

SEQ ID NO: 15385 - protein, 25 aa, Mycobacterium avium
CHREQWPVAGPVLGRLGWFVESTLS

SEQ ID NO: 15386 - protein, 19 aa, Mycobacterium avium
CLPMLAQIPVFLGLYHVLR

SEQ ID NO: 15387 - protein, 23 aa, Mycobacterium avium
CLTLMVIASLTWGAGRLNNAVGE

SEQ ID NO: 15388 - protein, 23 aa, Mycobacterium avium
CLTLMVIASLTWGAGRLNNAVGR

SEQ ID NO: 15389 - protein, 18 aa, Mycobacterium avium
CLVEPWALHRPFLGWLGW

SEQ ID NO: 15390 - protein, 26 aa, Mycobacterium avium
CPIWPAGARLLIRFTGPELWWVGGVA

SEQ ID NO: 15391 - protein, 29 aa, Mycobacterium avium
CTLNALPPRPEVRLLWALIAAAAIIEGAL

SEQ ID NO: 15392 - protein, 26 aa, Mycobacterium avium
CVAFAARLAHRMGRVLPGENSVTVVL

SEQ ID NO: 15393 - protein, 20 aa, Mycobacterium avium
CVALGVPMALVLARGGTRLV

SEQ ID NO: 15394 - protein, 26 aa, Mycobacterium avium
CVALGVPMALVLARGGTRLVRSLRPL

SEQ ID NO: 15395 - protein, 28 aa, Mycobacterium avium
CVALGVPMALVLARGGTRLVRSLRPLIL

SEQ ID NO: 15396 - protein, 19 aa, Mycobacterium avium
CVALPWLATICLRVRRVEG

SEQ ID NO: 15397 - protein, 17 aa, Mycobacterium avium
CVGALVLIAGLTAPAAW

SEQ ID NO: 15398 - protein, 19 aa, Mycobacterium avium
CVIDPKGGMELGAGAPMFT

SEQ ID NO: 15399 - protein, 27 aa, Mycobacterium avium
CVLGAITAAMPVRWRGVWAGWWLGTAV

SEQ ID NO: 15400 - protein, 19 aa, Mycobacterium avium
CVLLYLTPLILGLWRGETS

SEQ ID NO: 15401 - protein, 27 aa, Mycobacterium avium
CVPELLIPVLLLNFTPMFGHPSHASPS

SEQ ID NO: 15402 - protein, 19 aa, Mycobacterium avium
CVVMARVAPNTVFLFLLNS

SEQ ID NO: 15403 - protein, 18 aa, Mycobacterium avium
CWMGVVIWSAYVFNMTMF

SEQ ID NO: 15404 - protein, 19 aa, Mycobacterium avium
CWMGVVIWSAYVFNMTMFA

SEQ ID NO: 15405 - protein, 18 aa, Mycobacterium avium
CWTDHPRADQLRRALEDS

SEQ ID NO: 15406 - protein, 18 aa, Mycobacterium avium
CYPYREPLPAPPPGGPPP

SEQ ID NO: 15407 - protein, 34 aa, Mycobacterium avium
DAAAPPPRRKRLFTRSRLFPAAAVVIPAAAVLLV

SEQ ID NO: 15408 - protein, 24 aa, Mycobacterium avium
DAALRAGGVVVVFPGGDYDVYRPT

SEQ ID NO: 15409 - protein, 18 aa, Mycobacterium avium
DAARRTLNRPGFGLTDSL

SEQ ID NO: 15410 - protein, 28 aa, Mycobacterium avium
DAGPGSALRAVWRAGLRLWVPSLALTAA

SEQ ID NO: 15411 - protein, 17 aa, Mycobacterium avium
DAIKFNYPPAGLNPFNS

SEQ ID NO: 15412 - protein, 28 aa, Mycobacterium avium
DALAARRIDNVMLVSAFLAAAALAQNVG

SEQ ID NO: 15413 - protein, 19 aa, Mycobacterium avium
DALESLAIIGNWRYWNRPN

SEQ ID NO: 15414 - protein, 19 aa, Mycobacterium avium
DALGFLQDFFATAVFLGIA

SEQ ID NO: 15415 - protein, 21 aa, Mycobacterium avium
DALLRLARRSAASGAALAGGV

SEQ ID NO: 15416 - protein, 25 aa, Mycobacterium avium
DAQSGSIGLGFAIPVDQAKRIADEL

SEQ ID NO: 15417 - protein, 19 aa, Mycobacterium avium
DATRGLLRVPLRDGLYVRE

SEQ ID NO: 15418 - protein, 21 aa, Mycobacterium avium
DAWPPSARARPRLHPVDIPAG

SEQ ID NO: 15419 - protein, 18 aa, Mycobacterium avium
DDAESFDAAGFFRTGDLG

SEQ ID NO: 15420 - protein, 22 aa, Mycobacterium avium
DDLHPVLNLTSARLIVGKAVNP

SEQ ID NO: 15421 - protein, 22 aa, Mycobacterium avium
DDLHPVLNLTSARLIVGKPVNP

SEQ ID NO: 15422 - protein, 18 aa, Mycobacterium avium
DDLRPVVVDVQGLRAHVV

SEQ ID NO: 15423 - protein, 18 aa, Mycobacterium avium
DDRLHRWRPDAAALEPVA

SEQ ID NO: 15424 - protein, 30 aa, Mycobacterium avium
DEIEFRTRLWLPYLPLILAAAVGWGHAAGK

SEQ ID NO: 15425 - protein, 19 aa, Mycobacterium avium
DEIPVLVLPTGKRIEFDLA

SEQ ID NO: 15426 - protein, 17 aa, Mycobacterium avium
DEIREGRTFRSAVPRGW

SEQ ID NO: 15427 - protein, 24 aa, Mycobacterium avium
DELARSAGYPSVFAQGMFSAALLA

SEQ ID NO: 15428 - protein, 21 aa, Mycobacterium avium
DELRDAGGRFAEFWRQQHEAA

SEQ ID NO: 15429 - protein, 21 aa, Mycobacterium avium
DELRVPIGVTATGEPLIFDLK

SEQ ID NO: 15430 - protein, 21 aa, Mycobacterium avium
DELRVPIGVTATGEPLMFDLK

SEQ ID NO: 15431 - protein, 20 aa, Mycobacterium avium
DEPIPLSAMLARAGVPPRQW

SEQ ID NO: 15432 - protein, 23 aa, Mycobacterium avium
DEPKPAEVAWRIEKGDGDQYVLR

SEQ ID NO: 15433 - protein, 22 aa, Mycobacterium avium
DEPRNWRLKVTVTDEGGQYKMS

SEQ ID NO: 15434 - protein, 20 aa, Mycobacterium avium
DEVEARLALGQPSGQAASPY

SEQ ID NO: 15435 - protein, 17 aa, Mycobacterium avium
DEVRPEAAAVLKKLRAN

SEQ ID NO: 15436 - protein, 23 aa, Mycobacterium avium
DEVTEYFLVGSFTSWLLALGGIG

SEQ ID NO: 15437 - protein, 17 aa, Mycobacterium avium
DEYLEVCYKLWEGSWEA

SEQ ID NO: 15438 - protein, 25 aa, Mycobacterium avium
DFIANILRNLGIDWDPAKGTVNGLD

SEQ ID NO: 15439 - protein, 25 aa, Mycobacterium avium
DFMELRSAPIPLRLAFEGYCLALWA

SEQ ID NO: 15440 - protein, 18 aa, Mycobacterium avium
DFRPELAALDEVFCQALA

SEQ ID NO: 15441 - protein, 18 aa, Mycobacterium avium
DFVPARFVLANSAEVGVP

SEQ ID NO: 15442 - protein, 21 aa, Mycobacterium avium
DGKARAGVEVRLADDGEILSR

SEQ ID NO: 15443 - protein, 26 aa, Mycobacterium avium
DGLLPPRFARVNPRTMTPVHNTVIVA

SEQ ID NO: 15444 - protein, 25 aa, Mycobacterium avium
DGPLQIAVSLMWPAGIAALVYAVRA

SEQ ID NO: 15445 - protein, 26 aa, Mycobacterium avium
DGPLQIAVSLMWPAGIAALVYAVRAA

SEQ ID NO: 15446 - protein, 18 aa, Mycobacterium avium
DGQKWVALAVPGYALAGA

SEQ ID NO: 15447 - protein, 21 aa, Mycobacterium avium
DGQRPLAVGFFFSLGHSTVVF

SEQ ID NO: 15448 - protein, 22 aa, Mycobacterium avium
DGQRPLAVGFFFSLGHSTVVFA

SEQ ID NO: 15449 - protein, 18 aa, Mycobacterium avium
DGRFGRGAGVVFGGGRVR

SEQ ID NO: 15450 - protein, 22 aa, Mycobacterium avium
DGRYRRLWEGGRRGAVTVGTAG

SEQ ID NO: 15451 - protein, 21 aa, Mycobacterium avium
DGSAALAYRTRLGIAVVSGDP

SEQ ID NO: 15452 - protein, 19 aa, Mycobacterium avium
DGSRARYLARTGPRPPPPP

SEQ ID NO: 15453 - protein, 20 aa, Mycobacterium avium
DGTLRLFGRDSLVVNTGGEK

SEQ ID NO: 15454 - protein, 24 aa, Mycobacterium avium
DHHPDLLALRARYERVAESMSAHF

SEQ ID NO: 15455 - protein, 23 aa, Mycobacterium avium
DIAVLQLRGAAGLPTATIGGEAT

SEQ ID NO: 15456 - protein, 22 aa, Mycobacterium avium
DKDSRVLVEFNVDRSLALDQGT

SEQ ID NO: 15457 - protein, 18 aa, Mycobacterium avium
DKITLTFSDPAGGGSRTL

SEQ ID NO: 15458 - protein, 24 aa, Mycobacterium avium
DKWPEKLARISFWCMNIGLAWMVF

SEQ ID NO: 15459 - protein, 19 aa, Mycobacterium avium
DLFSAGGAARCLISTMTAM

SEQ ID NO: 15460 - protein, 31 aa, Mycobacterium avium
DLLPAVRAEIRWAFTPPRTWLMGVVANVIAA

SEQ ID NO: 15461 - protein, 18 aa, Mycobacterium avium
DLMSSLGPAARVRARLVL

SEQ ID NO: 15462 - protein, 29 aa, Mycobacterium avium
DLNDPPPCAVGFLPPPLMRTPADETVREL

SEQ ID NO: 15463 - protein, 19 aa, Mycobacterium avium
DLSAFVVFSSMAGIVGTPG

SEQ ID NO: 15464 - protein, 18 aa, Mycobacterium avium
DLSHAYTAVFVIAVVLVV

SEQ ID NO: 15465 - protein, 27 aa, Mycobacterium avium
DLVRGTLRILLPISIVGAVLLVAGGAI

SEQ ID NO: 15466 - protein, 22 aa, Mycobacterium avium
DNEILGLCFMFVLAGLDTVTSA

SEQ ID NO: 15467 - protein, 21 aa, Mycobacterium avium
DNPWKWNVIGLLAIALAGAVV

SEQ ID NO: 15468 - protein, 26 aa, Mycobacterium avium
DPAPAIPRMKVPVWSLLIIGVAALAV

SEQ ID NO: 15469 - protein, 26 aa, Mycobacterium avium
DPAPAIPRMKVPVWSLLIIGVASLAV

SEQ ID NO: 15470 - protein, 23 aa, Mycobacterium avium
DPATFARRRRNVLIGVGAGLAVL

SEQ ID NO: 15471 - protein, 22 aa, Mycobacterium avium
DPDGGAAFVRRLVTLTTALLIG

SEQ ID NO: 15472 - protein, 27 aa, Mycobacterium avium
DPDLRRGRAAGPPSPRRPPGAVTKLVL

SEQ ID NO: 15473 - protein, 25 aa, Mycobacterium avium
DPDVRPRLILGAGLIALSVLGLRHL

SEQ ID NO: 15474 - protein, 26 aa, Mycobacterium avium
DPEDMKARETVGWMRAELPKVPEAGT

SEQ ID NO: 15475 - protein, 26 aa, Mycobacterium avium
DPGELRSAHLLSPAPRPSIMRRGVGR

SEQ ID NO: 15476 - protein, 19 aa, Mycobacterium avium
DPGTLWPGVTAEQLAPWLL

SEQ ID NO: 15477 - protein, 20 aa, Mycobacterium avium
DPGTLWPGVTAEQLAPWLLD

SEQ ID NO: 15478 - protein, 18 aa, Mycobacterium avium
DPITHFALLVIGAVVATA

SEQ ID NO: 15479 - protein, 25 aa, Mycobacterium avium
DPQQRLLLEVSWEALERAGIDPATL

SEQ ID NO: 15480 - protein, 26 aa, Mycobacterium avium
DPQQRMALELTWEALEHARIPASSLR

SEQ ID NO: 15481 - protein, 29 aa, Mycobacterium avium
DPRISRAHLILRFEQGRWLAIDNGSLNGT

SEQ ID NO: 15482 - protein, 19 aa, Mycobacterium avium
DPRNWAGVTSLSIPSWWQP

SEQ ID NO: 15483 - protein, 22 aa, Mycobacterium avium
DPRTLWRNPVMFIVEIGAAWST

SEQ ID NO: 15484 - protein, 20 aa, Mycobacterium avium
DPVAALTWQLPAGDQPGPAA

SEQ ID NO: 15485 - protein, 18 aa, Mycobacterium avium
DPVAPRLADTGRYEVFAP

SEQ ID NO: 15486 - protein, 17 aa, Mycobacterium avium
DPVLRFASLQTVFHHGR

SEQ ID NO: 15487 - protein, 18 aa, Mycobacterium avium
DPVLRFASLQTVFHHGRS

SEQ ID NO: 15488 - protein, 24 aa, Mycobacterium avium
DPWLPSLGNPLSFLNPFNIAFALG

SEQ ID NO: 15489 - protein, 17 aa, Mycobacterium avium
DQELQLRAFEELGHGSG

SEQ ID NO: 15490 - protein, 17 aa, Mycobacterium avium
DQLKPTLPVFLANLSTI

SEQ ID NO: 15491 - protein, 18 aa, Mycobacterium avium
DQLSGVRVVRAFAREDFE

SEQ ID NO: 15492 - protein, 26 aa, Mycobacterium avium
DQRHRGRAGAWVLLPVELLNNPPVNA

SEQ ID NO: 15493 - protein, 23 aa, Mycobacterium avium
DQRRLAKELARYGVRSNTIRIGN

SEQ ID NO: 15494 - protein, 19 aa, Mycobacterium avium
DRAAALALAAAYSHAQATA

SEQ ID NO: 15495 - protein, 23 aa, Mycobacterium avium
DRAAEVWESLLAVADAAGGDWPA

SEQ ID NO: 15496 - protein, 17 aa, Mycobacterium avium
DRADPGTLWPGVTAEQL

SEQ ID NO: 15497 - protein, 20 aa, Mycobacterium avium
DRAGGFDFGDGARRQAGGEV

SEQ ID NO: 15498 - protein, 18 aa, Mycobacterium avium
DRAYAFLVPPTIRGVNQS

SEQ ID NO: 15499 - protein, 19 aa, Mycobacterium avium
DRAYAFLVPPTIRGVNQSR

SEQ ID NO: 15500 - protein, 21 aa, Mycobacterium avium
DRDGTTWLLWDGKRSQINLTD

SEQ ID NO: 15501 - protein, 24 aa, Mycobacterium avium
DRGEFNGHLWISMDYVEGTDASRL

SEQ ID NO: 15502 - protein, 22 aa, Mycobacterium avium
DRLDALDVRRLLRRALRRAQPV

SEQ ID NO: 15503 - protein, 23 aa, Mycobacterium avium
DRLKEMIKVRGFQVAPAEIDAVL

SEQ ID NO: 15504 - protein, 20 aa, Mycobacterium avium
DRLSAINWNRLQDDKDAEVW

SEQ ID NO: 15505 - protein, 19 aa, Mycobacterium avium
DRLTGFIYAFDDLLVRYRK

SEQ ID NO: 15506 - protein, 18 aa, Mycobacterium avium
DRLWIRFIPDTEHRSQVI

SEQ ID NO: 15507 - protein, 23 aa, Mycobacterium avium
DRPPRRLRLLLSVAATVLALDIV

SEQ ID NO: 15508 - protein, 25 aa, Mycobacterium avium
DRRDFSEPTALNWARHGTDVDFGAL

SEQ ID NO: 15509 - protein, 21 aa, Mycobacterium avium
DRRPTPKTVRLFILLVIALAL

SEQ ID NO: 15510 - protein, 22 aa, Mycobacterium avium
DRRRWAAVYLLLGGLVLGFVGN

SEQ ID NO: 15511 - protein, 17 aa, Mycobacterium avium
DRVPRRAVTHGAQLLVV

SEQ ID NO: 15512 - protein, 21 aa, Mycobacterium avium
DRWDPARAVALMTAHRCTHMA

SEQ ID NO: 15513 - protein, 19 aa, Mycobacterium avium
DRYRSWLPALKEMVPSLGV

SEQ ID NO: 15514 - protein, 21 aa, Mycobacterium avium
DSAKKWVIWSAAIGVVVGIIY

SEQ ID NO: 15515 - protein, 28 aa, Mycobacterium avium
DSFLARLEPSLSAFRHDLSVLPTVSNAY

SEQ ID NO: 15516 - protein, 21 aa, Mycobacterium avium
DSGALFVRVGDTWHPVLNLAS

SEQ ID NO: 15517 - protein, 24 aa, Mycobacterium avium
DSGALFVRVGDTWHPVLNLASARL

SEQ ID NO: 15518 - protein, 35 aa, Mycobacterium avium
DSRAARLIGALGLFCAACWLIQILVHHHSNPSWHY

SEQ ID NO: 15519 - protein, 21 aa, Mycobacterium avium
DSRLLPSPRTVVVATHHLPEG

SEQ ID NO: 15520 - protein, 21 aa, Mycobacterium avium
DSRTVRWDDIDGLRFHRGSWA

SEQ ID NO: 15521 - protein, 24 aa, Mycobacterium avium
DSVLNVRGARNMPCETRPGKRAPT

SEQ ID NO: 15522 - protein, 17 aa, Mycobacterium avium
DSWHGVTHVGSSTWIAW

SEQ ID NO: 15523 - protein, 19 aa, Mycobacterium avium
DTGFGDLVMRPDLSTLRRI

SEQ ID NO: 15524 - protein, 18 aa, Mycobacterium avium
DTHSWRWMLGLACVPAVL

SEQ ID NO: 15525 - protein, 17 aa, Mycobacterium avium
DTIGEDWRLFGATTGVY

SEQ ID NO: 15526 - protein, 20 aa, Mycobacterium avium
DTLRPDRIVLGIKQDSLRAE

SEQ ID NO: 15527 - protein, 20 aa, Mycobacterium avium
DTLRPDRIVLGIKQDSPRAE

SEQ ID NO: 15528 - protein, 20 aa, Mycobacterium avium
DTLRPDRIVLGIKQDSPRAQ

SEQ ID NO: 15529 - protein, 31 aa, Mycobacterium avium
DVAIPRWRFEILRLGAWFIIFQVTFFVFLII

SEQ ID NO: 15530 - protein, 21 aa, Mycobacterium avium
DVASLCWVLVFAARFVVQGLL

SEQ ID NO: 15531 - protein, 24 aa, Mycobacterium avium
DVGRRGTQHLGLLVLRAGLGVVLG

SEQ ID NO: 15532 - protein, 23 aa, Mycobacterium avium
DVIPARWSLVAVCVVVVAAASRL

SEQ ID NO: 15533 - protein, 25 aa, Mycobacterium avium
DVIRRRRLTWGFLFLFNSLAVYWME

SEQ ID NO: 15534 - protein, 17 aa, Mycobacterium avium
DVLRNGAIIRRFVYLVL

SEQ ID NO: 15535 - protein, 25 aa, Mycobacterium avium
DVLSGWMLGTAWAFAVMLVGTWWDN

SEQ ID NO: 15536 - protein, 25 aa, Mycobacterium avium
DVMARRASAHAARWRTGRFTYRPDH

SEQ ID NO: 15537 - protein, 24 aa, Mycobacterium avium
DVRIPLALPGHRGLVWLTMLAAVA

SEQ ID NO: 15538 - protein, 23 aa, Mycobacterium avium
DVRLEKRLAATVPEGSPAEIGAV

SEQ ID NO: 15539 - protein, 18 aa, Mycobacterium avium
DVRRFLTAVHALRQIERA

SEQ ID NO: 15540 - protein, 18 aa, Mycobacterium avium
DVTLCGLALGILVAAVVA

SEQ ID NO: 15541 - protein, 25 aa, Mycobacterium avium
DVVPSRLRRPGAVVLEIDDEDPIFE

SEQ ID NO: 15542 - protein, 19 aa, Mycobacterium avium
DWLEKTGFVDFYNRYIQPL

SEQ ID NO: 15543 - protein, 24 aa, Mycobacterium avium
DWPARARSACRHFVLDNEVEELSS

SEQ ID NO: 15544 - protein, 17 aa, Mycobacterium avium
DYARMWVQAATVMGTYQ

SEQ ID NO: 15545 - protein, 24 aa, Mycobacterium avium
DYVSEIRSGGSFRLGASSAGAQAH

SEQ ID NO: 15546 - protein, 17 aa, Mycobacterium avium
EAAFGPIDVWVNVAFTS

SEQ ID NO: 15547 - protein, 18 aa, Mycobacterium avium
EAAIMAAWEKAGGDTSPL

SEQ ID NO: 15548 - protein, 19 aa, Mycobacterium avium
EAASALLLYIGKIGTFGQL

SEQ ID NO: 15549 - protein, 19 aa, Mycobacterium avium
EAMGLRPIPFVVGTRVLGG

SEQ ID NO: 15550 - protein, 26 aa, Mycobacterium avium
EATGRVRWALCLVDGSPLRATQSLSE

SEQ ID NO: 15551 - protein, 26 aa, Mycobacterium avium
EDKELAVLCSKAWNDFHLDEWAATAP

SEQ ID NO: 15552 - protein, 24 aa, Mycobacterium avium
EDLHPVLNLTSARLITGRPVDPTM

SEQ ID NO: 15553 - protein, 20 aa, Mycobacterium avium
EDRFLPKVGPWALYGLLFTI

SEQ ID NO: 15554 - protein, 27 aa, Mycobacterium avium
EDYRRVEIAGLPECSLLGAAAGGAIHL

SEQ ID NO: 15555 - protein, 35 aa, Mycobacterium avium
EEAAPAKLSRRSLVIGNAVIAFAVIGLASLATAIA

SEQ ID NO: 15556 - protein, 19 aa, Mycobacterium avium
EERTQVPVEWDQLRNSITN

SEQ ID NO: 15557 - protein, 24 aa, Mycobacterium avium
EESAWRATARNGLLLIAVWALGSM

SEQ ID NO: 15558 - protein, 18 aa, Mycobacterium avium
EESAWRATARSGLLLIAV

SEQ ID NO: 15559 - protein, 17 aa, Mycobacterium avium
EESRSYLAPTINAFTAQ

SEQ ID NO: 15560 - protein, 18 aa, Mycobacterium avium
EESVKEIHRVAGKGAKCV

SEQ ID NO: 15561 - protein, 17 aa, Mycobacterium avium
EEVDAVIYDEEFSDSIA

SEQ ID NO: 15562 - protein, 20 aa, Mycobacterium avium
EFANPVQFICGGSFETAGGP

SEQ ID NO: 15563 - protein, 23 aa, Mycobacterium avium
EFGRSHYPVMVFIQTALLAGCLV

SEQ ID NO: 15564 - protein, 23 aa, Mycobacterium avium
EFSRGELHGGSWDNLNVKRAWSV

SEQ ID NO: 15565 - protein, 17 aa, Mycobacterium avium
EGACGFAVVAGTRVLLD

SEQ ID NO: 15566 - protein, 26 aa, Mycobacterium avium
EGEAMLFGEYIRFMALVEYSADELKT

SEQ ID NO: 15567 - protein, 17 aa, Mycobacterium avium
EGGQCIRSFMPDLPLPY

SEQ ID NO: 15568 - protein, 17 aa, Mycobacterium avium
EGMLARIGKEQQRTKAA

SEQ ID NO: 15569 - protein, 22 aa, Mycobacterium avium
EGPDWSWLKWLPHIDIPGELDG

SEQ ID NO: 15570 - protein, 22 aa, Mycobacterium avium
EGPEWSWLKWLPHIDIPGELDG

SEQ ID NO: 15571 - protein, 19 aa, Mycobacterium avium
EGSLGRLVVELADDADNAA

SEQ ID NO: 15572 - protein, 25 aa, Mycobacterium avium
EGYPIKASARYGLYYTPGSDLYRDT

SEQ ID NO: 15573 - protein, 24 aa, Mycobacterium avium
EHDVAIVLGSGWSPAVAALGTPTA

SEQ ID NO: 15574 - protein, 24 aa, Mycobacterium avium
EHHRPRPGAAPARATGPGAAEDHA

SEQ ID NO: 15575 - protein, 20 aa, Mycobacterium avium
EIGMPVSQFTVAFMTAILLG

SEQ ID NO: 15576 - protein, 26 aa, Mycobacterium avium
EIGQFTRWLVSFLVGRLDRIAPFRLS

SEQ ID NO: 15577 - protein, 17 aa, Mycobacterium avium
EIGVPIFFVLSGYLLFR

SEQ ID NO: 15578 - protein, 24 aa, Mycobacterium avium
EIPAPRPIALGLFNAIPEAPPLTA

SEQ ID NO: 15579 - protein, 19 aa, Mycobacterium avium
EIRDEMIIFLFAGHDTTAT

SEQ ID NO: 15580 - protein, 25 aa, Mycobacterium avium
EKAMAANSVNFVWITDFQPYQPQLG

SEQ ID NO: 15581 - protein, 24 aa, Mycobacterium avium
EKSWRKRLPTIFIDVARLALICVG

SEQ ID NO: 15582 - protein, 18 aa, Mycobacterium avium
ELAFRGVLHGALNRAWGF

SEQ ID NO: 15583 - protein, 24 aa, Mycobacterium avium
ELASLRRRLVTAIALAGPVIAVAM

SEQ ID NO: 15584 - protein, 26 aa, Mycobacterium avium
ELCWRNVRRRNLGWRMWYGGPWFSTR

SEQ ID NO: 15585 - protein, 22 aa, Mycobacterium avium
ELDALKTLGIDPVRRLVVPRFL

SEQ ID NO: 15586 - protein, 24 aa, Mycobacterium avium
ELDGPRVLVTFTVASNLRLGERTE

SEQ ID NO: 15587 - protein, 19 aa, Mycobacterium avium
ELDMRTRTSIGLLAAADAA

SEQ ID NO: 15588 - protein, 20 aa, Mycobacterium avium
ELDMRTRTSIGLLAAADAAG

SEQ ID NO: 15589 - protein, 20 aa, Mycobacterium avium
ELDVAWMIFAHMVFQELAGL

SEQ ID NO: 15590 - protein, 18 aa, Mycobacterium avium
ELEELRALLGARVATVPD

SEQ ID NO: 15591 - protein, 27 aa, Mycobacterium avium
ELFFWLPGLVCLLALGELLWRGKGLLV

SEQ ID NO: 15592 - protein, 25 aa, Mycobacterium avium
ELGIILTLLMGWQFTAAEFVGGPLM

SEQ ID NO: 15593 - protein, 20 aa, Mycobacterium avium
ELHLRVLLICASVIGGTVVV

SEQ ID NO: 15594 - protein, 17 aa, Mycobacterium avium
ELIEGIGSRVLAWVNSV

SEQ ID NO: 15595 - protein, 29 aa, Mycobacterium avium
ELPPPGFPPDRPEGFEQPGNVDPFDQQAE

SEQ ID NO: 15596 - protein, 19 aa, Mycobacterium avium
ELRTRLLISLAAIALTTIF

SEQ ID NO: 15597 - protein, 21 aa, Mycobacterium avium
ELTALRCTRLFGASGTMLMAI

SEQ ID NO: 15598 - protein, 26 aa, Mycobacterium avium
ELVNGLRLGLANAWLFVVAAELIASS

SEQ ID NO: 15599 - protein, 22 aa, Mycobacterium avium
EMIALPLSFLVLIWVFGGLLAA

SEQ ID NO: 15600 - protein, 19 aa, Mycobacterium avium
EMLFLRWLLDGRVGRQWWA

SEQ ID NO: 15601 - protein, 20 aa, Mycobacterium avium
EMPARRTGPVVVDRHSDTEV

SEQ ID NO: 15602 - protein, 19 aa, Mycobacterium avium
EMPNFDWPTAVVSGGRDLI

SEQ ID NO: 15603 - protein, 23 aa, Mycobacterium avium
EMTQNLTPVLGFFAMNSDKFVPI

SEQ ID NO: 15604 - protein, 18 aa, Mycobacterium avium
ENDRLLLALMPESVLQRY

SEQ ID NO: 15605 - protein, 35 aa, Mycobacterium avium
ENLPRVNARGGPGGAPGCWQKITRDLWPAPELIMD

SEQ ID NO: 15606 - protein, 30 aa, Mycobacterium avium
EPAATICAGWGDARSVAFLTGAAVPVPPGR

SEQ ID NO: 15607 - protein, 17 aa, Mycobacterium avium
EPAPRVMAAAAPAATAA

SEQ ID NO: 15608 - protein, 21 aa, Mycobacterium avium
EPASPRWRPTVALLTAVVLVT

SEQ ID NO: 15609 - protein, 24 aa, Mycobacterium avium
EPASPRWRPTVALLTAVVLVTTGA

SEQ ID NO: 15610 - protein, 21 aa, Mycobacterium avium
EPASPRWRTTVALLTAVVLVT

SEQ ID NO: 15611 - protein, 24 aa, Mycobacterium avium
EPASYIRRTWLVLRMNPQRNVAAV

SEQ ID NO: 15612 - protein, 20 aa, Mycobacterium avium
EPDTALARGAALASAHAPLF

SEQ ID NO: 15613 - protein, 20 aa, Mycobacterium avium
EPELRRQAGELIDAIVASGE

SEQ ID NO: 15614 - protein, 17 aa, Mycobacterium avium
EPGLRKLLNENLAAGRL

SEQ ID NO: 15615 - protein, 21 aa, Mycobacterium avium
EPGLVLRGFVERVGDRAPLVA

SEQ ID NO: 15616 - protein, 31 aa, Mycobacterium avium
EPIVRKTAAWAWRLLVILAAALALFWVLAKL

SEQ ID NO: 15617 - protein, 32 aa, Mycobacterium avium
EPIVRKTAAWAWRLLVILAAALAVFWVLAKLE

SEQ ID NO: 15618 - protein, 18 aa, Mycobacterium avium
EPLIPLVIFADRDFSLCT

SEQ ID NO: 15619 - protein, 20 aa, Mycobacterium avium
EPLPSHRLILGAMLATTVFV

SEQ ID NO: 15620 - protein, 28 aa, Mycobacterium avium
EPPRPRKRRRLKLVRAIAAGILAAVLAT

SEQ ID NO: 15621 - protein, 18 aa, Mycobacterium avium
EPQLGWVAREGRIPLGYF

SEQ ID NO: 15622 - protein, 23 aa, Mycobacterium avium
EPTLHGCTGCVGDRIMVDKVSYG

SEQ ID NO: 15623 - protein, 24 aa, Mycobacterium avium
EPTSYIRRTWLVLRMNPQRNVAAV

SEQ ID NO: 15624 - protein, 22 aa, Mycobacterium avium
EQPWTPIMIILVITAVKILGSV

SEQ ID NO: 15625 - protein, 22 aa, Mycobacterium avium
EQTFPGWLRPYVRNQPVSQFAE

SEQ ID NO: 15626 - protein, 31 aa, Mycobacterium avium
EQVRISRFQTLLLKWAMMLLLGLLTSAVYLA

SEQ ID NO: 15627 - protein, 19 aa, Mycobacterium avium
ERDSPTWSPRFIDHLVGDR

SEQ ID NO: 15628 - protein, 22 aa, Mycobacterium avium
ERESGVLTRLWVQPVHRASTVA

SEQ ID NO: 15629 - protein, 23 aa, Mycobacterium avium
ERQRVCIARAILADRPVLVLDEA

SEQ ID NO: 15630 - protein, 20 aa, Mycobacterium avium
ERYMTLAAIAAMFFDLTVTA

SEQ ID NO: 15631 - protein, 21 aa, Mycobacterium avium
ESFDAAGFFRTGDLGRWALAD

SEQ ID NO: 15632 - protein, 21 aa, Mycobacterium avium
ESQAVAALMRAAGQPGAALVM

SEQ ID NO: 15633 - protein, 26 aa, Mycobacterium avium
ESQAVAALMRAAGQPGAALVMDDATG

SEQ ID NO: 15634 - protein, 23 aa, Mycobacterium avium
ESQGREGFVWVGLREPNQAEMQE

SEQ ID NO: 15635 - protein, 25 aa, Mycobacterium avium
ETATGFTRDAVRDWHVTRLSMIPAA

SEQ ID NO: 15636 - protein, 19 aa, Mycobacterium avium
ETDLAALVRSAATQVLPDA

SEQ ID NO: 15637 - protein, 20 aa, Mycobacterium avium
ETLKAILDRTPWRAEETTVI

SEQ ID NO: 15638 - protein, 19 aa, Mycobacterium avium
ETTLPWGLEIFYRRDPSGY

SEQ ID NO: 15639 - protein, 23 aa, Mycobacterium avium
ETTRRARLGKAFRELGGVERIVP

SEQ ID NO: 15640 - protein, 22 aa, Mycobacterium avium
ETVRIAPHFVRVRMTSPTLFED

SEQ ID NO: 15641 - protein, 22 aa, Mycobacterium avium
ETVRLVAACVAFIVILGVIVAL

SEQ ID NO: 15642 - protein, 26 aa, Mycobacterium avium
ETWTHYSGWWVFDMVMLVLFGLAAAG

SEQ ID NO: 15643 - protein, 18 aa, Mycobacterium avium
EVCYKLWEGSWEAGAVLR

SEQ ID NO: 15644 - protein, 34 aa, Mycobacterium avium
EVEMRRIADFVVRWPWLVIGFWAALAVALPLAFP

SEQ ID NO: 15645 - protein, 35 aa, Mycobacterium avium
EVEMRRIADFVVRWPWLVIGFWAALAVALPLAFPS

SEQ ID NO: 15646 - protein, 19 aa, Mycobacterium avium
EVIRLVRRLVPALVVVLAG

SEQ ID NO: 15647 - protein, 20 aa, Mycobacterium avium
EVIVVPVLVALLLSALLVPV

SEQ ID NO: 15648 - protein, 17 aa, Mycobacterium avium
EVMAHALELFSYLTEHI

SEQ ID NO: 15649 - protein, 18 aa, Mycobacterium avium
EYAGPRLALVEWASGMRL

SEQ ID NO: 15650 - protein, 24 aa, Mycobacterium avium
EYGMSAFLIGYGVLVFGLAALPSV

SEQ ID NO: 15651 - protein, 18 aa, Mycobacterium avium
EYHVTIGLTSPADDSAAQ

SEQ ID NO: 15652 - protein, 26 aa, Mycobacterium avium
EYLDLPRLWQILLIAGMFMWIAIIWR

SEQ ID NO: 15653 - protein, 23 aa, Mycobacterium avium
FAASYRWGHHVQRLVEHPDSEQL

SEQ ID NO: 15654 - protein, 25 aa, Mycobacterium avium
FADEFGWRGSFWDWLGGLDLNTVGY

SEQ ID NO: 15655 - protein, 26 aa, Mycobacterium avium
FADSSGPLAWCRFQGFDRDHCAAKLV

SEQ ID NO: 15656 - protein, 21 aa, Mycobacterium avium
FAFGTGRLWPNGVLAVAIFAA

SEQ ID NO: 15657 - protein, 21 aa, Mycobacterium avium
FAFRSPHYLVVIVLWIAHTWT

SEQ ID NO: 15658 - protein, 17 aa, Mycobacterium avium
FAGIGRRIARLRSETDA

SEQ ID NO: 15659 - protein, 22 aa, Mycobacterium avium
FAHPERDKWVATAVVVLTALMV

SEQ ID NO: 15660 - protein, 17 aa, Mycobacterium avium
FALRRTRKVTVNSQATQ

SEQ ID NO: 15661 - protein, 17 aa, Mycobacterium avium
FAMGRDGLLPPRFARVN

SEQ ID NO: 15662 - protein, 17 aa, Mycobacterium avium
FANMELLESVAPKRPST

SEQ ID NO: 15663 - protein, 17 aa, Mycobacterium avium
FANMELLESVAPKRTST

SEQ ID NO: 15664 - protein, 26 aa, Mycobacterium avium
FAPDGRFPWPTALVFAAGVLLAALRP

SEQ ID NO: 15665 - protein, 18 aa, Mycobacterium avium
FASASSRRPLLAAAGLLS

SEQ ID NO: 15666 - protein, 23 aa, Mycobacterium avium
FASGNPATIAWTLLFTTIEVIGT

SEQ ID NO: 15667 - protein, 18 aa, Mycobacterium avium
FATGWSAFGLRMALVPLF

SEQ ID NO: 15668 - protein, 22 aa, Mycobacterium avium
FAVACALSALASVRVDRKREDE

SEQ ID NO: 15669 - protein, 20 aa, Mycobacterium avium
FAVIRSMRSPREIGRSSRFY

SEQ ID NO: 15670 - protein, 24 aa, Mycobacterium avium
FAVVAWRAPLPGPWVAATTATLVA

SEQ ID NO: 15671 - protein, 18 aa, Mycobacterium avium
FAYSRTAAMLGLGSFLMQ

SEQ ID NO: 15672 - protein, 25 aa, Mycobacterium avium
FDDLLVRYRKSWSDLAAVVTVGGGA

SEQ ID NO: 15673 - protein, 19 aa, Mycobacterium avium
FDIAIVFLLFASRRAEIDQ

SEQ ID NO: 15674 - protein, 19 aa, Mycobacterium avium
FDKRLDVLTTDTAVRMDPP

SEQ ID NO: 15675 - protein, 29 aa, Mycobacterium avium
FDLMEACPDRTAAMLAEIVGLLRAGVLTP

SEQ ID NO: 15676 - protein, 25 aa, Mycobacterium avium
FDNGLRPEPIIALGSLVTYVLIERS

SEQ ID NO: 15677 - protein, 17 aa, Mycobacterium avium
FDNWPLVVAFSSIPMAL

SEQ ID NO: 15678 - protein, 37 aa, Mycobacterium avium
FDPKRAIDVRGWRKVGTAVVRWPKPIIVVTAAIAVIG

SEQ ID NO: 15679 - protein, 35 aa, Mycobacterium avium
FDPKRAIGFGRWRRIGTAIVRWPTPILTATIAVAL

SEQ ID NO: 15680 - protein, 19 aa, Mycobacterium avium
FDVTLCGLALGILVAAVVA

SEQ ID NO: 15681 - protein, 19 aa, Mycobacterium avium
FERRSKRTAGAALRALLAL

SEQ ID NO: 15682 - protein, 19 aa, Mycobacterium avium
FESTPLWAGIYMLPTTIGF

SEQ ID NO: 15683 - protein, 18 aa, Mycobacterium avium
FEVIGKFIGGMPLLLLAR

SEQ ID NO: 15684 - protein, 19 aa, Mycobacterium avium
FEVIGKFIGGMPLLLLARL

SEQ ID NO: 15685 - protein, 23 aa, Mycobacterium avium
FFAAALQHWQWLVLGYALVAIVG

SEQ ID NO: 15686 - protein, 24 aa, Mycobacterium avium
FFAAALQHWQWLVLGYALVAIVGA

SEQ ID NO: 15687 - protein, 22 aa, Mycobacterium avium
FFAAALQHWQWMVLGYALVAIV

SEQ ID NO: 15688 - protein, 24 aa, Mycobacterium avium
FFEFLTDLLDGWVAYFADHPHERA

SEQ ID NO: 15689 - protein, 17 aa, Mycobacterium avium
FFGEKRWAPGSHPHEAP

SEQ ID NO: 15690 - protein, 18 aa, Mycobacterium avium
FFKPRNFGMVFLAALLVG

SEQ ID NO: 15691 - protein, 18 aa, Mycobacterium avium
FFQRFRRILVPGTAPQVL

SEQ ID NO: 15692 - protein, 37 aa, Mycobacterium avium
FFRPMRSYFYWEKHCYDIPVCWSLRSVFDALDGIDTM

SEQ ID NO: 15693 - protein, 17 aa, Mycobacterium avium
FGARRVYLAGIACYGLA

SEQ ID NO: 15694 - protein, 22 aa, Mycobacterium avium
FGEVAVFVFFGLVAVLGTEYTQ

SEQ ID NO: 15695 - protein, 17 aa, Mycobacterium avium
FGFRITGGLGYAMAFLF

SEQ ID NO: 15696 - protein, 25 aa, Mycobacterium avium
FGIALGLRFNDGWIAMLAFVLVPVT

SEQ ID NO: 15697 - protein, 22 aa, Mycobacterium avium
FGICLGCQLYPLVARFRRPARS

SEQ ID NO: 15698 - protein, 17 aa, Mycobacterium avium
FGLAAMVLAVWTAIAKA

SEQ ID NO: 15699 - protein, 18 aa, Mycobacterium avium
FGLAAMVLAVWTAIAKAG

SEQ ID NO: 15700 - protein, 17 aa, Mycobacterium avium
FGLAAMVLAVWTVIAKA

SEQ ID NO: 15701 - protein, 28 aa, Mycobacterium avium
FGLLLLIVFCFIELRAPQPMVNVRLFRS

SEQ ID NO: 15702 - protein, 18 aa, Mycobacterium avium
FGLTMPIAREVDAVINHG

SEQ ID NO: 15703 - protein, 26 aa, Mycobacterium avium
FGSPYAVYLFYVFKIAGYIAGAAAVI

SEQ ID NO: 15704 - protein, 25 aa, Mycobacterium avium
FGSRTGMGFGRDLRAAMFEHVITFS

SEQ ID NO: 15705 - protein, 21 aa, Mycobacterium avium
FGSWIGFSFAFGQVMQVNFLE

SEQ ID NO: 15706 - protein, 17 aa, Mycobacterium avium
FGYASALAWVMFAVLLV

SEQ ID NO: 15707 - protein, 20 aa, Mycobacterium avium
FGYASALAWVMFAVLLVLTV

SEQ ID NO: 15708 - protein, 24 aa, Mycobacterium avium
FGYTMGFGSLGWVYASESFPSRLR

SEQ ID NO: 15709 - protein, 23 aa, Mycobacterium avium
FHAAGPVGAWVDTALRTFIGAGV

SEQ ID NO: 15710 - protein, 25 aa, Mycobacterium avium
FHNIAFPGAFLLLALAANGYLVHLA

SEQ ID NO: 15711 - protein, 30 aa, Mycobacterium avium
FIAKLRLFRVPELLAGSFLLALLAVTAANF

SEQ ID NO: 15712 - protein, 24 aa, Mycobacterium avium
FIANILRNLGIDWDPAKGTVNGLD

SEQ ID NO: 15713 - protein, 17 aa, Mycobacterium avium
FICHVGWEVTADIAHRL

SEQ ID NO: 15714 - protein, 17 aa, Mycobacterium avium
FIFAGIVAVISSQRGME

SEQ ID NO: 15715 - protein, 24 aa, Mycobacterium avium
FITAEGFGRMTYVPEVCAGVPTVA

SEQ ID NO: 15716 - protein, 37 aa, Mycobacterium avium
FIVPSIVALLGRWFWWPSPLPRRGVARVVKTVEPQPV

SEQ ID NO: 15717 - protein, 23 aa, Mycobacterium avium
FKAPKEFLFVAAVQRLGNGKADY

SEQ ID NO: 15718 - protein, 17 aa, Mycobacterium avium
FKKRGIDPEDFWRSAGL

SEQ ID NO: 15719 - protein, 18 aa, Mycobacterium avium
FKKRGIDPEDFWRSAGLP

SEQ ID NO: 15720 - protein, 19 aa, Mycobacterium avium
FKLVGSAVAAIFVIGVVAL

SEQ ID NO: 15721 - protein, 21 aa, Mycobacterium avium
FLAATVFFALLALYLVGVDQG

SEQ ID NO: 15722 - protein, 21 aa, Mycobacterium avium
FLAATVFFALLALYLVGVEQG

SEQ ID NO: 15723 - protein, 17 aa, Mycobacterium avium
FLAMVFATLSVFAGLGP

SEQ ID NO: 15724 - protein, 17 aa, Mycobacterium avium
FLASYLFNVYFQRGAPG

SEQ ID NO: 15725 - protein, 21 aa, Mycobacterium avium
FLEEPRIAARVAGARTRGGYL

SEQ ID NO: 15726 - protein, 24 aa, Mycobacterium avium
FLLIRFGGVYPVIFIGVLLIGLME

SEQ ID NO: 15727 - protein, 19 aa, Mycobacterium avium
FLLIVYKLLIGKAVLAVTG

SEQ ID NO: 15728 - protein, 17 aa, Mycobacterium avium
FLLRRVLLGSSYFTVPK

SEQ ID NO: 15729 - protein, 17 aa, Mycobacterium avium
FLLSGYLFYWVVIGVDP

SEQ ID NO: 15730 - protein, 18 aa, Mycobacterium avium
FLPAVIVVAVVLYVALRD

SEQ ID NO: 15731 - protein, 20 aa, Mycobacterium avium
FLPAVIVVAVVLYVALRDRR

SEQ ID NO: 15732 - protein, 20 aa, Mycobacterium avium
FLPGIIGVTIGRWRVDRNPP

SEQ ID NO: 15733 - protein, 25 aa, Mycobacterium avium
FLRESRAAAILQEPHVIPIHDWGEI

SEQ ID NO: 15734 - protein, 21 aa, Mycobacterium avium
FLSLTAAFGALVWIFQDGHLG

SEQ ID NO: 15735 - protein, 17 aa, Mycobacterium avium
FLSPDGKTARFAIDTST

SEQ ID NO: 15736 - protein, 26 aa, Mycobacterium avium
FLTDAFSRMIIGWRVASHMRTTVVLD

SEQ ID NO: 15737 - protein, 29 aa, Mycobacterium avium
FLTGYDWTRWLTVVAFDIAIVFLLFASRR

SEQ ID NO: 15738 - protein, 19 aa, Mycobacterium avium
FLTVEAWAFLQLGARQQSG

SEQ ID NO: 15739 - protein, 17 aa, Mycobacterium avium
FLYGGRNIWRYVVQIVP

SEQ ID NO: 15740 - protein, 18 aa, Mycobacterium avium
FMMALCFATTNGWWYVSS

SEQ ID NO: 15741 - protein, 21 aa, Mycobacterium avium
FMNFAYGWAFSNPVRKIYYNI

SEQ ID NO: 15742 - protein, 17 aa, Mycobacterium avium
FNLARTWHVQLSLFWTA

SEQ ID NO: 15743 - protein, 23 aa, Mycobacterium avium
FPALDYTTPLFAFLFLAALGVDY

SEQ ID NO: 15744 - protein, 20 aa, Mycobacterium avium
FPAPSTSVWTNGHRATADSA

SEQ ID NO: 15745 - protein, 18 aa, Mycobacterium avium
FPLQLPWLPLLAPLGALA

SEQ ID NO: 15746 - protein, 22 aa, Mycobacterium avium
FPLTGGAVWLIGWRVIQGVGGA

SEQ ID NO: 15747 - protein, 21 aa, Mycobacterium avium
FPLTGGAVWLIGWRVVQGVGG

SEQ ID NO: 15748 - protein, 22 aa, Mycobacterium avium
FPLTGGAVWLIGWRVVQGVGGA

SEQ ID NO: 15749 - protein, 17 aa, Mycobacterium avium
FPPEVHSTLLSSGPGPA

SEQ ID NO: 15750 - protein, 21 aa, Mycobacterium avium
FPPEVHSTLLSSGPGPAPLLA

SEQ ID NO: 15751 - protein, 17 aa, Mycobacterium avium
FPQVVAVISNMAEKKSL

SEQ ID NO: 15752 - protein, 17 aa, Mycobacterium avium
FPSGGALVVSNHSGGLF

SEQ ID NO: 15753 - protein, 17 aa, Mycobacterium avium
FPTNVRYGALAISYNIS

SEQ ID NO: 15754 - protein, 25 aa, Mycobacterium avium
FQEVSRAFAHFFLDWAKSTSVAAVI

SEQ ID NO: 15755 - protein, 23 aa, Mycobacterium avium
FQQLMAAFFPDFDGVAPRNTVCV

SEQ ID NO: 15756 - protein, 25 aa, Mycobacterium avium
FQRKPVARPAHRWVMVPDDGPPPPA

SEQ ID NO: 15757 - protein, 18 aa, Mycobacterium avium
FQWAEFVRQGAFMAATAV

SEQ ID NO: 15758 - protein, 19 aa, Mycobacterium avium
FQWQEFVRQGAFMAGTAVL

SEQ ID NO: 15759 - protein, 17 aa, Mycobacterium avium
FRALYFPGMIAAVQGDT

SEQ ID NO: 15760 - protein, 17 aa, Mycobacterium avium
FRHGLLIGVAIAAVAVI

SEQ ID NO: 15761 - protein, 17 aa, Mycobacterium avium
FRISLVSPVTVREGCGY

SEQ ID NO: 15762 - protein, 25 aa, Mycobacterium avium
FRKGADFTAAMAFEIGSTNLVVELG

SEQ ID NO: 15763 - protein, 17 aa, Mycobacterium avium
FRPVRLFAISVAITAVA

SEQ ID NO: 15764 - protein, 18 aa, Mycobacterium avium
FRPVRLFAISVAITAVAV

SEQ ID NO: 15765 - protein, 19 aa, Mycobacterium avium
FRSDALAVALRAHHISTVV

SEQ ID NO: 15766 - protein, 20 aa, Mycobacterium avium
FRTDLSYGMYIYAYPVQQLL

SEQ ID NO: 15767 - protein, 19 aa, Mycobacterium avium
FRTLDAFRIFDNIYVLTNG

SEQ ID NO: 15768 - protein, 20 aa, Mycobacterium avium
FRTLDAFRIFDNIYVLTNGA

SEQ ID NO: 15769 - protein, 24 aa, Mycobacterium avium
FSAFNGAGYDLEWLLDSSGKLSRD

SEQ ID NO: 15770 - protein, 24 aa, Mycobacterium avium
FSARPDLFGGAALAAFSSALALTR

SEQ ID NO: 15771 - protein, 23 aa, Mycobacterium avium
FSARPDLFGGTALALFSTALTHA

SEQ ID NO: 15772 - protein, 19 aa, Mycobacterium avium
FSFGVLMLRIEETALGAVI

SEQ ID NO: 15773 - protein, 32 aa, Mycobacterium avium
FSGAPHRALVWLGWLTAATAIGWAIDTATARI

SEQ ID NO: 15774 - protein, 22 aa, Mycobacterium avium
FSQVWADLWYDIPYSIETFQGP

SEQ ID NO: 15775 - protein, 17 aa, Mycobacterium avium
FSTLALVTRRWALAWIA

SEQ ID NO: 15776 - protein, 17 aa, Mycobacterium avium
FSTVGAFAIVALIRDAD

SEQ ID NO: 15777 - protein, 25 aa, Mycobacterium avium
FSVSSFGEFEFWFAGIKVATIVIFL

SEQ ID NO: 15778 - protein, 26 aa, Mycobacterium avium
FTAFAVGLMALWLAGLRWRRHGIRAA

SEQ ID NO: 15779 - protein, 22 aa, Mycobacterium avium
FTAQAFVSPYLVGVLGAATESS

SEQ ID NO: 15780 - protein, 20 aa, Mycobacterium avium
FTAVPLLWLLAIDIGLTILG

SEQ ID NO: 15781 - protein, 17 aa, Mycobacterium avium
FTFAHQSAWLRIFAVGL

SEQ ID NO: 15782 - protein, 29 aa, Mycobacterium avium
FTFAHQSAWLRIFAVGLMFAGVTTTALLV

SEQ ID NO: 15783 - protein, 20 aa, Mycobacterium avium
FTGPELWWVGGVAHRAAGLP

SEQ ID NO: 15784 - protein, 24 aa, Mycobacterium avium
FTLSESILQRWILPLSNAGIFLAA

SEQ ID NO: 15785 - protein, 26 aa, Mycobacterium avium
FTRLWPTVICLLGYAASFALLAVSIS

SEQ ID NO: 15786 - protein, 17 aa, Mycobacterium avium
FVALIAFVMLLVSIHSV

SEQ ID NO: 15787 - protein, 19 aa, Mycobacterium avium
FVAYQVFFNAVGWPTWGAI

SEQ ID NO: 15788 - protein, 24 aa, Mycobacterium avium
FVDAIICFIGFLFPLWDSKRQTLA

SEQ ID NO: 15789 - protein, 20 aa, Mycobacterium avium
FVFARLCAEPVIARAIAFED

SEQ ID NO: 15790 - protein, 19 aa, Mycobacterium avium
FVGNTFPFAGYTGGGNKQI

SEQ ID NO: 15791 - protein, 27 aa, Mycobacterium avium
FVLLRAVDRKGWRRRLHAYSEQHRFAL

SEQ ID NO: 15792 - protein, 23 aa, Mycobacterium avium
FVSGSLWGVFAVLAKEVMARLGQ

SEQ ID NO: 15793 - protein, 22 aa, Mycobacterium avium
FVSPRGALALFGGWTGVDLAEL

SEQ ID NO: 15794 - protein, 18 aa, Mycobacterium avium
FVVALGMGGMGYSFGAGI

SEQ ID NO: 15795 - protein, 21 aa, Mycobacterium avium
FVVPYPPGFPVLVPGQVVSKE

SEQ ID NO: 15796 - protein, 19 aa, Mycobacterium avium
FVYFSHALNKVWRRHMLAV

SEQ ID NO: 15797 - protein, 17 aa, Mycobacterium avium
FWCMNIGLAWMVFATLL

SEQ ID NO: 15798 - protein, 17 aa, Mycobacterium avium
FYGLNAFLFTNSAGATV

SEQ ID NO: 15799 - protein, 19 aa, Mycobacterium avium
FYLPPDIFENADFKKAMSQ

SEQ ID NO: 15800 - protein, 26 aa, Mycobacterium avium
FYLYATASALVFKPLFFPNISPSAGT

SEQ ID NO: 15801 - protein, 17 aa, Mycobacterium avium
FYWAIGIAIGLPIGMIA

SEQ ID NO: 15802 - protein, 21 aa, Mycobacterium avium
FYWAIGIAIGLPIGMIALTEI

SEQ ID NO: 15803 - protein, 17 aa, Mycobacterium avium
GAADFDELLALGGWSAA

SEQ ID NO: 15804 - protein, 18 aa, Mycobacterium avium
GAALLGFLGGLALSREAA

SEQ ID NO: 15805 - protein, 19 aa, Mycobacterium avium
GAALLGFLGGLALSREAAL

SEQ ID NO: 15806 - protein, 17 aa, Mycobacterium avium
GAALPHLAGELAQAATA

SEQ ID NO: 15807 - protein, 26 aa, Mycobacterium avium
GAARLHARLPSRRLLPALAVLAVAGM

SEQ ID NO: 15808 - protein, 18 aa, Mycobacterium avium
GAARPARPTPKRAHAAND

SEQ ID NO: 15809 - protein, 17 aa, Mycobacterium avium
GACPIVGSYGGRDPSLR

SEQ ID NO: 15810 - protein, 18 aa, Mycobacterium avium
GADPPGSRRESIQSTLGE

SEQ ID NO: 15811 - protein, 17 aa, Mycobacterium avium
GAEHAVREACELAVRSA

SEQ ID NO: 15812 - protein, 25 aa, Mycobacterium avium
GAETLRLKGYLLMCRNSRRDYADFA

SEQ ID NO: 15813 - protein, 18 aa, Mycobacterium avium
GAFADRAATVGTQKAGQP

SEQ ID NO: 15814 - protein, 17 aa, Mycobacterium avium
GAFVLAVAPGWFGVLVA

SEQ ID NO: 15815 - protein, 19 aa, Mycobacterium avium
GAGILAGRMAIGRLPPAVT

SEQ ID NO: 15816 - protein, 18 aa, Mycobacterium avium
GAGILVWLLPAGRDLDAF

SEQ ID NO: 15817 - protein, 26 aa, Mycobacterium avium
GAGLLALACWCLILATAALAGVLSGA

SEQ ID NO: 15818 - protein, 19 aa, Mycobacterium avium
GAGRLGVTTVTGRRASGLA

SEQ ID NO: 15819 - protein, 21 aa, Mycobacterium avium
GALAGAFGEFFYKDPRRISAA

SEQ ID NO: 15820 - protein, 22 aa, Mycobacterium avium
GALAGGVAVLFVQQRDAQAKQS

SEQ ID NO: 15821 - protein, 17 aa, Mycobacterium avium
GALLPLIAILLPPPTWR

SEQ ID NO: 15822 - protein, 21 aa, Mycobacterium avium
GALLVGVFFWFAVVGGATVVM

SEQ ID NO: 15823 - protein, 17 aa, Mycobacterium avium
GALRTAHEAGWLNIGQR

SEQ ID NO: 15824 - protein, 19 aa, Mycobacterium avium
GALTLRLLTIGGCVLLYLT

SEQ ID NO: 15825 - protein, 25 aa, Mycobacterium avium
GALTLRLLTIGGCVLLYLTPLILGL

SEQ ID NO: 15826 - protein, 19 aa, Mycobacterium avium
GALVGWSFVGPRLPAGARM

SEQ ID NO: 15827 - protein, 18 aa, Mycobacterium avium
GALVIVGGVATLIALGTK

SEQ ID NO: 15828 - protein, 25 aa, Mycobacterium avium
GAMYCLSFTRLPYFQTLGVPCAVGM

SEQ ID NO: 15829 - protein, 32 aa, Mycobacterium avium
GANSRLVKRGGPAAGHRSDPHWTRPEDSDADL

SEQ ID NO: 15830 - protein, 19 aa, Mycobacterium avium
GANVGRLVLIAAIGTILAV

SEQ ID NO: 15831 - protein, 22 aa, Mycobacterium avium
GAPDRFWLSAGQAFVSGVVVDW

SEQ ID NO: 15832 - protein, 27 aa, Mycobacterium avium
GAQRSRLTEVLSRIYGHPVSVQLQIDT

SEQ ID NO: 15833 - protein, 18 aa, Mycobacterium avium
GAQWGYRMVLPQLILMPV

SEQ ID NO: 15834 - protein, 25 aa, Mycobacterium avium
GARPHHGPRRWRAHNEWVTNPTSDG

SEQ ID NO: 15835 - protein, 17 aa, Mycobacterium avium
GARWRVAGSAALFVAGF

SEQ ID NO: 15836 - protein, 20 aa, Mycobacterium avium
GARYRAFDLMEACPDRTAAM

SEQ ID NO: 15837 - protein, 18 aa, Mycobacterium avium
GASASVLACDVGDRDAVA

SEQ ID NO: 15838 - protein, 19 aa, Mycobacterium avium
GASGEFRHGLLIGVAIAAV

SEQ ID NO: 15839 - protein, 17 aa, Mycobacterium avium
GASHMFLAVAMVDLDRF

SEQ ID NO: 15840 - protein, 30 aa, Mycobacterium avium
GASIPLLTARLSGRFGVPVHSTAQPGLSAA

SEQ ID NO: 15841 - protein, 22 aa, Mycobacterium avium
GATELLRALGISDPRELDVDRL

SEQ ID NO: 15842 - protein, 25 aa, Mycobacterium avium
GATGAGKGSVLWSLIAGIAPAIKTG

SEQ ID NO: 15843 - protein, 28 aa, Mycobacterium avium
GATYCLSFSRLPWFNTMGAPVAIGMLVV

SEQ ID NO: 15844 - protein, 23 aa, Mycobacterium avium
GAVQRWLPYATVVVGVLLVALGG

SEQ ID NO: 15845 - protein, 18 aa, Mycobacterium avium
GAVVVPFSTFVTARELRE

SEQ ID NO: 15846 - protein, 19 aa, Mycobacterium avium
GAVYFGSRTGMGFGRDLRA

SEQ ID NO: 15847 - protein, 21 aa, Mycobacterium avium
GCAARAKFSVAELVRPWLDTW

SEQ ID NO: 15848 - protein, 20 aa, Mycobacterium avium
GCAPRTCSPVLSRAADLLEW

SEQ ID NO: 15849 - protein, 19 aa, Mycobacterium avium
GCFALSFLAIGALRLDGAG

SEQ ID NO: 15850 - protein, 17 aa, Mycobacterium avium
GCGAVLVRHCVRRFGGI

SEQ ID NO: 15851 - protein, 23 aa, Mycobacterium avium
GCLPAVIWWACHRPNRLWWRYTG

SEQ ID NO: 15852 - protein, 19 aa, Mycobacterium avium
GCLVEPWALHRPFLGWLGW

SEQ ID NO: 15853 - protein, 24 aa, Mycobacterium avium
GDGKAWYLPVGVAGTLGDPTAAES

SEQ ID NO: 15854 - protein, 26 aa, Mycobacterium avium
GDGSAWSAANVRFDFYVRDIATRFDY

SEQ ID NO: 15855 - protein, 19 aa, Mycobacterium avium
GDGSWIACQFVVNKHDGSG

SEQ ID NO: 15856 - protein, 17 aa, Mycobacterium avium
GDLPLLLGALFANGLAR

SEQ ID NO: 15857 - protein, 19 aa, Mycobacterium avium
GDLPLLLGALFANGLARFV

SEQ ID NO: 15858 - protein, 20 aa, Mycobacterium avium
GDLVMRPDLSTLRRIPWLPG

SEQ ID NO: 15859 - protein, 17 aa, Mycobacterium avium
GDQLDERGLEYIGFAVD

SEQ ID NO: 15860 - protein, 17 aa, Mycobacterium avium
GDRWPPGRTSSWLLGCL

SEQ ID NO: 15861 - protein, 24 aa, Mycobacterium avium
GDRWQPGCTSSWLLGCLVLLFVTS

SEQ ID NO: 15862 - protein, 25 aa, Mycobacterium avium
GDTALRRHFNWVRSWYDFAVPDIGR

SEQ ID NO: 15863 - protein, 17 aa, Mycobacterium avium
GDVIPVDRSYVPPDINS

SEQ ID NO: 15864 - protein, 18 aa, Mycobacterium avium
GDVRGWDVLFGTHDAGAA

SEQ ID NO: 15865 - protein, 17 aa, Mycobacterium avium
GDWTAMIGSADELAARG

SEQ ID NO: 15866 - protein, 19 aa, Mycobacterium avium
GEERQLRAALANVVVSVVL

SEQ ID NO: 15867 - protein, 31 aa, Mycobacterium avium
GEGGPPRPRKRRRLKLVRAIAAGILAAVLAT

SEQ ID NO: 15868 - protein, 19 aa, Mycobacterium avium
GEIAEAAWFTRDEVRAALA

SEQ ID NO: 15869 - protein, 17 aa, Mycobacterium avium
GELCIRGPYLMQRYHKR

SEQ ID NO: 15870 - protein, 28 aa, Mycobacterium avium
GELFDYLRPRAVIYHRGLGPKFADVLGR

SEQ ID NO: 15871 - protein, 24 aa, Mycobacterium avium
GELWTHLRASGWRVLAGYASGAAA

SEQ ID NO: 15872 - protein, 33 aa, Mycobacterium avium
GEMRSWPAPLSILLALWAIRAVAHWLQARLGQR

SEQ ID NO: 15873 - protein, 17 aa, Mycobacterium avium
GEPKSPRGLWIAAGAAV

SEQ ID NO: 15874 - protein, 26 aa, Mycobacterium avium
GERDRLPIELAIAVLVLVVLLVVYRS

SEQ ID NO: 15875 - protein, 17 aa, Mycobacterium avium
GESKGYFLLGIWMSLLW

SEQ ID NO: 15876 - protein, 19 aa, Mycobacterium avium
GETEYGLKAVPLGGFCDIA

SEQ ID NO: 15877 - protein, 21 aa, Mycobacterium avium
GETLTKGWQRLLGTMLGVPAG

SEQ ID NO: 15878 - protein, 19 aa, Mycobacterium avium
GFAEVGAWWSEPIVFQKAV

SEQ ID NO: 15879 - protein, 18 aa, Mycobacterium avium
GFGTPLVMHVMYGAKIAL

SEQ ID NO: 15880 - protein, 27 aa, Mycobacterium avium
GFSTLALVARRWALAWIALAGTAIAGA

SEQ ID NO: 15881 - protein, 19 aa, Mycobacterium avium
GFSTLALVTRRWALAWIAL

SEQ ID NO: 15882 - protein, 33 aa, Mycobacterium avium
GFVFSWPRRRSGSLIAPIALHWSLNGLGALAAA

SEQ ID NO: 15883 - protein, 19 aa, Mycobacterium avium
GFYLALPVLALLARRLPVT

SEQ ID NO: 15884 - protein, 31 aa, Mycobacterium avium
GGASIPLLTARLSGRFGVPVHSTAQPGLSAA

SEQ ID NO: 15885 - protein, 17 aa, Mycobacterium avium
GGASIPLLTPRLSGRFG

SEQ ID NO: 15886 - protein, 17 aa, Mycobacterium avium
GGDPYTRKAGCAARAKF

SEQ ID NO: 15887 - protein, 22 aa, Mycobacterium avium
GGEPRMTLPDAITGNPGDHPCG

SEQ ID NO: 15888 - protein, 18 aa, Mycobacterium avium
GGGRPWLIVGYFAVLAAI

SEQ ID NO: 15889 - protein, 19 aa, Mycobacterium avium
GGIGVMFAVYGRWSQKVGW

SEQ ID NO: 15890 - protein, 18 aa, Mycobacterium avium
GGIGWIPYILERADSVWR

SEQ ID NO: 15891 - protein, 19 aa, Mycobacterium avium
GGLGLLLGLADQWLFSRIS

SEQ ID NO: 15892 - protein, 26 aa, Mycobacterium avium
GGLLSEWDWRAIFWVGVPVGVLGTVW

SEQ ID NO: 15893 - protein, 20 aa, Mycobacterium avium
GGLRAGQFVRASGVEVGKVA

SEQ ID NO: 15894 - protein, 18 aa, Mycobacterium avium
GGMGYSFGAGIGIALGRN

SEQ ID NO: 15895 - protein, 17 aa, Mycobacterium avium
GGMLLSGMLTVIVGRAV

SEQ ID NO: 15896 - protein, 23 aa, Mycobacterium avium
GGPAMGSALFAYGHFGDVDAGYL

SEQ ID NO: 15897 - protein, 32 aa, Mycobacterium avium
GGPMSHAAVVAREFGFPCVVDVQGATKSLPPG

SEQ ID NO: 15898 - protein, 18 aa, Mycobacterium avium
GGPRSCIGDHFAMLEATL

SEQ ID NO: 15899 - protein, 50 aa, Mycobacterium avium
GGRGSGPWRDWSWTQQINWLWVRRAAYLCAAVLVLLPIVTFAMAYFIVDI

SEQ ID NO: 15900 - protein, 21 aa, Mycobacterium avium
GGRMSDRWQYLVVLAACLVVT

SEQ ID NO: 15901 - protein, 20 aa, Mycobacterium avium
GGRNIWRYVVQIVPAHARDR

SEQ ID NO: 15902 - protein, 19 aa, Mycobacterium avium
GGSPRMPMVPGTWEQDTQN

SEQ ID NO: 15903 - protein, 20 aa, Mycobacterium avium
GGSPRMPMVPGTWEQDTQNG

SEQ ID NO: 15904 - protein, 17 aa, Mycobacterium avium
GGVAGWVFGYAGIFWLA

SEQ ID NO: 15905 - protein, 17 aa, Mycobacterium avium
GGVLAWAGPSGVRASFA

SEQ ID NO: 15906 - protein, 18 aa, Mycobacterium avium
GGVLAWAGPSGVRASFAL

SEQ ID NO: 15907 - protein, 30 aa, Mycobacterium avium
GGVTLLAVVAWRWRRFRAAAAAALLVGLAW

SEQ ID NO: 15908 - protein, 29 aa, Mycobacterium avium
GHAVAVGRPRWLAERGLRPDAALAAAAAR

SEQ ID NO: 15909 - protein, 18 aa, Mycobacterium avium
GHGGGPIADVLGGGAEVV

SEQ ID NO: 15910 - protein, 20 aa, Mycobacterium avium
GHGTIDRWVDVPDRLLQRYT

SEQ ID NO: 15911 - protein, 24 aa, Mycobacterium avium
GHYFAVGLGVRWMSTAVYLCGLAA

SEQ ID NO: 15912 - protein, 24 aa, Mycobacterium avium
GHYRILELLGRGGMGRVYRAYDAT

SEQ ID NO: 15913 - protein, 20 aa, Mycobacterium avium
GIAVAYRLYATAPIPRVAPL

SEQ ID NO: 15914 - protein, 25 aa, Mycobacterium avium
GIDQRLKRFGTMAAAMVLYVLISQL

SEQ ID NO: 15915 - protein, 19 aa, Mycobacterium avium
GIETLRWAGTKSKALLRVL

SEQ ID NO: 15916 - protein, 25 aa, Mycobacterium avium
GINPVQRLLVPRVLALCLNGLLLNS

SEQ ID NO: 15917 - protein, 23 aa, Mycobacterium avium
GIPEEFSDKVFVIFQRLHGREVY

SEQ ID NO: 15918 - protein, 18 aa, Mycobacterium avium
GIVGAIAFGAGYMGWAWL

SEQ ID NO: 15919 - protein, 30 aa, Mycobacterium avium
GIVVLVVLGFWSLVVLREYERGVVFRMGHV

SEQ ID NO: 15920 - protein, 22 aa, Mycobacterium avium
GKDSRVLVEFNVDRSLALDQGT

SEQ ID NO: 15921 - protein, 21 aa, Mycobacterium avium
GKNLYLRNEVFAEWIEKVDAL

SEQ ID NO: 15922 - protein, 23 aa, Mycobacterium avium
GKPLVPRWLRFVLASDRAGSAWY

SEQ ID NO: 15923 - protein, 23 aa, Mycobacterium avium
GKPVAGCPVRILDRNNRPVGPRV

SEQ ID NO: 15924 - protein, 25 aa, Mycobacterium avium
GKQRAPLHIWAIVALVMVPVLVACV

SEQ ID NO: 15925 - protein, 23 aa, Mycobacterium avium
GKRGFLPPFVTWFAALLFAVIPI

SEQ ID NO: 15926 - protein, 24 aa, Mycobacterium avium
GKVSPVRYPRGWPAVAAAINARPD

SEQ ID NO: 15927 - protein, 18 aa, Mycobacterium avium
GLAALAMRLGWFSASALA

SEQ ID NO: 15928 - protein, 26 aa, Mycobacterium avium
GLAQGLKRDLLRAVAWVLTFNATYWL

SEQ ID NO: 15929 - protein, 18 aa, Mycobacterium avium
GLCATAYLVCRHAVGTPV

SEQ ID NO: 15930 - protein, 19 aa, Mycobacterium avium
GLEGGNFVRIAGVEVGKVK

SEQ ID NO: 15931 - protein, 17 aa, Mycobacterium avium
GLEGWSSTPARQVTASA

SEQ ID NO: 15932 - protein, 18 aa, Mycobacterium avium
GLEGWSSTPARQVTASAE

SEQ ID NO: 15933 - protein, 32 aa, Mycobacterium avium
GLELIETHLLFGIPYDRIEVVVHPQSIVHSMV

SEQ ID NO: 15934 - protein, 24 aa, Mycobacterium avium
GLGDLRYPVVVAVLFVVIAGIVVL

SEQ ID NO: 15935 - protein, 25 aa, Mycobacterium avium
GLGPACAVAVAVGFAATVTLLPPVL

SEQ ID NO: 15936 - protein, 19 aa, Mycobacterium avium
GLLGARVWADRPVAALLLA

SEQ ID NO: 15937 - protein, 18 aa, Mycobacterium avium
GLMELCFDSTGPAMLPAL

SEQ ID NO: 15938 - protein, 30 aa, Mycobacterium avium
GLNHLWLAFLHYRGWAIPVAFVIAQGTATV

SEQ ID NO: 15939 - protein, 24 aa, Mycobacterium avium
GLPRSEFAVSLALVLLMLPVIVRA

SEQ ID NO: 15940 - protein, 21 aa, Mycobacterium avium
GLPSDIWKATMDGALKGTPNE

SEQ ID NO: 15941 - protein, 19 aa, Mycobacterium avium
GLRAGQFVRASGVEVGKVA

SEQ ID NO: 15942 - protein, 19 aa, Mycobacterium avium
GLSFRLRSTASWTPVHLAL

SEQ ID NO: 15943 - protein, 26 aa, Mycobacterium avium
GLSLFMAIAIAVTWMVYATLRRDVAG

SEQ ID NO: 15944 - protein, 26 aa, Mycobacterium avium
GLSNVLRYGYYPALIVGLTIAVMILY

SEQ ID NO: 15945 - protein, 28 aa, Mycobacterium avium
GLSVLIWQDLFGIRIHWIVAALSVIILL

SEQ ID NO: 15946 - protein, 17 aa, Mycobacterium avium
GLTGSPVPIPWSVLSLF

SEQ ID NO: 15947 - protein, 17 aa, Mycobacterium avium
GLVAHVADRLLGLSALT

SEQ ID NO: 15948 - protein, 18 aa, Mycobacterium avium
GLVALVFAVVTSNELVAW

SEQ ID NO: 15949 - protein, 23 aa, Mycobacterium avium
GMALGFLTVFGLFGALTVSAAGA

SEQ ID NO: 15950 - protein, 18 aa, Mycobacterium avium
GMGCWPRSCAANGSGDRQ

SEQ ID NO: 15951 - protein, 18 aa, Mycobacterium avium
GMKVRRYFVGFGPTLWST

SEQ ID NO: 15952 - protein, 35 aa, Mycobacterium avium
GMVGLGMAVLWLHGWPTRRQSVVFALTGSVAIGAG

SEQ ID NO: 15953 - protein, 21 aa, Mycobacterium avium
GNAVLEWLRLPGDVILIAGGV

SEQ ID NO: 15954 - protein, 22 aa, Mycobacterium avium
GNEALAVPIWWAYAAAQILITA

SEQ ID NO: 15955 - protein, 24 aa, Mycobacterium avium
GNPHGPRLTFALGPQQGHAGHPGR

SEQ ID NO: 15956 - protein, 18 aa, Mycobacterium avium
GNQLPAPFINPGGTGGSG

SEQ ID NO: 15957 - protein, 33 aa, Mycobacterium avium
GNRQVRWVARREIRLLLANRLYFAFLALLPFVL

SEQ ID NO: 15958 - protein, 20 aa, Mycobacterium avium
GNTVGWRFALVGWVVTAGVY

SEQ ID NO: 15959 - protein, 17 aa, Mycobacterium avium
GNVVWPVSRNQISESGS

SEQ ID NO: 15960 - protein, 20 aa, Mycobacterium avium
GPAYPRGFMRLGGASGPAAA

SEQ ID NO: 15961 - protein, 20 aa, Mycobacterium avium
GPDFWVTVAGLTFADSSGPL

SEQ ID NO: 15962 - protein, 18 aa, Mycobacterium avium
GPFFAFRSPHYLVVIVLW

SEQ ID NO: 15963 - protein, 18 aa, Mycobacterium avium
GPGDARGADRMSAARRIY

SEQ ID NO: 15964 - protein, 24 aa, Mycobacterium avium
GPGGLSWLSPLGWSLLVKPYAGDR

SEQ ID NO: 15965 - protein, 23 aa, Mycobacterium avium
GPGRLLCRPAMRAIGRISYSWYL

SEQ ID NO: 15966 - protein, 25 aa, Mycobacterium avium
GPIAWPLEITVAWAVVLVAVFIPVA

SEQ ID NO: 15967 - protein, 17 aa, Mycobacterium avium
GPIRVLINFPDGGAASP

SEQ ID NO: 15968 - protein, 28 aa, Mycobacterium avium
GPKELRYILSSVRPRVFITAEGFGRMTY

SEQ ID NO: 15969 - protein, 20 aa, Mycobacterium avium
GPLLRPGYLLLRDAVSTPRS

SEQ ID NO: 15970 - protein, 24 aa, Mycobacterium avium
GPLQIAVSLMWPAGIAALVYAVRA

SEQ ID NO: 15971 - protein, 27 aa, Mycobacterium avium
GPPKPAFSVGEAFGWAWNAFTKNPVAL

SEQ ID NO: 15972 - protein, 23 aa, Mycobacterium avium
GPPSPRRRLGVAVSGSRRPSARR

SEQ ID NO: 15973 - protein, 19 aa, Mycobacterium avium
GPPSPRRRLGVAVTGSRRP

SEQ ID NO: 15974 - protein, 18 aa, Mycobacterium avium
GPREWLLAALHSRFSRLL

SEQ ID NO: 15975 - protein, 39 aa, Mycobacterium avium
GPRGWIRPRRELTTGLWRRSGIRIVRRPRTHLVASVLVL

SEQ ID NO: 15976 - protein, 22 aa, Mycobacterium avium
GPRILRPLLRVAGIGPEPDSAQ

SEQ ID NO: 15977 - protein, 25 aa, Mycobacterium avium
GPRRLGRLMSILSIPMLLAPIAGPI

SEQ ID NO: 15978 - protein, 17 aa, Mycobacterium avium
GPSPYIDFDGMRLKVID

SEQ ID NO: 15979 - protein, 22 aa, Mycobacterium avium
GQALRLSYMILLSIPVLAPLAL

SEQ ID NO: 15980 - protein, 23 aa, Mycobacterium avium
GQALRLSYMILLSIPVLAPLALR

SEQ ID NO: 15981 - protein, 22 aa, Mycobacterium avium
GQALRLSYMILLSIPVLAPLVL

SEQ ID NO: 15982 - protein, 18 aa, Mycobacterium avium
GQGPSLKNGDVIPVDRSY

SEQ ID NO: 15983 - protein, 17 aa, Mycobacterium avium
GQHPVGFSPNGVPEHTV

SEQ ID NO: 15984 - protein, 18 aa, Mycobacterium avium
GQIRDAWPPSARARPRLH

SEQ ID NO: 15985 - protein, 17 aa, Mycobacterium avium
GQKWVALAVPGYALAGA

SEQ ID NO: 15986 - protein, 21 aa, Mycobacterium avium
GQLRVLPPFLSRKHLPSRLAR

SEQ ID NO: 15987 - protein, 21 aa, Mycobacterium avium
GQLWRSFELYALVFCGVAGMI

SEQ ID NO: 15988 - protein, 22 aa, Mycobacterium avium
GQPDHFDWLTGYLQDHGFGTAT

SEQ ID NO: 15989 - protein, 23 aa, Mycobacterium avium
GQPSKFTVAGPWVGVAAPGERIV

SEQ ID NO: 15990 - protein, 24 aa, Mycobacterium avium
GQPSKFTVAGPWVGVAAPGERIVS

SEQ ID NO: 15991 - protein, 19 aa, Mycobacterium avium
GQTATRWAQDTLRTSDLGD

SEQ ID NO: 15992 - protein, 17 aa, Mycobacterium avium
GQYRRAGLLLSDARRAG

SEQ ID NO: 15993 - protein, 21 aa, Mycobacterium avium
GRAAMTWLLGITFALVFVNPG

SEQ ID NO: 15994 - protein, 22 aa, Mycobacterium avium
GRAELRALLVVVARSAVVGASL

SEQ ID NO: 15995 - protein, 17 aa, Mycobacterium avium
GRAGFAPVGPSLRYTDF

SEQ ID NO: 15996 - protein, 20 aa, Mycobacterium avium
GRALGMVAFMSYFFTLYLRA

SEQ ID NO: 15997 - protein, 17 aa, Mycobacterium avium
GRAVLMTGLAQINRDSV

SEQ ID NO: 15998 - protein, 19 aa, Mycobacterium avium
GRAVLMTGLAQINRDSVEA

SEQ ID NO: 15999 - protein, 23 aa, Mycobacterium avium
GRDPRAVKVFTMVTPVVAETHDA

SEQ ID NO: 16000 - protein, 21 aa, Mycobacterium avium
GRGPGARWIAMNDVTAGNAGA

SEQ ID NO: 16001 - protein, 20 aa, Mycobacterium avium
GRHHVPLATALRVNDTADEI

SEQ ID NO: 16002 - protein, 18 aa, Mycobacterium avium
GRHTPYRCMLGGPPGGLP

SEQ ID NO: 16003 - protein, 20 aa, Mycobacterium avium
GRKTVLVAALLVMGLVTTAI

SEQ ID NO: 16004 - protein, 21 aa, Mycobacterium avium
GRLEAIWRGSVVVLQSILAVA

SEQ ID NO: 16005 - protein, 18 aa, Mycobacterium avium
GRLFTPFFITVGLVEAAY

SEQ ID NO: 16006 - protein, 19 aa, Mycobacterium avium
GRLLLRWRRDQAVLMGSLL

SEQ ID NO: 16007 - protein, 17 aa, Mycobacterium avium
GRLPVGLAAARTRGPFQ

SEQ ID NO: 16008 - protein, 22 aa, Mycobacterium avium
GRLQGALAGWVHRHGLWPWALA

SEQ ID NO: 16009 - protein, 26 aa, Mycobacterium avium
GRPILRILVRRHRVVGTWPLVAPMLA

SEQ ID NO: 16010 - protein, 21 aa, Mycobacterium avium
GRPPRPGHAHPPAGRNYLPPL

SEQ ID NO: 16011 - protein, 29 aa, Mycobacterium avium
GRPSGRWGEEIVALVELRAGTGAAADELH

SEQ ID NO: 16012 - protein, 17 aa, Mycobacterium avium
GRQLRVLVIRALARAGI

SEQ ID NO: 16013 - protein, 22 aa, Mycobacterium avium
GRRAWVYVEGVFLLLVCALVLA

SEQ ID NO: 16014 - protein, 23 aa, Mycobacterium avium
GRRAWVYVEGVLLLLVCALVLAL

SEQ ID NO: 16015 - protein, 19 aa, Mycobacterium avium
GRRRIAVVGLFLVSGAVIL

SEQ ID NO: 16016 - protein, 19 aa, Mycobacterium avium
GRRRRARRAARRRAAQANA

SEQ ID NO: 16017 - protein, 19 aa, Mycobacterium avium
GRRRWVCAAAAIGAAAAAA

SEQ ID NO: 16018 - protein, 23 aa, Mycobacterium avium
GRRVVSLPWRLANVADLPAVDAS

SEQ ID NO: 16019 - protein, 26 aa, Mycobacterium avium
GRRWRPLPAPVWVSATAVLLVATTML

SEQ ID NO: 16020 - protein, 20 aa, Mycobacterium avium
GRSAIDAVVFGVVRELLSHV

SEQ ID NO: 16021 - protein, 20 aa, Mycobacterium avium
GRSAIDAVVFGVVRELLSNV

SEQ ID NO: 16022 - protein, 28 aa, Mycobacterium avium
GRSALSRIPRRWVIAALGVLVVAAGLAV

SEQ ID NO: 16023 - protein, 19 aa, Mycobacterium avium
GRTAYLVMELVNGEPLNSV

SEQ ID NO: 16024 - protein, 27 aa, Mycobacterium avium
GRTGIYGHARACGWAIRDGVVGPSSTP

SEQ ID NO: 16025 - protein, 23 aa, Mycobacterium avium
GRTPRQRWMSRFALLTIPTPFLA

SEQ ID NO: 16026 - protein, 24 aa, Mycobacterium avium
GRVSPVRYPRGWPAVAAAINARPD

SEQ ID NO: 16027 - protein, 18 aa, Mycobacterium avium
GRYFERRSKRTAGAALRA

SEQ ID NO: 16028 - protein, 27 aa, Mycobacterium avium
GRYFYVKWWKLVLVLLAVWAASAVIGL

SEQ ID NO: 16029 - protein, 17 aa, Mycobacterium avium
GSALAWLVAGLAAAGRW

SEQ ID NO: 16030 - protein, 34 aa, Mycobacterium avium
GSARPEHWQRLALCWRLAGDHGLGIATLMRAAQR

SEQ ID NO: 16031 - protein, 19 aa, Mycobacterium avium
GSARRGRRPAADAGAARRA

SEQ ID NO: 16032 - protein, 17 aa, Mycobacterium avium
GSAWTAALWAVALLVAG

SEQ ID NO: 16033 - protein, 17 aa, Mycobacterium avium
GSFFFSVYFQHVTPGAW

SEQ ID NO: 16034 - protein, 17 aa, Mycobacterium avium
GSGIDIPLIKPALEAAT

SEQ ID NO: 16035 - protein, 21 aa, Mycobacterium avium
GSLSRLRGGCRVAKEQLSANT

SEQ ID NO: 16036 - protein, 19 aa, Mycobacterium avium
GSLTAFLAYFTQILMAVLM

SEQ ID NO: 16037 - protein, 27 aa, Mycobacterium avium
GSNMLRFGRVTVRFGKPMDFSRFEGLA

SEQ ID NO: 16038 - protein, 25 aa, Mycobacterium avium
GSPVPIPWSVLSLFASGPTLSRADA

SEQ ID NO: 16039 - protein, 24 aa, Mycobacterium avium
GSSPRPLAYLGVFVFVIAGWLVSL

SEQ ID NO: 16040 - protein, 19 aa, Mycobacterium avium
GSSSPARTYGWHRAEVFTA

SEQ ID NO: 16041 - protein, 20 aa, Mycobacterium avium
GSSSPARTYGWHRAEVFTAV

SEQ ID NO: 16042 - protein, 22 aa, Mycobacterium avium
GSSSTLEFWGLTSTQQLSLPVL

SEQ ID NO: 16043 - protein, 20 aa, Mycobacterium avium
GSTKIPVFVFHPAGGSTVVY

SEQ ID NO: 16044 - protein, 28 aa, Mycobacterium avium
GTACGLSVLMWQDLIGLGVQWIVLPLSI

SEQ ID NO: 16045 - protein, 24 aa, Mycobacterium avium
GTDHRGRVRVGTVLLSPVESDGSP

SEQ ID NO: 16046 - protein, 18 aa, Mycobacterium avium
GTEVRRLAPEQVPPHISR

SEQ ID NO: 16047 - protein, 18 aa, Mycobacterium avium
GTEWARFTRKVMPRDRIY

SEQ ID NO: 16048 - protein, 18 aa, Mycobacterium avium
GTIGVISMVLFYIQAPTL

SEQ ID NO: 16049 - protein, 24 aa, Mycobacterium avium
GTNEWTRYGALMVTDAVIRVMVAA

SEQ ID NO: 16050 - protein, 20 aa, Mycobacterium avium
GTQGRLMFRATLQQLRSDQM

SEQ ID NO: 16051 - protein, 19 aa, Mycobacterium avium
GTRSLLYFGGRGDAGLSQA

SEQ ID NO: 16052 - protein, 25 aa, Mycobacterium avium
GTVKFGAVQLDWGALVIVGGVATLI

SEQ ID NO: 16053 - protein, 18 aa, Mycobacterium avium
GTVLLYFAARHAGASAAL

SEQ ID NO: 16054 - protein, 17 aa, Mycobacterium avium
GTVRLTVGAAFPAADYL

SEQ ID NO: 16055 - protein, 23 aa, Mycobacterium avium
GTVRLTVGAAFPAADYLAHPGAS

SEQ ID NO: 16056 - protein, 17 aa, Mycobacterium avium
GTVWGMRSLHELGVRTP

SEQ ID NO: 16057 - protein, 18 aa, Mycobacterium avium
GVALVMIFGFLVMGILVY

SEQ ID NO: 16058 - protein, 19 aa, Mycobacterium avium
GVGPLMWLYALFNVAAWIF

SEQ ID NO: 16059 - protein, 17 aa, Mycobacterium avium
GVGWRQRRVNVAALQAV

SEQ ID NO: 16060 - protein, 23 aa, Mycobacterium avium
GVIIVMLLWVYRSIVTVLITLMM

SEQ ID NO: 16061 - protein, 32 aa, Mycobacterium avium
GVLIAGPLGLCFLPAFVCLGIVPVVAGLAGDV

SEQ ID NO: 16062 - protein, 19 aa, Mycobacterium avium
GVLIVCFVAGVVIASVCRR

SEQ ID NO: 16063 - protein, 23 aa, Mycobacterium avium
GVLPFVWIAWTALRNFRSGTTVQ

SEQ ID NO: 16064 - protein, 27 aa, Mycobacterium avium
GVLVRHCVRRFGGISGDVLGAAIELTA

SEQ ID NO: 16065 - protein, 22 aa, Mycobacterium avium
GVMTPLCASVWVPASELGLREP

SEQ ID NO: 16066 - protein, 18 aa, Mycobacterium avium
GVPQLQLYISPAMLVLMA

SEQ ID NO: 16067 - protein, 23 aa, Mycobacterium avium
GVRIGGLFTALGITSVVIGLMLQ

SEQ ID NO: 16068 - protein, 17 aa, Mycobacterium avium
GVSFEFPLLIVMLNTIG

SEQ ID NO: 16069 - protein, 25 aa, Mycobacterium avium
GVSSFGFGGANAHLVVREVLPRDVI

SEQ ID NO: 16070 - protein, 27 aa, Mycobacterium avium
GVSYMRYPLFLGFDIVGGIAWGGGATL

SEQ ID NO: 16071 - protein, 21 aa, Mycobacterium avium
GVVATSAWGALNFVAGLGELF

SEQ ID NO: 16072 - protein, 24 aa, Mycobacterium avium
GVVLACPVWFYQLWAFITPGLYQK

SEQ ID NO: 16073 - protein, 19 aa, Mycobacterium avium
GVVSLRLTSDYERLLYVVL

SEQ ID NO: 16074 - protein, 24 aa, Mycobacterium avium
GVYLWHWPIFLALNGERSGWAGMP

SEQ ID NO: 16075 - protein, 24 aa, Mycobacterium avium
GWAAEQIGYGWGFFISGVVLLIAA

SEQ ID NO: 16076 - protein, 25 aa, Mycobacterium avium
GWAAEQIGYGWGFFISGVVLLIAAV

SEQ ID NO: 16077 - protein, 18 aa, Mycobacterium avium
GWAFLIWGLYAYLWAFAQ

SEQ ID NO: 16078 - protein, 27 aa, Mycobacterium avium
GWFRLVPPTEFWSRAPSGLAVGAAAAG

SEQ ID NO: 16079 - protein, 18 aa, Mycobacterium avium
GWGVTCFITVAAGAVQVL

SEQ ID NO: 16080 - protein, 19 aa, Mycobacterium avium
GWGVTCFITVVAGAVQVLL

SEQ ID NO: 16081 - protein, 20 aa, Mycobacterium avium
GWITQRLWWALLLTVGFWGL

SEQ ID NO: 16082 - protein, 21 aa, Mycobacterium avium
GWLAAARIGMGWPLTVLAALA

SEQ ID NO: 16083 - protein, 19 aa, Mycobacterium avium
GWTGRVLVWALAIGAVLLI

SEQ ID NO: 16084 - protein, 18 aa, Mycobacterium avium
GWVGYALALMLAILLNLN

SEQ ID NO: 16085 - protein, 20 aa, Mycobacterium avium
GWWRQRLVEHVQRLGIGSAV

SEQ ID NO: 16086 - protein, 25 aa, Mycobacterium avium
GYGEIDGRLYVDMRLIEGRDLAHYI

SEQ ID NO: 16087 - protein, 24 aa, Mycobacterium avium
GYLREFGNLVFHFSLLGLLVAVAV

SEQ ID NO: 16088 - protein, 21 aa, Mycobacterium avium
GYPLPWALPVAMWALAAASLV

SEQ ID NO: 16089 - protein, 34 aa, Mycobacterium avium
HAAPMAALLKWLGIPQFVVFDWLFWIFSILIATL

SEQ ID NO: 16090 - protein, 24 aa, Mycobacterium avium
HAGAAPIFGEWLIHAGWGTGPAVA

SEQ ID NO: 16091 - protein, 25 aa, Mycobacterium avium
HALDTCPWPPPTVFLMRHGANNTYT

SEQ ID NO: 16092 - protein, 20 aa, Mycobacterium avium
HALGVPGWITQRLWWALLLT

SEQ ID NO: 16093 - protein, 19 aa, Mycobacterium avium
HALNKVWRRHMLAVHGLDP

SEQ ID NO: 16094 - protein, 24 aa, Mycobacterium avium
HAPELRIAGLLPDVIAESQRRQRA

SEQ ID NO: 16095 - protein, 18 aa, Mycobacterium avium
HAPYHAWLLESAAKSSTA

SEQ ID NO: 16096 - protein, 26 aa, Mycobacterium avium
HARRRLRVKAKMLGRGYEYMDLEDDH

SEQ ID NO: 16097 - protein, 20 aa, Mycobacterium avium
HASFVRGARAVEYLRRRQQA

SEQ ID NO: 16098 - protein, 19 aa, Mycobacterium avium
HATDLLFNGVVGRQLPAGI

SEQ ID NO: 16099 - protein, 24 aa, Mycobacterium avium
HDDVIEFEPRYAIRQPDGGWGEYV

SEQ ID NO: 16100 - protein, 23 aa, Mycobacterium avium
HDLGFRLVERWQFNLVQVFEATK

SEQ ID NO: 16101 - protein, 25 aa, Mycobacterium avium
HDPELLTVEALDAMVLAAGADAASS

SEQ ID NO: 16102 - protein, 30 aa, Mycobacterium avium
HDPPARPWRPGVWAAVPALAAGAVIAGAAG

SEQ ID NO: 16103 - protein, 24 aa, Mycobacterium avium
HEEFPRIDPAVICLVHDGGDRAVL

SEQ ID NO: 16104 - protein, 20 aa, Mycobacterium avium
HELQIRPTLGAGREPTVTDL

SEQ ID NO: 16105 - protein, 25 aa, Mycobacterium avium
HFELLESKGLYARLWEHDRRVQSGV

SEQ ID NO: 16106 - protein, 24 aa, Mycobacterium avium
HFYTPWSWLPRIVTQFTAGALACA

SEQ ID NO: 16107 - protein, 27 aa, Mycobacterium avium
HGGALRRAGLLAALPLSLIAVAAAAVM

SEQ ID NO: 16108 - protein, 17 aa, Mycobacterium avium
HGGGPIADVLGDGAEVV

SEQ ID NO: 16109 - protein, 17 aa, Mycobacterium avium
HGGGPIADVLGGGAEVV

SEQ ID NO: 16110 - protein, 22 aa, Mycobacterium avium
HGMLERGGWHLVFGFVAGLLAW

SEQ ID NO: 16111 - protein, 24 aa, Mycobacterium avium
HGNHEPGWVVAPGMQGIDVQPFTA

SEQ ID NO: 16112 - protein, 20 aa, Mycobacterium avium
HHHRLPQLPPVITIPQVPTV

SEQ ID NO: 16113 - protein, 28 aa, Mycobacterium avium
HHSDLDWLWWFGAGWLAVAVVGAGVILW

SEQ ID NO: 16114 - protein, 24 aa, Mycobacterium avium
HHWVKDLPDEPVWVRGDQARLHQL

SEQ ID NO: 16115 - protein, 21 aa, Mycobacterium avium
HKELTHVFAGFYIAGCVAAVL

SEQ ID NO: 16116 - protein, 23 aa, Mycobacterium avium
HKELTHVFAGFYIAGCVAAVLAV

SEQ ID NO: 16117 - protein, 23 aa, Mycobacterium avium
HKVENVMLVSAFLAAAALAQAVG

SEQ ID NO: 16118 - protein, 24 aa, Mycobacterium avium
HLAAARAGPRWSIAATAAAGWVCS

SEQ ID NO: 16119 - protein, 21 aa, Mycobacterium avium
HLATRLSGLFRTRRFRVYTTD

SEQ ID NO: 16120 - protein, 25 aa, Mycobacterium avium
HLEACRGCRSWLIGAAVQTRRLASV

SEQ ID NO: 16121 - protein, 20 aa, Mycobacterium avium
HLEYAMPMRTFGWPRDLPRA

SEQ ID NO: 16122 - protein, 17 aa, Mycobacterium avium
HLPEGIGCRELHVDRGP

SEQ ID NO: 16123 - protein, 20 aa, Mycobacterium avium
HLPRLAWTRPCGAATIRRRL

SEQ ID NO: 16124 - protein, 17 aa, Mycobacterium avium
HLVLPSLTLALAAAAGY

SEQ ID NO: 16125 - protein, 23 aa, Mycobacterium avium
HLYDRKGFHRIPGAVEFAIAQDH

SEQ ID NO: 16126 - protein, 28 aa, Mycobacterium avium
HLYDRKGFHRIPGAVGFAIAQDHQAQHQ

SEQ ID NO: 16127 - protein, 25 aa, Mycobacterium avium
HPAPGRLEAIWRGSVVVLQSILAVA

SEQ ID NO: 16128 - protein, 26 aa, Mycobacterium avium
HPATLRRFCKRFAPYNFHEHMMQPSY

SEQ ID NO: 16129 - protein, 25 aa, Mycobacterium avium
HPIAARGDIGWGIGDHGLLTNIGVT

SEQ ID NO: 16130 - protein, 18 aa, Mycobacterium avium
HPLMLGFVIAFWAAPTMT

SEQ ID NO: 16131 - protein, 23 aa, Mycobacterium avium
HPNIPGLPWYAAVLVAVTATAIG

SEQ ID NO: 16132 - protein, 20 aa, Mycobacterium avium
HPVAMLGFMVLISAAFVAAT

SEQ ID NO: 16133 - protein, 24 aa, Mycobacterium avium
HQAPYWVCAVYLVFLAAVAIAAAM

SEQ ID NO: 16134 - protein, 24 aa, Mycobacterium avium
HQEAALTWLLLISVPVMAVTNYWV

SEQ ID NO: 16135 - protein, 24 aa, Mycobacterium avium
HQKLCDSYKLASRAVQIDTNGDNP

SEQ ID NO: 16136 - protein, 28 aa, Mycobacterium avium
HQRDDWAWLKAAFVIAGITLATAGLIWF

SEQ ID NO: 16137 - protein, 25 aa, Mycobacterium avium
HQVSGWRFVMRRIASGIALHDTRML

SEQ ID NO: 16138 - protein, 27 aa, Mycobacterium avium
HRFALELRTSLLVLFALAALAVATQVS

SEQ ID NO: 16139 - protein, 37 aa, Mycobacterium avium
HRFGAPTARPFRPYPRCGKGFAGVRSMTAPIWMASPP

SEQ ID NO: 16140 - protein, 17 aa, Mycobacterium avium
HRPYLPHAIRIFAVPII

SEQ ID NO: 16141 - protein, 17 aa, Mycobacterium avium
HRQAVASVISWVSVVII

SEQ ID NO: 16142 - protein, 34 aa, Mycobacterium avium
HRRTRTALEATWKYVIICSVGIAIAFLGTVLLYF

SEQ ID NO: 16143 - protein, 21 aa, Mycobacterium avium
HRSNWGVAGWSMGGTCAVDLT

SEQ ID NO: 16144 - protein, 22 aa, Mycobacterium avium
HRSNWGVAGWSMGGTCAVDLTV

SEQ ID NO: 16145 - protein, 20 aa, Mycobacterium avium
HRTQVWPVLAGVAVLAGCTA

SEQ ID NO: 16146 - protein, 25 aa, Mycobacterium avium
HSADRLIVIYADFKGEAGADSFRHF

SEQ ID NO: 16147 - protein, 25 aa, Mycobacterium avium
HSADRLIVIYADFKGEAGADSFRNF

SEQ ID NO: 16148 - protein, 26 aa, Mycobacterium avium
HSLHWKITEAPLFYGGYAVLLAASAA

SEQ ID NO: 16149 - protein, 24 aa, Mycobacterium avium
HSVSYLDVCDQILLIAPGGKTAFC

SEQ ID NO: 16150 - protein, 19 aa, Mycobacterium avium
HTLLYASVMGVAWLLDVPA

SEQ ID NO: 16151 - protein, 23 aa, Mycobacterium avium
HTRFRRMLDPFFGPKKMAEREPE

SEQ ID NO: 16152 - protein, 23 aa, Mycobacterium avium
HTRFRRMLDPFFSPKKMAEREPE

SEQ ID NO: 16153 - protein, 25 aa, Mycobacterium avium
HVIWSIRVMIAILWFSAGMAIVSSL

SEQ ID NO: 16154 - protein, 19 aa, Mycobacterium avium
HVMSTYLSHDWGRDWGSLR

SEQ ID NO: 16155 - protein, 23 aa, Mycobacterium avium
HVTGGLVAFIFLLARTAMSKFTP

SEQ ID NO: 16156 - protein, 23 aa, Mycobacterium avium
HVYDRKGFHRIPGAVEFAIAQDH

SEQ ID NO: 16157 - protein, 20 aa, Mycobacterium avium
HWQRLNGVAVVSVPGQDPVT

SEQ ID NO: 16158 - protein, 23 aa, Mycobacterium avium
IAAFKIIMLALWWGAATSKLNHH

SEQ ID NO: 16159 - protein, 20 aa, Mycobacterium avium
IAAGVLYFFFVLPRWPELMG

SEQ ID NO: 16160 - protein, 19 aa, Mycobacterium avium
IAALVLGLARYRRRRISFS

SEQ ID NO: 16161 - protein, 20 aa, Mycobacterium avium
IAALVLGLARYRRRRISFST

SEQ ID NO: 16162 - protein, 20 aa, Mycobacterium avium
IAAVGLWVAARLPWVVIRSF

SEQ ID NO: 16163 - protein, 24 aa, Mycobacterium avium
IAAVSRLDLRLAQRLAAEARDRFF

SEQ ID NO: 16164 - protein, 23 aa, Mycobacterium avium
IAFALGYPMDFGSYFGYLAQMFS

SEQ ID NO: 16165 - protein, 20 aa, Mycobacterium avium
IAGALRWRAARRHRRPRLSS

SEQ ID NO: 16166 - protein, 18 aa, Mycobacterium avium
IAGCVAAVLAVRQDGIFT

SEQ ID NO: 16167 - protein, 26 aa, Mycobacterium avium
IAIPLNGFVQFSWLRFGIFYYSEAVG

SEQ ID NO: 16168 - protein, 19 aa, Mycobacterium avium
IALICGDILYAPTATGVLR

SEQ ID NO: 16169 - protein, 21 aa, Mycobacterium avium
IALLLCLAVTLGADAVGSRAK

SEQ ID NO: 16170 - protein, 26 aa, Mycobacterium avium
IALLLIAVVLVLGFWQPGFFVTTKLD

SEQ ID NO: 16171 - protein, 26 aa, Mycobacterium avium
IAMMKGRNPLGWGILGLFFSILTLIV

SEQ ID NO: 16172 - protein, 27 aa, Mycobacterium avium
IANDIAKYFAIIPAMFVALFPGLDLIN

SEQ ID NO: 16173 - protein, 18 aa, Mycobacterium avium
IAPEEIKAAGYDGVVNYV

SEQ ID NO: 16174 - protein, 21 aa, Mycobacterium avium
IAQLAASCRRITEGNFVETIV

SEQ ID NO: 16175 - protein, 27 aa, Mycobacterium avium
IARGRVGSAGMLRRVFVIASAITAVLS

SEQ ID NO: 16176 - protein, 23 aa, Mycobacterium avium
IARHGRYTGVSGWFAVSSTGSPS

SEQ ID NO: 16177 - protein, 31 aa, Mycobacterium avium
IARRQMRLIVFDRGYFVFLALLPFIMGSLSM

SEQ ID NO: 16178 - protein, 20 aa, Mycobacterium avium
IASFFLFPGFNPPMSPSLPA

SEQ ID NO: 16179 - protein, 26 aa, Mycobacterium avium
IASGPFFKVVLHNLALYQISQPWVDA

SEQ ID NO: 16180 - protein, 19 aa, Mycobacterium avium
IATAWLFDMAMLAVLSVGY

SEQ ID NO: 16181 - protein, 22 aa, Mycobacterium avium
IATKMSGEWSKDEVLQSYLNII

SEQ ID NO: 16182 - protein, 17 aa, Mycobacterium avium
IAVILSFVASQFTTTFL

SEQ ID NO: 16183 - protein, 17 aa, Mycobacterium avium
IAVNGWQQGWLVPAGAP

SEQ ID NO: 16184 - protein, 17 aa, Mycobacterium avium
IAVNGWQQGWLVPAGDP

SEQ ID NO: 16185 - protein, 21 aa, Mycobacterium avium
IAVPLCGWALLIADVALMAAS

SEQ ID NO: 16186 - protein, 23 aa, Mycobacterium avium
IAVPLCGWALLIADVALMAASVS

SEQ ID NO: 16187 - protein, 21 aa, Mycobacterium avium
IAVTYPAHWESAAVEALGAAL

SEQ ID NO: 16188 - protein, 20 aa, Mycobacterium avium
IAYAQCSPASIPTRSTRTSS

SEQ ID NO: 16189 - protein, 20 aa, Mycobacterium avium
ICAAVASAGFGTWSLAHNRN

SEQ ID NO: 16190 - protein, 21 aa, Mycobacterium avium
ICASVIGGTVVVGWVISLIMV

SEQ ID NO: 16191 - protein, 23 aa, Mycobacterium avium
IDALEHLSRQALLEVAERENKVD

SEQ ID NO: 16192 - protein, 23 aa, Mycobacterium avium
IDARLWQAIIVLAAITAVALAIS

SEQ ID NO: 16193 - protein, 24 aa, Mycobacterium avium
IDARLWQAIIVLAAITAVALAISC

SEQ ID NO: 16194 - protein, 17 aa, Mycobacterium avium
IDILVALRVKVASDQSQ

SEQ ID NO: 16195 - protein, 18 aa, Mycobacterium avium
IDQELQLRAFEELGHGSG

SEQ ID NO: 16196 - protein, 20 aa, Mycobacterium avium
IDQRALGAAVRYAAVDKNAV

SEQ ID NO: 16197 - protein, 19 aa, Mycobacterium avium
IDQRLKRFGTLAAAMVLYV

SEQ ID NO: 16198 - protein, 24 aa, Mycobacterium avium
IDQRLKRFGTMAAAMVLYVLISQL

SEQ ID NO: 16199 - protein, 28 aa, Mycobacterium avium
IDSPTDWPRYGGYALAGVSSFGFGGANA

SEQ ID NO: 16200 - protein, 17 aa, Mycobacterium avium
IDTKFGYNNAVGAGTGI

SEQ ID NO: 16201 - protein, 19 aa, Mycobacterium avium
IEAAWWIRAKMLGVRPRVW

SEQ ID NO: 16202 - protein, 18 aa, Mycobacterium avium
IEALGRVDTICFDKTGTL

SEQ ID NO: 16203 - protein, 25 aa, Mycobacterium avium
IEFRTRLWLPYLPLILAAAVGWGHA

SEQ ID NO: 16204 - protein, 22 aa, Mycobacterium avium
IELAIGMAIGMAAQTARRAHNE

SEQ ID NO: 16205 - protein, 18 aa, Mycobacterium avium
IEMADMAFIAALKHEGVP

SEQ ID NO: 16206 - protein, 19 aa, Mycobacterium avium
IEMADMAFVAALKHEGVPV

SEQ ID NO: 16207 - protein, 26 aa, Mycobacterium avium
IEPSDFRLWVCLHEVTHRVQFTANPW

SEQ ID NO: 16208 - protein, 22 aa, Mycobacterium avium
IERSPLPFGRHRWVADSRSPDI

SEQ ID NO: 16209 - protein, 19 aa, Mycobacterium avium
IEVAWWIRAKMLGVRPRVW

SEQ ID NO: 16210 - protein, 25 aa, Mycobacterium avium
IEYLCLMPIFPLALWLMNVYAAIRY

SEQ ID NO: 16211 - protein, 23 aa, Mycobacterium avium
IFSTSRLRPWGTTHIQRFALATV

SEQ ID NO: 16212 - protein, 17 aa, Mycobacterium avium
IGARTGWYLALVAASAA

SEQ ID NO: 16213 - protein, 17 aa, Mycobacterium avium
IGARTGWYLALVAASTA

SEQ ID NO: 16214 - protein, 17 aa, Mycobacterium avium
IGFEVFKQVASIYLRTV

SEQ ID NO: 16215 - protein, 18 aa, Mycobacterium avium
IGFEVFKQVASIYLRTVL

SEQ ID NO: 16216 - protein, 26 aa, Mycobacterium avium
IGFTRAGALWSSLIAGFVILILLLIF

SEQ ID NO: 16217 - protein, 25 aa, Mycobacterium avium
IGGRELGVLPLLPVLLMVWATARNT

SEQ ID NO: 16218 - protein, 21 aa, Mycobacterium avium
IGGVAMMMFGGRFGGQQQMSR

SEQ ID NO: 16219 - protein, 18 aa, Mycobacterium avium
IGGVIGETLKLAATATGF

SEQ ID NO: 16220 - protein, 25 aa, Mycobacterium avium
IGGYLWWRSRRTYLLTVAGDRLTIG

SEQ ID NO: 16221 - protein, 18 aa, Mycobacterium avium
IGHLSEWVGLSGALVTIP

SEQ ID NO: 16222 - protein, 21 aa, Mycobacterium avium
IGIALMIGPFVARPLVRRTDQ

SEQ ID NO: 16223 - protein, 23 aa, Mycobacterium avium
IGIMCIWPNLIAYWAGKPPIRGL

SEQ ID NO: 16224 - protein, 17 aa, Mycobacterium avium
IGISLAVGRGVLSALGE

SEQ ID NO: 16225 - protein, 17 aa, Mycobacterium avium
IGLASLATAIAVAVEPT

SEQ ID NO: 16226 - protein, 17 aa, Mycobacterium avium
IGLCALAFDAQRMPFVV

SEQ ID NO: 16227 - protein, 17 aa, Mycobacterium avium
IGLHLAMVWFQKHTQFP

SEQ ID NO: 16228 - protein, 26 aa, Mycobacterium avium
IGLHQCWRGAPAVTVSVVGWVFAVRA

SEQ ID NO: 16229 - protein, 26 aa, Mycobacterium avium
IGLHRCWRGAPAVTVSVVGWVFAVRA

SEQ ID NO: 16230 - protein, 19 aa, Mycobacterium avium
IGLSEGGIGWIPYILERAD

SEQ ID NO: 16231 - protein, 32 aa, Mycobacterium avium
IGLSGCGAGLLALACWCLILATAALAGVLSGA

SEQ ID NO: 16232 - protein, 27 aa, Mycobacterium avium
IGLTCPRWRIVALLADEVGHRLLIGVV

SEQ ID NO: 16233 - protein, 24 aa, Mycobacterium avium
IGNHLATLPIGWFRTDRTGPIGRL

SEQ ID NO: 16234 - protein, 17 aa, Mycobacterium avium
IGPSQAWYTENLRYYYL

SEQ ID NO: 16235 - protein, 17 aa, Mycobacterium avium
IGQLFRRIPPVDSRPHP

SEQ ID NO: 16236 - protein, 17 aa, Mycobacterium avium
IGSMEVLVGILLACALA

SEQ ID NO: 16237 - protein, 17 aa, Mycobacterium avium
IGSVVAIVLGAIALDQI

SEQ ID NO: 16238 - protein, 17 aa, Mycobacterium avium
IGVEAFTGFFAALINVR

SEQ ID NO: 16239 - protein, 19 aa, Mycobacterium avium
IGVLPRWQTAAILGVLAAI

SEQ ID NO: 16240 - protein, 20 aa, Mycobacterium avium
IGYGCGFFISGVVLLIAAVG

SEQ ID NO: 16241 - protein, 24 aa, Mycobacterium avium
IHDLTAFFAWTAWASAAERPGHSY

SEQ ID NO: 16242 - protein, 24 aa, Mycobacterium avium
IHDWGEINGVLYIDMRLVQGQTLH

SEQ ID NO: 16243 - protein, 23 aa, Mycobacterium avium
IHFLCSAIQAGSRLGYQDSAELC

SEQ ID NO: 16244 - protein, 26 aa, Mycobacterium avium
IIAEFVCLIAPMFLAMYLRAFYSPRR

SEQ ID NO: 16245 - protein, 17 aa, Mycobacterium avium
IIAIAGLLTTLGLIMVL

SEQ ID NO: 16246 - protein, 24 aa, Mycobacterium avium
IIANRVSYFYDFRGPSVAVDTACS

SEQ ID NO: 16247 - protein, 19 aa, Mycobacterium avium
IIAVARWFGLSGKLGSLLA

SEQ ID NO: 16248 - protein, 19 aa, Mycobacterium avium
IIGLGAALLIAALLLTTYT

SEQ ID NO: 16249 - protein, 22 aa, Mycobacterium avium
IIGSISFWGSIIAFGKLQEIIS

SEQ ID NO: 16250 - protein, 27 aa, Mycobacterium avium
IIGSYVLDWRVGLAFTAGALLCALTLR

SEQ ID NO: 16251 - protein, 18 aa, Mycobacterium avium
IITRAPQALFVWIALAGM

SEQ ID NO: 16252 - protein, 17 aa, Mycobacterium avium
IKATTVFGGKYVSLTTP

SEQ ID NO: 16253 - protein, 17 aa, Mycobacterium avium
IKDEIREGRTFRSAVPR

SEQ ID NO: 16254 - protein, 33 aa, Mycobacterium avium
IKSYFYWEKHCFDIPLCWAFRSLWDTIDHIDHL

SEQ ID NO: 16255 - protein, 20 aa, Mycobacterium avium
IKTNLVWAFGYNLAAIPLAA

SEQ ID NO: 16256 - protein, 18 aa, Mycobacterium avium
ILAAAVGWGHAAGKAIHE

SEQ ID NO: 16257 - protein, 25 aa, Mycobacterium avium
ILASAGTVALAFLAMVFATLSVFAG

SEQ ID NO: 16258 - protein, 17 aa, Mycobacterium avium
ILAYPWFFVPVLVVVCA

SEQ ID NO: 16259 - protein, 23 aa, Mycobacterium avium
ILCTVLCCLPLGIVSIVYSTKVS

SEQ ID NO: 16260 - protein, 23 aa, Mycobacterium avium
ILCTVLCCLPLGIVSMVYSTKVS

SEQ ID NO: 16261 - protein, 18 aa, Mycobacterium avium
ILFWTLPVALVLWIASFC

SEQ ID NO: 16262 - protein, 20 aa, Mycobacterium avium
ILGVWKYREMMTSENHLAHP

SEQ ID NO: 16263 - protein, 19 aa, Mycobacterium avium
ILGVWKYREMMTSQNHLAH

SEQ ID NO: 16264 - protein, 29 aa, Mycobacterium avium
ILLAFPMGVPLEWNVFMIFGVLWLFLAHA

SEQ ID NO: 16265 - protein, 30 aa, Mycobacterium avium
ILLAFPMGVPLEWNVFMIFGVLWLFVAHAP

SEQ ID NO: 16266 - protein, 30 aa, Mycobacterium avium
ILLAFPMGVPLEWNVFMIFGVLWLFVAHAR

SEQ ID NO: 16267 - protein, 17 aa, Mycobacterium avium
ILLGAIGFALGWRPALA

SEQ ID NO: 16268 - protein, 18 aa, Mycobacterium avium
ILNRQGLYGDFFSFYLCD

SEQ ID NO: 16269 - protein, 22 aa, Mycobacterium avium
ILRVDGPVPFAPRVTTEGVEVA

SEQ ID NO: 16270 - protein, 17 aa, Mycobacterium avium
ILSPAAYLAGFSVALHG

SEQ ID NO: 16271 - protein, 17 aa, Mycobacterium avium
ILVAFVVLVTFLLPALR

SEQ ID NO: 16272 - protein, 24 aa, Mycobacterium avium
INEARCVRGAVPFEGDVGSYRQYV

SEQ ID NO: 16273 - protein, 21 aa, Mycobacterium avium
INHFIAVDFAGFAKMVDALGG

SEQ ID NO: 16274 - protein, 19 aa, Mycobacterium avium
INLLIVFGVSFEFPLLIVM

SEQ ID NO: 16275 - protein, 23 aa, Mycobacterium avium
INNARDFLRIDIIIFGLTIYALL

SEQ ID NO: 16276 - protein, 41 aa, Mycobacterium avium
INPDLLRPVLGWVLFAGLIGWRAASALAYLRGFGRKPAWVL

SEQ ID NO: 16277 - protein, 27 aa, Mycobacterium avium
INPDLLRPVLGWVLFAGLIGWSAACAL

SEQ ID NO: 16278 - protein, 22 aa, Mycobacterium avium
INPRGGYVEVEFTVDRGVKVPA

SEQ ID NO: 16279 - protein, 17 aa, Mycobacterium avium
INWFQPVLFYNAGLVNF

SEQ ID NO: 16280 - protein, 25 aa, Mycobacterium avium
IPADPRLVEVLGWLLYAVPVLVVFL

SEQ ID NO: 16281 - protein, 20 aa, Mycobacterium avium
IPADVHAAVRSMSAVGEQYV

SEQ ID NO: 16282 - protein, 21 aa, Mycobacterium avium
IPESERATVFERFARGSTAAR

SEQ ID NO: 16283 - protein, 21 aa, Mycobacterium avium
IPESERATVFERFARGSTASR

SEQ ID NO: 16284 - protein, 17 aa, Mycobacterium avium
IPHASFVRGARAVEYLR

SEQ ID NO: 16285 - protein, 26 aa, Mycobacterium avium
IPHIARALVGPGFGRLLLVSAALGGV

SEQ ID NO: 16286 - protein, 23 aa, Mycobacterium avium
IPITVRPSIGFTVCTGASTCTVD

SEQ ID NO: 16287 - protein, 27 aa, Mycobacterium avium
IPKAARVRRGARFVVTVAVIVAAVAAF

SEQ ID NO: 16288 - protein, 30 aa, Mycobacterium avium
IPLPGSAPKSLWLSAFAHPERDKWVATAVV

SEQ ID NO: 16289 - protein, 18 aa, Mycobacterium avium
IPLPRILLAHLFGRNPLV

SEQ ID NO: 16290 - protein, 24 aa, Mycobacterium avium
IPPAQRSRVFERFVRLDTDRARSG

SEQ ID NO: 16291 - protein, 20 aa, Mycobacterium avium
IPPWMVFFSFSVNLIYQFWI

SEQ ID NO: 16292 - protein, 20 aa, Mycobacterium avium
IPVDDWSVALALALRTFPML

SEQ ID NO: 16293 - protein, 22 aa, Mycobacterium avium
IPVMMTIVAVAIRYTPAFDTAD

SEQ ID NO: 16294 - protein, 19 aa, Mycobacterium avium
IPVNYIWDFAVEGTATAMG

SEQ ID NO: 16295 - protein, 29 aa, Mycobacterium avium
IPVSLILWRTFRPGFGQFYAWVSTPAAIS

SEQ ID NO: 16296 - protein, 23 aa, Mycobacterium avium
IPYLCIGFAWTVFHADQTHRIQA

SEQ ID NO: 16297 - protein, 19 aa, Mycobacterium avium
IQAGPGIRPLAERAQNAIA

SEQ ID NO: 16298 - protein, 17 aa, Mycobacterium avium
IQGLAALGDTYADASPD

SEQ ID NO: 16299 - protein, 23 aa, Mycobacterium avium
IQQWRRLSLRTASIARWGGLALI

SEQ ID NO: 16300 - protein, 24 aa, Mycobacterium avium
IQTEFNVALPWSKQVSLSKSAVHP

SEQ ID NO: 16301 - protein, 18 aa, Mycobacterium avium
IQYMKARMDDMLVQADLM

SEQ ID NO: 16302 - protein, 17 aa, Mycobacterium avium
IRCLLFPNPLETQRMGS

SEQ ID NO: 16303 - protein, 24 aa, Mycobacterium avium
IRDLTAFFAWTAWAAAAERPGHKY

SEQ ID NO: 16304 - protein, 27 aa, Mycobacterium avium
IREGRTFRSAVPRGWTRARKTIVSGNA

SEQ ID NO: 16305 - protein, 17 aa, Mycobacterium avium
IREVALLRVVHRSKCGY

SEQ ID NO: 16306 - protein, 20 aa, Mycobacterium avium
IRGRGRAFADIAAARDYLAG

SEQ ID NO: 16307 - protein, 17 aa, Mycobacterium avium
IRSLRPIPSGVEVVANI

SEQ ID NO: 16308 - protein, 17 aa, Mycobacterium avium
IRSSVLTLFEQRPTEVG

SEQ ID NO: 16309 - protein, 17 aa, Mycobacterium avium
IRTAIGPSQAWYTENLR

SEQ ID NO: 16310 - protein, 22 aa, Mycobacterium avium
IRVTPKFTRMVVAALFGVLALM

SEQ ID NO: 16311 - protein, 19 aa, Mycobacterium avium
ISIPCPAVATLPADGGLVV

SEQ ID NO: 16312 - protein, 19 aa, Mycobacterium avium
ISLIQGLVLLTAVAIVTAN

SEQ ID NO: 16313 - protein, 22 aa, Mycobacterium avium
ISLLLCLAVTLGADALGSSAKS

SEQ ID NO: 16314 - protein, 30 aa, Mycobacterium avium
ISLLTAAGYLLWWAVLFPAISVPIIASLTL

SEQ ID NO: 16315 - protein, 21 aa, Mycobacterium avium
ISLSAASLMFFDYMQIPTVFF

SEQ ID NO: 16316 - protein, 25 aa, Mycobacterium avium
ISMVLYIGCWWRHLNPPAAAPAQPA

SEQ ID NO: 16317 - protein, 17 aa, Mycobacterium avium
ISNDYSLIPAFIEELLR

SEQ ID NO: 16318 - protein, 18 aa, Mycobacterium avium
ISPKKSWEGLAGSLVLGI

SEQ ID NO: 16319 - protein, 18 aa, Mycobacterium avium
ISQLTWPIAVAVGPALTY

SEQ ID NO: 16320 - protein, 17 aa, Mycobacterium avium
ISTEFRSDALAVALRAH

SEQ ID NO: 16321 - protein, 17 aa, Mycobacterium avium
ISVAELLARNGTIGAPA

SEQ ID NO: 16322 - protein, 22 aa, Mycobacterium avium
ISWLIPARWGFAASASTVNLRR

SEQ ID NO: 16323 - protein, 21 aa, Mycobacterium avium
ITALVLGLARYRRRRISFSTR

SEQ ID NO: 16324 - protein, 25 aa, Mycobacterium avium
ITDLPEGRWSEFLEEPRIAARVAGA

SEQ ID NO: 16325 - protein, 23 aa, Mycobacterium avium
ITGGLGYAMAFLFIALLLCLAVT

SEQ ID NO: 16326 - protein, 18 aa, Mycobacterium avium
ITGRQAVWALLLAAAVAV

SEQ ID NO: 16327 - protein, 19 aa, Mycobacterium avium
ITIGETWTKIRGRLPALLG

SEQ ID NO: 16328 - protein, 30 aa, Mycobacterium avium
ITLTVMAVFYLRLPATFGIGTYGVSADFVA

SEQ ID NO: 16329 - protein, 17 aa, Mycobacterium avium
ITPGGLAVRGWYRTQVL

SEQ ID NO: 16330 - protein, 23 aa, Mycobacterium avium
ITTGLRLSQIGLFVLLTTYSLSY

SEQ ID NO: 16331 - protein, 19 aa, Mycobacterium avium
ITVLVLIYQWARVVWSRTI

SEQ ID NO: 16332 - protein, 18 aa, Mycobacterium avium
IVAATGWLGYLLGPPLIG

SEQ ID NO: 16333 - protein, 17 aa, Mycobacterium avium
IVAAVLCHRLVELIGVG

SEQ ID NO: 16334 - protein, 22 aa, Mycobacterium avium
IVAAWLLGYLMRTQRLLVAEQI

SEQ ID NO: 16335 - protein, 17 aa, Mycobacterium avium
IVETGEIMVFVGRDFVV

SEQ ID NO: 16336 - protein, 26 aa, Mycobacterium avium
IVGASLVGWWALSRVLERLRGIPDVH

SEQ ID NO: 16337 - protein, 18 aa, Mycobacterium avium
IVLIPAILPLLTVSVVPL

SEQ ID NO: 16338 - protein, 18 aa, Mycobacterium avium
IVLYRVILYILKERYFAS

SEQ ID NO: 16339 - protein, 18 aa, Mycobacterium avium
IVPVSWQLGLAALGGLPL

SEQ ID NO: 16340 - protein, 18 aa, Mycobacterium avium
IVSPAAYLAGFTVALHGL

SEQ ID NO: 16341 - protein, 29 aa, Mycobacterium avium
IVVLVVLGFWSLVVLREYERGVVFRMGHA

SEQ ID NO: 16342 - protein, 29 aa, Mycobacterium avium
IVVLVVLGFWSLVVLREYERGVVFRMGHV

SEQ ID NO: 16343 - protein, 21 aa, Mycobacterium avium
IVVPLCGWALLIADVALMAAS

SEQ ID NO: 16344 - protein, 17 aa, Mycobacterium avium
IVVTRYLTVPAEDAGPR

SEQ ID NO: 16345 - protein, 19 aa, Mycobacterium avium
IWAVYDVRPEFEHAAHPAA

SEQ ID NO: 16346 - protein, 20 aa, Mycobacterium avium
IWDRPERRSGIPALDGLRAI

SEQ ID NO: 16347 - protein, 25 aa, Mycobacterium avium
IWRSVRALPDFWRLLQVRVASQFGD

SEQ ID NO: 16348 - protein, 17 aa, Mycobacterium avium
KADVKPVWQSLRHADTW

SEQ ID NO: 16349 - protein, 23 aa, Mycobacterium avium
KAEVERIWLPFTIWLTAAAALLP

SEQ ID NO: 16350 - protein, 18 aa, Mycobacterium avium
KAGQKVRIAGVPVGAVEA

SEQ ID NO: 16351 - protein, 24 aa, Mycobacterium avium
KALNVRAGDRLRLQTPHGPREAAV

SEQ ID NO: 16352 - protein, 18 aa, Mycobacterium avium
KANGYRLVTVGELLGPRA

SEQ ID NO: 16353 - protein, 17 aa, Mycobacterium avium
KAVLRDVLINELRPDLD

SEQ ID NO: 16354 - protein, 20 aa, Mycobacterium avium
KAYVAGLILTVFSMRVAAAI

SEQ ID NO: 16355 - protein, 24 aa, Mycobacterium avium
KCRCDRTIRIGPWLMSREAENTVL

SEQ ID NO: 16356 - protein, 20 aa, Mycobacterium avium
KEGFETSVFLLAAAETSHGS

SEQ ID NO: 16357 - protein, 17 aa, Mycobacterium avium
KEREFHLALVGALTVAA

SEQ ID NO: 16358 - protein, 17 aa, Mycobacterium avium
KFAAWMVFVPVWTVAVY

SEQ ID NO: 16359 - protein, 17 aa, Mycobacterium avium
KFAWLFMRFSGVALFVL

SEQ ID NO: 16360 - protein, 23 aa, Mycobacterium avium
KFLNFPYWWGFINGGSFVTVGAV

SEQ ID NO: 16361 - protein, 17 aa, Mycobacterium avium
KFLRYNANKALMNLGYE

SEQ ID NO: 16362 - protein, 20 aa, Mycobacterium avium
KGLFYGGGWAQLERQAVGAF

SEQ ID NO: 16363 - protein, 23 aa, Mycobacterium avium
KGLSRPRVVTVHILRNSLIPVVT

SEQ ID NO: 16364 - protein, 31 aa, Mycobacterium avium
KGRLYRRIGASVVRWPVPILVASSAIVMVGA

SEQ ID NO: 16365 - protein, 18 aa, Mycobacterium avium
KHYFGEFMKHVGVELSPI

SEQ ID NO: 16366 - protein, 17 aa, Mycobacterium avium
KIPELFGPLGAGIGGQV

SEQ ID NO: 16367 - protein, 17 aa, Mycobacterium avium
KISVPEPVAAPKPLSPP

SEQ ID NO: 16368 - protein, 19 aa, Mycobacterium avium
KKHFHGCFIEDDFGVEMRH

SEQ ID NO: 16369 - protein, 21 aa, Mycobacterium avium
KKPKKRRLRRKKAGEEAETAE

SEQ ID NO: 16370 - protein, 17 aa, Mycobacterium avium
KLAALLTQPGKTYDVSS

SEQ ID NO: 16371 - protein, 19 aa, Mycobacterium avium
KLIEWPDVVGVSFPVGHRW

SEQ ID NO: 16372 - protein, 20 aa, Mycobacterium avium
KLLTFITVVVLAVIFTLVYI

SEQ ID NO: 16373 - protein, 20 aa, Mycobacterium avium
KLSFPDAWVPGAAKPADREP

SEQ ID NO: 16374 - protein, 38 aa, Mycobacterium avium
KLSRTSVILGALVIVLALVVGYVGWRLYEKLTNNTVVA

SEQ ID NO: 16375 - protein, 39 aa, Mycobacterium avium
KLSRTSVILGALVIVLALVVGYVGWRLYEKLTNNTVVAY

SEQ ID NO: 16376 - protein, 23 aa, Mycobacterium avium
KLSRTSVILGSLVIVLALVVGYV

SEQ ID NO: 16377 - protein, 25 aa, Mycobacterium avium
KLSTLDRFLPVWIGAAMVAGLLLGR

SEQ ID NO: 16378 - protein, 19 aa, Mycobacterium avium
KLYPLLFLGPMLLLGIRTG

SEQ ID NO: 16379 - protein, 18 aa, Mycobacterium avium
KPFTTPHIRALRRAAAPP

SEQ ID NO: 16380 - protein, 24 aa, Mycobacterium avium
KPGLLPWLAASAIALIALALMAII

SEQ ID NO: 16381 - protein, 19 aa, Mycobacterium avium
KPLIPLAVSAFLTSRKKAA

SEQ ID NO: 16382 - protein, 19 aa, Mycobacterium avium
KPLPVWIVAGFIASAIVVV

SEQ ID NO: 16383 - protein, 27 aa, Mycobacterium avium
KPRRPWRRLRFSQLIIGMSAAVAMTAI

SEQ ID NO: 16384 - protein, 17 aa, Mycobacterium avium
KPVIFWTPEHGAYVVRG

SEQ ID NO: 16385 - protein, 20 aa, Mycobacterium avium
KRAAPKLGIDLQGGTRVTLT

SEQ ID NO: 16386 - protein, 29 aa, Mycobacterium avium
KRAGGRWRPLPAPVWVSATAVLLVATTML

SEQ ID NO: 16387 - protein, 21 aa, Mycobacterium avium
KRERDAVELDLRANVASMSAT

SEQ ID NO: 16388 - protein, 24 aa, Mycobacterium avium
KREVVELRRCVNPLSSAFHRIQTE

SEQ ID NO: 16389 - protein, 17 aa, Mycobacterium avium
KRGGRRGAGDGSREMPM

SEQ ID NO: 16390 - protein, 21 aa, Mycobacterium avium
KRLAVPIKWLLAIPHVLVCWS

SEQ ID NO: 16391 - protein, 26 aa, Mycobacterium avium
KRRFLRDPVSVLLIFIIVFALLIAGF

SEQ ID NO: 16392 - protein, 29 aa, Mycobacterium avium
KRVARVRAGAVCWLAIAVCCVAAAGLAAT

SEQ ID NO: 16393 - protein, 19 aa, Mycobacterium avium
KRWGHQWMIVTCWMGVVIW

SEQ ID NO: 16394 - protein, 27 aa, Mycobacterium avium
KSHHHRSVWWSWLVGVLTVVGLGLGLG

SEQ ID NO: 16395 - protein, 20 aa, Mycobacterium avium
KSPRGLWIAAGAAVLLVVAL

SEQ ID NO: 16396 - protein, 17 aa, Mycobacterium avium
KSTLAWIMAGLTVPTTG

SEQ ID NO: 16397 - protein, 26 aa, Mycobacterium avium
KTALRSACCACDGAVVVYPSWWPPAR

SEQ ID NO: 16398 - protein, 20 aa, Mycobacterium avium
KTGLARLALQTGVPVIPVAM

SEQ ID NO: 16399 - protein, 18 aa, Mycobacterium avium
KTLALFGYAAIYAYLAPW

SEQ ID NO: 16400 - protein, 18 aa, Mycobacterium avium
KTNLVWAFGYNLAAIPLA

SEQ ID NO: 16401 - protein, 18 aa, Mycobacterium avium
KTTLLRHLIRTVREHSSP

SEQ ID NO: 16402 - protein, 17 aa, Mycobacterium avium
KVFHEFDSDSVTMIVLE

SEQ ID NO: 16403 - protein, 20 aa, Mycobacterium avium
KVHEAAVCNPPPKSTGPAGS

SEQ ID NO: 16404 - protein, 20 aa, Mycobacterium avium
KVSFLPGMRYYAGNWDTTLW

SEQ ID NO: 16405 - protein, 18 aa, Mycobacterium avium
KYLEAGPKIIEWERPDTG

SEQ ID NO: 16406 - protein, 26 aa, Mycobacterium avium
KYMDMLNLQEAWQFGRGAGQKVAVID

SEQ ID NO: 16407 - protein, 17 aa, Mycobacterium avium
LAAEVIFWHTFPIRGHL

SEQ ID NO: 16408 - protein, 24 aa, Mycobacterium avium
LAAGVLGPWVLRVVFGPQYQAGSA

SEQ ID NO: 16409 - protein, 21 aa, Mycobacterium avium
LAAHAPYLAWLVRASTDSAAV

SEQ ID NO: 16410 - protein, 23 aa, Mycobacterium avium
LAAIAVIVLVDWISERTRLPSAT

SEQ ID NO: 16411 - protein, 23 aa, Mycobacterium avium
LAALDEVFCQALAKAPEDRFDRC

SEQ ID NO: 16412 - protein, 20 aa, Mycobacterium avium
LAALDEVFCQALAKVPEDRF

SEQ ID NO: 16413 - protein, 29 aa, Mycobacterium avium
LAALGSWWPPCWRGSSWSWSTTRICCRRS

SEQ ID NO: 16414 - protein, 27 aa, Mycobacterium avium
LAALIRARFPALTARQVMQRIEATAHH

SEQ ID NO: 16415 - protein, 23 aa, Mycobacterium avium
LAALRVNWALGVQVFDYTGETSP

SEQ ID NO: 16416 - protein, 17 aa, Mycobacterium avium
LAALSLVVGAGRFSLTF

SEQ ID NO: 16417 - protein, 17 aa, Mycobacterium avium
LAANILQLIVFRVVQGI

SEQ ID NO: 16418 - protein, 18 aa, Mycobacterium avium
LAANILQLIVFRVVQGIG

SEQ ID NO: 16419 - protein, 17 aa, Mycobacterium avium
LAARWDRRHRLRVVLLL

SEQ ID NO: 16420 - protein, 26 aa, Mycobacterium avium
LAASLAVSGFLGWRQWQEHQVKAAGE

SEQ ID NO: 16421 - protein, 18 aa, Mycobacterium avium
LAATLWHPHIVGVHDRGE

SEQ ID NO: 16422 - protein, 30 aa, Mycobacterium avium
LACVDPAPAIPRMKVPVWSLLIIGVAALAV

SEQ ID NO: 16423 - protein, 27 aa, Mycobacterium avium
LAFAVPRLRGAHKLWLLLAAPFGMMVA

SEQ ID NO: 16424 - protein, 21 aa, Mycobacterium avium
LAFCAAAFDPAGMTARQSMLP

SEQ ID NO: 16425 - protein, 18 aa, Mycobacterium avium
LAFRHFGQGYAILLLAIW

SEQ ID NO: 16426 - protein, 19 aa, Mycobacterium avium
LAGIVGWAGLLIPHIARAL

SEQ ID NO: 16427 - protein, 23 aa, Mycobacterium avium
LAGLDEVFCQALAKAPEDRFDRC

SEQ ID NO: 16428 - protein, 27 aa, Mycobacterium avium
LAGLLIVIGIELLKPAHIETALRNGDL

SEQ ID NO: 16429 - protein, 32 aa, Mycobacterium avium
LAGLPLIPFTPRWLVRRAEGIAMSSGQLPVGC

SEQ ID NO: 16430 - protein, 25 aa, Mycobacterium avium
LAGPDGRPPIHLPLDDPYQAPEGYP

SEQ ID NO: 16431 - protein, 24 aa, Mycobacterium avium
LAGPDGRPTIHLPLEDPYQAPEGY

SEQ ID NO: 16432 - protein, 19 aa, Mycobacterium avium
LAGRQSAILVTAWAVSGGI

SEQ ID NO: 16433 - protein, 21 aa, Mycobacterium avium
LAGTIRLASGVSFLVDPLRAN

SEQ ID NO: 16434 - protein, 20 aa, Mycobacterium avium
LAIWLRRQLANLAARLVTSL

SEQ ID NO: 16435 - protein, 30 aa, Mycobacterium avium
LAKGRRTVWIPWALGPAAAVLRMLPQFIWR

SEQ ID NO: 16436 - protein, 24 aa, Mycobacterium avium
LALAAVPFGHAWRRGQRADRLPDP

SEQ ID NO: 16437 - protein, 19 aa, Mycobacterium avium
LALCALAAALALLATLLLR

SEQ ID NO: 16438 - protein, 21 aa, Mycobacterium avium
LALGWWQWTRFQSVSGSFQNL

SEQ ID NO: 16439 - protein, 18 aa, Mycobacterium avium
LALILKYTMGLRLNPEAE

SEQ ID NO: 16440 - protein, 17 aa, Mycobacterium avium
LALLLCTVFELDHSYAT

SEQ ID NO: 16441 - protein, 34 aa, Mycobacterium avium
LALLMLVAAIHWRARGWLKRVLPAALVAAVAVTV

SEQ ID NO: 16442 - protein, 23 aa, Mycobacterium avium
LALLPANRVELGFLLIAGVIAFA

SEQ ID NO: 16443 - protein, 24 aa, Mycobacterium avium
LALLPVLALLACWRTRKRGTQDPP

SEQ ID NO: 16444 - protein, 32 aa, Mycobacterium avium
LALTAPVVGWCGRPFHAAAWANLKHGVATMDT

SEQ ID NO: 16445 - protein, 31 aa, Mycobacterium avium
LALTAPVVGWCGRPFHAAAWANLKHGVTTMD

SEQ ID NO: 16446 - protein, 24 aa, Mycobacterium avium
LALVTRRWALAWIALAGTAIAGAA

SEQ ID NO: 16447 - protein, 22 aa, Mycobacterium avium
LAMGSIARWTMGRARHRWPTLG

SEQ ID NO: 16448 - protein, 18 aa, Mycobacterium avium
LAPEQVPPHISRWAAAAV

SEQ ID NO: 16449 - protein, 25 aa, Mycobacterium avium
LAPGGFSVFGVFWGAFGLVTGAANG

SEQ ID NO: 16450 - protein, 19 aa, Mycobacterium avium
LAPIAGPILGGWLIDTSSW

SEQ ID NO: 16451 - protein, 18 aa, Mycobacterium avium
LAPQLFQPFLDYLWGFRT

SEQ ID NO: 16452 - protein, 25 aa, Mycobacterium avium
LAPRGWWAQLSWLPQRPVLVPGTVD

SEQ ID NO: 16453 - protein, 17 aa, Mycobacterium avium
LAPTLERLNSVTAMLEK

SEQ ID NO: 16454 - protein, 24 aa, Mycobacterium avium
LAPVAIALAMLFAPFAGADGYTDQ

SEQ ID NO: 16455 - protein, 17 aa, Mycobacterium avium
LAQCLRGGTGDEVAKLV

SEQ ID NO: 16456 - protein, 17 aa, Mycobacterium avium
LAQLRAWFDRPAATTLQ

SEQ ID NO: 16457 - protein, 18 aa, Mycobacterium avium
LAQLRAWFDRPAATTLQV

SEQ ID NO: 16458 - protein, 20 aa, Mycobacterium avium
LARDRTVIVVAHRLSTVAAA

SEQ ID NO: 16459 - protein, 24 aa, Mycobacterium avium
LARELRPWVPVVSLVKGLEQGTNM

SEQ ID NO: 16460 - protein, 17 aa, Mycobacterium avium
LARGGTRLVRSLRPLIL

SEQ ID NO: 16461 - protein, 26 aa, Mycobacterium avium
LARRLQARLGPWNARLLSAAAYLVAI

SEQ ID NO: 16462 - protein, 18 aa, Mycobacterium avium
LARRWRIRLRHLAVAGVV

SEQ ID NO: 16463 - protein, 17 aa, Mycobacterium avium
LARVGGHVILAVRNTDK

SEQ ID NO: 16464 - protein, 25 aa, Mycobacterium avium
LASRIVFGVGCHRRGPASCDGAPVG

SEQ ID NO: 16465 - protein, 23 aa, Mycobacterium avium
LASVVAMAFMFFQYMQVPTLLGI

SEQ ID NO: 16466 - protein, 19 aa, Mycobacterium avium
LATAIAVAVEPTASRQPVV

SEQ ID NO: 16467 - protein, 19 aa, Mycobacterium avium
LATLAGHWALPRWGSHRLI

SEQ ID NO: 16468 - protein, 25 aa, Mycobacterium avium
LATLWWVVGLVMLRAISPPFLDFIE

SEQ ID NO: 16469 - protein, 18 aa, Mycobacterium avium
LAVAPGWFGVLVALRVTA

SEQ ID NO: 16470 - protein, 21 aa, Mycobacterium avium
LAVASAWCLGLLALFGVLAVR

SEQ ID NO: 16471 - protein, 25 aa, Mycobacterium avium
LAVASPCAYFLVYESTAGNKAPEHH

SEQ ID NO: 16472 - protein, 22 aa, Mycobacterium avium
LAVATAVIWTVALTRPAKVHEA

SEQ ID NO: 16473 - protein, 20 aa, Mycobacterium avium
LAVLCTWFLQTSMCMFFKAR

SEQ ID NO: 16474 - protein, 25 aa, Mycobacterium avium
LAVLCTWFLQTSMCMFFKARSDVAR

SEQ ID NO: 16475 - protein, 22 aa, Mycobacterium avium
LAWDGQIAWWLDMVVFGIYQVT

SEQ ID NO: 16476 - protein, 24 aa, Mycobacterium avium
LAWMTVDALVWVPRMYYLYGNPNR

SEQ ID NO: 16477 - protein, 21 aa, Mycobacterium avium
LAYGLGLWWGVLRERNARALK

SEQ ID NO: 16478 - protein, 21 aa, Mycobacterium avium
LCASFPAVNWWWAAVPAAALL

SEQ ID NO: 16479 - protein, 22 aa, Mycobacterium avium
LCASFPAVNWWWAAVPAAAVLA

SEQ ID NO: 16480 - protein, 18 aa, Mycobacterium avium
LCLHEFGHAVIAWRFGDR

SEQ ID NO: 16481 - protein, 21 aa, Mycobacterium avium
LDAELAIEWVATAGRRAAALG

SEQ ID NO: 16482 - protein, 22 aa, Mycobacterium avium
LDAELAIEWVATAGRRAAALGA

SEQ ID NO: 16483 - protein, 19 aa, Mycobacterium avium
LDDAIAPALGGFVSVLRET

SEQ ID NO: 16484 - protein, 18 aa, Mycobacterium avium
LDDFPSGGALVVSNHSGG

SEQ ID NO: 16485 - protein, 17 aa, Mycobacterium avium
LDDPRWIGMLAAVLTVS

SEQ ID NO: 16486 - protein, 21 aa, Mycobacterium avium
LDEPIPLSAMLARAGVPPRQW

SEQ ID NO: 16487 - protein, 23 aa, Mycobacterium avium
LDGRWLIRIAQLLLVIAAVGLWV

SEQ ID NO: 16488 - protein, 25 aa, Mycobacterium avium
LDGRWLIRIAQLLLVIAAVGLWVAA

SEQ ID NO: 16489 - protein, 19 aa, Mycobacterium avium
LDHLAARLRRNSANLLVLA

SEQ ID NO: 16490 - protein, 30 aa, Mycobacterium avium
LDLNDPPPCAVGFLPPPLMRTPADETVREL

SEQ ID NO: 16491 - protein, 30 aa, Mycobacterium avium
LDPVLRFASLQMVFHHGRSLLIATSNGAAG

SEQ ID NO: 16492 - protein, 23 aa, Mycobacterium avium
LDRFPRGNLIGIPGAPERMVQNP

SEQ ID NO: 16493 - protein, 24 aa, Mycobacterium avium
LDRLRSLMRSVLCSLAVFHNPRDV

SEQ ID NO: 16494 - protein, 31 aa, Mycobacterium avium
LDRYGGGTVRRLWQIGIFARFARISIGQIGW

SEQ ID NO: 16495 - protein, 31 aa, Mycobacterium avium
LDRYGGGTVRRLWQIGIFARFARISIGQTGW

SEQ ID NO: 16496 - protein, 30 aa, Mycobacterium avium
LDRYGGGTVRRLWQIGVFARFARVSIGQIG

SEQ ID NO: 16497 - protein, 24 aa, Mycobacterium avium
LDSPTVRVPARWQYAGAEHAGDVI

SEQ ID NO: 16498 - protein, 21 aa, Mycobacterium avium
LDSVVCALTLAAVAAALTAGP

SEQ ID NO: 16499 - protein, 21 aa, Mycobacterium avium
LDSVVCALTLTAVAAALTAGP

SEQ ID NO: 16500 - protein, 27 aa, Mycobacterium avium
LDTASIVGWLWPLWDSRRRTFADMLAG

SEQ ID NO: 16501 - protein, 23 aa, Mycobacterium avium
LDTGSPYALEYVWGRQVGDNTIN

SEQ ID NO: 16502 - protein, 17 aa, Mycobacterium avium
LDTVVAAALRLSTEEQR

SEQ ID NO: 16503 - protein, 24 aa, Mycobacterium avium
LDVVRIAVPLLVYFAVMWGGGYAL

SEQ ID NO: 16504 - protein, 27 aa, Mycobacterium avium
LDVVRRARFAAAFTFQYSKRPGTPAAE

SEQ ID NO: 16505 - protein, 17 aa, Mycobacterium avium
LEEAIDYCDKFPLDSLP

SEQ ID NO: 16506 - protein, 19 aa, Mycobacterium avium
LEELCPRSLYLRDGALQTA

SEQ ID NO: 16507 - protein, 21 aa, Mycobacterium avium
LEIAPGVVTTWMKLAIRDRIV

SEQ ID NO: 16508 - protein, 26 aa, Mycobacterium avium
LEKYLDHWPDAFKILNRQGLYGDFFS

SEQ ID NO: 16509 - protein, 22 aa, Mycobacterium avium
LELMRAIICQLTFSHGPDHVRM

SEQ ID NO: 16510 - protein, 24 aa, Mycobacterium avium
LENPDWSWLKWLPHIDIPGELDGV

SEQ ID NO: 16511 - protein, 33 aa, Mycobacterium avium
LEQMRKRFGSTLGYRLVIYPTYAALDRPDPSDD

SEQ ID NO: 16512 - protein, 18 aa, Mycobacterium avium
LERVAPPHPSRWRHVPTI

SEQ ID NO: 16513 - protein, 23 aa, Mycobacterium avium
LESAGAGLLRPSEVIPLSRTSSP

SEQ ID NO: 16514 - protein, 24 aa, Mycobacterium avium
LESPTVTVPARWSVDGIEHTGDVS

SEQ ID NO: 16515 - protein, 17 aa, Mycobacterium avium
LEVGLILTVFTMRIAAA

SEQ ID NO: 16516 - protein, 26 aa, Mycobacterium avium
LFADEFGWRGSFWDWLGGLDLNTVGY

SEQ ID NO: 16517 - protein, 25 aa, Mycobacterium avium
LFALYVAGYCVGRFCVELLRDDTAT

SEQ ID NO: 16518 - protein, 24 aa, Mycobacterium avium
LFAQANRAAHAWLFDESGAGGGQW

SEQ ID NO: 16519 - protein, 25 aa, Mycobacterium avium
LFAQANRAAHAWLFDGSGAGGDQWA

SEQ ID NO: 16520 - protein, 24 aa, Mycobacterium avium
LFAVDWRVALVLFVPVLVYLVLTA

SEQ ID NO: 16521 - protein, 19 aa, Mycobacterium avium
LFAVVGLLFLGTVALTLAG

SEQ ID NO: 16522 - protein, 18 aa, Mycobacterium avium
LFPTAAVVIAAAALLLVG

SEQ ID NO: 16523 - protein, 21 aa, Mycobacterium avium
LFPVVQPWYLLWAIIPLAAWA

SEQ ID NO: 16524 - protein, 23 aa, Mycobacterium avium
LFQPFLDYLWGFRTFDTALGPGH

SEQ ID NO: 16525 - protein, 20 aa, Mycobacterium avium
LFVISWVFVVEAQLREHTGT

SEQ ID NO: 16526 - protein, 25 aa, Mycobacterium avium
LFVIVDWRMHAAILPPSVFSPGPLK

SEQ ID NO: 16527 - protein, 23 aa, Mycobacterium avium
LGADGRLPLPNRLLATRPLVELG

SEQ ID NO: 16528 - protein, 18 aa, Mycobacterium avium
LGAGAPMFTVFSHDATDT

SEQ ID NO: 16529 - protein, 17 aa, Mycobacterium avium
LGAGLAAMFPGLTSVEV

SEQ ID NO: 16530 - protein, 19 aa, Mycobacterium avium
LGALDWPHALSHGGYEALG

SEQ ID NO: 16531 - protein, 26 aa, Mycobacterium avium
LGALLGGLVWPFLLLPHLGMIRGAAA

SEQ ID NO: 16532 - protein, 19 aa, Mycobacterium avium
LGAVGIWKAGMFHVLIAIA

SEQ ID NO: 16533 - protein, 20 aa, Mycobacterium avium
LGAWPHWTFTALGAGVIGAV

SEQ ID NO: 16534 - protein, 22 aa, Mycobacterium avium
LGDLLSRPGVFVFGSNDYFGPH

SEQ ID NO: 16535 - protein, 23 aa, Mycobacterium avium
LGDLLSRPGVFVFGSNDYFGPHL

SEQ ID NO: 16536 - protein, 23 aa, Mycobacterium avium
LGDRIGRHRVLVVTILMMTVSTT

SEQ ID NO: 16537 - protein, 17 aa, Mycobacterium avium
LGDRLDALDVRRLLRRA

SEQ ID NO: 16538 - protein, 22 aa, Mycobacterium avium
LGEVLPLLVPVILAAVLFNGSL

SEQ ID NO: 16539 - protein, 17 aa, Mycobacterium avium
LGFLRYALPPEDRIQLQ

SEQ ID NO: 16540 - protein, 20 aa, Mycobacterium avium
LGGIGVMFAVYGRWSQKVGW

SEQ ID NO: 16541 - protein, 30 aa, Mycobacterium avium
LGGLPLMLGALWASARLARRADSTAAEAHS

SEQ ID NO: 16542 - protein, 23 aa, Mycobacterium avium
LGGSRRAIFTGALRVGRDHIAST

SEQ ID NO: 16543 - protein, 18 aa, Mycobacterium avium
LGHGGIDFGVAFYGAPAV

SEQ ID NO: 16544 - protein, 17 aa, Mycobacterium avium
LGIALVIARALREMTKL

SEQ ID NO: 16545 - protein, 20 aa, Mycobacterium avium
LGIDPVRRLVVPRFLGLLLI

SEQ ID NO: 16546 - protein, 19 aa, Mycobacterium avium
LGLHGGGWAGLLCLLAGSS

SEQ ID NO: 16547 - protein, 26 aa, Mycobacterium avium
LGLHQCWRGAPAVTVSVVGWVFAVRA

SEQ ID NO: 16548 - protein, 24 aa, Mycobacterium avium
LGLLWWMMVCWAQPVRNRSDRREF

SEQ ID NO: 16549 - protein, 18 aa, Mycobacterium avium
LGNLNARKVVVLLNPTTN

SEQ ID NO: 16550 - protein, 29 aa, Mycobacterium avium
LGPAARVRARLVLRLARNYIPLRGTGKVA

SEQ ID NO: 16551 - protein, 20 aa, Mycobacterium avium
LGPELSRLVSGTAKLATDSR

SEQ ID NO: 16552 - protein, 17 aa, Mycobacterium avium
LGPRIGFKKDAMRPHNL

SEQ ID NO: 16553 - protein, 19 aa, Mycobacterium avium
LGPTLDRLNSVAAMLEKNR

SEQ ID NO: 16554 - protein, 27 aa, Mycobacterium avium
LGPVRTFYCGWLAVYVIEFPLEIFAVH

SEQ ID NO: 16555 - protein, 24 aa, Mycobacterium avium
LGRLEDGRHVWAIRGALQAPDDPE

SEQ ID NO: 16556 - protein, 22 aa, Mycobacterium avium
LGRRRRARRSARRRAAQANAAA

SEQ ID NO: 16557 - protein, 17 aa, Mycobacterium avium
LGRVSLAMLPLFVAAMM

SEQ ID NO: 16558 - protein, 19 aa, Mycobacterium avium
LGSALAWLLAGLAAAGRWP

SEQ ID NO: 16559 - protein, 22 aa, Mycobacterium avium
LGSLLQWMFYVGLLITVADVLI

SEQ ID NO: 16560 - protein, 28 aa, Mycobacterium avium
LGSRYFRFLPRRLVERIVPKPGTGPSPA

SEQ ID NO: 16561 - protein, 17 aa, Mycobacterium avium
LGSTVGHVVVSGTVAAL

SEQ ID NO: 16562 - protein, 17 aa, Mycobacterium avium
LGSTVGHVVVSGTVAVL

SEQ ID NO: 16563 - protein, 18 aa, Mycobacterium avium
LGVAAGIGLVLFFFGAVG

SEQ ID NO: 16564 - protein, 18 aa, Mycobacterium avium
LGVAAGIGLVLFFIGAVG

SEQ ID NO: 16565 - protein, 18 aa, Mycobacterium avium
LGVWKYREMMTSENHLAH

SEQ ID NO: 16566 - protein, 25 aa, Mycobacterium avium
LGWVAREGRIPLGYFDDPDATRKTF

SEQ ID NO: 16567 - protein, 21 aa, Mycobacterium avium
LGYLRRQLLVLAAFTTGVLLI

SEQ ID NO: 16568 - protein, 17 aa, Mycobacterium avium
LHAAAVRFAEFFAAALQ

SEQ ID NO: 16569 - protein, 18 aa, Mycobacterium avium
LHAFFGVVLMGTRKVLGA

SEQ ID NO: 16570 - protein, 17 aa, Mycobacterium avium
LHGYRFESTPLWAGIYM

SEQ ID NO: 16571 - protein, 17 aa, Mycobacterium avium
LHLAMVWFQKHTQFPGP

SEQ ID NO: 16572 - protein, 19 aa, Mycobacterium avium
LHLFDRDGVDFATGPPPPA

SEQ ID NO: 16573 - protein, 24 aa, Mycobacterium avium
LHLTRRTKIQLAIFTVISLSAASL

SEQ ID NO: 16574 - protein, 17 aa, Mycobacterium avium
LHPPRLWAGLRCGAAVA

SEQ ID NO: 16575 - protein, 18 aa, Mycobacterium avium
LHPPRLWAGLRCGAAVAG

SEQ ID NO: 16576 - protein, 18 aa, Mycobacterium avium
LHYLRRIIESGAFRLEPP

SEQ ID NO: 16577 - protein, 17 aa, Mycobacterium avium
LIAAPVAGWLADRFGAR

SEQ ID NO: 16578 - protein, 17 aa, Mycobacterium avium
LIAGFVGHAWHRADHPL

SEQ ID NO: 16579 - protein, 25 aa, Mycobacterium avium
LIAGMFMWIAIIWRGIRGRLKGESK

SEQ ID NO: 16580 - protein, 18 aa, Mycobacterium avium
LIATGGMGQVWEAVDNRL

SEQ ID NO: 16581 - protein, 24 aa, Mycobacterium avium
LIAVAVAVLVDFAAKRTREARRAS

SEQ ID NO: 16582 - protein, 23 aa, Mycobacterium avium
LICASVIGGTVVVGWVISLIMVN

SEQ ID NO: 16583 - protein, 22 aa, Mycobacterium avium
LIEEFQVLYAARRLRPNQTPHS

SEQ ID NO: 16584 - protein, 24 aa, Mycobacterium avium
LIFDAGICLVLFALPAMALTIALL

SEQ ID NO: 16585 - protein, 18 aa, Mycobacterium avium
LIFGWLAFLLVFGIFVRR

SEQ ID NO: 16586 - protein, 25 aa, Mycobacterium avium
LIFTALRIAFLAVLVGTTLEVLSER

SEQ ID NO: 16587 - protein, 20 aa, Mycobacterium avium
LILAAAVGWGHAAGKAIHEP

SEQ ID NO: 16588 - protein, 17 aa, Mycobacterium avium
LILRLVLGVTLAAHGYN

SEQ ID NO: 16589 - protein, 25 aa, Mycobacterium avium
LIPDRVDAVLRAKVDGAWNLHELTK

SEQ ID NO: 16590 - protein, 17 aa, Mycobacterium avium
LIPMLPAALILAAATAA

SEQ ID NO: 16591 - protein, 21 aa, Mycobacterium avium
LIQPFFDYYFGFRRNDPNMPR

SEQ ID NO: 16592 - protein, 18 aa, Mycobacterium avium
LIRERFGRGWAWLSAFTL

SEQ ID NO: 16593 - protein, 24 aa, Mycobacterium avium
LIWQYIFGIQLYWMVLPMSVIVLL

SEQ ID NO: 16594 - protein, 18 aa, Mycobacterium avium
LIYGPARPGPWKTVEDVE

SEQ ID NO: 16595 - protein, 18 aa, Mycobacterium avium
LIYGTAAALVFPAVFFPR

SEQ ID NO: 16596 - protein, 19 aa, Mycobacterium avium
LKAGQKVRIAGVPVGAVEA

SEQ ID NO: 16597 - protein, 24 aa, Mycobacterium avium
LKKLRANGIRRIVMLTGDHPDIAA

SEQ ID NO: 16598 - protein, 17 aa, Mycobacterium avium
LKLAGAVGLTLGLVALP

SEQ ID NO: 16599 - protein, 17 aa, Mycobacterium avium
LKMLMVTILLVIVGIGL

SEQ ID NO: 16600 - protein, 19 aa, Mycobacterium avium
LKMLMVTILLVIVGIGLAL

SEQ ID NO: 16601 - protein, 19 aa, Mycobacterium avium
LKPTLPVFLANLSTIGQIG

SEQ ID NO: 16602 - protein, 20 aa, Mycobacterium avium
LKSLLRQAGPTADQVNDVFN

SEQ ID NO: 16603 - protein, 28 aa, Mycobacterium avium
LLAGENHRLVGTRLCWTDHPRADQLRRA

SEQ ID NO: 16604 - protein, 29 aa, Mycobacterium avium
LLAGENHRLVGTRLCWTDHPRADQLRRAL

SEQ ID NO: 16605 - protein, 26 aa, Mycobacterium avium
LLALLANLFLPWGIAGGHPSAVDVAI

SEQ ID NO: 16606 - protein, 20 aa, Mycobacterium avium
LLAPLRWALIPSGVLQAVIT

SEQ ID NO: 16607 - protein, 17 aa, Mycobacterium avium
LLARLFASHGLAPAPPP

SEQ ID NO: 16608 - protein, 17 aa, Mycobacterium avium
LLARLFASHGLSPAPPP

SEQ ID NO: 16609 - protein, 26 aa, Mycobacterium avium
LLAVLCTWFLQTSMCMFFKARSDVAR

SEQ ID NO: 16610 - protein, 18 aa, Mycobacterium avium
LLAWELMATASLVLVLAQ

SEQ ID NO: 16611 - protein, 23 aa, Mycobacterium avium
LLDAELAIEWVATAGRRAAALGA

SEQ ID NO: 16612 - protein, 19 aa, Mycobacterium avium
LLDFLRATALTVVLLGLGA

SEQ ID NO: 16613 - protein, 21 aa, Mycobacterium avium
LLELLPHITLINGYGSSETGN

SEQ ID NO: 16614 - protein, 19 aa, Mycobacterium avium
LLEPVTWSPGTRLAMIALR

SEQ ID NO: 16615 - protein, 19 aa, Mycobacterium avium
LLFIGFMFGLLLLTGTTIR

SEQ ID NO: 16616 - protein, 17 aa, Mycobacterium avium
LLFPAFLLIVYKLLIGK

SEQ ID NO: 16617 - protein, 17 aa, Mycobacterium avium
LLGDGRFLWACFREPFW

SEQ ID NO: 16618 - protein, 19 aa, Mycobacterium avium
LLGEVKRRGATIFEVTEEA

SEQ ID NO: 16619 - protein, 18 aa, Mycobacterium avium
LLGEVKRRGATTFEVTEE

SEQ ID NO: 16620 - protein, 27 aa, Mycobacterium avium
LLGPGPRWWAITLLVVGGVSAVYGVLQ

SEQ ID NO: 16621 - protein, 23 aa, Mycobacterium avium
LLIARFVVEFIRSFSRDWHPTGI

SEQ ID NO: 16622 - protein, 21 aa, Mycobacterium avium
LLICAAIALWLSRSAPPGPSE

SEQ ID NO: 16623 - protein, 23 aa, Mycobacterium avium
LLIDFKGGATFLDYANAPHVAAV

SEQ ID NO: 16624 - protein, 19 aa, Mycobacterium avium
LLIVRPGFVIGRMTEGMTP

SEQ ID NO: 16625 - protein, 24 aa, Mycobacterium avium
LLLACLLATLGIWRWSQGTVSVAT

SEQ ID NO: 16626 - protein, 17 aa, Mycobacterium avium
LLLAISCAILMLGPQAH

SEQ ID NO: 16627 - protein, 25 aa, Mycobacterium avium
LLLDGRKLLWWTLSRFTTLGNLPFR

SEQ ID NO: 16628 - protein, 20 aa, Mycobacterium avium
LLLGLADQWLFSRISGDMMN

SEQ ID NO: 16629 - protein, 25 aa, Mycobacterium avium
LLLLIVFCLIELRAPQPMVNVRLFR

SEQ ID NO: 16630 - protein, 19 aa, Mycobacterium avium
LLLLPVAWYLAVGSHQPGF

SEQ ID NO: 16631 - protein, 18 aa, Mycobacterium avium
LLLNFTPMFGHPSHASPS

SEQ ID NO: 16632 - protein, 18 aa, Mycobacterium avium
LLLPVFLLFCYQIVLGEQ

SEQ ID NO: 16633 - protein, 25 aa, Mycobacterium avium
LLLSSLIVGAGWPLIVEQISVKPNA

SEQ ID NO: 16634 - protein, 21 aa, Mycobacterium avium
LLLTVFPGWVAIGLATALAAA

SEQ ID NO: 16635 - protein, 19 aa, Mycobacterium avium
LLLVLICRRQWQPKLVLGA

SEQ ID NO: 16636 - protein, 19 aa, Mycobacterium avium
LLLVLICRRQWQPKLVLGP

SEQ ID NO: 16637 - protein, 18 aa, Mycobacterium avium
LLPPVLALAATRGIGEPK

SEQ ID NO: 16638 - protein, 23 aa, Mycobacterium avium
LLRCSGTARAARVCASTAPRTTS

SEQ ID NO: 16639 - protein, 20 aa, Mycobacterium avium
LLRDTRWWLGGLGDIGSYVL

SEQ ID NO: 16640 - protein, 23 aa, Mycobacterium avium
LLRSQRWWWGAVLLLASIGLQAA

SEQ ID NO: 16641 - protein, 17 aa, Mycobacterium avium
LLRVPLRDGLYVREAML

SEQ ID NO: 16642 - protein, 24 aa, Mycobacterium avium
LLSFERWAPDMPWEVSTGRPVSPG

SEQ ID NO: 16643 - protein, 18 aa, Mycobacterium avium
LLSNIAWGNGSIVVGGGT

SEQ ID NO: 16644 - protein, 20 aa, Mycobacterium avium
LLSRIREYWLASGAARPARP

SEQ ID NO: 16645 - protein, 18 aa, Mycobacterium avium
LLTIGGCVLLYLTPLILG

SEQ ID NO: 16646 - protein, 17 aa, Mycobacterium avium
LLTILGFSLYDTVIVFD

SEQ ID NO: 16647 - protein, 18 aa, Mycobacterium avium
LLTILGFSLYDTVIVFDK

SEQ ID NO: 16648 - protein, 33 aa, Mycobacterium avium
LLTVLRLLQGFAVGGEWAGSVLLSAEYAPTDRR

SEQ ID NO: 16649 - protein, 17 aa, Mycobacterium avium
LLVAFLCVALVVYFALL

SEQ ID NO: 16650 - protein, 23 aa, Mycobacterium avium
LLVAVMALLLVMRYRGRRRRAAA

SEQ ID NO: 16651 - protein, 23 aa, Mycobacterium avium
LLVDFKGGATFLDYANAPHVAAV

SEQ ID NO: 16652 - protein, 17 aa, Mycobacterium avium
LLVGAALVLNFLIVTAM

SEQ ID NO: 16653 - protein, 23 aa, Mycobacterium avium
LLWGDARVGNVLYRDFVPVAVLD

SEQ ID NO: 16654 - protein, 18 aa, Mycobacterium avium
LLWRGKGLLVTFAVGHIG

SEQ ID NO: 16655 - protein, 23 aa, Mycobacterium avium
LLYAHHGWLPLVVAITVINGIAE

SEQ ID NO: 16656 - protein, 22 aa, Mycobacterium avium
LLYSLLYYRVLGLLTALSLAAS

SEQ ID NO: 16657 - protein, 24 aa, Mycobacterium avium
LMAEPVLMIGMIYIWMPLAMGSIA

SEQ ID NO: 16658 - protein, 23 aa, Mycobacterium avium
LMAGCGLYAMIGFPLDDIWHRIF

SEQ ID NO: 16659 - protein, 21 aa, Mycobacterium avium
LMHAAGMWTAFAAIMAGTTVV

SEQ ID NO: 16660 - protein, 26 aa, Mycobacterium avium
LMLFDWPTHILEIFMSQPELLAPALL

SEQ ID NO: 16661 - protein, 17 aa, Mycobacterium avium
LMLLPLSAFEAMTPLPA

SEQ ID NO: 16662 - protein, 17 aa, Mycobacterium avium
LMNRWLGRFTKSITQSW

SEQ ID NO: 16663 - protein, 19 aa, Mycobacterium avium
LMRAAGQPGAALVMDDATG

SEQ ID NO: 16664 - protein, 21 aa, Mycobacterium avium
LMRGSFCLVMALVAGYVLGFR

SEQ ID NO: 16665 - protein, 23 aa, Mycobacterium avium
LMSALCALYLGGILNPTTNLRHF

SEQ ID NO: 16666 - protein, 17 aa, Mycobacterium avium
LMTNPLLRRFNDLQATT

SEQ ID NO: 16667 - protein, 17 aa, Mycobacterium avium
LMTSRLRNSIKVRDHYT

SEQ ID NO: 16668 - protein, 17 aa, Mycobacterium avium
LMVGQPVRFTARIGRPT

SEQ ID NO: 16669 - protein, 17 aa, Mycobacterium avium
LNAGEVIQRVVERDQRV

SEQ ID NO: 16670 - protein, 25 aa, Mycobacterium avium
LNAHGLKAFVLVGAVAVVIVATIAL

SEQ ID NO: 16671 - protein, 20 aa, Mycobacterium avium
LNIWAGAALLVLDIAVAVVL

SEQ ID NO: 16672 - protein, 28 aa, Mycobacterium avium
LNPCGFAMLPAYLLLVVRGAGARAPGVA

SEQ ID NO: 16673 - protein, 19 aa, Mycobacterium avium
LNRMVDIRSNPALRAQIQA

SEQ ID NO: 16674 - protein, 17 aa, Mycobacterium avium
LNSTMPVALRWVATTVM

SEQ ID NO: 16675 - protein, 18 aa, Mycobacterium avium
LNSVAAMLEKNRDNLSKA

SEQ ID NO: 16676 - protein, 20 aa, Mycobacterium avium
LNVKSGDAFEIWVDGKGAPV

SEQ ID NO: 16677 - protein, 17 aa, Mycobacterium avium
LPADVAAVVARRRAEHR

SEQ ID NO: 16678 - protein, 18 aa, Mycobacterium avium
LPAGEQELLISPGAQFVV

SEQ ID NO: 16679 - protein, 22 aa, Mycobacterium avium
LPAGEQELLISPGAQFVVDGAE

SEQ ID NO: 16680 - protein, 19 aa, Mycobacterium avium
LPAGRFVAAHGARRGIMIG

SEQ ID NO: 16681 - protein, 18 aa, Mycobacterium avium
LPDGRHVWEYAPRNGETD

SEQ ID NO: 16682 - protein, 19 aa, Mycobacterium avium
LPDKLGLPSVHSDHWDPVL

SEQ ID NO: 16683 - protein, 17 aa, Mycobacterium avium
LPDTKGALASWLPPGAA

SEQ ID NO: 16684 - protein, 25 aa, Mycobacterium avium
LPEIRYSMILFNWFGVCLVPILALI

SEQ ID NO: 16685 - protein, 23 aa, Mycobacterium avium
LPFGEVIVQAWTLLKVTALPAVL

SEQ ID NO: 16686 - protein, 20 aa, Mycobacterium avium
LPFVWIAWTALRNFRSGTTV

SEQ ID NO: 16687 - protein, 27 aa, Mycobacterium avium
LPGKQPRPAIGPLRRTGLSGVLRGGRS

SEQ ID NO: 16688 - protein, 18 aa, Mycobacterium avium
LPHGGGLGLLGSVPTGLL

SEQ ID NO: 16689 - protein, 33 aa, Mycobacterium avium
LPIIKPAVVVALLFRTLDAFRIFDNIYVLTNGA

SEQ ID NO: 16690 - protein, 17 aa, Mycobacterium avium
LPIPGLDGYDALEPHLS

SEQ ID NO: 16691 - protein, 30 aa, Mycobacterium avium
LPLLAIAVKVDWPHFWSLITSPSSRTALLL

SEQ ID NO: 16692 - protein, 17 aa, Mycobacterium avium
LPLLLGALFANGLARFV

SEQ ID NO: 16693 - protein, 18 aa, Mycobacterium avium
LPPSINFAGPSPYIDFDG

SEQ ID NO: 16694 - protein, 19 aa, Mycobacterium avium
LPPTPGIPIAGRPGDAPPD

SEQ ID NO: 16695 - protein, 20 aa, Mycobacterium avium
LPQGEVVRIFVGNTFPFAGY

SEQ ID NO: 16696 - protein, 20 aa, Mycobacterium avium
LPRVNAHGGPGGRPGCWQKI

SEQ ID NO: 16697 - protein, 22 aa, Mycobacterium avium
LPSRVFGWLALVFGVGFSTLAL

SEQ ID NO: 16698 - protein, 20 aa, Mycobacterium avium
LPTGLRLVIDNAIANAVKHG

SEQ ID NO: 16699 - protein, 18 aa, Mycobacterium avium
LPTTIGFLIAAPVAGWLA

SEQ ID NO: 16700 - protein, 20 aa, Mycobacterium avium
LPVIFIAAVVALGDRPGDQH

SEQ ID NO: 16701 - protein, 25 aa, Mycobacterium avium
LPVLALMVVAVWLLGVGTLKDLALV

SEQ ID NO: 16702 - protein, 26 aa, Mycobacterium avium
LPWYAILCLPVLFAAGMCLLDTIDGS

SEQ ID NO: 16703 - protein, 17 aa, Mycobacterium avium
LQALLGAAHWNSDDKAV

SEQ ID NO: 16704 - protein, 24 aa, Mycobacterium avium
LQCVAEARPFVLLERFELNAWTAA

SEQ ID NO: 16705 - protein, 17 aa, Mycobacterium avium
LQESISLQGNQALVGQT

SEQ ID NO: 16706 - protein, 20 aa, Mycobacterium avium
LQGPGVVITGFVNRVGDPRP

SEQ ID NO: 16707 - protein, 26 aa, Mycobacterium avium
LQHCVTAFAAVGWRSRVRRLPDPDDP

SEQ ID NO: 16708 - protein, 20 aa, Mycobacterium avium
LQHSWPLTGRKVHPPYDQLF

SEQ ID NO: 16709 - protein, 25 aa, Mycobacterium avium
LQLHNRPGPIPSYDAAAALRADAAT

SEQ ID NO: 16710 - protein, 25 aa, Mycobacterium avium
LQLLFSVGVDGFFAISGFLITRSWL

SEQ ID NO: 16711 - protein, 18 aa, Mycobacterium avium
LQRTGGLRRAVVAVATTT

SEQ ID NO: 16712 - protein, 17 aa, Mycobacterium avium
LQVGIAEHSFVDTVRAL

SEQ ID NO: 16713 - protein, 18 aa, Mycobacterium avium
LRALAYAATGGRAQPDDI

SEQ ID NO: 16714 - protein, 18 aa, Mycobacterium avium
LRALGGRRRAVVGDLLAE

SEQ ID NO: 16715 - protein, 21 aa, Mycobacterium avium
LRALIAPLYLLGTVVLNYLAS

SEQ ID NO: 16716 - protein, 17 aa, Mycobacterium avium
LRASVRVTRVIRGSAGP

SEQ ID NO: 16717 - protein, 20 aa, Mycobacterium avium
LRAVVLPRLLARAVGAEQRD

SEQ ID NO: 16718 - protein, 24 aa, Mycobacterium avium
LRDALRTHLGFVRSGMAPRLVSDA

SEQ ID NO: 16719 - protein, 23 aa, Mycobacterium avium
LREFGNIVFHFSLLGLLVAVAVG

SEQ ID NO: 16720 - protein, 21 aa, Mycobacterium avium
LRELVLLWLADQVDTALAKYR

SEQ ID NO: 16721 - protein, 21 aa, Mycobacterium avium
LRFASLQTVFHHGRSLLIATS

SEQ ID NO: 16722 - protein, 20 aa, Mycobacterium avium
LRGGSLTFLDCVYFSAVSLS

SEQ ID NO: 16723 - protein, 19 aa, Mycobacterium avium
LRGVRIGRIESLQITDNGV

SEQ ID NO: 16724 - protein, 18 aa, Mycobacterium avium
LRLAAARADVVPAITKYM

SEQ ID NO: 16725 - protein, 19 aa, Mycobacterium avium
LRLAAARADVVPAITKYMS

SEQ ID NO: 16726 - protein, 24 aa, Mycobacterium avium
LRLTMMRLWLLRPGMRLWELPLFP

SEQ ID NO: 16727 - protein, 20 aa, Mycobacterium avium
LRNALFDAFGPKGADGKPSK

SEQ ID NO: 16728 - protein, 26 aa, Mycobacterium avium
LRNRRLRLATDLSYGVYIYAFPVQQL

SEQ ID NO: 16729 - protein, 19 aa, Mycobacterium avium
LRNSIKVRDHYTCRYCSVS

SEQ ID NO: 16730 - protein, 28 aa, Mycobacterium avium
LRPPAPWPAPGYPPAWPGSGPAPQWPAP

SEQ ID NO: 16731 - protein, 20 aa, Mycobacterium avium
LRPSWGEWRTAGAAATAGAL

SEQ ID NO: 16732 - protein, 20 aa, Mycobacterium avium
LRPSWGEWRTAGAAATAGVL

SEQ ID NO: 16733 - protein, 24 aa, Mycobacterium avium
LRPYGPRPAVRQLLLWEDGDPAVA

SEQ ID NO: 16734 - protein, 25 aa, Mycobacterium avium
LRPYGPRPAVRTLLLPENRDVAGSY

SEQ ID NO: 16735 - protein, 32 aa, Mycobacterium avium
LRQLILGGIDARLWQAIIVLAAITAVALAISC

SEQ ID NO: 16736 - protein, 18 aa, Mycobacterium avium
LRRLLGRMHSAWESGASW

SEQ ID NO: 16737 - protein, 20 aa, Mycobacterium avium
LRRLLILCAAWMVIPTALVV

SEQ ID NO: 16738 - protein, 17 aa, Mycobacterium avium
LRSGFAHDSATSVPVVI

SEQ ID NO: 16739 - protein, 26 aa, Mycobacterium avium
LRTKILPISFGFPFGLSAVLPVNLPL

SEQ ID NO: 16740 - protein, 17 aa, Mycobacterium avium
LRTVLRSPAGAAFGPVL

SEQ ID NO: 16741 - protein, 20 aa, Mycobacterium avium
LRVDGPVPFAPRVTTQEVEV

SEQ ID NO: 16742 - protein, 18 aa, Mycobacterium avium
LRVGQPVVAIGSPLGLSG

SEQ ID NO: 16743 - protein, 18 aa, Mycobacterium avium
LRVLGQFGSTVCIGLLLD

SEQ ID NO: 16744 - protein, 17 aa, Mycobacterium avium
LRVRAYQSALLSNFATG

SEQ ID NO: 16745 - protein, 25 aa, Mycobacterium avium
LRVVQGLAVGAEWGGAAVLSVEHAP

SEQ ID NO: 16746 - protein, 19 aa, Mycobacterium avium
LRWLLDGRVGRQWWAGVAI

SEQ ID NO: 16747 - protein, 23 aa, Mycobacterium avium
LRYLIGQLRLSAPDRMRMLREFA

SEQ ID NO: 16748 - protein, 21 aa, Mycobacterium avium
LRYLPDLVVVLALLAAVALCA

SEQ ID NO: 16749 - protein, 21 aa, Mycobacterium avium
LRYLPDLVVVLALLAAVALSA

SEQ ID NO: 16750 - protein, 22 aa, Mycobacterium avium
LRYLPDLVVVLALLAAVALSAP

SEQ ID NO: 16751 - protein, 25 aa, Mycobacterium avium
LSADWFGMAVLVAWGALGALGSLRW

SEQ ID NO: 16752 - protein, 23 aa, Mycobacterium avium
LSAIRLALVPVFVYALLVAHANG

SEQ ID NO: 16753 - protein, 18 aa, Mycobacterium avium
LSALLGQVQAGSWEGESA

SEQ ID NO: 16754 - protein, 20 aa, Mycobacterium avium
LSARFGWRRPQTLLVVGLVV

SEQ ID NO: 16755 - protein, 21 aa, Mycobacterium avium
LSAVSSRAGVEIAVDDNGSGV

SEQ ID NO: 16756 - protein, 22 aa, Mycobacterium avium
LSAYKIPRRFASLRRADVPLLS

SEQ ID NO: 16757 - protein, 24 aa, Mycobacterium avium
LSDDFPLAVPFTMVAAAPIRAMVR

SEQ ID NO: 16758 - protein, 23 aa, Mycobacterium avium
LSFERWAPDMPWEVSTGKPVSPG

SEQ ID NO: 16759 - protein, 23 aa, Mycobacterium avium
LSFERWAPDMPWEVSTGRPVSPG

SEQ ID NO: 16760 - protein, 22 aa, Mycobacterium avium
LSFLLRPGWVVLALVVVAFAYL

SEQ ID NO: 16761 - protein, 26 aa, Mycobacterium avium
LSGFVVYRLHGIFGVHPGSFGGGTSG

SEQ ID NO: 16762 - protein, 37 aa, Mycobacterium avium
LSIMACGYILASLHWYTWIAFSGWVLLALIFYFVWGR

SEQ ID NO: 16763 - protein, 17 aa, Mycobacterium avium
LSIPFNALSVFIINVLL

SEQ ID NO: 16764 - protein, 32 aa, Mycobacterium avium
LSITLHRLVAGWNRLGSQTAFYVKALSLMWDA

SEQ ID NO: 16765 - protein, 17 aa, Mycobacterium avium
LSLMIGGSIAMVPWLGY

SEQ ID NO: 16766 - protein, 25 aa, Mycobacterium avium
LSLTWPRLTTVFLVDIVIMVVASHC

SEQ ID NO: 16767 - protein, 18 aa, Mycobacterium avium
LSNFLGWLLTGWLIFQLV

SEQ ID NO: 16768 - protein, 17 aa, Mycobacterium avium
LSNITWGNGSIVVGGGT

SEQ ID NO: 16769 - protein, 24 aa, Mycobacterium avium
LSPARLRAMLRRRVAPPARPDVDS

SEQ ID NO: 16770 - protein, 25 aa, Mycobacterium avium
LSRAPRFPIAVPRPQFADYHRRTGT

SEQ ID NO: 16771 - protein, 19 aa, Mycobacterium avium
LSRIREYWLASGAARPARP

SEQ ID NO: 16772 - protein, 27 aa, Mycobacterium avium
LSRMMKVELPLAVPVLIAGLRVVVVTN

SEQ ID NO: 16773 - protein, 17 aa, Mycobacterium avium
LSRQPWRSVDGYAGHAG

SEQ ID NO: 16774 - protein, 23 aa, Mycobacterium avium
LSRYRPGTHLANWRRVGFATWIA

SEQ ID NO: 16775 - protein, 23 aa, Mycobacterium avium
LSSTAYVLAKIVVFCVFAVAQAA

SEQ ID NO: 16776 - protein, 17 aa, Mycobacterium avium
LSTALGWAIFHTLMIFW

SEQ ID NO: 16777 - protein, 18 aa, Mycobacterium avium
LSTALGWAIFHTLMIFWP

SEQ ID NO: 16778 - protein, 24 aa, Mycobacterium avium
LSTFAVNLLVALAMAAGTDYAIFF

SEQ ID NO: 16779 - protein, 20 aa, Mycobacterium avium
LSVEVGFYLALPVLALLARR

SEQ ID NO: 16780 - protein, 24 aa, Mycobacterium avium
LSVEVGFYLALPVLALLARRLPVT

SEQ ID NO: 16781 - protein, 25 aa, Mycobacterium avium
LSVEVGFYLALPVLALLARRLPVTA

SEQ ID NO: 16782 - protein, 20 aa, Mycobacterium avium
LSVTAGVLIVCFVAGVVIAS

SEQ ID NO: 16783 - protein, 19 aa, Mycobacterium avium
LSYLDVCDQVLLMAPGGKT

SEQ ID NO: 16784 - protein, 32 aa, Mycobacterium avium
LSYPKRWGYRPAALGLFAFVWMELASPNPAAP

SEQ ID NO: 16785 - protein, 19 aa, Mycobacterium avium
LTADARAAGLPLPAGAGVT

SEQ ID NO: 16786 - protein, 22 aa, Mycobacterium avium
LTAQAFVSPYLVGVLGAATESS

SEQ ID NO: 16787 - protein, 17 aa, Mycobacterium avium
LTARPGTLTAVIGGSGA

SEQ ID NO: 16788 - protein, 22 aa, Mycobacterium avium
LTDCDGHGTLLAGLVAGQPSPD

SEQ ID NO: 16789 - protein, 24 aa, Mycobacterium avium
LTEGTRAAIRFADLTGGRYVALEE

SEQ ID NO: 16790 - protein, 17 aa, Mycobacterium avium
LTGDPKLVAGFLGLANG

SEQ ID NO: 16791 - protein, 18 aa, Mycobacterium avium
LTGLLAFVALVIVIVAET

SEQ ID NO: 16792 - protein, 24 aa, Mycobacterium avium
LTIMLAAWGWFALLLEITGAVAVV

SEQ ID NO: 16793 - protein, 18 aa, Mycobacterium avium
LTLLRYLIGQLRLSAPDR

SEQ ID NO: 16794 - protein, 17 aa, Mycobacterium avium
LTLMVITSLTWGAGRLN

SEQ ID NO: 16795 - protein, 28 aa, Mycobacterium avium
LTNYWVMSHMLPLFRRMQALIDGVNRVM

SEQ ID NO: 16796 - protein, 21 aa, Mycobacterium avium
LTPAQRACVWFFAIVSVLFLA

SEQ ID NO: 16797 - protein, 18 aa, Mycobacterium avium
LTPPGTFTAIPPYWQQTA

SEQ ID NO: 16798 - protein, 24 aa, Mycobacterium avium
LTPPRFADRFEHVYGRHDGFRRNH

SEQ ID NO: 16799 - protein, 26 aa, Mycobacterium avium
LTQLTVRGWLALVLWIMGTTVLIGAL

SEQ ID NO: 16800 - protein, 26 aa, Mycobacterium avium
LTQLTVRGWLALVLWIMGTTVLVGAV

SEQ ID NO: 16801 - protein, 20 aa, Mycobacterium avium
LTRQLERPDALLAGIGDHAL

SEQ ID NO: 16802 - protein, 19 aa, Mycobacterium avium
LTSDYERLLYVVLPAFHLM

SEQ ID NO: 16803 - protein, 18 aa, Mycobacterium avium
LTSTRIRDVLRNGAIIRR

SEQ ID NO: 16804 - protein, 19 aa, Mycobacterium avium
LTVGAAFPAADYLAHPGAS

SEQ ID NO: 16805 - protein, 22 aa, Mycobacterium avium
LTVGLFLWIAIIWRGIRGKLKG

SEQ ID NO: 16806 - protein, 18 aa, Mycobacterium avium
LTVLIIFTLNILLAEFGA

SEQ ID NO: 16807 - protein, 17 aa, Mycobacterium avium
LVAFGILTVISLLVLGI

SEQ ID NO: 16808 - protein, 19 aa, Mycobacterium avium
LVALGGWLLAGRSLSALTP

SEQ ID NO: 16809 - protein, 18 aa, Mycobacterium avium
LVALGVVFPLYLNTFSAI

SEQ ID NO: 16810 - protein, 17 aa, Mycobacterium avium
LVALPIGVTLSIQFALL

SEQ ID NO: 16811 - protein, 18 aa, Mycobacterium avium
LVALPIGVTLSIQFALLA

SEQ ID NO: 16812 - protein, 17 aa, Mycobacterium avium
LVASRWLLRSDRASRLT

SEQ ID NO: 16813 - protein, 18 aa, Mycobacterium avium
LVAVLVGGVYVLTSQAKT

SEQ ID NO: 16814 - protein, 22 aa, Mycobacterium avium
LVAVMALLLVMRYRGRRRRAAA

SEQ ID NO: 16815 - protein, 20 aa, Mycobacterium avium
LVCSAFLCAYLVTRWIQLPG

SEQ ID NO: 16816 - protein, 18 aa, Mycobacterium avium
LVEDLLLLARLDSGRPLE

SEQ ID NO: 16817 - protein, 17 aa, Mycobacterium avium
LVEPWALHRPFLGWLGW

SEQ ID NO: 16818 - protein, 18 aa, Mycobacterium avium
LVGFECLFAKALKADPLL

SEQ ID NO: 16819 - protein, 36 aa, Mycobacterium avium
LVGGCARIPYTLGIAAFGGRKWTTFSAVVLLIPTVG

SEQ ID NO: 16820 - protein, 29 aa, Mycobacterium avium
LVHHCHREQWPVAGPVLGRLGWFVESTLS

SEQ ID NO: 16821 - protein, 28 aa, Mycobacterium avium
LVIGCVVLAGLLGMCSLQLHGRPGPIPS

SEQ ID NO: 16822 - protein, 22 aa, Mycobacterium avium
LVKRGWMVLVVVVVVGVAGFCV

SEQ ID NO: 16823 - protein, 24 aa, Mycobacterium avium
LVLAGLLLYVCLAVAVTALVTLST

SEQ ID NO: 16824 - protein, 23 aa, Mycobacterium avium
LVLLWRLVRRDSPQPAISGFFGV

SEQ ID NO: 16825 - protein, 24 aa, Mycobacterium avium
LVLNFLIVTAMLRSPVAGLVVVGT

SEQ ID NO: 16826 - protein, 18 aa, Mycobacterium avium
LVMSIAFVALMVWVVIDT

SEQ ID NO: 16827 - protein, 23 aa, Mycobacterium avium
LVNDGRLTTEIERIIAAGEKVTA

SEQ ID NO: 16828 - protein, 23 aa, Mycobacterium avium
LVNRLLLPVITGWSLGRALAGIA

SEQ ID NO: 16829 - protein, 28 aa, Mycobacterium avium
LVPAAPFVAGALKLGLTAPFNIDDVAQV

SEQ ID NO: 16830 - protein, 22 aa, Mycobacterium avium
LVPAGVGSPGFLARLTREAPRL

SEQ ID NO: 16831 - protein, 20 aa, Mycobacterium avium
LVPLTCWIAGLYGTVRGLTL

SEQ ID NO: 16832 - protein, 25 aa, Mycobacterium avium
LVRHCVRRFGGISGDVLGAAIELTA

SEQ ID NO: 16833 - protein, 18 aa, Mycobacterium avium
LVSDATAALAMLRGTPGF

SEQ ID NO: 16834 - protein, 33 aa, Mycobacterium avium
LVSFTVPARGVWWWVGVCMLGVVTLLALVNRLL

SEQ ID NO: 16835 - protein, 33 aa, Mycobacterium avium
LVSFTVPARGVWWWVGVCVLGVVTLLVLVNRLL

SEQ ID NO: 16836 - protein, 17 aa, Mycobacterium avium
LVSLYGTPMWDEMTREQ

SEQ ID NO: 16837 - protein, 20 aa, Mycobacterium avium
LVVHGGLFAATYVLLGLLVM

SEQ ID NO: 16838 - protein, 18 aa, Mycobacterium avium
LVVSEWIRGGSLQEVADT

SEQ ID NO: 16839 - protein, 19 aa, Mycobacterium avium
LVWEVACYLAVAAIGVAGL

SEQ ID NO: 16840 - protein, 17 aa, Mycobacterium avium
LVYVRRPVAAPGVSLPE

SEQ ID NO: 16841 - protein, 21 aa, Mycobacterium avium
LWLETPARLAITVPTVAVPIV

SEQ ID NO: 16842 - protein, 22 aa, Mycobacterium avium
LWRLAIYVVVSVLGMFTLVAVF

SEQ ID NO: 16843 - protein, 18 aa, Mycobacterium avium
LWSLVWEVACYLAVAAIG

SEQ ID NO: 16844 - protein, 26 aa, Mycobacterium avium
LWVAARLPWVVIRSFDGLGPPKAVTL

SEQ ID NO: 16845 - protein, 20 aa, Mycobacterium avium
LWVTRRGRTPRQRWMSRFAL

SEQ ID NO: 16846 - protein, 21 aa, Mycobacterium avium
LYALLWRVGVVEIRHDDRTRA

SEQ ID NO: 16847 - protein, 17 aa, Mycobacterium avium
LYFGFAVLVDSAIGGMA

SEQ ID NO: 16848 - protein, 26 aa, Mycobacterium avium
LYFTTLLRRRLAIIGRHNAVRPQRPD

SEQ ID NO: 16849 - protein, 17 aa, Mycobacterium avium
LYLIWLILYNPAGLLSF

SEQ ID NO: 16850 - protein, 24 aa, Mycobacterium avium
LYLRARVSELPWMIGAVAVGTVCT

SEQ ID NO: 16851 - protein, 17 aa, Mycobacterium avium
LYMGYAFRGFNTHGRAL

SEQ ID NO: 16852 - protein, 21 aa, Mycobacterium avium
LYSLLYYRVLGLLTALSLAAS

SEQ ID NO: 16853 - protein, 21 aa, Mycobacterium avium
LYWAAAVVFGLPLLLIVLTEW

SEQ ID NO: 16854 - protein, 19 aa, Mycobacterium avium
LYWATAVVFGLPLLLIVLT

SEQ ID NO: 16855 - protein, 17 aa, Mycobacterium avium
MAEVYLALHPRLPRRDV

SEQ ID NO: 16856 - protein, 18 aa, Mycobacterium avium
MALGFVLALFVVYSGHVI

SEQ ID NO: 16857 - protein, 18 aa, Mycobacterium avium
MALVPLFVSDVIGRGIGT

SEQ ID NO: 16858 - protein, 17 aa, Mycobacterium avium
MASRIAQIPAVTRVSGI

SEQ ID NO: 16859 - protein, 19 aa, Mycobacterium avium
MCRNGRGFVTAVFAVALLG

SEQ ID NO: 16860 - protein, 23 aa, Mycobacterium avium
MCVVPGFLLTLIVSFFTCDLIIG

SEQ ID NO: 16861 - protein, 18 aa, Mycobacterium avium
MFGAAYRRGLLGGRAALA

SEQ ID NO: 16862 - protein, 23 aa, Mycobacterium avium
MGAGRRFILRMVLAEAAGIGCVG

SEQ ID NO: 16863 - protein, 18 aa, Mycobacterium avium
MGAMLGGIIIGDLLSSGM

SEQ ID NO: 16864 - protein, 19 aa, Mycobacterium avium
MGKPGKRAPTVEICNSDKP

SEQ ID NO: 16865 - protein, 21 aa, Mycobacterium avium
MGPDARQVLVTGPFGGEGTTT

SEQ ID NO: 16866 - protein, 23 aa, Mycobacterium avium
MGTGRRLTLRMVLAEAAGIGCVG

SEQ ID NO: 16867 - protein, 20 aa, Mycobacterium avium
MGVPLEWNVLMIFGVLSLFV

SEQ ID NO: 16868 - protein, 19 aa, Mycobacterium avium
MGVVTVLWVLYGYSVAFGD

SEQ ID NO: 16869 - protein, 22 aa, Mycobacterium avium
MHIFTAPINVVFKRLPNGLGPL

SEQ ID NO: 16870 - protein, 26 aa, Mycobacterium avium
MHSAWESGASWVAWVIGVISVPVDGV

SEQ ID NO: 16871 - protein, 20 aa, Mycobacterium avium
MIGTTIEWYDFYLYATASAL

SEQ ID NO: 16872 - protein, 21 aa, Mycobacterium avium
MIGTTIEWYDFYLYATASALV

SEQ ID NO: 16873 - protein, 17 aa, Mycobacterium avium
MLFVLAERGEAPARLVR

SEQ ID NO: 16874 - protein, 21 aa, Mycobacterium avium
MLHCGLMDWGCVGQMNLGMAL

SEQ ID NO: 16875 - protein, 25 aa, Mycobacterium avium
MLLLGIRTGRLGAWARTAVAAVATW

SEQ ID NO: 16876 - protein, 19 aa, Mycobacterium avium
MLRALGGRRRAVIGDLLAE

SEQ ID NO: 16877 - protein, 21 aa, Mycobacterium avium
MLTTSLFFIFGQFRNGPTHSY

SEQ ID NO: 16878 - protein, 20 aa, Mycobacterium avium
MNFAYGWAFSNPVRKIYYNI

SEQ ID NO: 16879 - protein, 22 aa, Mycobacterium avium
MPARGRLVTMLLIGVVLMAAGY

SEQ ID NO: 16880 - protein, 23 aa, Mycobacterium avium
MPARGRLVTMLLVGVVLMAAGYS

SEQ ID NO: 16881 - protein, 18 aa, Mycobacterium avium
MPEPVLPHEDWVLTRPRL

SEQ ID NO: 16882 - protein, 17 aa, Mycobacterium avium
MPFVVLSIAFGIFATGL

SEQ ID NO: 16883 - protein, 20 aa, Mycobacterium avium
MPLFAARCAATVAVAAASWW

SEQ ID NO: 16884 - protein, 17 aa, Mycobacterium avium
MPPYVITVLFAYVLYHF

SEQ ID NO: 16885 - protein, 28 aa, Mycobacterium avium
MPVLLFCIAFGLSMDYEVFLLSRIREYW

SEQ ID NO: 16886 - protein, 29 aa, Mycobacterium avium
MPVLLFCIAFGLSMDYEVFLLSRIREYWL

SEQ ID NO: 16887 - protein, 44 aa, Mycobacterium avium
MPVLLFCIAFGLSMDYEVFLLSRIREYWLASGAARPARPTPKRA

SEQ ID NO: 16888 - protein, 21 aa, Mycobacterium avium
MQDRLTGFIYAFDDLLVRYRK

SEQ ID NO: 16889 - protein, 23 aa, Mycobacterium avium
MQFICSAIQAGSRLGYQESAELC

SEQ ID NO: 16890 - protein, 22 aa, Mycobacterium avium
MQMVLCGGMVPVTRRVFLDQLS

SEQ ID NO: 16891 - protein, 17 aa, Mycobacterium avium
MQRLRLLQISYGVVVTV

SEQ ID NO: 16892 - protein, 25 aa, Mycobacterium avium
MRMRGHDGWTAYLLPVAIDVLAAAA

SEQ ID NO: 16893 - protein, 18 aa, Mycobacterium avium
MRTRRGGDHMLFEAAPLT

SEQ ID NO: 16894 - protein, 17 aa, Mycobacterium avium
MRYRSGGPFADAVAAVR

SEQ ID NO: 16895 - protein, 21 aa, Mycobacterium avium
MSAFLIGYGVLVFGLAALPSV

SEQ ID NO: 16896 - protein, 20 aa, Mycobacterium avium
MSEAFGEQGSKTMLFVAMQD

SEQ ID NO: 16897 - protein, 23 aa, Mycobacterium avium
MSLLLTVFPGWVAIGLATALAAA

SEQ ID NO: 16898 - protein, 24 aa, Mycobacterium avium
MSLLLTVFPGWVAVGLATALAAAG

SEQ ID NO: 16899 - protein, 20 aa, Mycobacterium avium
MSLNTSYYRLMLKLKGGPQA

SEQ ID NO: 16900 - protein, 24 aa, Mycobacterium avium
MTWTLPVLGAWVIVSTWILPGVVL

SEQ ID NO: 16901 - protein, 17 aa, Mycobacterium avium
MVCGSSALLAPPAAADR

SEQ ID NO: 16902 - protein, 26 aa, Mycobacterium avium
MVFVICVAALLVPRCSCGPSAGCRPA

SEQ ID NO: 16903 - protein, 18 aa, Mycobacterium avium
MVMIKLGVLVVFGILAFT

SEQ ID NO: 16904 - protein, 20 aa, Mycobacterium avium
MVMIKLGVLVVFGILAFTAF

SEQ ID NO: 16905 - protein, 22 aa, Mycobacterium avium
MVSLAELWRSVGVVPDAVIGHS

SEQ ID NO: 16906 - protein, 22 aa, Mycobacterium avium
MVYGGKISFCLYMVHELVHTSW

SEQ ID NO: 16907 - protein, 20 aa, Mycobacterium avium
MWQRGDEIFAEVALPDDAAA

SEQ ID NO: 16908 - protein, 18 aa, Mycobacterium avium
MYGDAAGLSRAVLNLLDN

SEQ ID NO: 16909 - protein, 19 aa, Mycobacterium avium
NAAGLRLAAARADVVPAIT

SEQ ID NO: 16910 - protein, 21 aa, Mycobacterium avium
NAAMCAAVIVALGASTPIHAG

SEQ ID NO: 16911 - protein, 17 aa, Mycobacterium avium
NAAWAQAAEIARLGHVD

SEQ ID NO: 16912 - protein, 23 aa, Mycobacterium avium
NAHEAIEILALLNVAAVIIGTAL

SEQ ID NO: 16913 - protein, 18 aa, Mycobacterium avium
NALAGALLQVFQGQGQTL

SEQ ID NO: 16914 - protein, 18 aa, Mycobacterium avium
NALLTPLVTLGFDEIGQV

SEQ ID NO: 16915 - protein, 23 aa, Mycobacterium avium
NALPGSPPFGSWVDITVVIWVLV

SEQ ID NO: 16916 - protein, 21 aa, Mycobacterium avium
NAWRLALAAEVIFWHTFPIRG

SEQ ID NO: 16917 - protein, 17 aa, Mycobacterium avium
NCSSCHNFTGKGGALSS

SEQ ID NO: 16918 - protein, 17 aa, Mycobacterium avium
NDWVECGEWIRELRPHI

SEQ ID NO: 16919 - protein, 26 aa, Mycobacterium avium
NEEGRPRFEALIAKPGLAQGLKRDLL

SEQ ID NO: 16920 - protein, 21 aa, Mycobacterium avium
NEMRTLGIAMVQDITRPWESR

SEQ ID NO: 16921 - protein, 22 aa, Mycobacterium avium
NEQIMPLLVVAVMSQLVFSGGM

SEQ ID NO: 16922 - protein, 26 aa, Mycobacterium avium
NESGYRLRVKMALAEGQYKISKLDQV

SEQ ID NO: 16923 - protein, 18 aa, Mycobacterium avium
NFPVAFRLSPLALACTAG

SEQ ID NO: 16924 - protein, 22 aa, Mycobacterium avium
NGCVLLAEMLFLRWLLDGRVGR

SEQ ID NO: 16925 - protein, 24 aa, Mycobacterium avium
NGKLPLDSFIAFLVFGTVITAGLM

SEQ ID NO: 16926 - protein, 27 aa, Mycobacterium avium
NGKPWLVFGPYAGWSPKFLKHGHFTDL

SEQ ID NO: 16927 - protein, 19 aa, Mycobacterium avium
NGPTHSYSAVFIDASQLKT

SEQ ID NO: 16928 - protein, 19 aa, Mycobacterium avium
NHSMGWCFLFADGNTSAGG

SEQ ID NO: 16929 - protein, 23 aa, Mycobacterium avium
NIGIEALTGFLAAFINVRIVAPV

SEQ ID NO: 16930 - protein, 22 aa, Mycobacterium avium
NIKAVRTVRFWAAPLVITLALM

SEQ ID NO: 16931 - protein, 17 aa, Mycobacterium avium
NIRLPKLSRTSVILGAL

SEQ ID NO: 16932 - protein, 18 aa, Mycobacterium avium
NIRLPKLSRTSVILGALV

SEQ ID NO: 16933 - protein, 18 aa, Mycobacterium avium
NIRLPKLSRTSVILGSLV

SEQ ID NO: 16934 - protein, 21 aa, Mycobacterium avium
NLANALLVWLAEFALVVVGAL

SEQ ID NO: 16935 - protein, 26 aa, Mycobacterium avium
NLGQTARLYIRPVLNSMPAQSGEPKP

SEQ ID NO: 16936 - protein, 26 aa, Mycobacterium avium
NLLSSFKIPTVWLVLRSDDDLPRGGT

SEQ ID NO: 16937 - protein, 22 aa, Mycobacterium avium
NLPAFLAANGPLLFFVAYQVFF

SEQ ID NO: 16938 - protein, 21 aa, Mycobacterium avium
NLPRVNAHGGPGGRPGCWQKI

SEQ ID NO: 16939 - protein, 25 aa, Mycobacterium avium
NLQEWLEALFPFNPFSPQGWSMHPS

SEQ ID NO: 16940 - protein, 33 aa, Mycobacterium avium
NLRLPKVSARVLVIAALAAVFVFIAAVAGVQLY

SEQ ID NO: 16941 - protein, 26 aa, Mycobacterium avium
NLTLLMPVFRWQRRDNLLAESDPAAT

SEQ ID NO: 16942 - protein, 23 aa, Mycobacterium avium
NMNTEALSGLGLIANPVSAVPVI

SEQ ID NO: 16943 - protein, 25 aa, Mycobacterium avium
NNESPCTVNSFASLIGQKYFDNTKC

SEQ ID NO: 16944 - protein, 26 aa, Mycobacterium avium
NNTESHWKLGLYAAGRASQMRRLRAP

SEQ ID NO: 16945 - protein, 18 aa, Mycobacterium avium
NPATIAWTLLFTTIEVIG

SEQ ID NO: 16946 - protein, 31 aa, Mycobacterium avium
NPFNIAFALGYPMDFGSYFGYLAQMFSFVAA

SEQ ID NO: 16947 - protein, 26 aa, Mycobacterium avium
NPFPHRWAVMFLVAVGFWNFLGAGIF

SEQ ID NO: 16948 - protein, 17 aa, Mycobacterium avium
NPGWAPNPNPLVPVPIP

SEQ ID NO: 16949 - protein, 24 aa, Mycobacterium avium
NPIRSRLRSLLLLLVLGSAAIAAT

SEQ ID NO: 16950 - protein, 24 aa, Mycobacterium avium
NPRQARAALRAGFQSLPGMPIGQL

SEQ ID NO: 16951 - protein, 49 aa, Mycobacterium avium
NPSVLFSWPTLLWVLDFIAGRIFDILVTLKFLLEQPLLYVVGLGMAVTS

SEQ ID NO: 16952 - protein, 18 aa, Mycobacterium avium
NRLRGHTRLHTPTPADPL

SEQ ID NO: 16953 - protein, 29 aa, Mycobacterium avium
NRQILAGPWRWSSGPPIWVAAVAPAQSGV

SEQ ID NO: 16954 - protein, 26 aa, Mycobacterium avium
NRRTWLVRRFRVAAEGIADVEVAPTA

SEQ ID NO: 16955 - protein, 23 aa, Mycobacterium avium
NSAGATVPVRWSVVPQDGGVAGA

SEQ ID NO: 16956 - protein, 17 aa, Mycobacterium avium
NSPWMMSVSSAWTSPSA

SEQ ID NO: 16957 - protein, 19 aa, Mycobacterium avium
NTALRWAQNALSFVGFVPP

SEQ ID NO: 16958 - protein, 31 aa, Mycobacterium avium
NTAPTAFRFLGLHWSLPLGVAILLAAVVGGL

SEQ ID NO: 16959 - protein, 24 aa, Mycobacterium avium
NTVCVSWLPFYHDMGLVQGVIAPI

SEQ ID NO: 16960 - protein, 21 aa, Mycobacterium avium
NTVDTAIRWGGTTLVQPVATA

SEQ ID NO: 16961 - protein, 18 aa, Mycobacterium avium
NTVGWRFALVGWVVTAGV

SEQ ID NO: 16962 - protein, 19 aa, Mycobacterium avium
NTVGWRFALVGWVVTAGVY

SEQ ID NO: 16963 - protein, 26 aa, Mycobacterium avium
NVAGGARLLLPIALGALLGGSAAAGT

SEQ ID NO: 16964 - protein, 17 aa, Mycobacterium avium
NVALPWTLSVITTLPSM

SEQ ID NO: 16965 - protein, 21 aa, Mycobacterium avium
NVSSVALIWFGGLRIDHGQMH

SEQ ID NO: 16966 - protein, 19 aa, Mycobacterium avium
NWFGVCLVPILALIVLQIR

SEQ ID NO: 16967 - protein, 30 aa, Mycobacterium avium
PAALLRVWPFIALGALGWLAAVGAAFLVPG

SEQ ID NO: 16968 - protein, 18 aa, Mycobacterium avium
PAAMPVHRGAISAWAVCD

SEQ ID NO: 16969 - protein, 20 aa, Mycobacterium avium
PAAMRARIGVVSREERLHRR

SEQ ID NO: 16970 - protein, 28 aa, Mycobacterium avium
PADKWPEKWARLSFWCMNIGLAWMVFAT

SEQ ID NO: 16971 - protein, 28 aa, Mycobacterium avium
PAEVGWLRLPVFDWPTDPSWLYRATQGL

SEQ ID NO: 16972 - protein, 17 aa, Mycobacterium avium
PAFHLMTDVLKLFDQLS

SEQ ID NO: 16973 - protein, 19 aa, Mycobacterium avium
PAGLGVLFGLALFQVLLVA

SEQ ID NO: 16974 - protein, 29 aa, Mycobacterium avium
PAHPKKFSWHWWWLMAAVPVAVLLVLLIW

SEQ ID NO: 16975 - protein, 25 aa, Mycobacterium avium
PAHRRRGPGRVIAAVTHRFSPQTRW

SEQ ID NO: 16976 - protein, 18 aa, Mycobacterium avium
PAKPIAVNVIDFGADPDR

SEQ ID NO: 16977 - protein, 21 aa, Mycobacterium avium
PALFAALALWGMFQGALDVAM

SEQ ID NO: 16978 - protein, 21 aa, Mycobacterium avium
PALFAALALWGMFQGTLDVAM

SEQ ID NO: 16979 - protein, 33 aa, Mycobacterium avium
PALGVPLFVVLGCASGLCLREGLIDLGGRRAAT

SEQ ID NO: 16980 - protein, 19 aa, Mycobacterium avium
PALQFQHWHWAALALTAPV

SEQ ID NO: 16981 - protein, 18 aa, Mycobacterium avium
PANPAPMAVQAWSDTGTD

SEQ ID NO: 16982 - protein, 23 aa, Mycobacterium avium
PAPRPAAPTVPWLARVPRPTMAL

SEQ ID NO: 16983 - protein, 40 aa, Mycobacterium avium
PARARRGGKRVARLRAGAVCWLAIAVCCLAAAGLAATGAR

SEQ ID NO: 16984 - protein, 17 aa, Mycobacterium avium
PARGRLVTMLLVGVVLM

SEQ ID NO: 16985 - protein, 18 aa, Mycobacterium avium
PARPGHAHPPAGRNYLPP

SEQ ID NO: 16986 - protein, 19 aa, Mycobacterium avium
PARWSLVAVCVVIVLVAGQ

SEQ ID NO: 16987 - protein, 33 aa, Mycobacterium avium
PATLLLLRYRWLRAEPLPAPRPATVRRLPPPGS

SEQ ID NO: 16988 - protein, 34 aa, Mycobacterium avium
PATLLLLRYRWLRAEPLPAPRPATVRRLPPPGSA

SEQ ID NO: 16989 - protein, 31 aa, Mycobacterium avium
PATLLLLRYRWLRAEPLPAPRTTNVRRLPPP

SEQ ID NO: 16990 - protein, 28 aa, Mycobacterium avium
PAVDPKGALARWNWVLDGMVETKALPAK

SEQ ID NO: 16991 - protein, 17 aa, Mycobacterium avium
PCAAELPAMAEYQRRAG

SEQ ID NO: 16992 - protein, 19 aa, Mycobacterium avium
PCLRAFCDTVLAQDVEPRV

SEQ ID NO: 16993 - protein, 19 aa, Mycobacterium avium
PDADPELRGQPPREPRREP

SEQ ID NO: 16994 - protein, 18 aa, Mycobacterium avium
PDADPELRGQTPREPRRE

SEQ ID NO: 16995 - protein, 17 aa, Mycobacterium avium
PDDRLTTILPPVDDDRA

SEQ ID NO: 16996 - protein, 20 aa, Mycobacterium avium
PDFGGLMVGQPVRFTARIGR

SEQ ID NO: 16997 - protein, 24 aa, Mycobacterium avium
PDFGKASPVGLLIVVLLLISTLFL

SEQ ID NO: 16998 - protein, 17 aa, Mycobacterium avium
PDFLVLRAGRHHVPLAT

SEQ ID NO: 16999 - protein, 19 aa, Mycobacterium avium
PDFLVLRAGRHHVPLATAL

SEQ ID NO: 17000 - protein, 18 aa, Mycobacterium avium
PDFLVLRAGRHHVPLATT

SEQ ID NO: 17001 - protein, 17 aa, Mycobacterium avium
PDFRISLVSPVTVREGC

SEQ ID NO: 17002 - protein, 19 aa, Mycobacterium avium
PDFRISLVSPVTVREGCGY

SEQ ID NO: 17003 - protein, 24 aa, Mycobacterium avium
PDLPEYRTGLIIVGLARCIAMVII

SEQ ID NO: 17004 - protein, 24 aa, Mycobacterium avium
PDLPTELFVKFSRDFDNPVRDRGR

SEQ ID NO: 17005 - protein, 17 aa, Mycobacterium avium
PDLPWRRGRQIAPELAG

SEQ ID NO: 17006 - protein, 17 aa, Mycobacterium avium
PDLSGPVPRGPHRKPAA

SEQ ID NO: 17007 - protein, 21 aa, Mycobacterium avium
PDPNLRPQIVGVFTDLTGPAP

SEQ ID NO: 17008 - protein, 21 aa, Mycobacterium avium
PDPNLRPQIVGVFTDLTGPSP

SEQ ID NO: 17009 - protein, 18 aa, Mycobacterium avium
PDPPDARHAAQPDLADPR

SEQ ID NO: 17010 - protein, 20 aa, Mycobacterium avium
PDPRIDRSRIKMTMEKVDGR

SEQ ID NO: 17011 - protein, 23 aa, Mycobacterium avium
PDTARWYLLKGRVDDARRALLRV

SEQ ID NO: 17012 - protein, 26 aa, Mycobacterium avium
PDVTRRIGLGIGRLVFRALNSVEVVF

SEQ ID NO: 17013 - protein, 22 aa, Mycobacterium avium
PEARAALDAVRFRITGRGPRPR

SEQ ID NO: 17014 - protein, 20 aa, Mycobacterium avium
PEERTQVPVEWDQLRNSITN

SEQ ID NO: 17015 - protein, 21 aa, Mycobacterium avium
PEERTQVPVEWDQLRNSITNI

SEQ ID NO: 17016 - protein, 19 aa, Mycobacterium avium
PEGSWRQRVPGIFLDVTRF

SEQ ID NO: 17017 - protein, 26 aa, Mycobacterium avium
PEKSWRKRLPTIFIDVARLALICVGL

SEQ ID NO: 17018 - protein, 20 aa, Mycobacterium avium
PELFGPLGAGIGGQVLAGSV

SEQ ID NO: 17019 - protein, 31 aa, Mycobacterium avium
PELPRVIPPSFLRRAMPYVLVILIVGMIVAL

SEQ ID NO: 17020 - protein, 33 aa, Mycobacterium avium
PESERATVFERFARGCLLLVYPNVIAVERQLRI

SEQ ID NO: 17021 - protein, 19 aa, Mycobacterium avium
PETVRGLGLLFDAGGQQWR

SEQ ID NO: 17022 - protein, 19 aa, Mycobacterium avium
PEVHSTLLSSGPGPAPLLA

SEQ ID NO: 17023 - protein, 21 aa, Mycobacterium avium
PFAGGVRAWAGPSGVRASFAL

SEQ ID NO: 17024 - protein, 20 aa, Mycobacterium avium
PFCGGLRMTHDLLHGDLWAA

SEQ ID NO: 17025 - protein, 30 aa, Mycobacterium avium
PFLLLFRLTCYYYRGAYYRTVWQSPTACAV

SEQ ID NO: 17026 - protein, 18 aa, Mycobacterium avium
PFQYWSWANLACVVCAIG

SEQ ID NO: 17027 - protein, 19 aa, Mycobacterium avium
PGDLRMRFGGETYDEDGPA

SEQ ID NO: 17028 - protein, 21 aa, Mycobacterium avium
PGDTFVGPRFGLYGRTQPTWR

SEQ ID NO: 17029 - protein, 17 aa, Mycobacterium avium
PGDVVAFQLPNWVEAAV

SEQ ID NO: 17030 - protein, 29 aa, Mycobacterium avium
PGEKAWVMVCVLIAFPMRIAAAIGLLQMR

SEQ ID NO: 17031 - protein, 17 aa, Mycobacterium avium
PGGFPYLVGGMRVSSAA

SEQ ID NO: 17032 - protein, 19 aa, Mycobacterium avium
PGLIDELGTLAWRELDRQS

SEQ ID NO: 17033 - protein, 20 aa, Mycobacterium avium
PGLPLWPYLVCAALTGLGGG

SEQ ID NO: 17034 - protein, 24 aa, Mycobacterium avium
PGLPLWPYLVCAALTGLGGGNYAA

SEQ ID NO: 17035 - protein, 17 aa, Mycobacterium avium
PGMQRLRLLQISYGVVV

SEQ ID NO: 17036 - protein, 22 aa, Mycobacterium avium
PGRLEAIWRGSVVVLQSILAVA

SEQ ID NO: 17037 - protein, 29 aa, Mycobacterium avium
PGRSRWLRLPGRRAIAAGAGILLASASLG

SEQ ID NO: 17038 - protein, 17 aa, Mycobacterium avium
PGSRVIAAAAFALSPRV

SEQ ID NO: 17039 - protein, 18 aa, Mycobacterium avium
PGTATGPAVNFLPNNPPP

SEQ ID NO: 17040 - protein, 18 aa, Mycobacterium avium
PGTLWPGVTAEQLAPWLL

SEQ ID NO: 17041 - protein, 19 aa, Mycobacterium avium
PGYYVCLIVTAFAVAPLSV

SEQ ID NO: 17042 - protein, 21 aa, Mycobacterium avium
PHHPGDTIAVHFRSVDGGERT

SEQ ID NO: 17043 - protein, 18 aa, Mycobacterium avium
PHISRWAAAAVLGAAAVC

SEQ ID NO: 17044 - protein, 22 aa, Mycobacterium avium
PHRANWGVAGWSMGGTCAVDLT

SEQ ID NO: 17045 - protein, 18 aa, Mycobacterium avium
PHRGGARFRLTLPRATTQ

SEQ ID NO: 17046 - protein, 24 aa, Mycobacterium avium
PHVEHALNFWGQRFTSSGVESYDH

SEQ ID NO: 17047 - protein, 25 aa, Mycobacterium avium
PIAVHPRLRVHWVARRDEKSLAAAL

SEQ ID NO: 17048 - protein, 19 aa, Mycobacterium avium
PIAVNGWQQGWLVPAGAPG

SEQ ID NO: 17049 - protein, 24 aa, Mycobacterium avium
PIDRLPARIVVGLLIAIGVAVAVG

SEQ ID NO: 17050 - protein, 18 aa, Mycobacterium avium
PILAMAAIGYVIRKSVRE

SEQ ID NO: 17051 - protein, 33 aa, Mycobacterium avium
PIRSYFYWEKHCFDIPACWSLRSVFDTLDGIDL

SEQ ID NO: 17052 - protein, 34 aa, Mycobacterium avium
PIRSYFYWEKHCYDIPVCWALRSVFNALDGIDQV

SEQ ID NO: 17053 - protein, 21 aa, Mycobacterium avium
PIRTYFYWEKHCYDIPVCIGL

SEQ ID NO: 17054 - protein, 18 aa, Mycobacterium avium
PISVAELLARNGTIGAPA

SEQ ID NO: 17055 - protein, 17 aa, Mycobacterium avium
PITRWELGPELPGRPGC

SEQ ID NO: 17056 - protein, 17 aa, Mycobacterium avium
PIVQVLRTDARNVVITT

SEQ ID NO: 17057 - protein, 30 aa, Mycobacterium avium
PKCLVKEIQKLSGLSINHFIAVDFAGFAKM

SEQ ID NO: 17058 - protein, 19 aa, Mycobacterium avium
PKISVPEPVAAPKPLSLPV

SEQ ID NO: 17059 - protein, 17 aa, Mycobacterium avium
PKIYRHFHDKSDLFQAI

SEQ ID NO: 17060 - protein, 20 aa, Mycobacterium avium
PKLSIDYAIFVIAIIGAAES

SEQ ID NO: 17061 - protein, 17 aa, Mycobacterium avium
PKLVAGFLGLANGVGFL

SEQ ID NO: 17062 - protein, 17 aa, Mycobacterium avium
PKPLADAVAVAWAAQLV

SEQ ID NO: 17063 - protein, 20 aa, Mycobacterium avium
PKPPAPRIEMADMAFVAALK

SEQ ID NO: 17064 - protein, 29 aa, Mycobacterium avium
PKPRRPWRRLRFSQLIIGMSAAVAMTAIG

SEQ ID NO: 17065 - protein, 18 aa, Mycobacterium avium
PKVEAFYWATITFSQTLG

SEQ ID NO: 17066 - protein, 19 aa, Mycobacterium avium
PKVGPWALYGLLFTIVILF

SEQ ID NO: 17067 - protein, 18 aa, Mycobacterium avium
PLAADALPQFGPRQLGPG

SEQ ID NO: 17068 - protein, 20 aa, Mycobacterium avium
PLALPLASLVFLGAFIPLVG

SEQ ID NO: 17069 - protein, 20 aa, Mycobacterium avium
PLESYNKTWLGFVAVAVVAA

SEQ ID NO: 17070 - protein, 17 aa, Mycobacterium avium
PLGRGGVGLSLGQRQRL

SEQ ID NO: 17071 - protein, 28 aa, Mycobacterium avium
PLGVVVGGPFLPLAIILYWFANNIWTFG

SEQ ID NO: 17072 - protein, 18 aa, Mycobacterium avium
PLHGYRFESTPLWAGIYM

SEQ ID NO: 17073 - protein, 32 aa, Mycobacterium avium
PLILRVGAIILHPYIELRLRKSFFAEPELRRW

SEQ ID NO: 17074 - protein, 17 aa, Mycobacterium avium
PLINWFQPVLFYNAGLV

SEQ ID NO: 17075 - protein, 17 aa, Mycobacterium avium
PLIPLVIFADRDFSLCN

SEQ ID NO: 17076 - protein, 22 aa, Mycobacterium avium
PLISVGLAFALARAVVAALGQA

SEQ ID NO: 17077 - protein, 20 aa, Mycobacterium avium
PLLCCLVAFILTFFVTRSFV

SEQ ID NO: 17078 - protein, 17 aa, Mycobacterium avium
PLLGLPMAHPGAVDVVY

SEQ ID NO: 17079 - protein, 18 aa, Mycobacterium avium
PLLQRLSQTAGFVGTMYR

SEQ ID NO: 17080 - protein, 40 aa, Mycobacterium avium
PLNMWAGANTGWWPVLWFTAKMWTFLFIYFWLRASLPRLR

SEQ ID NO: 17081 - protein, 41 aa, Mycobacterium avium
PLNMWAGANTGWWPVLWFTAKMWTFLFIYFWLRASLPRLRY

SEQ ID NO: 17082 - protein, 41 aa, Mycobacterium avium
PLNTWAGANTGWWPVLWFTAKMWTFLFIYFWLRASLPRLRY

SEQ ID NO: 17083 - protein, 17 aa, Mycobacterium avium
PLPEPGPSANGTGRRSS

SEQ ID NO: 17084 - protein, 24 aa, Mycobacterium avium
PLSAGYSHRAFVFLGPGFFPGSPS

SEQ ID NO: 17085 - protein, 22 aa, Mycobacterium avium
PMALVLARGGTRLVRLLRPLIL

SEQ ID NO: 17086 - protein, 24 aa, Mycobacterium avium
PMRPDRYVRMGAAVRRQGMTVTTG

SEQ ID NO: 17087 - protein, 19 aa, Mycobacterium avium
PNPGWAPNPNPLVPVPIPI

SEQ ID NO: 17088 - protein, 31 aa, Mycobacterium avium
PNPNPLVPVPIPIPVPIPGWNPPYNPPYTPP

SEQ ID NO: 17089 - protein, 18 aa, Mycobacterium avium
PNRPVHRRAAPEETEPIE

SEQ ID NO: 17090 - protein, 21 aa, Mycobacterium avium
PNSPGAGSLFWVSDTGVRYGI

SEQ ID NO: 17091 - protein, 25 aa, Mycobacterium avium
PPAFALAGIIAFEFNMGVTRQSSWW

SEQ ID NO: 17092 - protein, 19 aa, Mycobacterium avium
PPAFILKHYFGEFMKHVGV

SEQ ID NO: 17093 - protein, 19 aa, Mycobacterium avium
PPAGAWVDQALVLWVLIAL

SEQ ID NO: 17094 - protein, 17 aa, Mycobacterium avium
PPGHPLPVLPLAFDPPQ

SEQ ID NO: 17095 - protein, 18 aa, Mycobacterium avium
PPGHPLPVLPLAFDPPQH

SEQ ID NO: 17096 - protein, 21 aa, Mycobacterium avium
PPGPPPMWAAPPMPPPPLHGP

SEQ ID NO: 17097 - protein, 17 aa, Mycobacterium avium
PPGTSFYVLLPGRSLPP

SEQ ID NO: 17098 - protein, 25 aa, Mycobacterium avium
PPHRRRGPGRVIAAVTHRFSSQTRW

SEQ ID NO: 17099 - protein, 22 aa, Mycobacterium avium
PPLKFAQLVGLIFAVLGAAGFA

SEQ ID NO: 17100 - protein, 17 aa, Mycobacterium avium
PPLYFPTVFRVDGTIGA

SEQ ID NO: 17101 - protein, 17 aa, Mycobacterium avium
PPPFTSWQPPGVPPVPP

SEQ ID NO: 17102 - protein, 18 aa, Mycobacterium avium
PPPFTSWQPPGVPPVPPQ

SEQ ID NO: 17103 - protein, 22 aa, Mycobacterium avium
PPPGPPPMWAAPPMPPPPLHGP

SEQ ID NO: 17104 - protein, 26 aa, Mycobacterium avium
PPPPDHRARNIAIGFLGTVAAGVLVL

SEQ ID NO: 17105 - protein, 30 aa, Mycobacterium avium
PPPRRQPHRTLVAWISFAAAVLAVGALAGG

SEQ ID NO: 17106 - protein, 26 aa, Mycobacterium avium
PPPSLSRYAWHRVRRIMPAYVITVLF

SEQ ID NO: 17107 - protein, 25 aa, Mycobacterium avium
PPPVRPSRCRWRRRWPSSPASWCRR

SEQ ID NO: 17108 - protein, 17 aa, Mycobacterium avium
PPQGVWHLGPVPIRAYA

SEQ ID NO: 17109 - protein, 18 aa, Mycobacterium avium
PPSLSRYVWHRVRRIMPP

SEQ ID NO: 17110 - protein, 18 aa, Mycobacterium avium
PPTPGIPIAGRPGDAPPD

SEQ ID NO: 17111 - protein, 17 aa, Mycobacterium avium
PPTRPAVLLGNATFELF

SEQ ID NO: 17112 - protein, 23 aa, Mycobacterium avium
PPVTMYLHFPFVTVPIPITPPAP

SEQ ID NO: 17113 - protein, 17 aa, Mycobacterium avium
PPWMVFFSFSLNLIYQF

SEQ ID NO: 17114 - protein, 17 aa, Mycobacterium avium
PPWPDRVPFTAGTKRKP

SEQ ID NO: 17115 - protein, 19 aa, Mycobacterium avium
PQALFVWIALAGMAIAILL

SEQ ID NO: 17116 - protein, 23 aa, Mycobacterium avium
PQDAIRWTALVVLTVIGLGLIFP

SEQ ID NO: 17117 - protein, 20 aa, Mycobacterium avium
PQFVVFDWLFWIFSILIATL

SEQ ID NO: 17118 - protein, 18 aa, Mycobacterium avium
PQPELERLIDEGKFRSDV

SEQ ID NO: 17119 - protein, 23 aa, Mycobacterium avium
PQPNSRGRWRAIREDLSHAVLSL

SEQ ID NO: 17120 - protein, 27 aa, Mycobacterium avium
PQPPRSRTWPAVALAAVAVLLGGAALV

SEQ ID NO: 17121 - protein, 17 aa, Mycobacterium avium
PQRLRGGLTGLFYVVTY

SEQ ID NO: 17122 - protein, 25 aa, Mycobacterium avium
PQSLSRYAWHRVRRIMPPYVITVLF

SEQ ID NO: 17123 - protein, 24 aa, Mycobacterium avium
PRAEPRTAQKFIITGSFLGLFAAM

SEQ ID NO: 17124 - protein, 40 aa, Mycobacterium avium
PRAPDYYKRAELCRERLGPVLRRLTVNYPPLMFHPLNTIT

SEQ ID NO: 17125 - protein, 23 aa, Mycobacterium avium
PRAPRLRSAVGVWVTILDRTRLR

SEQ ID NO: 17126 - protein, 21 aa, Mycobacterium avium
PRFGTDTAFDDAVRGMRTRLL

SEQ ID NO: 17127 - protein, 29 aa, Mycobacterium avium
PRFIRAFAVPIIIGWIALIAVLNVVVPQL

SEQ ID NO: 17128 - protein, 22 aa, Mycobacterium avium
PRHWRMRVIVQKVGNDMKVSNV

SEQ ID NO: 17129 - protein, 17 aa, Mycobacterium avium
PRILLAHLFGRNPLVRV

SEQ ID NO: 17130 - protein, 17 aa, Mycobacterium avium
PRLCCLAFGTGTGALLL

SEQ ID NO: 17131 - protein, 19 aa, Mycobacterium avium
PRLGFGFNEQRRAVLDNHV

SEQ ID NO: 17132 - protein, 33 aa, Mycobacterium avium
PRLGGKLRTSRQFNWGWILALVVIVLALAAIAI

SEQ ID NO: 17133 - protein, 21 aa, Mycobacterium avium
PRLLVAVAALCLGSVAWSPIA

SEQ ID NO: 17134 - protein, 21 aa, Mycobacterium avium
PRLLVAVAALCLGSVAWSPMA

SEQ ID NO: 17135 - protein, 22 aa, Mycobacterium avium
PRMLHFPRSWPYMNISPNLEPA

SEQ ID NO: 17136 - protein, 19 aa, Mycobacterium avium
PRPAPERAPEPAPEPQQPA

SEQ ID NO: 17137 - protein, 17 aa, Mycobacterium avium
PRPATPQRPPAQAAPPS

SEQ ID NO: 17138 - protein, 17 aa, Mycobacterium avium
PRPSIMRRGVGRAFDDI

SEQ ID NO: 17139 - protein, 18 aa, Mycobacterium avium
PRRPRGRLLDPWAIAVLA

SEQ ID NO: 17140 - protein, 19 aa, Mycobacterium avium
PRRRLGVAVTGSRRPSARR

SEQ ID NO: 17141 - protein, 24 aa, Mycobacterium avium
PRRVFPQVVAAPFDPAVGAALAGA

SEQ ID NO: 17142 - protein, 24 aa, Mycobacterium avium
PRTEILGRLGPYRVNSTVNGSDVL

SEQ ID NO: 17143 - protein, 20 aa, Mycobacterium avium
PRTHLVASVLVLIILASCAG

SEQ ID NO: 17144 - protein, 20 aa, Mycobacterium avium
PRTLRLFIVLVIAFALIPVG

SEQ ID NO: 17145 - protein, 17 aa, Mycobacterium avium
PRTSLLVLGDGRTNYRN

SEQ ID NO: 17146 - protein, 21 aa, Mycobacterium avium
PRVDVVLRFTGAHWVAIDLSH

SEQ ID NO: 17147 - protein, 21 aa, Mycobacterium avium
PRVPPYKLLTFITVVVLAVIF

SEQ ID NO: 17148 - protein, 19 aa, Mycobacterium avium
PRYIEYRGGRFPELDVPAV

SEQ ID NO: 17149 - protein, 25 aa, Mycobacterium avium
PSAGRWHAIGLIAFLWLVGIYSVKA

SEQ ID NO: 17150 - protein, 19 aa, Mycobacterium avium
PSAGSARAGRLATIKLWAG

SEQ ID NO: 17151 - protein, 23 aa, Mycobacterium avium
PSARCGDCNRIAMDDLHRSSPPR

SEQ ID NO: 17152 - protein, 21 aa, Mycobacterium avium
PSARFARGAAFAVLGTAFTVR

SEQ ID NO: 17153 - protein, 22 aa, Mycobacterium avium
PSARFARGAAFAVLGTAFTVRA

SEQ ID NO: 17154 - protein, 21 aa, Mycobacterium avium
PSARFARGAAFAVLGTSFTVR

SEQ ID NO: 17155 - protein, 18 aa, Mycobacterium avium
PSHDSGPPTLTWTAIAEQ

SEQ ID NO: 17156 - protein, 24 aa, Mycobacterium avium
PSINISASLTWGGERYRYPTNLPK

SEQ ID NO: 17157 - protein, 25 aa, Mycobacterium avium
PSIPDATKAAARWIRPLAPPLVARM

SEQ ID NO: 17158 - protein, 32 aa, Mycobacterium avium
PSIPDATKAAARWIRPLVPPLVARMMDTTTHR

SEQ ID NO: 17159 - protein, 20 aa, Mycobacterium avium
PSLDLDLLLGGLKPVIQGLN

SEQ ID NO: 17160 - protein, 17 aa, Mycobacterium avium
PSLIGVGEEAVYFQVST

SEQ ID NO: 17161 - protein, 19 aa, Mycobacterium avium
PSLLPRGAIFQGLVSGISG

SEQ ID NO: 17162 - protein, 33 aa, Mycobacterium avium
PSMNRGWCMLRTRWARRVARILPVLGLAGLAAA

SEQ ID NO: 17163 - protein, 22 aa, Mycobacterium avium
PSSTPGHRWAWQTRSWSHGERE

SEQ ID NO: 17164 - protein, 25 aa, Mycobacterium avium
PSVAALMGRWFWWPQQVRTRPASQM

SEQ ID NO: 17165 - protein, 19 aa, Mycobacterium avium
PSYLWKKHFHGCFIEDDFG

SEQ ID NO: 17166 - protein, 17 aa, Mycobacterium avium
PSYPWQPARRPRPWLAI

SEQ ID NO: 17167 - protein, 17 aa, Mycobacterium avium
PTDGHGTIDRWVDVPDR

SEQ ID NO: 17168 - protein, 21 aa, Mycobacterium avium
PTEFFSRFPSALAVGAAAAGV

SEQ ID NO: 17169 - protein, 26 aa, Mycobacterium avium
PTGPGRCPRCGFDVATQGHRRDCEDV

SEQ ID NO: 17170 - protein, 25 aa, Mycobacterium avium
PTKRPAARRRPVVLLRPVPGSSPIH

SEQ ID NO: 17171 - protein, 17 aa, Mycobacterium avium
PTPKLSIDYAIFVIAII

SEQ ID NO: 17172 - protein, 17 aa, Mycobacterium avium
PTSLSARFDRACAQSSL

SEQ ID NO: 17173 - protein, 23 aa, Mycobacterium avium
PTSYIRRTWLVLRMNPQRNVAAV

SEQ ID NO: 17174 - protein, 19 aa, Mycobacterium avium
PTSYWGLKGLIGVNAVAAD

SEQ ID NO: 17175 - protein, 17 aa, Mycobacterium avium
PTVEIRDGLAITIEDPG

SEQ ID NO: 17176 - protein, 17 aa, Mycobacterium avium
PTVEIRDGLAITIEDPR

SEQ ID NO: 17177 - protein, 19 aa, Mycobacterium avium
PTVVIEKLFLPEDSEPRRR

SEQ ID NO: 17178 - protein, 23 aa, Mycobacterium avium
PVAGAGRRRWVWAAAAIGAAAVA

SEQ ID NO: 17179 - protein, 19 aa, Mycobacterium avium
PVELMPTWLHVLSKINPLS

SEQ ID NO: 17180 - protein, 20 aa, Mycobacterium avium
PVEMWIKFVVLNLLWCTMPF

SEQ ID NO: 17181 - protein, 25 aa, Mycobacterium avium
PVGPPPPPPRRGWSGGPGGPGGRGS

SEQ ID NO: 17182 - protein, 18 aa, Mycobacterium avium
PVIGTWLHWALFGGDFPC

SEQ ID NO: 17183 - protein, 18 aa, Mycobacterium avium
PVISMLRALGGRRRAVIG

SEQ ID NO: 17184 - protein, 18 aa, Mycobacterium avium
PVISMLRALGGRRRAVVG

SEQ ID NO: 17185 - protein, 17 aa, Mycobacterium avium
PVLMDWAVGLAFPCQQP

SEQ ID NO: 17186 - protein, 20 aa, Mycobacterium avium
PVMMTIVAVAIRYTPAFDTA

SEQ ID NO: 17187 - protein, 20 aa, Mycobacterium avium
PVMMTVVAVAIRYTPAFDTA

SEQ ID NO: 17188 - protein, 25 aa, Mycobacterium avium
PVPVVVPPVPVPVPVRIPVPDPVSP

SEQ ID NO: 17189 - protein, 27 aa, Mycobacterium avium
PVPVVVPPVPVPVPVRIPVPDPVSPPQ

SEQ ID NO: 17190 - protein, 20 aa, Mycobacterium avium
PVTRWLAAHRDLWLTTVLQA

SEQ ID NO: 17191 - protein, 21 aa, Mycobacterium avium
PVTRWLAAHRDLWLTTVLQAI

SEQ ID NO: 17192 - protein, 19 aa, Mycobacterium avium
PVVDVWTGWADRAGQRPWS

SEQ ID NO: 17193 - protein, 18 aa, Mycobacterium avium
PWLPSLGNPLSFLNPFNI

SEQ ID NO: 17194 - protein, 18 aa, Mycobacterium avium
PWRPGGLAAAEPGPATMS

SEQ ID NO: 17195 - protein, 25 aa, Mycobacterium avium
PWYAILCLPVLFAAGMCLLDTIDGS

SEQ ID NO: 17196 - protein, 27 aa, Mycobacterium avium
PYFQTLGVPCAVGMLVAVFAALTLGPA

SEQ ID NO: 17197 - protein, 17 aa, Mycobacterium avium
QAAEIARLGHVDVQGSF

SEQ ID NO: 17198 - protein, 25 aa, Mycobacterium avium
QAELPGFRPPTAVGHTGELVSMRIG

SEQ ID NO: 17199 - protein, 19 aa, Mycobacterium avium
QAGPLMEILQILKANNIPL

SEQ ID NO: 17200 - protein, 23 aa, Mycobacterium avium
QAICQRYGVAYNRGPLLRQFGTV

SEQ ID NO: 17201 - protein, 21 aa, Mycobacterium avium
QALNVPLPWSKVLSSTKPGIP

SEQ ID NO: 17202 - protein, 18 aa, Mycobacterium avium
QALTEMWWDTQIESPGFV

SEQ ID NO: 17203 - protein, 17 aa, Mycobacterium avium
QAMTCFPSFPRFAGAVF

SEQ ID NO: 17204 - protein, 25 aa, Mycobacterium avium
QAVDAWLGLCQTYGWAPGVMGASTQ

SEQ ID NO: 17205 - protein, 19 aa, Mycobacterium avium
QCAYEWSHHVGMAKDEGIT

SEQ ID NO: 17206 - protein, 20 aa, Mycobacterium avium
QCAYEWSHHVGMAKDEGITD

SEQ ID NO: 17207 - protein, 20 aa, Mycobacterium avium
QCAYEWSHHVSMAKDEGITD

SEQ ID NO: 17208 - protein, 20 aa, Mycobacterium avium
QDIIGFKLHWMVLAMSVILM

SEQ ID NO: 17209 - protein, 19 aa, Mycobacterium avium
QDQWLDWLEKTGFVDFYNR

SEQ ID NO: 17210 - protein, 25 aa, Mycobacterium avium
QDQWLDWLEKTGFVDFYNRYIQPLI

SEQ ID NO: 17211 - protein, 17 aa, Mycobacterium avium
QDYLRSIFRAAAPGAAL

SEQ ID NO: 17212 - protein, 23 aa, Mycobacterium avium
QEAALTWLLLISVPVMALTNYWV

SEQ ID NO: 17213 - protein, 23 aa, Mycobacterium avium
QEAALTWLLLISVPVMAVTNYWV

SEQ ID NO: 17214 - protein, 20 aa, Mycobacterium avium
QELYQARGLMQYGSVLGHGA

SEQ ID NO: 17215 - protein, 21 aa, Mycobacterium avium
QFPPSRLQAYTTPYTAQFHNP

SEQ ID NO: 17216 - protein, 26 aa, Mycobacterium avium
QFTANPWLPGYMSQALALLTRDTGDD

SEQ ID NO: 17217 - protein, 19 aa, Mycobacterium avium
QFVVFDWLFWIFSILIATL

SEQ ID NO: 17218 - protein, 20 aa, Mycobacterium avium
QGGDVVVPWVLSARSAEALT

SEQ ID NO: 17219 - protein, 17 aa, Mycobacterium avium
QGISYVVVRNDLDPDTS

SEQ ID NO: 17220 - protein, 23 aa, Mycobacterium avium
QGSTVQCTWVYDRAVDIDELRSF

SEQ ID NO: 17221 - protein, 17 aa, Mycobacterium avium
QHDKLPPSINFAGPSPY

SEQ ID NO: 17222 - protein, 18 aa, Mycobacterium avium
QHGINWRAVYAGRSRDDM

SEQ ID NO: 17223 - protein, 18 aa, Mycobacterium avium
QHGINWRAVYAGRSRDYM

SEQ ID NO: 17224 - protein, 18 aa, Mycobacterium avium
QHHLLEWLPIKTRNDPLF

SEQ ID NO: 17225 - protein, 18 aa, Mycobacterium avium
QHHRWAAAVTLSLVLAWF

SEQ ID NO: 17226 - protein, 18 aa, Mycobacterium avium
QIMPLLVVSIMSQLVFSS

SEQ ID NO: 17227 - protein, 25 aa, Mycobacterium avium
QIRDLTAFFAWTAWAAAAERPGHKY

SEQ ID NO: 17228 - protein, 20 aa, Mycobacterium avium
QIRYDVRRLADLAGAYTKAA

SEQ ID NO: 17229 - protein, 20 aa, Mycobacterium avium
QIRYDVRRLADLAVAYTKAA

SEQ ID NO: 17230 - protein, 18 aa, Mycobacterium avium
QKARAAGIHLVLATQRPS

SEQ ID NO: 17231 - protein, 20 aa, Mycobacterium avium
QLAADRGADCGYGEPYQTPD

SEQ ID NO: 17232 - protein, 18 aa, Mycobacterium avium
QLAGFAILLAVLALIVGI

SEQ ID NO: 17233 - protein, 28 aa, Mycobacterium avium
QLARVCPRRWPLRGAVGAADRQVVHVAL

SEQ ID NO: 17234 - protein, 24 aa, Mycobacterium avium
QLASALCRHYWPLALLAATMSRHF

SEQ ID NO: 17235 - protein, 22 aa, Mycobacterium avium
QLDSVVCALTLAAVAAALTAGP

SEQ ID NO: 17236 - protein, 24 aa, Mycobacterium avium
QLFDRLSPTLPIVLANLVSVGQVG

SEQ ID NO: 17237 - protein, 19 aa, Mycobacterium avium
QLGQPTAWLVAPIGAPGRA

SEQ ID NO: 17238 - protein, 23 aa, Mycobacterium avium
QLHNRPGPIPPYDAAAALRADAA

SEQ ID NO: 17239 - protein, 17 aa, Mycobacterium avium
QLISTPLDRFLDWCQEA

SEQ ID NO: 17240 - protein, 21 aa, Mycobacterium avium
QLLDRHFPKDVVITEFLVVEN

SEQ ID NO: 17241 - protein, 20 aa, Mycobacterium avium
QLLFSVGVDGFFAISGFLIT

SEQ ID NO: 17242 - protein, 23 aa, Mycobacterium avium
QLLFSVGVDGFFAISGFLITRSW

SEQ ID NO: 17243 - protein, 22 aa, Mycobacterium avium
QLLYLRVPALNALFPDYRGSVL

SEQ ID NO: 17244 - protein, 27 aa, Mycobacterium avium
QLMLFDWPTHILEIFMSQPELLAPALL

SEQ ID NO: 17245 - protein, 24 aa, Mycobacterium avium
QLPNWVEAAVTFWASALLSAVVVP

SEQ ID NO: 17246 - protein, 17 aa, Mycobacterium avium
QLRPGAFPPALDRVIAK

SEQ ID NO: 17247 - protein, 19 aa, Mycobacterium avium
QLRTLAGFGSMFPVAAGAV

SEQ ID NO: 17248 - protein, 17 aa, Mycobacterium avium
QMKRWGHQWMIVTCWMG

SEQ ID NO: 17249 - protein, 18 aa, Mycobacterium avium
QMPWPTGTMGLKSVPLTF

SEQ ID NO: 17250 - protein, 18 aa, Mycobacterium avium
QMTMRVFTGLTLLDTIQG

SEQ ID NO: 17251 - protein, 26 aa, Mycobacterium avium
QNLQEWLEALFPFNPFSPQGWSMHPS

SEQ ID NO: 17252 - protein, 35 aa, Mycobacterium avium
QNSYCTEVGVLPGTDFRLQPKYMDMLNLQEAWQFG

SEQ ID NO: 17253 - protein, 46 aa, Mycobacterium avium
QNSYCTEVGVLPGTDFRLQPKYMDMLNLQEAWQFGRGAGQKVAVID

SEQ ID NO: 17254 - protein, 19 aa, Mycobacterium avium
QPNLRWPVEESTYLLTAHG

SEQ ID NO: 17255 - protein, 23 aa, Mycobacterium avium
QPPGAAFPLVWTTLYADIAATSA

SEQ ID NO: 17256 - protein, 24 aa, Mycobacterium avium
QPPVTMYLHFPFVTVPIPITPPAP

SEQ ID NO: 17257 - protein, 19 aa, Mycobacterium avium
QPRISIGLDQTRFGRSVHS

SEQ ID NO: 17258 - protein, 19 aa, Mycobacterium avium
QPVGFGMSVVRALAHFVDA

SEQ ID NO: 17259 - protein, 18 aa, Mycobacterium avium
QPWRDLRKQLGKQQISPQ

SEQ ID NO: 17260 - protein, 19 aa, Mycobacterium avium
QQHGIDWRAVYAGRSRDYM

SEQ ID NO: 17261 - protein, 17 aa, Mycobacterium avium
QRAAALAPRGVDVEIAW

SEQ ID NO: 17262 - protein, 20 aa, Mycobacterium avium
QRAAAQWSHPEPAALAAVPG

SEQ ID NO: 17263 - protein, 20 aa, Mycobacterium avium
QRAAAQWSHPEPSALATVPG

SEQ ID NO: 17264 - protein, 18 aa, Mycobacterium avium
QRAVPGPGARLVTTMTRH

SEQ ID NO: 17265 - protein, 19 aa, Mycobacterium avium
QRCPDRPGLIDELGTLAWR

SEQ ID NO: 17266 - protein, 26 aa, Mycobacterium avium
QRFWRITMPMLRPTTFFVLVTGIVSS

SEQ ID NO: 17267 - protein, 17 aa, Mycobacterium avium
QRLAIARAVIRRPAIYL

SEQ ID NO: 17268 - protein, 25 aa, Mycobacterium avium
QSAIPRQSLAPGFGGNVLHDLSHAY

SEQ ID NO: 17269 - protein, 27 aa, Mycobacterium avium
QSALRLKGRLLFTPGVMVTSVPWQLSS

SEQ ID NO: 17270 - protein, 17 aa, Mycobacterium avium
QSLAIAWLTLIVAEQIN

SEQ ID NO: 17271 - protein, 20 aa, Mycobacterium avium
QSLLPRLQVGIAEHSFVDTV

SEQ ID NO: 17272 - protein, 37 aa, Mycobacterium avium
QSPEDLKRFGAFGWAVPWIPGTAFGNLVTRDGSTDRV

SEQ ID NO: 17273 - protein, 23 aa, Mycobacterium avium
QTEFNVALPWSKQVSLSKSAVHP

SEQ ID NO: 17274 - protein, 17 aa, Mycobacterium avium
QTFPAWLQPFVRNQPVS

SEQ ID NO: 17275 - protein, 26 aa, Mycobacterium avium
QTGSSFKVFCLIAALEQGIGLGYQVD

SEQ ID NO: 17276 - protein, 26 aa, Mycobacterium avium
QTPRGRYWWVRWVILGVVAIVLAVEV

SEQ ID NO: 17277 - protein, 23 aa, Mycobacterium avium
QTRESVAIARDWRSASRLRDRLG

SEQ ID NO: 17278 - protein, 26 aa, Mycobacterium avium
QTSRGRYWWVRWVILGVVAIVLAVEV

SEQ ID NO: 17279 - protein, 17 aa, Mycobacterium avium
QTVGNRGTWLVRRFRVA

SEQ ID NO: 17280 - protein, 24 aa, Mycobacterium avium
QTYVPLNDGFNWKGDPNATYSGQD

SEQ ID NO: 17281 - protein, 17 aa, Mycobacterium avium
QVRSRRAATPPDAAGAD

SEQ ID NO: 17282 - protein, 17 aa, Mycobacterium avium
QVRTRPASQMLRPYGPR

SEQ ID NO: 17283 - protein, 20 aa, Mycobacterium avium
QWKTIVHIVFPIAMPGIVSG

SEQ ID NO: 17284 - protein, 25 aa, Mycobacterium avium
QWPLFAWFCVYAYRKFVRYEEEPPR

SEQ ID NO: 17285 - protein, 23 aa, Mycobacterium avium
QYLVRCAAFWRQVAPAGAVLARF

SEQ ID NO: 17286 - protein, 17 aa, Mycobacterium avium
RAAALGAELPEAVRAEL

SEQ ID NO: 17287 - protein, 17 aa, Mycobacterium avium
RAAAPRVVVLSRLVPHK

SEQ ID NO: 17288 - protein, 19 aa, Mycobacterium avium
RAAAQWSHPEPSALATVPG

SEQ ID NO: 17289 - protein, 24 aa, Mycobacterium avium
RAAARTVWRAGLRLWVPSLALTAA

SEQ ID NO: 17290 - protein, 19 aa, Mycobacterium avium
RAAGMVLLTAWMPFDNGLR

SEQ ID NO: 17291 - protein, 18 aa, Mycobacterium avium
RAAIRAWIAQAVTWHDPT

SEQ ID NO: 17292 - protein, 18 aa, Mycobacterium avium
RAAMRAWIAQAVTWHDPT

SEQ ID NO: 17293 - protein, 18 aa, Mycobacterium avium
RAAPKLGIDLQGGTRVTL

SEQ ID NO: 17294 - protein, 17 aa, Mycobacterium avium
RAAPTPVQIPRFLRKLL

SEQ ID NO: 17295 - protein, 18 aa, Mycobacterium avium
RAASGRRRYGWLALTTAL

SEQ ID NO: 17296 - protein, 19 aa, Mycobacterium avium
RACRVTLDLPPGARLAVTG

SEQ ID NO: 17297 - protein, 22 aa, Mycobacterium avium
RADFAPALLVLMVLVVATLASV

SEQ ID NO: 17298 - protein, 19 aa, Mycobacterium avium
RADQLRRALEDSGVHNVAV

SEQ ID NO: 17299 - protein, 20 aa, Mycobacterium avium
RAEVRREAEIMWAEHQLTQA

SEQ ID NO: 17300 - protein, 21 aa, Mycobacterium avium
RAGGRYSVYIWALLAMAVARL

SEQ ID NO: 17301 - protein, 17 aa, Mycobacterium avium
RAGLPVATVQMMSDLGA

SEQ ID NO: 17302 - protein, 36 aa, Mycobacterium avium
RAGRLATIKLWAGRCAARWRSIVATALVAGAVGVTV

SEQ ID NO: 17303 - protein, 23 aa, Mycobacterium avium
RAGTVPVVGRFSLGGGLPDQADK

SEQ ID NO: 17304 - protein, 18 aa, Mycobacterium avium
RALAMGWCALYGGAIAVL

SEQ ID NO: 17305 - protein, 18 aa, Mycobacterium avium
RALAPTLRHRDFSGDVID

SEQ ID NO: 17306 - protein, 18 aa, Mycobacterium avium
RALGMVAFMSYFFTLYLR

SEQ ID NO: 17307 - protein, 19 aa, Mycobacterium avium
RALRAGLSVRPMIVTLIGY

SEQ ID NO: 17308 - protein, 17 aa, Mycobacterium avium
RALRASVRVTRVIRGSA

SEQ ID NO: 17309 - protein, 34 aa, Mycobacterium avium
RALTLGSWAVAAGWAFALAMIDGWQRGFAGRLTT

SEQ ID NO: 17310 - protein, 35 aa, Mycobacterium avium
RALTLGSWAVAAGWAFALAMIDGWQRGFAGRLTTR

SEQ ID NO: 17311 - protein, 19 aa, Mycobacterium avium
RANWGVAGWSMGGTCAVDL

SEQ ID NO: 17312 - protein, 30 aa, Mycobacterium avium
RARDVAVRGAAFCLVALTLAAAAGAVRARL

SEQ ID NO: 17313 - protein, 19 aa, Mycobacterium avium
RARKITWGEMEKGRRRYLR

SEQ ID NO: 17314 - protein, 19 aa, Mycobacterium avium
RARRRRRGTATDRAYRYEY

SEQ ID NO: 17315 - protein, 17 aa, Mycobacterium avium
RASDVLLALPGFLTSVW

SEQ ID NO: 17316 - protein, 21 aa, Mycobacterium avium
RASLRELLIPLVPAAVIALAL

SEQ ID NO: 17317 - protein, 17 aa, Mycobacterium avium
RASMQIRRIDPWSTLKV

SEQ ID NO: 17318 - protein, 47 aa, Mycobacterium avium
RASMQIRRIDPWSTLKVSLLLSVALFFVWMIAVAFLYLVLGGMGVWS

SEQ ID NO: 17319 - protein, 17 aa, Mycobacterium avium
RATVGGVRFSAFVIATV

SEQ ID NO: 17320 - protein, 21 aa, Mycobacterium avium
RAVSFVAPWLFSVFVDAFGAV

SEQ ID NO: 17321 - protein, 17 aa, Mycobacterium avium
RAYAFLVPPTIRGVNQS

SEQ ID NO: 17322 - protein, 20 aa, Mycobacterium avium
RCMLGGPPGGLPALDPDAVR

SEQ ID NO: 17323 - protein, 17 aa, Mycobacterium avium
RCTRATVGGVRFSAFVI

SEQ ID NO: 17324 - protein, 22 aa, Mycobacterium avium
RCTRLFRPVFYYLVFWAVMLTV

SEQ ID NO: 17325 - protein, 29 aa, Mycobacterium avium
RDALAARRIDNVMLVSAFLAAAALAQNVG

SEQ ID NO: 17326 - protein, 17 aa, Mycobacterium avium
RDAMAVLDGVLPRGADI

SEQ ID NO: 17327 - protein, 19 aa, Mycobacterium avium
RDIRRGMAGAGLRFESVKG

SEQ ID NO: 17328 - protein, 23 aa, Mycobacterium avium
RDLDLLGGLARRMPATTALFGVA

SEQ ID NO: 17329 - protein, 17 aa, Mycobacterium avium
RDLFGRYVGEDVARRAL

SEQ ID NO: 17330 - protein, 17 aa, Mycobacterium avium
RDLRAAMFEHVITFSER

SEQ ID NO: 17331 - protein, 17 aa, Mycobacterium avium
RDRIPAAVLALVGVMSV

SEQ ID NO: 17332 - protein, 17 aa, Mycobacterium avium
RDTRWWLGGLGDIGSYV

SEQ ID NO: 17333 - protein, 26 aa, Mycobacterium avium
RDYRTERLWSAIGLVPQRGYLFSGTI

SEQ ID NO: 17334 - protein, 19 aa, Mycobacterium avium
REAELRWHAAHSDRPPPPP

SEQ ID NO: 17335 - protein, 19 aa, Mycobacterium avium
REKIPRFIRAFAVPIIIGW

SEQ ID NO: 17336 - protein, 17 aa, Mycobacterium avium
RELARVGGHVILAVRNT

SEQ ID NO: 17337 - protein, 18 aa, Mycobacterium avium
RELSYWTELARTLEAGGF

SEQ ID NO: 17338 - protein, 21 aa, Mycobacterium avium
REPRNIWVMIGVPALIVALIG

SEQ ID NO: 17339 - protein, 31 aa, Mycobacterium avium
RERRKRPWRRYLRRSVLPLLLAASLAVSGFL

SEQ ID NO: 17340 - protein, 22 aa, Mycobacterium avium
RETLVAGGWEWVVLAVTAVVVI

SEQ ID NO: 17341 - protein, 25 aa, Mycobacterium avium
REVLGPWVNRAWLNWVAGLIVGTLL

SEQ ID NO: 17342 - protein, 27 aa, Mycobacterium avium
REVLGYAAGCALAPVLLSLGTMAGAGG

SEQ ID NO: 17343 - protein, 19 aa, Mycobacterium avium
REVLPRDVIEREPEPTPAP

SEQ ID NO: 17344 - protein, 21 aa, Mycobacterium avium
REVLPRLGPAVAASRPANRAA

SEQ ID NO: 17345 - protein, 22 aa, Mycobacterium avium
REVLPRLGPAVAASRPANWAAG

SEQ ID NO: 17346 - protein, 23 aa, Mycobacterium avium
REVLPRLGPAVAASRPANWAAGM

SEQ ID NO: 17347 - protein, 20 aa, Mycobacterium avium
RFASLQTVFHHGRSLLIATS

SEQ ID NO: 17348 - protein, 17 aa, Mycobacterium avium
RFDYGALVLPGLLSALC

SEQ ID NO: 17349 - protein, 18 aa, Mycobacterium avium
RFGFLITALCLFTAVFIM

SEQ ID NO: 17350 - protein, 25 aa, Mycobacterium avium
RFMAEPVLMIGMIYIWMPLAMGKVA

SEQ ID NO: 17351 - protein, 19 aa, Mycobacterium avium
RFQWAEFVRQGAFMAATAV

SEQ ID NO: 17352 - protein, 19 aa, Mycobacterium avium
RFSQGWPAALLFLLVPSIV

SEQ ID NO: 17353 - protein, 22 aa, Mycobacterium avium
RFVPRLRRRDIRAGHFSPMSHP

SEQ ID NO: 17354 - protein, 19 aa, Mycobacterium avium
RGAALASAHAPLFASSTAA

SEQ ID NO: 17355 - protein, 20 aa, Mycobacterium avium
RGAGRLGITTVTGRRASGLA

SEQ ID NO: 17356 - protein, 17 aa, Mycobacterium avium
RGAGVVFGGGRVRRSQH

SEQ ID NO: 17357 - protein, 18 aa, Mycobacterium avium
RGAIAGRPARPGHAHPPA

SEQ ID NO: 17358 - protein, 23 aa, Mycobacterium avium
RGAPRPWIGYALALMLAILLNLN

SEQ ID NO: 17359 - protein, 19 aa, Mycobacterium avium
RGFRVPGYPVTPVLSIMAC

SEQ ID NO: 17360 - protein, 19 aa, Mycobacterium avium
RGFYRYDLDGLRGIAIALV

SEQ ID NO: 17361 - protein, 17 aa, Mycobacterium avium
RGGDGTRALVFAAGAIV

SEQ ID NO: 17362 - protein, 17 aa, Mycobacterium avium
RGGDGTRALVFAAGGIV

SEQ ID NO: 17363 - protein, 19 aa, Mycobacterium avium
RGGTPRFGTDTAFDDAVRG

SEQ ID NO: 17364 - protein, 18 aa, Mycobacterium avium
RGIMIGMALSAIGLCALA

SEQ ID NO: 17365 - protein, 20 aa, Mycobacterium avium
RGIRVGRIRSLRPIPSGVEV

SEQ ID NO: 17366 - protein, 26 aa, Mycobacterium avium
RGKVPVIRLGHLLVFFVRALVAVPLA

SEQ ID NO: 17367 - protein, 18 aa, Mycobacterium avium
RGLGPKFADVLGRGDVDL

SEQ ID NO: 17368 - protein, 17 aa, Mycobacterium avium
RGLKMLMVTILLVIVGI

SEQ ID NO: 17369 - protein, 20 aa, Mycobacterium avium
RGPVGLRRQLRTLAGFGSMF

SEQ ID NO: 17370 - protein, 18 aa, Mycobacterium avium
RGPVIAVAGRFVHTAIHT

SEQ ID NO: 17371 - protein, 18 aa, Mycobacterium avium
RGPYLVGYLRDQLETPLT

SEQ ID NO: 17372 - protein, 18 aa, Mycobacterium avium
RGQLMLLTLILAVVTMAL

SEQ ID NO: 17373 - protein, 19 aa, Mycobacterium avium
RGRHGRGILLTALGYGITV

SEQ ID NO: 17374 - protein, 19 aa, Mycobacterium avium
RGRLVTMLLVGVVLMAAGY

SEQ ID NO: 17375 - protein, 33 aa, Mycobacterium avium
RGRLWRRVGTAVVRWPAPVLAVSAAVVLVGMIA

SEQ ID NO: 17376 - protein, 21 aa, Mycobacterium avium
RGRPLRLAVAVAVLDIFANIT

SEQ ID NO: 17377 - protein, 28 aa, Mycobacterium avium
RGSRPVRRAWSLRRRPRVRRRARVRWRP

SEQ ID NO: 17378 - protein, 27 aa, Mycobacterium avium
RGVLPSVPRWLWIFLGVVGVTAALAGG

SEQ ID NO: 17379 - protein, 24 aa, Mycobacterium avium
RHEAYYRYAALSSIIGLSHLYFGF

SEQ ID NO: 17380 - protein, 17 aa, Mycobacterium avium
RHFPQVVAVISNMAEKK

SEQ ID NO: 17381 - protein, 19 aa, Mycobacterium avium
RHFRRVVLVAAVMDGVVDW

SEQ ID NO: 17382 - protein, 17 aa, Mycobacterium avium
RHGPRLVFQVADPGHSA

SEQ ID NO: 17383 - protein, 18 aa, Mycobacterium avium
RHLRRRRHTTGRRRERRR

SEQ ID NO: 17384 - protein, 21 aa, Mycobacterium avium
RHPHWKRLIGPVLVLVLGTGL

SEQ ID NO: 17385 - protein, 19 aa, Mycobacterium avium
RHPLMLGFVIAFWAAPTMT

SEQ ID NO: 17386 - protein, 31 aa, Mycobacterium avium
RHSRGGGTLINWRSPIAWLSRYRPGTHLANW

SEQ ID NO: 17387 - protein, 25 aa, Mycobacterium avium
RIAATLRRPVLRLGRPAPDELEPVL

SEQ ID NO: 17388 - protein, 19 aa, Mycobacterium avium
RIASRVGTGVGFAKDQVFE

SEQ ID NO: 17389 - protein, 19 aa, Mycobacterium avium
RIEMADMAFIAALKHEGVP

SEQ ID NO: 17390 - protein, 18 aa, Mycobacterium avium
RIGAFAIVEMQKLQHDRT

SEQ ID NO: 17391 - protein, 23 aa, Mycobacterium avium
RIGVKPIMWTGCALLIGASVPAF

SEQ ID NO: 17392 - protein, 18 aa, Mycobacterium avium
RIIALGVLVFLAAAVFGI

SEQ ID NO: 17393 - protein, 27 aa, Mycobacterium avium
RIIHRLSVPIILGWLAVAVLITIGVPS

SEQ ID NO: 17394 - protein, 32 aa, Mycobacterium avium
RIKDEIREGRTFRSAVPRGWTRARKTIVSGNA

SEQ ID NO: 17395 - protein, 34 aa, Mycobacterium avium
RIKDEIREGRTFRSAVPRGWTRARKTIVSGNAVT

SEQ ID NO: 17396 - protein, 19 aa, Mycobacterium avium
RILAAAAIAFAPLSVVVDG

SEQ ID NO: 17397 - protein, 19 aa, Mycobacterium avium
RILILIALGVIALLLAGPR

SEQ ID NO: 17398 - protein, 17 aa, Mycobacterium avium
RILPGFYVCMIVTAFVF

SEQ ID NO: 17399 - protein, 19 aa, Mycobacterium avium
RIPGESGTWVFLLGDMLVF

SEQ ID NO: 17400 - protein, 18 aa, Mycobacterium avium
RITARWIPYGRADLVIGI

SEQ ID NO: 17401 - protein, 17 aa, Mycobacterium avium
RIVPIVFGLLYIVLLVG

SEQ ID NO: 17402 - protein, 18 aa, Mycobacterium avium
RKAGCAARAKFSVAELVR

SEQ ID NO: 17403 - protein, 24 aa, Mycobacterium avium
RKAGCAARAKFSVAELVRPWLDTW

SEQ ID NO: 17404 - protein, 18 aa, Mycobacterium avium
RKAPEPDSAAAAAAAAAR

SEQ ID NO: 17405 - protein, 22 aa, Mycobacterium avium
RKETLRLIAQIGMGTGAMAVIG

SEQ ID NO: 17406 - protein, 20 aa, Mycobacterium avium
RKLMVASLVLNWVIGPALMF

SEQ ID NO: 17407 - protein, 20 aa, Mycobacterium avium
RKRMVEELDMSRSAQEQLDE

SEQ ID NO: 17408 - protein, 22 aa, Mycobacterium avium
RKRRRIKLVRAIAAGILAAVLA

SEQ ID NO: 17409 - protein, 19 aa, Mycobacterium avium
RKSFFAEPELRRWDAAVTS

SEQ ID NO: 17410 - protein, 36 aa, Mycobacterium avium
RKVASTLLESFLFYSGFYLPMYWSSRAKLTNTADMI

SEQ ID NO: 17411 - protein, 18 aa, Mycobacterium avium
RLAAPRAVLGAAIASLAV

SEQ ID NO: 17412 - protein, 19 aa, Mycobacterium avium
RLAAPRAVLGAAIVSLTVG

SEQ ID NO: 17413 - protein, 19 aa, Mycobacterium avium
RLADLAGAYTKAAPDLLDF

SEQ ID NO: 17414 - protein, 20 aa, Mycobacterium avium
RLAGGLVYSAAFVFISLLLC

SEQ ID NO: 17415 - protein, 21 aa, Mycobacterium avium
RLAQLPLRRGVLIGAAQILAL

SEQ ID NO: 17416 - protein, 22 aa, Mycobacterium avium
RLELWRSDMVRMLTYSETDARV

SEQ ID NO: 17417 - protein, 19 aa, Mycobacterium avium
RLETSCYNPVFGANREARV

SEQ ID NO: 17418 - protein, 18 aa, Mycobacterium avium
RLFIGSVVAFMLGSLLCA

SEQ ID NO: 17419 - protein, 18 aa, Mycobacterium avium
RLGAGLAAMFPGLTSVEV

SEQ ID NO: 17420 - protein, 23 aa, Mycobacterium avium
RLGARFGPYELRSLIGTGTVGEV

SEQ ID NO: 17421 - protein, 18 aa, Mycobacterium avium
RLGFGFNEQRRAVLDNHV

SEQ ID NO: 17422 - protein, 17 aa, Mycobacterium avium
RLGVCTVPVSLLVAVLA

SEQ ID NO: 17423 - protein, 23 aa, Mycobacterium avium
RLHARLPSRRLLPALAVLAVAGM

SEQ ID NO: 17424 - protein, 34 aa, Mycobacterium avium
RLKDLLINCGYPLIERFPLMLGTAGAVLAIGLVR

SEQ ID NO: 17425 - protein, 22 aa, Mycobacterium avium
RLKFAAWLVFAGLWATFVYFPV

SEQ ID NO: 17426 - protein, 23 aa, Mycobacterium avium
RLKFAAWLVFAGLWATFVYFPVA

SEQ ID NO: 17427 - protein, 24 aa, Mycobacterium avium
RLLAPLRWALILSGVLQAVITLIQ

SEQ ID NO: 17428 - protein, 24 aa, Mycobacterium avium
RLLAPLRWALILSGVLQAVITVIQ

SEQ ID NO: 17429 - protein, 25 aa, Mycobacterium avium
RLLGACRRAKEQLSTAVAATVAGAP

SEQ ID NO: 17430 - protein, 20 aa, Mycobacterium avium
RLLLEVCWEALERAGIDPAT

SEQ ID NO: 17431 - protein, 19 aa, Mycobacterium avium
RLLVIGSLIGTVAGIAAGA

SEQ ID NO: 17432 - protein, 21 aa, Mycobacterium avium
RLPDLKVFICGGASVSPSLIR

SEQ ID NO: 17433 - protein, 26 aa, Mycobacterium avium
RLQTRAVWRLVNFLLEGVVFLLIGHQ

SEQ ID NO: 17434 - protein, 25 aa, Mycobacterium avium
RLRDFLAARALRILPGYYVCLIVTA

SEQ ID NO: 17435 - protein, 23 aa, Mycobacterium avium
RLREIDGLLPTLVRGRGTEFDSL

SEQ ID NO: 17436 - protein, 18 aa, Mycobacterium avium
RLRHLFFDVITANANGVA

SEQ ID NO: 17437 - protein, 20 aa, Mycobacterium avium
RLRWDPYPFILLNLAFSTQA

SEQ ID NO: 17438 - protein, 19 aa, Mycobacterium avium
RLSASAADVYPALREFIDR

SEQ ID NO: 17439 - protein, 19 aa, Mycobacterium avium
RLTSAWYRLPAPDDGHPLV

SEQ ID NO: 17440 - protein, 19 aa, Mycobacterium avium
RLVLDGPLLPADWTVELNY

SEQ ID NO: 17441 - protein, 19 aa, Mycobacterium avium
RLVLIAAIGTILAVRAGDL

SEQ ID NO: 17442 - protein, 20 aa, Mycobacterium avium
RLVSDAIAALTAVKSELGLP

SEQ ID NO: 17443 - protein, 21 aa, Mycobacterium avium
RLWVPWWWWPPAFALAGIIAF

SEQ ID NO: 17444 - protein, 23 aa, Mycobacterium avium
RMALAFYGPFAFVIGGTQHVIAN

SEQ ID NO: 17445 - protein, 23 aa, Mycobacterium avium
RMARARLGVENAYDRDYDVVPSR

SEQ ID NO: 17446 - protein, 18 aa, Mycobacterium avium
RMATRTTAALGLSLLALW

SEQ ID NO: 17447 - protein, 31 aa, Mycobacterium avium
RMGHARPLYGPGLRFLIPLLDKMIRVDQRLV

SEQ ID NO: 17448 - protein, 31 aa, Mycobacterium avium
RMGHARPLYGPGLRWLIPLVDKMIRVDQRVV

SEQ ID NO: 17449 - protein, 17 aa, Mycobacterium avium
RMLAPIPGKSAVGIEVP

SEQ ID NO: 17450 - protein, 18 aa, Mycobacterium avium
RMLYCLIRSVVALVAAVA

SEQ ID NO: 17451 - protein, 32 aa, Mycobacterium avium
RMPFYRTVTSMVIWCIGGVVFIIASWSVARFA

SEQ ID NO: 17452 - protein, 17 aa, Mycobacterium avium
RMRAEAFDLVLQSGAAQ

SEQ ID NO: 17453 - protein, 19 aa, Mycobacterium avium
RNALLGMGAVAGFAAVDVG

SEQ ID NO: 17454 - protein, 22 aa, Mycobacterium avium
RNAPVLLCRLIDAWVVIMAAAM

SEQ ID NO: 17455 - protein, 19 aa, Mycobacterium avium
RNARTALDIVADIANPRIL

SEQ ID NO: 17456 - protein, 19 aa, Mycobacterium avium
RNFGMVFLAALLVGILTSI

SEQ ID NO: 17457 - protein, 23 aa, Mycobacterium avium
RNIKAVRTVRFWAAPLVITLALM

SEQ ID NO: 17458 - protein, 24 aa, Mycobacterium avium
RNIKAVRTVRFWAAPLVITLALMS

SEQ ID NO: 17459 - protein, 24 aa, Mycobacterium avium
RNKTGWDFGPAQRWTAQATSITCP

SEQ ID NO: 17460 - protein, 18 aa, Mycobacterium avium
RPAADAGAARRARGGPAS

SEQ ID NO: 17461 - protein, 19 aa, Mycobacterium avium
RPAADAGAARRARGGRASA

SEQ ID NO: 17462 - protein, 20 aa, Mycobacterium avium
RPAEEAVQFLAEVAVARRGE

SEQ ID NO: 17463 - protein, 22 aa, Mycobacterium avium
RPAEPRPAPPQRPPTQAAPPSG

SEQ ID NO: 17464 - protein, 19 aa, Mycobacterium avium
RPAGLATLTRDGSSEGPGV

SEQ ID NO: 17465 - protein, 22 aa, Mycobacterium avium
RPAKRPPPETITFWNTWENSRG

SEQ ID NO: 17466 - protein, 27 aa, Mycobacterium avium
RPALGDSRSGPGWLLFQWRWSIVALWF

SEQ ID NO: 17467 - protein, 24 aa, Mycobacterium avium
RPAPRPAAPTVPWLARVPRPTMAL

SEQ ID NO: 17468 - protein, 24 aa, Mycobacterium avium
RPASLPAPHWTFWRIFAYGKVTPS

SEQ ID NO: 17469 - protein, 20 aa, Mycobacterium avium
RPASQMLRPYGPRPAVRTLL

SEQ ID NO: 17470 - protein, 20 aa, Mycobacterium avium
RPATHLETFAAASPITHVNP

SEQ ID NO: 17471 - protein, 22 aa, Mycobacterium avium
RPAVAAPGRIVLLTSGTTGKPK

SEQ ID NO: 17472 - protein, 20 aa, Mycobacterium avium
RPDPPDARHADPHDLADPRV

SEQ ID NO: 17473 - protein, 18 aa, Mycobacterium avium
RPGLVLGLLVIAILVAWR

SEQ ID NO: 17474 - protein, 18 aa, Mycobacterium avium
RPHVSAWVRYHTEKRLRR

SEQ ID NO: 17475 - protein, 20 aa, Mycobacterium avium
RPILLRLGVLLVLLCAQAAV

SEQ ID NO: 17476 - protein, 19 aa, Mycobacterium avium
RPILLRLGVLLVLLCAQAT

SEQ ID NO: 17477 - protein, 19 aa, Mycobacterium avium
RPILLRLGVLLVLLCTQAA

SEQ ID NO: 17478 - protein, 19 aa, Mycobacterium avium
RPKGVLWRQSDIYVSSMVG

SEQ ID NO: 17479 - protein, 19 aa, Mycobacterium avium
RPMPGTSLVEGRVALSVPN

SEQ ID NO: 17480 - protein, 25 aa, Mycobacterium avium
RPNRLWWRYTGWWLVALVLATLWWV

SEQ ID NO: 17481 - protein, 19 aa, Mycobacterium avium
RPPERANRARLVKGPEVTD

SEQ ID NO: 17482 - protein, 20 aa, Mycobacterium avium
RPPRPGHAHPPAGRNYLPPL

SEQ ID NO: 17483 - protein, 17 aa, Mycobacterium avium
RPPSYPWQPARRPRPWL

SEQ ID NO: 17484 - protein, 20 aa, Mycobacterium avium
RPQQPAPLRRERPRYQEPPG

SEQ ID NO: 17485 - protein, 18 aa, Mycobacterium avium
RPRRSPYERPVPRSSRFD

SEQ ID NO: 17486 - protein, 19 aa, Mycobacterium avium
RPRRSPYERPVPRSSRFDG

SEQ ID NO: 17487 - protein, 19 aa, Mycobacterium avium
RPRSVQLLLTPLILAPFAA

SEQ ID NO: 17488 - protein, 19 aa, Mycobacterium avium
RPRTLPNALAPVVAGTGAA

SEQ ID NO: 17489 - protein, 20 aa, Mycobacterium avium
RPRTLPNALAPVVAGTGAAA

SEQ ID NO: 17490 - protein, 19 aa, Mycobacterium avium
RPSARRLAGLGWVAAGAGC

SEQ ID NO: 17491 - protein, 25 aa, Mycobacterium avium
RPSARRLPFILARYPRTFAGIGRRI

SEQ ID NO: 17492 - protein, 20 aa, Mycobacterium avium
RPVDDLVMFVCLAVAAICAA

SEQ ID NO: 17493 - protein, 18 aa, Mycobacterium avium
RPVGPRWAPTARLGSMYG

SEQ ID NO: 17494 - protein, 25 aa, Mycobacterium avium
RQAGRRRPGLSWISIQSKVMVMLLV

SEQ ID NO: 17495 - protein, 22 aa, Mycobacterium avium
RQETWLMILFGVGFGLGVALTL

SEQ ID NO: 17496 - protein, 24 aa, Mycobacterium avium
RQHVDLRPLWGIDQRLKRFGTLAA

SEQ ID NO: 17497 - protein, 24 aa, Mycobacterium avium
RQHVDLRPLWGIDQRLKRFGTMAA

SEQ ID NO: 17498 - protein, 25 aa, Mycobacterium avium
RQHVDLRPLWGIDQRLKRFGTMAAA

SEQ ID NO: 17499 - protein, 29 aa, Mycobacterium avium
RQMRLIVSDRGYFVFLALLPFIMGSLSMS

SEQ ID NO: 17500 - protein, 17 aa, Mycobacterium avium
RQRTAMVAAERLEQMLA

SEQ ID NO: 17501 - protein, 17 aa, Mycobacterium avium
RQRTWLSGLALLVALVV

SEQ ID NO: 17502 - protein, 23 aa, Mycobacterium avium
RQSSWWPYAALFAVAAAALLWLG

SEQ ID NO: 17503 - protein, 28 aa, Mycobacterium avium
RQVRLVVADRAYFLFLAVLPFVMGALSL

SEQ ID NO: 17504 - protein, 22 aa, Mycobacterium avium
RRAKQARTRRILLIAAGSIVAV

SEQ ID NO: 17505 - protein, 18 aa, Mycobacterium avium
RRAPGNAGKPAIRSGDQR

SEQ ID NO: 17506 - protein, 19 aa, Mycobacterium avium
RRATVFVVVLGFLIQITGI

SEQ ID NO: 17507 - protein, 24 aa, Mycobacterium avium
RRDFSEPTALNWARHGTDVDFGAL

SEQ ID NO: 17508 - protein, 20 aa, Mycobacterium avium
RRDMGVGELLGMVQAGLSHT

SEQ ID NO: 17509 - protein, 20 aa, Mycobacterium avium
RRFDTKTAIAISARKYAFRK

SEQ ID NO: 17510 - protein, 25 aa, Mycobacterium avium
RRFLQSAGLRRARHLRNHIIVVGQG

SEQ ID NO: 17511 - protein, 19 aa, Mycobacterium avium
RRGALLFGKLLPVGIGVVV

SEQ ID NO: 17512 - protein, 19 aa, Mycobacterium avium
RRGGDHMLFEAAPLTAAQH

SEQ ID NO: 17513 - protein, 17 aa, Mycobacterium avium
RRHRQLRAALTPLVQER

SEQ ID NO: 17514 - protein, 21 aa, Mycobacterium avium
RRIAGELGIGEVISGALPADK

SEQ ID NO: 17515 - protein, 22 aa, Mycobacterium avium
RRIMPAYVITVLFAYVLYHFRE

SEQ ID NO: 17516 - protein, 21 aa, Mycobacterium avium
RRLAAVPTPRPAATQTAASPA

SEQ ID NO: 17517 - protein, 25 aa, Mycobacterium avium
RRLVVPRFLGLLLITPSLVVIVIAM

SEQ ID NO: 17518 - protein, 19 aa, Mycobacterium avium
RRLWFRTDLSYGMYIYAYP

SEQ ID NO: 17519 - protein, 20 aa, Mycobacterium avium
RRMTPAVAILAAVSFASFLC

SEQ ID NO: 17520 - protein, 22 aa, Mycobacterium avium
RRPAYWLSMLIVLGFQVPVDGW

SEQ ID NO: 17521 - protein, 32 aa, Mycobacterium avium
RRPESTQSKFWNRWIGWVMRRPWMSALAASLV

SEQ ID NO: 17522 - protein, 33 aa, Mycobacterium avium
RRPESTQSKFWNRWIGWVMRRPWMSALAASLVL

SEQ ID NO: 17523 - protein, 21 aa, Mycobacterium avium
RRPLLGTGFCGGLTTFSTMQV

SEQ ID NO: 17524 - protein, 17 aa, Mycobacterium avium
RRPLPPVAAMVKLLAAS

SEQ ID NO: 17525 - protein, 20 aa, Mycobacterium avium
RRPSARRLAGLGWVAAGAGC

SEQ ID NO: 17526 - protein, 23 aa, Mycobacterium avium
RRPSFLRPPLAPNYGRVARAVHS

SEQ ID NO: 17527 - protein, 24 aa, Mycobacterium avium
RRPTRRLKPRPAPAAPVAEEHDSV

SEQ ID NO: 17528 - protein, 21 aa, Mycobacterium avium
RRPTTVPEMREWLRNWVGRAV

SEQ ID NO: 17529 - protein, 30 aa, Mycobacterium avium
RRQMRLIVSDRGYFVFLALLPFIMGSLSMS

SEQ ID NO: 17530 - protein, 20 aa, Mycobacterium avium
RRRHRAAAKQLGRGYEYLDP

SEQ ID NO: 17531 - protein, 18 aa, Mycobacterium avium
RRRIAVVGLFLVSGAVIL

SEQ ID NO: 17532 - protein, 21 aa, Mycobacterium avium
RRRLAPPVTRKGTIAIEAPPE

SEQ ID NO: 17533 - protein, 24 aa, Mycobacterium avium
RRRLSRAATVLAVGAVMVAALAGL

SEQ ID NO: 17534 - protein, 20 aa, Mycobacterium avium
RRRRFTLTRRNALLGMGAVA

SEQ ID NO: 17535 - protein, 18 aa, Mycobacterium avium
RRRRGRVATWVASAAAAA

SEQ ID NO: 17536 - protein, 19 aa, Mycobacterium avium
RRRRGRVATWVASAAAAAV

SEQ ID NO: 17537 - protein, 17 aa, Mycobacterium avium
RRRRHTTGRRRERRRPG

SEQ ID NO: 17538 - protein, 27 aa, Mycobacterium avium
RRRRRALRWGLIFTAGCAFWAVLTIML

SEQ ID NO: 17539 - protein, 25 aa, Mycobacterium avium
RRRVAHDFTLIPAFIEEILRVDGPV

SEQ ID NO: 17540 - protein, 27 aa, Mycobacterium avium
RRTAMALTRWRVRMEVEPGRRQNLAVV

SEQ ID NO: 17541 - protein, 44 aa, Mycobacterium avium
RRTGLSGVLRGGRSRFGFGTLAVLLCLLLGIAIVTQVRQTESGD

SEQ ID NO: 17542 - protein, 17 aa, Mycobacterium avium
RRTKRLAGKAWAVAAMV

SEQ ID NO: 17543 - protein, 20 aa, Mycobacterium avium
RRVTPAVAILAAVSFASFLC

SEQ ID NO: 17544 - protein, 27 aa, Mycobacterium avium
RRVVLNFWAYWCAPCAAELPAMAEYQR

SEQ ID NO: 17545 - protein, 20 aa, Mycobacterium avium
RRVYLAGIACYGLAAFPAFA

SEQ ID NO: 17546 - protein, 25 aa, Mycobacterium avium
RRWRPLPAPVWVSATAVLLVATTML

SEQ ID NO: 17547 - protein, 18 aa, Mycobacterium avium
RSAAALSARATAVVREAR

SEQ ID NO: 17548 - protein, 20 aa, Mycobacterium avium
RSAGYPSVFAQGMFSAALLA

SEQ ID NO: 17549 - protein, 20 aa, Mycobacterium avium
RSAMRAWVAQAVTWHDPTVL

SEQ ID NO: 17550 - protein, 17 aa, Mycobacterium avium
RSARALWAGCVVPLANL

SEQ ID NO: 17551 - protein, 23 aa, Mycobacterium avium
RSFMPDLPLPYAFPPPPGSAAPT

SEQ ID NO: 17552 - protein, 29 aa, Mycobacterium avium
RSFQLVRRGFWRVLGIRALAFLVTAVVAN

SEQ ID NO: 17553 - protein, 27 aa, Mycobacterium avium
RSGPPRGRRRALPILLRTGAAALGSTV

SEQ ID NO: 17554 - protein, 19 aa, Mycobacterium avium
RSGSGLGLALVAQQAELHG

SEQ ID NO: 17555 - protein, 19 aa, Mycobacterium avium
RSGVGAVLLQAVSSQDISL

SEQ ID NO: 17556 - protein, 22 aa, Mycobacterium avium
RSGVPARVGWLLAGGYGTAALL

SEQ ID NO: 17557 - protein, 18 aa, Mycobacterium avium
RSGWAAVVGAGLFLGFTA

SEQ ID NO: 17558 - protein, 21 aa, Mycobacterium avium
RSLHFLGLVAFVVFIVIHLSM

SEQ ID NO: 17559 - protein, 17 aa, Mycobacterium avium
RSLRRARSVRRPRSLRR

SEQ ID NO: 17560 - protein, 23 aa, Mycobacterium avium
RSPRNGMALSIAALVPIGAALAL

SEQ ID NO: 17561 - protein, 19 aa, Mycobacterium avium
RSPSGLTQWSVVIDAPPSS

SEQ ID NO: 17562 - protein, 19 aa, Mycobacterium avium
RSRRRRRATRHGHGEEFMD

SEQ ID NO: 17563 - protein, 23 aa, Mycobacterium avium
RSSKFVMRRWAPVGLIVVGLLLL

SEQ ID NO: 17564 - protein, 20 aa, Mycobacterium avium
RSTASWTPVHLALLCVGATF

SEQ ID NO: 17565 - protein, 18 aa, Mycobacterium avium
RSVLRRLLGRMHSAWESG

SEQ ID NO: 17566 - protein, 20 aa, Mycobacterium avium
RSYVPPDINSLLAATNRGLT

SEQ ID NO: 17567 - protein, 18 aa, Mycobacterium avium
RTAFTLAAGLLFGPLLGV

SEQ ID NO: 17568 - protein, 19 aa, Mycobacterium avium
RTAGELGIGEVISGALPAD

SEQ ID NO: 17569 - protein, 24 aa, Mycobacterium avium
RTDDLRPIPVFGSDELARLTESFN

SEQ ID NO: 17570 - protein, 22 aa, Mycobacterium avium
RTDGVVLHWVTDYWNHFSLMVQ

SEQ ID NO: 17571 - protein, 21 aa, Mycobacterium avium
RTEFLRLLSNIAWGNGSIVVG

SEQ ID NO: 17572 - protein, 22 aa, Mycobacterium avium
RTLPEFWRLLGHIDAVHGAYYL

SEQ ID NO: 17573 - protein, 28 aa, Mycobacterium avium
RTLVIPALFTLVGDRIWWPNNPARHERS

SEQ ID NO: 17574 - protein, 17 aa, Mycobacterium avium
RTQPTWRNWPAKRAGTA

SEQ ID NO: 17575 - protein, 25 aa, Mycobacterium avium
RTVEYCVVDLFTGRFQWAEFVRQGA

SEQ ID NO: 17576 - protein, 18 aa, Mycobacterium avium
RTVLWRFGISSAVAVGVL

SEQ ID NO: 17577 - protein, 18 aa, Mycobacterium avium
RTVLWRFGISSVVAVGVL

SEQ ID NO: 17578 - protein, 23 aa, Mycobacterium avium
RTVVACGLAALFLASSLYSTATF

SEQ ID NO: 17579 - protein, 20 aa, Mycobacterium avium
RTYWLLPCLFWLSTTTQIFT

SEQ ID NO: 17580 - protein, 21 aa, Mycobacterium avium
RVAAMLGGWLAVLAGAWFVVG

SEQ ID NO: 17581 - protein, 20 aa, Mycobacterium avium
RVAAVLACRRTVPAAAGSSL

SEQ ID NO: 17582 - protein, 18 aa, Mycobacterium avium
RVDGELILFWTLPVALVL

SEQ ID NO: 17583 - protein, 19 aa, Mycobacterium avium
RVEALRHNKIEPALHDGDW

SEQ ID NO: 17584 - protein, 20 aa, Mycobacterium avium
RVGALSSRVGAFAIVEIQKL

SEQ ID NO: 17585 - protein, 20 aa, Mycobacterium avium
RVGALSSRVGAFAIVEMQKL

SEQ ID NO: 17586 - protein, 21 aa, Mycobacterium avium
RVIALAGVVGFLVNSVPESWA

SEQ ID NO: 17587 - protein, 20 aa, Mycobacterium avium
RVILYILKERYFASEEFLAH

SEQ ID NO: 17588 - protein, 24 aa, Mycobacterium avium
RVITRRLAIALVVLFAAAVIVYAD

SEQ ID NO: 17589 - protein, 22 aa, Mycobacterium avium
RVLCAITHGLLWSVIAPIATRL

SEQ ID NO: 17590 - protein, 29 aa, Mycobacterium avium
RVLRLRLAAWDVVCTVALLVLLALLATAT

SEQ ID NO: 17591 - protein, 20 aa, Mycobacterium avium
RVSLVPTLLVSIPFTVLVAF

SEQ ID NO: 17592 - protein, 23 aa, Mycobacterium avium
RVVALRSRLLVRLSGRGGMVSLA

SEQ ID NO: 17593 - protein, 26 aa, Mycobacterium avium
RVVGRGRPADRPALLGAVKTNVGHLE

SEQ ID NO: 17594 - protein, 19 aa, Mycobacterium avium
RVVKRQGQESFNFGEFFAY

SEQ ID NO: 17595 - protein, 17 aa, Mycobacterium avium
RVWATVMTVLIGVLTTV

SEQ ID NO: 17596 - protein, 21 aa, Mycobacterium avium
RWFGYLNAWYALLALPGGAVM

SEQ ID NO: 17597 - protein, 21 aa, Mycobacterium avium
RWGHWLGCATAVAAFVVGVGL

SEQ ID NO: 17598 - protein, 21 aa, Mycobacterium avium
RWLAEFEPMHQVFLGTRSLLY

SEQ ID NO: 17599 - protein, 18 aa, Mycobacterium avium
RWLWLVKWCVLAVPHYPI

SEQ ID NO: 17600 - protein, 21 aa, Mycobacterium avium
RWMLGLACVPAVLLLPLVFRM

SEQ ID NO: 17601 - protein, 17 aa, Mycobacterium avium
RYAGVVFPVIGWWLYDI

SEQ ID NO: 17602 - protein, 23 aa, Mycobacterium avium
RYKAETLRLIATMSLGVGALAVI

SEQ ID NO: 17603 - protein, 19 aa, Mycobacterium avium
RYLEEMERLLSPAVLIAFD

SEQ ID NO: 17604 - protein, 21 aa, Mycobacterium avium
RYPNVKLLWSGDWSTFSGPDF

SEQ ID NO: 17605 - protein, 20 aa, Mycobacterium avium
RYPRTFAGIGRRIARLRSET

SEQ ID NO: 17606 - protein, 18 aa, Mycobacterium avium
RYRLLVFHGGAPPLQFWQ

SEQ ID NO: 17607 - protein, 19 aa, Mycobacterium avium
RYRLLVFHGGAPPLQFWQA

SEQ ID NO: 17608 - protein, 24 aa, Mycobacterium avium
RYRLLVFHGGAPPLQFWQALDTAL

SEQ ID NO: 17609 - protein, 17 aa, Mycobacterium avium
RYRSWLPALKEMVPSLG

SEQ ID NO: 17610 - protein, 18 aa, Mycobacterium avium
RYRSWLPALKEMVPSLGV

SEQ ID NO: 17611 - protein, 19 aa, Mycobacterium avium
RYVLVPALVGLVLIAAFIL

SEQ ID NO: 17612 - protein, 35 aa, Mycobacterium avium
SAALTIGVVWLARRLEARLGPWNARLLSAAAYLVA

SEQ ID NO: 17613 - protein, 24 aa, Mycobacterium avium
SAAPARPKLADWVTLAITVAAGAI

SEQ ID NO: 17614 - protein, 26 aa, Mycobacterium avium
SADGHVVAGSWSFRLTVPGTGTPGPA

SEQ ID NO: 17615 - protein, 17 aa, Mycobacterium avium
SADSASPDQGWALSAAD

SEQ ID NO: 17616 - protein, 20 aa, Mycobacterium avium
SADSVQAWAAHLATITSELR

SEQ ID NO: 17617 - protein, 23 aa, Mycobacterium avium
SAELCAQYLAPILDAIKFNYPPF

SEQ ID NO: 17618 - protein, 18 aa, Mycobacterium avium
SAFGLRMALVPLFISDVM

SEQ ID NO: 17619 - protein, 18 aa, Mycobacterium avium
SAFGLRMALVPLFVSDVI

SEQ ID NO: 17620 - protein, 18 aa, Mycobacterium avium
SAFGLRMALVPLFVSDVM

SEQ ID NO: 17621 - protein, 19 aa, Mycobacterium avium
SAFLIGYGVLVFGLAALPS

SEQ ID NO: 17622 - protein, 28 aa, Mycobacterium avium
SAFYGLDLAKLLPFNLARTWHVQLSLFW

SEQ ID NO: 17623 - protein, 23 aa, Mycobacterium avium
SAGRLRFTTDYDMAASFADVHFL

SEQ ID NO: 17624 - protein, 23 aa, Mycobacterium avium
SAGRWHAIGLIAFLWLVGIYSVK

SEQ ID NO: 17625 - protein, 24 aa, Mycobacterium avium
SAGRWHAIGLIAFLWLVGIYSVKA

SEQ ID NO: 17626 - protein, 20 aa, Mycobacterium avium
SALCFVGAGVLLYVDIDRRR

SEQ ID NO: 17627 - protein, 21 aa, Mycobacterium avium
SALCFVGAGVLLYVDIDRRRG

SEQ ID NO: 17628 - protein, 33 aa, Mycobacterium avium
SALTCWAVTAGGIWWPIGRELAWCCVGLLAIAG

SEQ ID NO: 17629 - protein, 19 aa, Mycobacterium avium
SAPPYLACTHVHTGDLRGS

SEQ ID NO: 17630 - protein, 23 aa, Mycobacterium avium
SASEAGRLLRRWRRDPIVAVQAL

SEQ ID NO: 17631 - protein, 20 aa, Mycobacterium avium
SAVAAIFVIGVVALVVSLAI

SEQ ID NO: 17632 - protein, 17 aa, Mycobacterium avium
SAVPIVAEHKVFFCVAA

SEQ ID NO: 17633 - protein, 22 aa, Mycobacterium avium
SAVSRTRWLASHLVIALAGSGV

SEQ ID NO: 17634 - protein, 20 aa, Mycobacterium avium
SAYPRPLPEPGPSANGTGRR

SEQ ID NO: 17635 - protein, 24 aa, Mycobacterium avium
SCAAEGDWAAAIRHRLRAVARQLE

SEQ ID NO: 17636 - protein, 18 aa, Mycobacterium avium
SDADGVWHVHVVDPPSDE

SEQ ID NO: 17637 - protein, 17 aa, Mycobacterium avium
SDFLLPGILAVTAVCST

SEQ ID NO: 17638 - protein, 19 aa, Mycobacterium avium
SDFRPELAALDEVFCQALA

SEQ ID NO: 17639 - protein, 18 aa, Mycobacterium avium
SDLGDYDALLAVATTDRA

SEQ ID NO: 17640 - protein, 26 aa, Mycobacterium avium
SDLPGELMGALSQGLSQFGINLPPVP

SEQ ID NO: 17641 - protein, 23 aa, Mycobacterium avium
SDNEILGLCFMFVLAGLDTVTSA

SEQ ID NO: 17642 - protein, 34 aa, Mycobacterium avium
SDPRNWAGVTSLSIPSWWQPYVLSVASLTPDGQP

SEQ ID NO: 17643 - protein, 24 aa, Mycobacterium avium
SDRREFAGALAFVAGFSVLVRPEL

SEQ ID NO: 17644 - protein, 21 aa, Mycobacterium avium
SDVLLALPGFLTSVWIVTAYG

SEQ ID NO: 17645 - protein, 23 aa, Mycobacterium avium
SEAARPAGLATLTRDGLSEGPGV

SEQ ID NO: 17646 - protein, 20 aa, Mycobacterium avium
SEAELLDWIHGAADANQPVI

SEQ ID NO: 17647 - protein, 23 aa, Mycobacterium avium
SEALFKACFYAVIAALAVAPLAL

SEQ ID NO: 17648 - protein, 17 aa, Mycobacterium avium
SEIGAWIERRARVRVDP

SEQ ID NO: 17649 - protein, 21 aa, Mycobacterium avium
SELHPDSAVVLVFINQTATSK

SEQ ID NO: 17650 - protein, 31 aa, Mycobacterium avium
SEPAATICAGWGDARSVAFLTGAAVPVPPGR

SEQ ID NO: 17651 - protein, 24 aa, Mycobacterium avium
SEPEPRWPKSPPQPKRAPGPERSA

SEQ ID NO: 17652 - protein, 24 aa, Mycobacterium avium
SERESGVLTRLWVQPVHRASPVAG

SEQ ID NO: 17653 - protein, 26 aa, Mycobacterium avium
SERSRQGWKIQRWRSRVRNHTIVIGY

SEQ ID NO: 17654 - protein, 18 aa, Mycobacterium avium
SFAGPRLPAGARMVLQAG

SEQ ID NO: 17655 - protein, 21 aa, Mycobacterium avium
SFLLRPGWVVLALVVVAFAYL

SEQ ID NO: 17656 - protein, 19 aa, Mycobacterium avium
SFLVLIWVFGGLLAAALPM

SEQ ID NO: 17657 - protein, 19 aa, Mycobacterium avium
SFPERLWRSPLRGPWLTSV

SEQ ID NO: 17658 - protein, 36 aa, Mycobacterium avium
SFVNYYICGLTFRVTDLQGRTAVYPWLKQTEGRCAE

SEQ ID NO: 17659 - protein, 22 aa, Mycobacterium avium
SGAALLAIIAFRGEVTALIQLY

SEQ ID NO: 17660 - protein, 25 aa, Mycobacterium avium
SGAMVFAILILLGRYINYTLDLAGI

SEQ ID NO: 17661 - protein, 19 aa, Mycobacterium avium
SGANLSAWASHGMLERGGW

SEQ ID NO: 17662 - protein, 19 aa, Mycobacterium avium
SGGGFGVVATSAWGALNFV

SEQ ID NO: 17663 - protein, 26 aa, Mycobacterium avium
SGGQRKRASVALELLTQPSLLLLDEP

SEQ ID NO: 17664 - protein, 21 aa, Mycobacterium avium
SGLALDRFADRPLAPIDPSAM

SEQ ID NO: 17665 - protein, 19 aa, Mycobacterium avium
SGLCATAYLVCRHAVGTPV

SEQ ID NO: 17666 - protein, 25 aa, Mycobacterium avium
SGLPLGAGFVSEWLLVQSLIHAAPQ

SEQ ID NO: 17667 - protein, 33 aa, Mycobacterium avium
SGLVGRSGLVYDMWGGAVSLAYQMHSGSPQPGN

SEQ ID NO: 17668 - protein, 26 aa, Mycobacterium avium
SGLVGRSSLVYDMWGAAVNLAHQTRS

SEQ ID NO: 17669 - protein, 27 aa, Mycobacterium avium
SGLVGRSSLVYDMWGAAVNLAHQTRSS

SEQ ID NO: 17670 - protein, 30 aa, Mycobacterium avium
SGPWLPARWRRWWWALLLAFVPIHLVVSAI

SEQ ID NO: 17671 - protein, 21 aa, Mycobacterium avium
SGRSAIDAVVFGVVRELLSNV

SEQ ID NO: 17672 - protein, 24 aa, Mycobacterium avium
SGSFRRWERAMFIFIAITLLQIPM

SEQ ID NO: 17673 - protein, 23 aa, Mycobacterium avium
SGSRMRPDVVIKFMDQFGDVIYN

SEQ ID NO: 17674 - protein, 17 aa, Mycobacterium avium
SGVHQWLDATLLAGAAL

SEQ ID NO: 17675 - protein, 17 aa, Mycobacterium avium
SGVHQWLNATLLAGAAL

SEQ ID NO: 17676 - protein, 21 aa, Mycobacterium avium
SGVVVDWCAMLDGLGGRRVDL

SEQ ID NO: 17677 - protein, 25 aa, Mycobacterium avium
SGVVVDWCAMLDGLGGRRVDLPTYG

SEQ ID NO: 17678 - protein, 19 aa, Mycobacterium avium
SGYADRAGAMVPRPGSDVV

SEQ ID NO: 17679 - protein, 29 aa, Mycobacterium avium
SHPIHLLTMICGFALLGYVVAVMKPDALY

SEQ ID NO: 17680 - protein, 24 aa, Mycobacterium avium
SHPRPADLPRIWELINATRDDALA

SEQ ID NO: 17681 - protein, 18 aa, Mycobacterium avium
SHRRVVLLIYLWVGIVAF

SEQ ID NO: 17682 - protein, 19 aa, Mycobacterium avium
SHRRVVLLIYLWVGIVAFG

SEQ ID NO: 17683 - protein, 23 aa, Mycobacterium avium
SHRRVVLLIYLWVGIVAFGAAST

SEQ ID NO: 17684 - protein, 36 aa, Mycobacterium avium
SIASALCFLPGLILGLFAQFTIAYAIDRSESAVKAL

SEQ ID NO: 17685 - protein, 34 aa, Mycobacterium avium
SIASALCFLPGLILGLFAQFTIPYAIDRSESAVK

SEQ ID NO: 17686 - protein, 17 aa, Mycobacterium avium
SIAYRPALGDSRSGPGW

SEQ ID NO: 17687 - protein, 17 aa, Mycobacterium avium
SIGPLGLAGRQGSQSVP

SEQ ID NO: 17688 - protein, 30 aa, Mycobacterium avium
SIPDATKAAARWIRPLVPPLVARMMDTTTH

SEQ ID NO: 17689 - protein, 28 aa, Mycobacterium avium
SIPLLTPRLSGRFGVPVHSTAQPGLSAA

SEQ ID NO: 17690 - protein, 17 aa, Mycobacterium avium
SIVAALFIFSLWIATLG

SEQ ID NO: 17691 - protein, 49 aa, Mycobacterium avium
SKARSRRLRLPSWSVAWKAAVIALICAFVAASGYMMWERHQTSERNQRI

SEQ ID NO: 17692 - protein, 22 aa, Mycobacterium avium
SKGDCRHLGGSMVGDLPPAPGQ

SEQ ID NO: 17693 - protein, 23 aa, Mycobacterium avium
SKGDCRHLGGSMVGDLPPAPGQG

SEQ ID NO: 17694 - protein, 23 aa, Mycobacterium avium
SKGDCRHLGGSMVGDLPPGPGQG

SEQ ID NO: 17695 - protein, 18 aa, Mycobacterium avium
SKMNLPWMFFFTGLAIPA

SEQ ID NO: 17696 - protein, 26 aa, Mycobacterium avium
SLAANIVGGIDWDGHGLLGLEESMDS

SEQ ID NO: 17697 - protein, 28 aa, Mycobacterium avium
SLAANIVGGIDWDGHGLLGLEESMDSVL

SEQ ID NO: 17698 - protein, 22 aa, Mycobacterium avium
SLAATVFFALLALYLVGVDQGA

SEQ ID NO: 17699 - protein, 17 aa, Mycobacterium avium
SLAELMGGPDTAPPPPG

SEQ ID NO: 17700 - protein, 18 aa, Mycobacterium avium
SLAFAMQAGCRFTAQLGA

SEQ ID NO: 17701 - protein, 25 aa, Mycobacterium avium
SLCSALLSWRVLRWEKQSAKAAERS

SEQ ID NO: 17702 - protein, 18 aa, Mycobacterium avium
SLFAAIIGSISFWGSIIA

SEQ ID NO: 17703 - protein, 23 aa, Mycobacterium avium
SLGALIIWVAFAPMLRRAARLPA

SEQ ID NO: 17704 - protein, 26 aa, Mycobacterium avium
SLGRRDLSVAFGWSMFNWIADVACLG

SEQ ID NO: 17705 - protein, 18 aa, Mycobacterium avium
SLILALLAFRHFGQGYAI

SEQ ID NO: 17706 - protein, 19 aa, Mycobacterium avium
SLIRERFGRGWAWLSAFTL

SEQ ID NO: 17707 - protein, 29 aa, Mycobacterium avium
SLIRERFGRGWAWLSAFTLFASAIGALLT

SEQ ID NO: 17708 - protein, 18 aa, Mycobacterium avium
SLIRRAAAYFDRAVVTRV

SEQ ID NO: 17709 - protein, 22 aa, Mycobacterium avium
SLQCKLPISIPQALGMVQQAQG

SEQ ID NO: 17710 - protein, 26 aa, Mycobacterium avium
SLQLHGRPGPIPSYDAAAALRADAAT

SEQ ID NO: 17711 - protein, 20 aa, Mycobacterium avium
SLRGEAVGVYVGFSNNDYQF

SEQ ID NO: 17712 - protein, 17 aa, Mycobacterium avium
SLRSGECDLALAGGVTV

SEQ ID NO: 17713 - protein, 29 aa, Mycobacterium avium
SLVIVLALVVGYVGWRLYEKLTNNTVVAY

SEQ ID NO: 17714 - protein, 20 aa, Mycobacterium avium
SLVLLGWAAVWIARRAGPLQ

SEQ ID NO: 17715 - protein, 28 aa, Mycobacterium avium
SLYRIGALCPYCMVVWVVTIALLVVVAS

SEQ ID NO: 17716 - protein, 24 aa, Mycobacterium avium
SMADDAGIYPGEMDEYAPEFDDYD

SEQ ID NO: 17717 - protein, 21 aa, Mycobacterium avium
SMADDAGIYPGEMDEYDPEFD

SEQ ID NO: 17718 - protein, 24 aa, Mycobacterium avium
SMFLSRVETLIPMYAHNPAQLLET

SEQ ID NO: 17719 - protein, 25 aa, Mycobacterium avium
SMFLSRVETLIPMYAHNPAQLLETI

SEQ ID NO: 17720 - protein, 27 aa, Mycobacterium avium
SMHVMGRWNWWAPKPLAWLHDRFGISE

SEQ ID NO: 17721 - protein, 19 aa, Mycobacterium avium
SMLKTSRVVLMTLSDKNAG

SEQ ID NO: 17722 - protein, 21 aa, Mycobacterium avium
SMLVLAIPVNYIWDFAVEGTA

SEQ ID NO: 17723 - protein, 30 aa, Mycobacterium avium
SMNRGWCMLRTRWARRVARILPVLGLAGLA

SEQ ID NO: 17724 - protein, 21 aa, Mycobacterium avium
SMRIGEHRVLVLVGRIHAYEG

SEQ ID NO: 17725 - protein, 27 aa, Mycobacterium avium
SMSRLNSRLLKSWVRRYTLRRGALLFG

SEQ ID NO: 17726 - protein, 26 aa, Mycobacterium avium
SMTADELYARIGFVLQETQLVHGTVA

SEQ ID NO: 17727 - protein, 18 aa, Mycobacterium avium
SNALNAWRLALAAEVIFW

SEQ ID NO: 17728 - protein, 27 aa, Mycobacterium avium
SNALNAWRLALAAEVIFWHTFPIRGHL

SEQ ID NO: 17729 - protein, 23 aa, Mycobacterium avium
SNDLQSWATLTAHEKQMTMRVFT

SEQ ID NO: 17730 - protein, 26 aa, Mycobacterium avium
SNPRQARAALRAGFQSLPGMPIGQLF

SEQ ID NO: 17731 - protein, 23 aa, Mycobacterium avium
SNRPEFLAVLLAIWRLAATAVLI

SEQ ID NO: 17732 - protein, 22 aa, Mycobacterium avium
SPCILPVLPVILLSSMDGDRRG

SEQ ID NO: 17733 - protein, 26 aa, Mycobacterium avium
SPISVRGARTYPCMGKPGKRAPTVEI

SEQ ID NO: 17734 - protein, 28 aa, Mycobacterium avium
SPPDMRLPISLALGWPHRVPGAAACCDF

SEQ ID NO: 17735 - protein, 20 aa, Mycobacterium avium
SPRGIRFAAAHAEAVFVSGP

SEQ ID NO: 17736 - protein, 20 aa, Mycobacterium avium
SPSRSALGYGGKLGVRDVLF

SEQ ID NO: 17737 - protein, 23 aa, Mycobacterium avium
SPSYLRFGWAAAKLDDIANYPAA

SEQ ID NO: 17738 - protein, 24 aa, Mycobacterium avium
SPTRPARAGWSRVNPVTGHEEFPR

SEQ ID NO: 17739 - protein, 21 aa, Mycobacterium avium
SPTVVIEKLFLPEDSEPRRRP

SEQ ID NO: 17740 - protein, 17 aa, Mycobacterium avium
SQFALVFHDSEMDPQST

SEQ ID NO: 17741 - protein, 22 aa, Mycobacterium avium
SQFDALHFAKPIFGPAARALAQ

SEQ ID NO: 17742 - protein, 24 aa, Mycobacterium avium
SQHSPALFAGRLIVGLGVGLAISA

SEQ ID NO: 17743 - protein, 17 aa, Mycobacterium avium
SQPELLAPALLLAAAPF

SEQ ID NO: 17744 - protein, 31 aa, Mycobacterium avium
SQSALNLPAAWRFSRGDGQLVAVLDTGVRPG

SEQ ID NO: 17745 - protein, 25 aa, Mycobacterium avium
SQSRLTIRGAWALIGFFGTVQLVVT

SEQ ID NO: 17746 - protein, 19 aa, Mycobacterium avium
SQTRWAAALVCAVLVAVAA

SEQ ID NO: 17747 - protein, 34 aa, Mycobacterium avium
SRAARLIGALALFCAACWLIQILVHHHSNPSWHY

SEQ ID NO: 17748 - protein, 21 aa, Mycobacterium avium
SRAETVLAVGAVMVAALAGLS

SEQ ID NO: 17749 - protein, 30 aa, Mycobacterium avium
SRGEPSIAWPRVFGYGILPGLALVLALGAG

SEQ ID NO: 17750 - protein, 20 aa, Mycobacterium avium
SRGGDGTRALVFAAGGIVTT

SEQ ID NO: 17751 - protein, 30 aa, Mycobacterium avium
SRGKPSIAWPRVFGYGILPGLALVLALGAG

SEQ ID NO: 17752 - protein, 22 aa, Mycobacterium avium
SRGKWDTLRAMGFDDDHIGDSR

SEQ ID NO: 17753 - protein, 20 aa, Mycobacterium avium
SRIAQIPAVTRVSGITRPAG

SEQ ID NO: 17754 - protein, 26 aa, Mycobacterium avium
SRLPDYRVVAALPLAYAIIVSGALLR

SEQ ID NO: 17755 - protein, 17 aa, Mycobacterium avium
SRMKITMENVGGRWLAS

SEQ ID NO: 17756 - protein, 23 aa, Mycobacterium avium
SRPHAPWARWRYSTQPEKMRRAL

SEQ ID NO: 17757 - protein, 26 aa, Mycobacterium avium
SRPLRRPRPVRWGPRSLRRARSVRRP

SEQ ID NO: 17758 - protein, 27 aa, Mycobacterium avium
SRPRWSRRRLFIVIALAVMLVLAGLTV

SEQ ID NO: 17759 - protein, 18 aa, Mycobacterium avium
SRTAAMLGLGSFLMQLFV

SEQ ID NO: 17760 - protein, 24 aa, Mycobacterium avium
SRTLPELWRLLGHIDAVHGAYYLL

SEQ ID NO: 17761 - protein, 19 aa, Mycobacterium avium
SRVGAFAIVEMQKLQHDRT

SEQ ID NO: 17762 - protein, 35 aa, Mycobacterium avium
SRVKRPLIPRMVRAFAIPIIFFWGLLAVTTNTFMP

SEQ ID NO: 17763 - protein, 17 aa, Mycobacterium avium
SSALGFLSTPGWALLSD

SEQ ID NO: 17764 - protein, 34 aa, Mycobacterium avium
SSARPEHWQRLALCWRLAGDHGLGIATLMRAAQR

SEQ ID NO: 17765 - protein, 25 aa, Mycobacterium avium
SSASDRGAGALGFAGTARKDAAGAA

SEQ ID NO: 17766 - protein, 29 aa, Mycobacterium avium
SSGPFFKAYVVNLFPGQFVQPFIDAAFSD

SEQ ID NO: 17767 - protein, 18 aa, Mycobacterium avium
SSPLGGLLAVAALLLITR

SEQ ID NO: 17768 - protein, 23 aa, Mycobacterium avium
SSPRPLAYLGVFVFVIAGWLVSL

SEQ ID NO: 17769 - protein, 17 aa, Mycobacterium avium
SSSDLRVGQPVVAIGSP

SEQ ID NO: 17770 - protein, 24 aa, Mycobacterium avium
SSSGRGGLQFMLIIWLQGIWLPLH

SEQ ID NO: 17771 - protein, 18 aa, Mycobacterium avium
SSSPARTYGWHRAEVFTA

SEQ ID NO: 17772 - protein, 19 aa, Mycobacterium avium
SSTVRWRAGHRGRFRSAPS

SEQ ID NO: 17773 - protein, 25 aa, Mycobacterium avium
SSYPRLIRVAMMYNDKIGYGPTVRD

SEQ ID NO: 17774 - protein, 18 aa, Mycobacterium avium
STAARSGSGLGLALVAQQ

SEQ ID NO: 17775 - protein, 18 aa, Mycobacterium avium
STAELIGAMLGRKAGTAA

SEQ ID NO: 17776 - protein, 17 aa, Mycobacterium avium
STIARRQMRLIVSDRGY

SEQ ID NO: 17777 - protein, 17 aa, Mycobacterium avium
STLAALLARFHDVDRGS

SEQ ID NO: 17778 - protein, 23 aa, Mycobacterium avium
STLPAVVRWARLPADVAHAEELQ

SEQ ID NO: 17779 - protein, 17 aa, Mycobacterium avium
STLPVIFIAAVVALGDR

SEQ ID NO: 17780 - protein, 19 aa, Mycobacterium avium
STRSRFEHRAVIVGADGAQ

SEQ ID NO: 17781 - protein, 27 aa, Mycobacterium avium
STVFAEHMHRCAGALAEHVDWSLIDVI

SEQ ID NO: 17782 - protein, 23 aa, Mycobacterium avium
STVRGARNYPCQEFPGKRAPTVQ

SEQ ID NO: 17783 - protein, 24 aa, Mycobacterium avium
STVRGARNYPCQEFPGKRAPTVQL

SEQ ID NO: 17784 - protein, 26 aa, Mycobacterium avium
SVADFWRFWVVHLWVEDFLELFTTVM

SEQ ID NO: 17785 - protein, 34 aa, Mycobacterium avium
SVASALCFLPGLILGLFAQFTIPYAIDRSESAVK

SEQ ID NO: 17786 - protein, 24 aa, Mycobacterium avium
SVDGRARVLGVIHLKDVVKQGMRE

SEQ ID NO: 17787 - protein, 25 aa, Mycobacterium avium
SVDGRARVLGVIHLKDVVKQGMRER

SEQ ID NO: 17788 - protein, 26 aa, Mycobacterium avium
SVDPAELYRHVAFVFQDAELLRMSIR

SEQ ID NO: 17789 - protein, 17 aa, Mycobacterium avium
SVFKLIPSVFAQRSRAL

SEQ ID NO: 17790 - protein, 17 aa, Mycobacterium avium
SVIRIGGLGSWFTQGYQ

SEQ ID NO: 17791 - protein, 18 aa, Mycobacterium avium
SVLCYRYLDAKAEDRLDR

SEQ ID NO: 17792 - protein, 25 aa, Mycobacterium avium
SVLIRRPLVGYAWSWAGGRGDGWRS

SEQ ID NO: 17793 - protein, 27 aa, Mycobacterium avium
SVLSRLSVWLRPDWTRTVLARRIAAGT

SEQ ID NO: 17794 - protein, 18 aa, Mycobacterium avium
SVMGVAWLLDVPALIRKR

SEQ ID NO: 17795 - protein, 26 aa, Mycobacterium avium
SVNALVPFYAIGVFSGFAMAGYGMTK

SEQ ID NO: 17796 - protein, 17 aa, Mycobacterium avium
SVRGWRGPYGTRPVDDL

SEQ ID NO: 17797 - protein, 24 aa, Mycobacterium avium
SVSAEFVLGLALALVMHRTLIGKG

SEQ ID NO: 17798 - protein, 18 aa, Mycobacterium avium
SVSNGFYYNAFVPNLAIP

SEQ ID NO: 17799 - protein, 18 aa, Mycobacterium avium
SVTIRCALVVGRNVDNWV

SEQ ID NO: 17800 - protein, 18 aa, Mycobacterium avium
SWDGPAWSISAEWLAYVL

SEQ ID NO: 17801 - protein, 20 aa, Mycobacterium avium
SYAGAFGLSILFWQHLIGLH

SEQ ID NO: 17802 - protein, 26 aa, Mycobacterium avium
SYSWYLWHWPVLLLMPALLGEPAGLP

SEQ ID NO: 17803 - protein, 20 aa, Mycobacterium avium
SYYRLMLKLKGGPQAVADAA

SEQ ID NO: 17804 - protein, 22 aa, Mycobacterium avium
TAADALTCARKLAGQRVTAGDG

SEQ ID NO: 17805 - protein, 24 aa, Mycobacterium avium
TAADALTCARRLAGQRVTAGDGDG

SEQ ID NO: 17806 - protein, 26 aa, Mycobacterium avium
TAADPAGWPRLDWSMDAALLLAALAS

SEQ ID NO: 17807 - protein, 18 aa, Mycobacterium avium
TAALGLSLLALWLLTRAT

SEQ ID NO: 17808 - protein, 17 aa, Mycobacterium avium
TAALYVRVGEDLHPVLN

SEQ ID NO: 17809 - protein, 24 aa, Mycobacterium avium
TADARRAANAGVRRREAAAPENVE

SEQ ID NO: 17810 - protein, 26 aa, Mycobacterium avium
TADDRLFCNSPFFWIGGFAFGLLATL

SEQ ID NO: 17811 - protein, 18 aa, Mycobacterium avium
TADGLGCYGPPDRARAVM

SEQ ID NO: 17812 - protein, 27 aa, Mycobacterium avium
TAELLEGIEIIPPRYIEYRGGRFPELD

SEQ ID NO: 17813 - protein, 19 aa, Mycobacterium avium
TAGCAFWAVLTIMLAAWGW

SEQ ID NO: 17814 - protein, 17 aa, Mycobacterium avium
TAGHLLFSIAMTGYILL

SEQ ID NO: 17815 - protein, 23 aa, Mycobacterium avium
TAGLIALILLIVYRSVFTALLPL

SEQ ID NO: 17816 - protein, 22 aa, Mycobacterium avium
TAGRTVFRVRLPLIDGPGTLGA

SEQ ID NO: 17817 - protein, 17 aa, Mycobacterium avium
TAGVLGFLTAAAANAYE

SEQ ID NO: 17818 - protein, 17 aa, Mycobacterium avium
TAHELRSPLTAMRTNLE

SEQ ID NO: 17819 - protein, 23 aa, Mycobacterium avium
TAHIRTGSLLGARVLTLESAGAG

SEQ ID NO: 17820 - protein, 17 aa, Mycobacterium avium
TAIGPSQAWYTENLRYY

SEQ ID NO: 17821 - protein, 22 aa, Mycobacterium avium
TALCGYAVIYLAARDLAPGGFS

SEQ ID NO: 17822 - protein, 17 aa, Mycobacterium avium
TALLLAVLCTWFLQTSM

SEQ ID NO: 17823 - protein, 18 aa, Mycobacterium avium
TALRNFRSGTTVQELPEH

SEQ ID NO: 17824 - protein, 17 aa, Mycobacterium avium
TALTIGAVWLARRLEVR

SEQ ID NO: 17825 - protein, 18 aa, Mycobacterium avium
TAPAPSIVKSGGEANNLA

SEQ ID NO: 17826 - protein, 30 aa, Mycobacterium avium
TAPTAFRFLGLHWSLPLGVAILLAAVVGGL

SEQ ID NO: 17827 - protein, 18 aa, Mycobacterium avium
TAQPSGLLDVIWSPIALG

SEQ ID NO: 17828 - protein, 18 aa, Mycobacterium avium
TAQVLGFSFFQRFRRILV

SEQ ID NO: 17829 - protein, 17 aa, Mycobacterium avium
TASRSGSGLGLALVAQQ

SEQ ID NO: 17830 - protein, 20 aa, Mycobacterium avium
TAVFCGFTVLQSAIVTAIVV

SEQ ID NO: 17831 - protein, 25 aa, Mycobacterium avium
TCFPSFPRFAGAVFAEGEDKELAVL

SEQ ID NO: 17832 - protein, 17 aa, Mycobacterium avium
TCIASAMLGLLLSALAQ

SEQ ID NO: 17833 - protein, 25 aa, Mycobacterium avium
TDAAPGPWRLLLRDLAHLLDTASIV

SEQ ID NO: 17834 - protein, 21 aa, Mycobacterium avium
TDCDGHGTLLAGLVAGQPSPD

SEQ ID NO: 17835 - protein, 19 aa, Mycobacterium avium
TDEGRRWMAAAGIALAVAA

SEQ ID NO: 17836 - protein, 23 aa, Mycobacterium avium
TDHRGRVRVGTVLLSPVESDGSP

SEQ ID NO: 17837 - protein, 23 aa, Mycobacterium avium
TDHRGRVRVGTVLLSPVESDRSP

SEQ ID NO: 17838 - protein, 18 aa, Mycobacterium avium
TDHVEAAMLRDALIAHKV

SEQ ID NO: 17839 - protein, 17 aa, Mycobacterium avium
TDLSYGMYIYAYPVQQL

SEQ ID NO: 17840 - protein, 18 aa, Mycobacterium avium
TDLSYGMYIYAYPVQQLL

SEQ ID NO: 17841 - protein, 29 aa, Mycobacterium avium
TDPLTGLLNRAGWEIATADLLSRTRSATA

SEQ ID NO: 17842 - protein, 19 aa, Mycobacterium avium
TDWLGARNVRRFGVRFREQ

SEQ ID NO: 17843 - protein, 18 aa, Mycobacterium avium
TEAAFGPIDVWVNVAFTS

SEQ ID NO: 17844 - protein, 21 aa, Mycobacterium avium
TEFNVALPWTKQVSLSKSAVH

SEQ ID NO: 17845 - protein, 26 aa, Mycobacterium avium
TELPVRRWELPVLRWVDGGRGNRRVI

SEQ ID NO: 17846 - protein, 19 aa, Mycobacterium avium
TEPAPRVMAAAAPAATAAQ

SEQ ID NO: 17847 - protein, 23 aa, Mycobacterium avium
TEPPRPAGSVPRPTGPGRLTADI

SEQ ID NO: 17848 - protein, 17 aa, Mycobacterium avium
TERRRRFTLTRRNALLG

SEQ ID NO: 17849 - protein, 25 aa, Mycobacterium avium
TERTIYRLIGVDARSEQTWGAYARG

SEQ ID NO: 17850 - protein, 17 aa, Mycobacterium avium
TESLARRLIRDGVAPGR

SEQ ID NO: 17851 - protein, 23 aa, Mycobacterium avium
TETELREAVSVLWHIDDLHAARV

SEQ ID NO: 17852 - protein, 24 aa, Mycobacterium avium
TETELREAVSVLWHIDDLRAARVY

SEQ ID NO: 17853 - protein, 25 aa, Mycobacterium avium
TETELREAVSVLWHIDDLRAARVYG

SEQ ID NO: 17854 - protein, 22 aa, Mycobacterium avium
TFCTGWLAVYVIEFPLEIFAVR

SEQ ID NO: 17855 - protein, 21 aa, Mycobacterium avium
TFGEFLAWIIGWNLLLELAIG

SEQ ID NO: 17856 - protein, 21 aa, Mycobacterium avium
TFLTVEAWAFLQLGSRQQSHE

SEQ ID NO: 17857 - protein, 24 aa, Mycobacterium avium
TGAAPGPWRLLLRDLAHLLDTASI

SEQ ID NO: 17858 - protein, 27 aa, Mycobacterium avium
TGAELFTKGGPYLARGAQDLIPTAQLL

SEQ ID NO: 17859 - protein, 23 aa, Mycobacterium avium
TGDKRAAPKLGIDLQGGTRVTLT

SEQ ID NO: 17860 - protein, 27 aa, Mycobacterium avium
TGDLRGSLRLLIRALRGHRRPVAPAGQ

SEQ ID NO: 17861 - protein, 19 aa, Mycobacterium avium
TGDVRGWDVLFGTHDAGAA

SEQ ID NO: 17862 - protein, 25 aa, Mycobacterium avium
TGFFPLMGIGAFSMLAFSGRFGRAR

SEQ ID NO: 17863 - protein, 22 aa, Mycobacterium avium
TGFLRLGSTVGHVVVSGTVAVL

SEQ ID NO: 17864 - protein, 26 aa, Mycobacterium avium
TGFWIRRARRLLPALVLMVLTVAAAR

SEQ ID NO: 17865 - protein, 24 aa, Mycobacterium avium
TGLCVVPVMFDRIVDLPSDILSRY

SEQ ID NO: 17866 - protein, 26 aa, Mycobacterium avium
TGLFRTVYVLPWICAPLAIAVLWRWI

SEQ ID NO: 17867 - protein, 19 aa, Mycobacterium avium
TGLLCGIGSVVAIVLGAIA

SEQ ID NO: 17868 - protein, 17 aa, Mycobacterium avium
TGMRLGWSVISPGDRPR

SEQ ID NO: 17869 - protein, 32 aa, Mycobacterium avium
TGPAAFLGFGWRIPFLLSIFLVAVGLFVRLRL

SEQ ID NO: 17870 - protein, 17 aa, Mycobacterium avium
TGPRLPGRPDLSGSAPT

SEQ ID NO: 17871 - protein, 21 aa, Mycobacterium avium
TGRLNDYIRVVAELTNVGDGL

SEQ ID NO: 17872 - protein, 24 aa, Mycobacterium avium
TGSVAIGAGCLWQTEPLVGLMACS

SEQ ID NO: 17873 - protein, 21 aa, Mycobacterium avium
TGTALGWLVSRGWRRPTAVLP

SEQ ID NO: 17874 - protein, 18 aa, Mycobacterium avium
TGVECCGYLLAVDVDMNT

SEQ ID NO: 17875 - protein, 28 aa, Mycobacterium avium
THAGKRFLVIDLPRPRSVQLLLTPLILA

SEQ ID NO: 17876 - protein, 24 aa, Mycobacterium avium
THALWCWIVAIAVAVVAHHGLLAW

SEQ ID NO: 17877 - protein, 19 aa, Mycobacterium avium
THLRASGWRVLAGYASGAA

SEQ ID NO: 17878 - protein, 19 aa, Mycobacterium avium
THTRRVLKRRAGGARASAE

SEQ ID NO: 17879 - protein, 28 aa, Mycobacterium avium
TIFGVALGLRFSYGWIAALAFVLVPVAI

SEQ ID NO: 17880 - protein, 30 aa, Mycobacterium avium
TIGAVWLARRLEVRLGPWNARLLSAAAYLV

SEQ ID NO: 17881 - protein, 17 aa, Mycobacterium avium
TIGETWTKIRGRLPALL

SEQ ID NO: 17882 - protein, 20 aa, Mycobacterium avium
TIKGRRMWAGLRSMSMRAVL

SEQ ID NO: 17883 - protein, 24 aa, Mycobacterium avium
TIRTEIEQLLGLLLSQGRAVGISV

SEQ ID NO: 17884 - protein, 22 aa, Mycobacterium avium
TIVCAAVLFSARLIGPRAAVLL

SEQ ID NO: 17885 - protein, 18 aa, Mycobacterium avium
TKDLDLSAFVVFSSMAGI

SEQ ID NO: 17886 - protein, 25 aa, Mycobacterium avium
TKIRGRLPALLGLALLEAVGVAAIA

SEQ ID NO: 17887 - protein, 24 aa, Mycobacterium avium
TLATIKTNLVWAFGYNLAAIPLAA

SEQ ID NO: 17888 - protein, 18 aa, Mycobacterium avium
TLEFWGLTSTQQLSLPVL

SEQ ID NO: 17889 - protein, 20 aa, Mycobacterium avium
TLEVYPRYLKLIPSNVNADI

SEQ ID NO: 17890 - protein, 22 aa, Mycobacterium avium
TLGWAGPWARGLLRVLAVTGFL

SEQ ID NO: 17891 - protein, 22 aa, Mycobacterium avium
TLHYWQAWVFIAVFTVATIVPA

SEQ ID NO: 17892 - protein, 18 aa, Mycobacterium avium
TLIAGFVGHAWHRADHPL

SEQ ID NO: 17893 - protein, 19 aa, Mycobacterium avium
TLIAGFVGHAWHRADHPLI

SEQ ID NO: 17894 - protein, 18 aa, Mycobacterium avium
TLIFEIFCYIAIAVAGVA

SEQ ID NO: 17895 - protein, 18 aa, Mycobacterium avium
TLIFEIFCYVAIAVAGVA

SEQ ID NO: 17896 - protein, 18 aa, Mycobacterium avium
TLKLAGAVGLTLGLVALP

SEQ ID NO: 17897 - protein, 18 aa, Mycobacterium avium
TLLGRGGVGLSLGQRQRL

SEQ ID NO: 17898 - protein, 24 aa, Mycobacterium avium
TLLLEPMAGLALFLVVTACVGGAK

SEQ ID NO: 17899 - protein, 26 aa, Mycobacterium avium
TLLVAIPFTVLVSFTLNILLRELGAA

SEQ ID NO: 17900 - protein, 21 aa, Mycobacterium avium
TLLVCDRLAITAAPFLMAEVF

SEQ ID NO: 17901 - protein, 19 aa, Mycobacterium avium
TLMDGRAGFAPVGPSLRYT

SEQ ID NO: 17902 - protein, 21 aa, Mycobacterium avium
TLMDGRAGFAPVGPSLRYTDF

SEQ ID NO: 17903 - protein, 20 aa, Mycobacterium avium
TLPATVFVAFQLMFAIITVA

SEQ ID NO: 17904 - protein, 18 aa, Mycobacterium avium
TLPPGWKPGSQAAAPPKL

SEQ ID NO: 17905 - protein, 30 aa, Mycobacterium avium
TLSLAAGWRSRRWRLLWLPSAAVLGVTTAV

SEQ ID NO: 17906 - protein, 24 aa, Mycobacterium avium
TLVRAPRGWQRVGALSSRIGAFAI

SEQ ID NO: 17907 - protein, 17 aa, Mycobacterium avium
TLVSWLLFTWMIARLPR

SEQ ID NO: 17908 - protein, 20 aa, Mycobacterium avium
TLVYIQFRGGFTPKTELTML

SEQ ID NO: 17909 - protein, 22 aa, Mycobacterium avium
TLWLETPARLAITVPTVAVPIL

SEQ ID NO: 17910 - protein, 22 aa, Mycobacterium avium
TLWLETPARLAITVPTVAVPIV

SEQ ID NO: 17911 - protein, 25 aa, Mycobacterium avium
TLYLRARVSELPWMIGAVAVGTVCT

SEQ ID NO: 17912 - protein, 18 aa, Mycobacterium avium
TMGVAWSVLYIPIGGVGT

SEQ ID NO: 17913 - protein, 17 aa, Mycobacterium avium
TMIIGSYVLDWRVGLAF

SEQ ID NO: 17914 - protein, 21 aa, Mycobacterium avium
TMMRLWLLRPGMRLWDLPLFP

SEQ ID NO: 17915 - protein, 21 aa, Mycobacterium avium
TMPVALRWVATTVMMAMMVGW

SEQ ID NO: 17916 - protein, 25 aa, Mycobacterium avium
TMREARAGDRYLLCSDGLSDPVSDD

SEQ ID NO: 17917 - protein, 17 aa, Mycobacterium avium
TMVRSSLWIGVAVVAVL

SEQ ID NO: 17918 - protein, 26 aa, Mycobacterium avium
TNAGEPIFWVVRALELLEDFEQFGYY

SEQ ID NO: 17919 - protein, 22 aa, Mycobacterium avium
TPEGRSVVVFAKQHFGLRARTP

SEQ ID NO: 17920 - protein, 31 aa, Mycobacterium avium
TPFPHRWAVMFLVAVGFWNFLGAGIFGFLIN

SEQ ID NO: 17921 - protein, 22 aa, Mycobacterium avium
TPGELRIALMRGDVLAEPIALP

SEQ ID NO: 17922 - protein, 19 aa, Mycobacterium avium
TPGQLVLRLQVVTVDGRGL

SEQ ID NO: 17923 - protein, 17 aa, Mycobacterium avium
TPGTDWGGWLMRRCTRL

SEQ ID NO: 17924 - protein, 21 aa, Mycobacterium avium
TPPAIRRWGRYASANGALAAS

SEQ ID NO: 17925 - protein, 25 aa, Mycobacterium avium
TPPDLKAAVQGVARFSQTLDERDGQ

SEQ ID NO: 17926 - protein, 18 aa, Mycobacterium avium
TPPLPMPFPRTGQGGEPR

SEQ ID NO: 17927 - protein, 17 aa, Mycobacterium avium
TPWCAAGLVATPLALRA

SEQ ID NO: 17928 - protein, 17 aa, Mycobacterium avium
TQGRLLLCGVYTAVAVV

SEQ ID NO: 17929 - protein, 27 aa, Mycobacterium avium
TQPKFWNRWIGWVMRRPWMSALAASLV

SEQ ID NO: 17930 - protein, 18 aa, Mycobacterium avium
TQSLLLVLHDWVRTYHRQ

SEQ ID NO: 17931 - protein, 23 aa, Mycobacterium avium
TRDEVRAALAAGDWSSDSESKLL

SEQ ID NO: 17932 - protein, 17 aa, Mycobacterium avium
TRDLWPAPELIMDTGNS

SEQ ID NO: 17933 - protein, 20 aa, Mycobacterium avium
TRDRTVLVIAHRLHTITRAD

SEQ ID NO: 17934 - protein, 24 aa, Mycobacterium avium
TRFKRKEHWLDVHFSGDGSVIMPG

SEQ ID NO: 17935 - protein, 17 aa, Mycobacterium avium
TRFPLIIQNIHRYFFYI

SEQ ID NO: 17936 - protein, 32 aa, Mycobacterium avium
TRGWRRVGTAIVRWPGPVLAVSVAVALVGLLA

SEQ ID NO: 17937 - protein, 23 aa, Mycobacterium avium
TRIRSAPMLLSWMTRMTDWVPPM

SEQ ID NO: 17938 - protein, 25 aa, Mycobacterium avium
TRKAGCAARAKFSVAELVRPWLDTW

SEQ ID NO: 17939 - protein, 20 aa, Mycobacterium avium
TRLGPYELRSLIGTGTLGEV

SEQ ID NO: 17940 - protein, 25 aa, Mycobacterium avium
TRLTLITLIPIVAFMTVGGPAMGSA

SEQ ID NO: 17941 - protein, 24 aa, Mycobacterium avium
TRPEVRSAGLFYAVMTQLGFVAIL

SEQ ID NO: 17942 - protein, 21 aa, Mycobacterium avium
TRPVDDLVMFVCLAVAAMCAA

SEQ ID NO: 17943 - protein, 17 aa, Mycobacterium avium
TRRVLKRRAGGARASAE

SEQ ID NO: 17944 - protein, 19 aa, Mycobacterium avium
TRVGCLKGFVGQSASEAGR

SEQ ID NO: 17945 - protein, 21 aa, Mycobacterium avium
TRVQAAVPFYGIYDFTRFDDS

SEQ ID NO: 17946 - protein, 23 aa, Mycobacterium avium
TRWIQLPGLIAVTARWDFAPGTL

SEQ ID NO: 17947 - protein, 31 aa, Mycobacterium avium
TSAALLTWRLLRPSWGEWRTAGAAATAGALS

SEQ ID NO: 17948 - protein, 27 aa, Mycobacterium avium
TSAYLLAKVCIYTVFAIVQSAIVTTIA

SEQ ID NO: 17949 - protein, 18 aa, Mycobacterium avium
TSDIAVIRVQGMSGLTPI

SEQ ID NO: 17950 - protein, 18 aa, Mycobacterium avium
TSIGRTAIEQVLNAVSSR

SEQ ID NO: 17951 - protein, 23 aa, Mycobacterium avium
TSIPRPVGPMLDRLSALVKSIPK

SEQ ID NO: 17952 - protein, 26 aa, Mycobacterium avium
TSMLQRKLRVGFAKAGRLMDLMETRG

SEQ ID NO: 17953 - protein, 22 aa, Mycobacterium avium
TSPETLLRFVIEGPPSQTDYHD

SEQ ID NO: 17954 - protein, 17 aa, Mycobacterium avium
TSSRGKPSIAWPRVFGY

SEQ ID NO: 17955 - protein, 33 aa, Mycobacterium avium
TSSRGKPSIAWPRVFGYGILPGLALILALGAGY

SEQ ID NO: 17956 - protein, 18 aa, Mycobacterium avium
TTDPSWVSLMFLSAALVV

SEQ ID NO: 17957 - protein, 19 aa, Mycobacterium avium
TTHIQRFALATVIAVALLA

SEQ ID NO: 17958 - protein, 19 aa, Mycobacterium avium
TTLLEDWRDNLRWPPASAL

SEQ ID NO: 17959 - protein, 17 aa, Mycobacterium avium
TTLLRHLIRTVREHSSP

SEQ ID NO: 17960 - protein, 24 aa, Mycobacterium avium
TTPLRRLDLLIAYGTAFSLAAAAQ

SEQ ID NO: 17961 - protein, 29 aa, Mycobacterium avium
TTPLWRAAQVFRLLSCLYATGFQIAINPD

SEQ ID NO: 17962 - protein, 26 aa, Mycobacterium avium
TTPLWRAAQVFRLLSCVYATGFQIAI

SEQ ID NO: 17963 - protein, 24 aa, Mycobacterium avium
TVARRIAGELGIGEVISGALPADK

SEQ ID NO: 17964 - protein, 24 aa, Mycobacterium avium
TVATACPFCRVMVTDRVNDRQEEA

SEQ ID NO: 17965 - protein, 26 aa, Mycobacterium avium
TVCCVLSFVVGFAMLGAMTFLPTYMQ

SEQ ID NO: 17966 - protein, 18 aa, Mycobacterium avium
TVCSRSAAVAKLEGVDGS

SEQ ID NO: 17967 - protein, 18 aa, Mycobacterium avium
TVCTYVMTSHVLPDRPER

SEQ ID NO: 17968 - protein, 28 aa, Mycobacterium avium
TVFADFPGLEVCVYAAPSQTVIGGPPEQ

SEQ ID NO: 17969 - protein, 19 aa, Mycobacterium avium
TVFHHGRSLLIATSNGAAG

SEQ ID NO: 17970 - protein, 18 aa, Mycobacterium avium
TVFRVRLPLIDGPGTLGA

SEQ ID NO: 17971 - protein, 18 aa, Mycobacterium avium
TVFSMRVAAAIGFLQMKR

SEQ ID NO: 17972 - protein, 19 aa, Mycobacterium avium
TVFSRSGVGAVLLQAVSSQ

SEQ ID NO: 17973 - protein, 26 aa, Mycobacterium avium
TVIVAPMFHAWGFGQLVFAAMMACTI

SEQ ID NO: 17974 - protein, 26 aa, Mycobacterium avium
TVPAGHPGPGWGLIVAWITVLVLIYQ

SEQ ID NO: 17975 - protein, 27 aa, Mycobacterium avium
TVPAGHPGPGWGLIVAWITVLVLIYQW

SEQ ID NO: 17976 - protein, 29 aa, Mycobacterium avium
TVPAGHPGPGWGLIVAWITVLVLIYQWAR

SEQ ID NO: 17977 - protein, 23 aa, Mycobacterium avium
TVPWRPGPIRALLATRPAAFRSL

SEQ ID NO: 17978 - protein, 18 aa, Mycobacterium avium
TVRRAGLIVLLQGVAALV

SEQ ID NO: 17979 - protein, 24 aa, Mycobacterium avium
TVTLELPDTGGLYRFSNVTYRGVQ

SEQ ID NO: 17980 - protein, 18 aa, Mycobacterium avium
TVVFGRSSPLGGLLAVAA

SEQ ID NO: 17981 - protein, 24 aa, Mycobacterium avium
TVVHLRLALVPVLIGLAIALPLGM

SEQ ID NO: 17982 - protein, 23 aa, Mycobacterium avium
TVWVRPRQGPKLADLITEPNTTV

SEQ ID NO: 17983 - protein, 24 aa, Mycobacterium avium
TVWVRPRQGPKLADLITEPNTTVA

SEQ ID NO: 17984 - protein, 24 aa, Mycobacterium avium
TVWVRPRQGPKLADLITEPNTTVT

SEQ ID NO: 17985 - protein, 19 aa, Mycobacterium avium
TWMIARVSLVPTLLVSIPF

SEQ ID NO: 17986 - protein, 17 aa, Mycobacterium avium
TWTVGAFYVTPRLIIDS

SEQ ID NO: 17987 - protein, 23 aa, Mycobacterium avium
TYEHYFRTFLRPDDVFWSFLEAI

SEQ ID NO: 17988 - protein, 23 aa, Mycobacterium avium
TYPANYFRSFAIRKQGVAVIDVP

SEQ ID NO: 17989 - protein, 25 aa, Mycobacterium avium
TYREIRPAHQVRWAVLLDGPVRISI

SEQ ID NO: 17990 - protein, 22 aa, Mycobacterium avium
TYSSIGIWAPILLVIARIFQGL

SEQ ID NO: 17991 - protein, 25 aa, Mycobacterium avium
TYSYWFEPNPGWSRLFAPGGEVKQY

SEQ ID NO: 17992 - protein, 25 aa, Mycobacterium avium
TYVPEVCAGVPTVALVGESFDALLE

SEQ ID NO: 17993 - protein, 26 aa, Mycobacterium avium
VAAAIGVAVGAIWLGRRLLQGRQQNP

SEQ ID NO: 17994 - protein, 18 aa, Mycobacterium avium
VAAALRLSTEEQRSLRSA

SEQ ID NO: 17995 - protein, 18 aa, Mycobacterium avium
VAAALSWIILGQRPDQGV

SEQ ID NO: 17996 - protein, 18 aa, Mycobacterium avium
VAAANWLGAPGFAALAVY

SEQ ID NO: 17997 - protein, 22 aa, Mycobacterium avium
VAAGLAWYLAHDVLDHREPFFA

SEQ ID NO: 17998 - protein, 23 aa, Mycobacterium avium
VAAGRRKALAFIEGRSVEQLVAL

SEQ ID NO: 17999 - protein, 20 aa, Mycobacterium avium
VAAIAVRGWLLRALAGLLAV

SEQ ID NO: 18000 - protein, 17 aa, Mycobacterium avium
VAAIFVIGVVALVVSLA

SEQ ID NO: 18001 - protein, 20 aa, Mycobacterium avium
VAARLPWVVIRSFDGLGPPK

SEQ ID NO: 18002 - protein, 19 aa, Mycobacterium avium
VAAVLACRRTVPAAAGSSL

SEQ ID NO: 18003 - protein, 18 aa, Mycobacterium avium
VADFAAACHAHGWRIAVV

SEQ ID NO: 18004 - protein, 18 aa, Mycobacterium avium
VADFAATCHAHGWRIAVV

SEQ ID NO: 18005 - protein, 24 aa, Mycobacterium avium
VADRLPGVRLDWFTVEHTATARQA

SEQ ID NO: 18006 - protein, 18 aa, Mycobacterium avium
VAEGYAAAAVLAMPDQHL

SEQ ID NO: 18007 - protein, 23 aa, Mycobacterium avium
VAEHDLRPGAALTAADVRLEKRL

SEQ ID NO: 18008 - protein, 17 aa, Mycobacterium avium
VAFIPFGLAMAIGVGVA

SEQ ID NO: 18009 - protein, 21 aa, Mycobacterium avium
VAFVVLVTFLLPALRDGAPAV

SEQ ID NO: 18010 - protein, 27 aa, Mycobacterium avium
VAGDGPFWRRLLSAAGFTAVSHVFVME

SEQ ID NO: 18011 - protein, 26 aa, Mycobacterium avium
VAGGSFRRWERLMFLLIAVNVLIFPM

SEQ ID NO: 18012 - protein, 26 aa, Mycobacterium avium
VAGLCVSRLRAAFANRDDRPISSGAA

SEQ ID NO: 18013 - protein, 27 aa, Mycobacterium avium
VAGLLKRRWPAVVVFILLLVFSALVAY

SEQ ID NO: 18014 - protein, 24 aa, Mycobacterium avium
VAGRARGGAVAAVLFAFVSGSLWG

SEQ ID NO: 18015 - protein, 17 aa, Mycobacterium avium
VAGTALMALAFLLMSRM

SEQ ID NO: 18016 - protein, 17 aa, Mycobacterium avium
VAGWLADRFGARPFAVA

SEQ ID NO: 18017 - protein, 19 aa, Mycobacterium avium
VAIAFFKAALFGLVAGTIA

SEQ ID NO: 18018 - protein, 17 aa, Mycobacterium avium
VALAEKLFNRWGARAVF

SEQ ID NO: 18019 - protein, 17 aa, Mycobacterium avium
VALAFAPFRRWIGIGRL

SEQ ID NO: 18020 - protein, 17 aa, Mycobacterium avium
VALAFAPFRRWIGTGRL

SEQ ID NO: 18021 - protein, 25 aa, Mycobacterium avium
VALLKAVIYGAIVAVIACQKGLFTR

SEQ ID NO: 18022 - protein, 25 aa, Mycobacterium avium
VALPSRVFGWLALVFGVGFSTLALV

SEQ ID NO: 18023 - protein, 17 aa, Mycobacterium avium
VALRGVRIGRIESLQIT

SEQ ID NO: 18024 - protein, 19 aa, Mycobacterium avium
VALVIWGSAVVAGFESVTK

SEQ ID NO: 18025 - protein, 18 aa, Mycobacterium avium
VALWRLDQLDGHRMRRLI

SEQ ID NO: 18026 - protein, 25 aa, Mycobacterium avium
VAMLAFGAGLAWLAMDRRRIRQEQR

SEQ ID NO: 18027 - protein, 18 aa, Mycobacterium avium
VANLGQWISGARPRTLPN

SEQ ID NO: 18028 - protein, 24 aa, Mycobacterium avium
VAPILLPVGVHFIPKAARVRRGAR

SEQ ID NO: 18029 - protein, 26 aa, Mycobacterium avium
VAPKAPWIPQSSFRPSFGGNVGPVGS

SEQ ID NO: 18030 - protein, 24 aa, Mycobacterium avium
VAPPDLGANCQYRAVPDPSSRPVS

SEQ ID NO: 18031 - protein, 25 aa, Mycobacterium avium
VAPPDLGANCQYRAVPDPSSRPVSP

SEQ ID NO: 18032 - protein, 26 aa, Mycobacterium avium
VARREIRLLLANRLYFAFLALLPFVL

SEQ ID NO: 18033 - protein, 40 aa, Mycobacterium avium
VARVKRLLDRIAAYERYWLYPGAENLAIFRAHLDSLSTVR

SEQ ID NO: 18034 - protein, 31 aa, Mycobacterium avium
VARYRALVLSRLRLVSVGVPVAIGLLAGIIA

SEQ ID NO: 18035 - protein, 20 aa, Mycobacterium avium
VASVLPVWLLLAPHDYLSTF

SEQ ID NO: 18036 - protein, 18 aa, Mycobacterium avium
VATGFPFGSYTHHLPGPK

SEQ ID NO: 18037 - protein, 20 aa, Mycobacterium avium
VATIQEWSAGYVVRHPLASL

SEQ ID NO: 18038 - protein, 18 aa, Mycobacterium avium
VATLAGWLAAGGTLATAL

SEQ ID NO: 18039 - protein, 18 aa, Mycobacterium avium
VATLAGWLTAGGTLATAL

SEQ ID NO: 18040 - protein, 18 aa, Mycobacterium avium
VAVCANNIGVIWVAIEAT

SEQ ID NO: 18041 - protein, 23 aa, Mycobacterium avium
VAVGLAPDRLVTWATTIRYEALF

SEQ ID NO: 18042 - protein, 17 aa, Mycobacterium avium
VAVLMLIAGVVLSVKSV

SEQ ID NO: 18043 - protein, 20 aa, Mycobacterium avium
VAWLLGYLMRTQRLLVAEQI

SEQ ID NO: 18044 - protein, 19 aa, Mycobacterium avium
VCGNAAMVLGVPNPADINA

SEQ ID NO: 18045 - protein, 31 aa, Mycobacterium avium
VCLAGVAVSVCWWLLLRVYRRLNTAKFTVIN

SEQ ID NO: 18046 - protein, 21 aa, Mycobacterium avium
VCMRMTLSGFYSHPWAWNEIG

SEQ ID NO: 18047 - protein, 21 aa, Mycobacterium avium
VCPEDHWLWPSSFDPKHRVMR

SEQ ID NO: 18048 - protein, 18 aa, Mycobacterium avium
VCSAFLCAYLVTRWVQLP

SEQ ID NO: 18049 - protein, 19 aa, Mycobacterium avium
VCSAFLCAYLVTRWVQLPG

SEQ ID NO: 18050 - protein, 18 aa, Mycobacterium avium
VCSFAAGAKLRFNYDDSL

SEQ ID NO: 18051 - protein, 28 aa, Mycobacterium avium
VCVPELLIPVLLLNFTPMFGHPSHASPS

SEQ ID NO: 18052 - protein, 27 aa, Mycobacterium avium
VDAITKRLPTVFGLIAVVTFMLLFLLT

SEQ ID NO: 18053 - protein, 22 aa, Mycobacterium avium
VDALCVTMLIVIGIVGTLATWA

SEQ ID NO: 18054 - protein, 31 aa, Mycobacterium avium
VDGHAVAIGRPSWLAERGLRPDAALAAAAAR

SEQ ID NO: 18055 - protein, 28 aa, Mycobacterium avium
VDKLYTDRHIRLWVVYVDTFSGQTATRW

SEQ ID NO: 18056 - protein, 25 aa, Mycobacterium avium
VDLAAPWFIGTAMGLQVLGTFSVGQ

SEQ ID NO: 18057 - protein, 17 aa, Mycobacterium avium
VDLCWRLIEAGVRLRYE

SEQ ID NO: 18058 - protein, 23 aa, Mycobacterium avium
VDLRIAAAGAFIMAAGYLLSYIG

SEQ ID NO: 18059 - protein, 25 aa, Mycobacterium avium
VDNKVGYGLVDPVAALTFNIPPGDR

SEQ ID NO: 18060 - protein, 25 aa, Mycobacterium avium
VDNWVRRVLALPAFPGGSVDRPIQL

SEQ ID NO: 18061 - protein, 25 aa, Mycobacterium avium
VDNWVRRVLALPAFPGGTVDRPIQL

SEQ ID NO: 18062 - protein, 26 aa, Mycobacterium avium
VDNWVRRVLALPAFPGGTVDRPIQLV

SEQ ID NO: 18063 - protein, 21 aa, Mycobacterium avium
VDPVAALTWQLPAGDQPGPAA

SEQ ID NO: 18064 - protein, 17 aa, Mycobacterium avium
VDRILIGACAAIYLALL

SEQ ID NO: 18065 - protein, 23 aa, Mycobacterium avium
VDRLPARIVVGLLIAIGVAVAVG

SEQ ID NO: 18066 - protein, 25 aa, Mycobacterium avium
VDRSTWRMPPLALLEPVTWSPGTRL

SEQ ID NO: 18067 - protein, 27 aa, Mycobacterium avium
VDRSTWRMPPLTLLEPVTWSPGTRLAM

SEQ ID NO: 18068 - protein, 31 aa, Mycobacterium avium
VDRSTWRMPPLTLLEPVTWSPGTRLAMIALR

SEQ ID NO: 18069 - protein, 18 aa, Mycobacterium avium
VDTRRTWAAVVGVYTLIT

SEQ ID NO: 18070 - protein, 27 aa, Mycobacterium avium
VDVGGFAYAGGWLRPDSPLTPPRFADR

SEQ ID NO: 18071 - protein, 34 aa, Mycobacterium avium
VEAMARAVGYGAPITIAVPAYWSDDQFAALREEF

SEQ ID NO: 18072 - protein, 19 aa, Mycobacterium avium
VEAPAMRDAEPAPTATQTP

SEQ ID NO: 18073 - protein, 23 aa, Mycobacterium avium
VEGLAALIFSRYLWAFELTSALL

SEQ ID NO: 18074 - protein, 31 aa, Mycobacterium avium
VEGRVALSVPNDWPTQRLVGGPGSARVQVTS

SEQ ID NO: 18075 - protein, 22 aa, Mycobacterium avium
VEHKPRLARTIRVLALPIVLGW

SEQ ID NO: 18076 - protein, 37 aa, Mycobacterium avium
VEIGDLHWFYVYSGVMWACVFMRTGARRCISARPKNP

SEQ ID NO: 18077 - protein, 21 aa, Mycobacterium avium
VELFAGLLRSQRWWWGAVLLL

SEQ ID NO: 18078 - protein, 20 aa, Mycobacterium avium
VELPQAGGLYPGGNVTYRGV

SEQ ID NO: 18079 - protein, 29 aa, Mycobacterium avium
VEPDVVSWKLKPGVVSTMTAQARYTDPNT

SEQ ID NO: 18080 - protein, 27 aa, Mycobacterium avium
VERYIRMCRRLAGFSVINHGSTLSVGS

SEQ ID NO: 18081 - protein, 22 aa, Mycobacterium avium
VFAAMMACTIVTRRKFDPEATL

SEQ ID NO: 18082 - protein, 17 aa, Mycobacterium avium
VFAGFYIAGCVAAVLAV

SEQ ID NO: 18083 - protein, 26 aa, Mycobacterium avium
VFAYARRLLRRWRHDVLTANAISLAT

SEQ ID NO: 18084 - protein, 20 aa, Mycobacterium avium
VFDNPDFKRGLKMFLSPDGH

SEQ ID NO: 18085 - protein, 17 aa, Mycobacterium avium
VFHHGRSLLIATSNGAA

SEQ ID NO: 18086 - protein, 26 aa, Mycobacterium avium
VFHNIAFPGAFLLLALAATGYLVHLA

SEQ ID NO: 18087 - protein, 29 aa, Mycobacterium avium
VFLTGFDWTRWLTIVAFDVAIVFLLFAAR

SEQ ID NO: 18088 - protein, 21 aa, Mycobacterium avium
VFPTYRLDHQFEVIRKVGELT

SEQ ID NO: 18089 - protein, 22 aa, Mycobacterium avium
VFRGLPEVVIILLIGLGIGPIV

SEQ ID NO: 18090 - protein, 21 aa, Mycobacterium avium
VFTLFPIRPGLTLSNPAGGIV

SEQ ID NO: 18091 - protein, 25 aa, Mycobacterium avium
VGALLCLAGIALLAAIRWGLKDDGL

SEQ ID NO: 18092 - protein, 19 aa, Mycobacterium avium
VGALSSRIGAFAIVEMQKL

SEQ ID NO: 18093 - protein, 17 aa, Mycobacterium avium
VGALVFGLWADRVGRRL

SEQ ID NO: 18094 - protein, 27 aa, Mycobacterium avium
VGALVPRIRWPMWLRTLLATVALGAVL

SEQ ID NO: 18095 - protein, 28 aa, Mycobacterium avium
VGALVPRIRWPMWLRTLLATVALGAVLS

SEQ ID NO: 18096 - protein, 18 aa, Mycobacterium avium
VGATACWASTRAVASLAM

SEQ ID NO: 18097 - protein, 17 aa, Mycobacterium avium
VGAVKVAPAHYGVFSAI

SEQ ID NO: 18098 - protein, 17 aa, Mycobacterium avium
VGAVLVFGAITLRMQRR

SEQ ID NO: 18099 - protein, 25 aa, Mycobacterium avium
VGCLAGLVAVGWVWHSFTGRVRRLA

SEQ ID NO: 18100 - protein, 19 aa, Mycobacterium avium
VGDLFLLNFLTIVTEFIGI

SEQ ID NO: 18101 - protein, 17 aa, Mycobacterium avium
VGDRLRSGFAHDSATSV

SEQ ID NO: 18102 - protein, 22 aa, Mycobacterium avium
VGDRYLELIIGPGSMRVLPEGS

SEQ ID NO: 18103 - protein, 18 aa, Mycobacterium avium
VGFAAIVFLVVRYVVPPV

SEQ ID NO: 18104 - protein, 23 aa, Mycobacterium avium
VGFALAFLVARSFSSGCAALTGV

SEQ ID NO: 18105 - protein, 25 aa, Mycobacterium avium
VGGIVALAWALAFIRPHADQRPEVG

SEQ ID NO: 18106 - protein, 32 aa, Mycobacterium avium
VGGVTLLAVVAWRWRRFRAAAAAALLIDLAWV

SEQ ID NO: 18107 - protein, 18 aa, Mycobacterium avium
VGHCGDFYTAGPGNQLLT

SEQ ID NO: 18108 - protein, 19 aa, Mycobacterium avium
VGIIYRPLLFASVNPVVAE

SEQ ID NO: 18109 - protein, 22 aa, Mycobacterium avium
VGLAGIPLVGWLAEVSGTTTAF

SEQ ID NO: 18110 - protein, 21 aa, Mycobacterium avium
VGLAVIFSYVWGVRVGGLFTA

SEQ ID NO: 18111 - protein, 17 aa, Mycobacterium avium
VGLECLFAKALKADPLL

SEQ ID NO: 18112 - protein, 17 aa, Mycobacterium avium
VGLEIYGRMSASQPPGW

SEQ ID NO: 18113 - protein, 17 aa, Mycobacterium avium
VGPFAGGVRAWAGPSGV

SEQ ID NO: 18114 - protein, 21 aa, Mycobacterium avium
VGPLLRPGYLLLRDAVSTPRS

SEQ ID NO: 18115 - protein, 22 aa, Mycobacterium avium
VGPTLRIGHIHFPLIMAVYDSF

SEQ ID NO: 18116 - protein, 17 aa, Mycobacterium avium
VGRRLPLMVDVMFYSVV

SEQ ID NO: 18117 - protein, 31 aa, Mycobacterium avium
VGRVEFAHVSFAYRPGIRVIDDLSLVAEPGS

SEQ ID NO: 18118 - protein, 17 aa, Mycobacterium avium
VGTAWRRSLQLRVVALT

SEQ ID NO: 18119 - protein, 18 aa, Mycobacterium avium
VGVDGFFAISGFLITRSW

SEQ ID NO: 18120 - protein, 25 aa, Mycobacterium avium
VGVIGFCMGGGFALLTANTGYDAAA

SEQ ID NO: 18121 - protein, 19 aa, Mycobacterium avium
VGVLRDGQKWVALAVPGYA

SEQ ID NO: 18122 - protein, 20 aa, Mycobacterium avium
VGVLRDGQKWVALAVPGYAL

SEQ ID NO: 18123 - protein, 20 aa, Mycobacterium avium
VHPVAMLGFMVLISGAFVAA

SEQ ID NO: 18124 - protein, 25 aa, Mycobacterium avium
VHRSEILLADALRALAYAATGGRAQ

SEQ ID NO: 18125 - protein, 17 aa, Mycobacterium avium
VHSAEQAIRAHLSSPPP

SEQ ID NO: 18126 - protein, 17 aa, Mycobacterium avium
VHSALLSAGPGPGPLLA

SEQ ID NO: 18127 - protein, 18 aa, Mycobacterium avium
VIKGWHRAEVHGLDDFPS

SEQ ID NO: 18128 - protein, 31 aa, Mycobacterium avium
VILCGPGRYGLDARRGWAHRPFIGSFVALLA

SEQ ID NO: 18129 - protein, 25 aa, Mycobacterium avium
VINSALPRWLWTRGSALVSAMWGVA

SEQ ID NO: 18130 - protein, 17 aa, Mycobacterium avium
VIPGSYRNRHRAVNGAM

SEQ ID NO: 18131 - protein, 17 aa, Mycobacterium avium
VIPGSYRNRHRAVNGSM

SEQ ID NO: 18132 - protein, 21 aa, Mycobacterium avium
VIRLHWPAMMPLGYLNLAIWL

SEQ ID NO: 18133 - protein, 18 aa, Mycobacterium avium
VIRLVRRLVPALVVVLAG

SEQ ID NO: 18134 - protein, 19 aa, Mycobacterium avium
VIRPVIKGWHRAEVHGLDD

SEQ ID NO: 18135 - protein, 31 aa, Mycobacterium avium
VITLTVMAVFYLRLPATFGIGTYGVSADFVA

SEQ ID NO: 18136 - protein, 18 aa, Mycobacterium avium
VITSLTWGAGRLNNAVGE

SEQ ID NO: 18137 - protein, 19 aa, Mycobacterium avium
VKAFYGYDRPLWVQYFAQL

SEQ ID NO: 18138 - protein, 22 aa, Mycobacterium avium
VKDLLSGFFILAERQYGFGDLV

SEQ ID NO: 18139 - protein, 19 aa, Mycobacterium avium
VKFGVFAAVMLMLTTSLFF

SEQ ID NO: 18140 - protein, 17 aa, Mycobacterium avium
VKGLGIAAGAKRPGAKK

SEQ ID NO: 18141 - protein, 25 aa, Mycobacterium avium
VKIALYVLGGWLFAWSTRGIGGFAE

SEQ ID NO: 18142 - protein, 25 aa, Mycobacterium avium
VKIALYVLGGWLFAWSTRGIGGFTE

SEQ ID NO: 18143 - protein, 23 aa, Mycobacterium avium
VKLSFPEAWIPGAAKPADREPVA

SEQ ID NO: 18144 - protein, 21 aa, Mycobacterium avium
VKLSFPNAWIPGAAKPADREP

SEQ ID NO: 18145 - protein, 23 aa, Mycobacterium avium
VLAAVGLACWRSRRRSDPVTLPL

SEQ ID NO: 18146 - protein, 24 aa, Mycobacterium avium
VLAELVVVVLLMWSNHLVASPHWA

SEQ ID NO: 18147 - protein, 23 aa, Mycobacterium avium
VLAELVVVVLLMWSNNLVASPHW

SEQ ID NO: 18148 - protein, 22 aa, Mycobacterium avium
VLAIGLVRWYFGHGQRSTTAAG

SEQ ID NO: 18149 - protein, 27 aa, Mycobacterium avium
VLAIWLRRRLANLAARLVTSLCGLVAA

SEQ ID NO: 18150 - protein, 18 aa, Mycobacterium avium
VLAPLVLRLTLSIPALRR

SEQ ID NO: 18151 - protein, 28 aa, Mycobacterium avium
VLAVRPELLPALSGQNWAALPGLQTNPN

SEQ ID NO: 18152 - protein, 19 aa, Mycobacterium avium
VLAVVWFFLLKRYTVEGPL

SEQ ID NO: 18153 - protein, 35 aa, Mycobacterium avium
VLDLEPRGPLPTEIYWRRRGLAVGIAVVVMGVVAA

SEQ ID NO: 18154 - protein, 17 aa, Mycobacterium avium
VLFLPYSLLGPFAGALM

SEQ ID NO: 18155 - protein, 18 aa, Mycobacterium avium
VLHRAWVGPMILVVLDDP

SEQ ID NO: 18156 - protein, 19 aa, Mycobacterium avium
VLIGVGLAVIFSYVWGVRV

SEQ ID NO: 18157 - protein, 21 aa, Mycobacterium avium
VLIVLFGWWGGLYFTTLLRRR

SEQ ID NO: 18158 - protein, 20 aa, Mycobacterium avium
VLIYQWARVVWSRTIVQLAA

SEQ ID NO: 18159 - protein, 24 aa, Mycobacterium avium
VLKRTGRLSLRHALDMLEQTGRAL

SEQ ID NO: 18160 - protein, 18 aa, Mycobacterium avium
VLLGWRVAAGLTLRRRSD

SEQ ID NO: 18161 - protein, 18 aa, Mycobacterium avium
VLLIYLWVGIVAFGAAST

SEQ ID NO: 18162 - protein, 18 aa, Mycobacterium avium
VLLTRGRHTNVSQEDQVR

SEQ ID NO: 18163 - protein, 26 aa, Mycobacterium avium
VLLWQYLLGLKLHWMVLAMAVILLLA

SEQ ID NO: 18164 - protein, 19 aa, Mycobacterium avium
VLMAIPFGAMVAVQLSGLV

SEQ ID NO: 18165 - protein, 22 aa, Mycobacterium avium
VLMLGQCRVLFAMARDGLLPRA

SEQ ID NO: 18166 - protein, 22 aa, Mycobacterium avium
VLPFVWIAWTALRNFRSGTTVQ

SEQ ID NO: 18167 - protein, 19 aa, Mycobacterium avium
VLRWSWRLMNYRFPMNSTD

SEQ ID NO: 18168 - protein, 21 aa, Mycobacterium avium
VLSGLRPGERVLVHTATGGVG

SEQ ID NO: 18169 - protein, 19 aa, Mycobacterium avium
VLTLNGWVAFNLPRTVTAL

SEQ ID NO: 18170 - protein, 17 aa, Mycobacterium avium
VLTWLAVLSCYDIRQHR

SEQ ID NO: 18171 - protein, 18 aa, Mycobacterium avium
VLTWLAVLSCYDIRQHRL

SEQ ID NO: 18172 - protein, 23 aa, Mycobacterium avium
VLVAELAAGFALTVPIVTATSAL

SEQ ID NO: 18173 - protein, 18 aa, Mycobacterium avium
VLVASRWLLRSDRASRLT

SEQ ID NO: 18174 - protein, 29 aa, Mycobacterium avium
VLVGWSLGGALAYACAIGLKRAGADVRFV

SEQ ID NO: 18175 - protein, 26 aa, Mycobacterium avium
VLVLGWRTARRWRRGAAVLAVPLCSL

SEQ ID NO: 18176 - protein, 17 aa, Mycobacterium avium
VLWLGRYRSRTMGVLAY

SEQ ID NO: 18177 - protein, 20 aa, Mycobacterium avium
VLYALRWPVTVVVSGDEDAH

SEQ ID NO: 18178 - protein, 21 aa, Mycobacterium avium
VMCSAGGWIHGQRQSLLQNAT

SEQ ID NO: 18179 - protein, 18 aa, Mycobacterium avium
VMGLLLVMRYRGRRRRAA

SEQ ID NO: 18180 - protein, 27 aa, Mycobacterium avium
VMWIGYRHGWGWLARMDWSFLNGTRDL

SEQ ID NO: 18181 - protein, 28 aa, Mycobacterium avium
VNGKPWLVFGPYAGWSPKFLKHGHFTDL

SEQ ID NO: 18182 - protein, 21 aa, Mycobacterium avium
VNRLLLPVITGWSLGRALAGI

SEQ ID NO: 18183 - protein, 22 aa, Mycobacterium avium
VNRLLLPVITGWSLGRALAGIA

SEQ ID NO: 18184 - protein, 18 aa, Mycobacterium avium
VPAAIMLWLLLRLPESPR

SEQ ID NO: 18185 - protein, 17 aa, Mycobacterium avium
VPAFLPAVIVVAVVLYV

SEQ ID NO: 18186 - protein, 32 aa, Mycobacterium avium
VPAGLLILIFGFPWYWFSPRSSAPAPSVAAPT

SEQ ID NO: 18187 - protein, 19 aa, Mycobacterium avium
VPARVNAVVMFQVADPRKA

SEQ ID NO: 18188 - protein, 21 aa, Mycobacterium avium
VPARVNAVVMFQVVDPLKAIL

SEQ ID NO: 18189 - protein, 26 aa, Mycobacterium avium
VPEDRFDRCRAFAAAVSRECDGAAAI

SEQ ID NO: 18190 - protein, 17 aa, Mycobacterium avium
VPGFAWWAAALNSLPLL

SEQ ID NO: 18191 - protein, 20 aa, Mycobacterium avium
VPGPGARLVTTMTRHPGGAS

SEQ ID NO: 18192 - protein, 22 aa, Mycobacterium avium
VPHRDMVPIWVAAGGLFGALLI

SEQ ID NO: 18193 - protein, 31 aa, Mycobacterium avium
VPHTPEFRWLMSSDVCKHCTHAGCLDVCPTG

SEQ ID NO: 18194 - protein, 19 aa, Mycobacterium avium
VPLAAGFMALVFIASMVAG

SEQ ID NO: 18195 - protein, 17 aa, Mycobacterium avium
VPLASWTAGSREVACSI

SEQ ID NO: 18196 - protein, 22 aa, Mycobacterium avium
VPLSLLATRVIVRRSQRLFVAQ

SEQ ID NO: 18197 - protein, 19 aa, Mycobacterium avium
VPLTCWIAGLYGTVRGLTL

SEQ ID NO: 18198 - protein, 22 aa, Mycobacterium avium
VPLWCLSSLAGYLATRTLVVVA

SEQ ID NO: 18199 - protein, 17 aa, Mycobacterium avium
VPTRNALVFGLVLTAGS

SEQ ID NO: 18200 - protein, 25 aa, Mycobacterium avium
VPTWAGVAYVCFLTDAFSRMIIGWR

SEQ ID NO: 18201 - protein, 21 aa, Mycobacterium avium
VPVAGAGRRRWVCAAAAIGAA

SEQ ID NO: 18202 - protein, 17 aa, Mycobacterium avium
VPVDCAAPHAMEVTGTV

SEQ ID NO: 18203 - protein, 25 aa, Mycobacterium avium
VPVFATDFYARFGYDRPVYTLTHDI

SEQ ID NO: 18204 - protein, 17 aa, Mycobacterium avium
VPVPVRIPVPDPVSPPQ

SEQ ID NO: 18205 - protein, 17 aa, Mycobacterium avium
VPVSIALLLSWRFAPRA

SEQ ID NO: 18206 - protein, 22 aa, Mycobacterium avium
VQEMTVRLGIVTGRGHGSLIRE

SEQ ID NO: 18207 - protein, 25 aa, Mycobacterium avium
VQIPRFLRKLLRELAPAPDTDRSES

SEQ ID NO: 18208 - protein, 19 aa, Mycobacterium avium
VQPALWLLVFGTTFSHLHM

SEQ ID NO: 18209 - protein, 21 aa, Mycobacterium avium
VRAACAAGVRAVVLTNAAGGL

SEQ ID NO: 18210 - protein, 23 aa, Mycobacterium avium
VRDHYTCRYCSVSLAAEPHLLLE

SEQ ID NO: 18211 - protein, 24 aa, Mycobacterium avium
VRGAAFCLVALTLAAAAGAVRARL

SEQ ID NO: 18212 - protein, 22 aa, Mycobacterium avium
VRGKVILIDFWAYSCINCQRAI

SEQ ID NO: 18213 - protein, 20 aa, Mycobacterium avium
VRIAPHFVRVRMTSPTLFED

SEQ ID NO: 18214 - protein, 17 aa, Mycobacterium avium
VRKIVKLSFPDAWVPGA

SEQ ID NO: 18215 - protein, 17 aa, Mycobacterium avium
VRKIVKLSFPEAWIPGA

SEQ ID NO: 18216 - protein, 17 aa, Mycobacterium avium
VRKIVKLSFPNAWIPGA

SEQ ID NO: 18217 - protein, 17 aa, Mycobacterium avium
VRLTVGAAFPAADYLAH

SEQ ID NO: 18218 - protein, 17 aa, Mycobacterium avium
VRPEAAAVLKKLRANGI

SEQ ID NO: 18219 - protein, 17 aa, Mycobacterium avium
VRPLWLLLTQSLPRSLH

SEQ ID NO: 18220 - protein, 23 aa, Mycobacterium avium
VRQLFTVRIGLRLTEATQTTMVL

SEQ ID NO: 18221 - protein, 25 aa, Mycobacterium avium
VRRDADCAVHTDIRPARLLADPTAM

SEQ ID NO: 18222 - protein, 17 aa, Mycobacterium avium
VRRPRSLRRGSRPVRRA

SEQ ID NO: 18223 - protein, 26 aa, Mycobacterium avium
VRSSEQIMPLFVVTVMAQLVLCGGMV

SEQ ID NO: 18224 - protein, 18 aa, Mycobacterium avium
VRVGDTWHPVLNLASARL

SEQ ID NO: 18225 - protein, 19 aa, Mycobacterium avium
VRVGLAFSLLAACVALPWL

SEQ ID NO: 18226 - protein, 23 aa, Mycobacterium avium
VRWPWLVIGFWAALAVALPLAFP

SEQ ID NO: 18227 - protein, 17 aa, Mycobacterium avium
VSAIVGAFAAHRGYRHW

SEQ ID NO: 18228 - protein, 17 aa, Mycobacterium avium
VSALFIWMQARLLNRTV

SEQ ID NO: 18229 - protein, 18 aa, Mycobacterium avium
VSALNRPVSTTGESGNQN

SEQ ID NO: 18230 - protein, 17 aa, Mycobacterium avium
VSDRLKFAAWLVFAGLW

SEQ ID NO: 18231 - protein, 18 aa, Mycobacterium avium
VSDRLKFAAWLVFAGLWA

SEQ ID NO: 18232 - protein, 26 aa, Mycobacterium avium
VSDRLKFAAWLVFAGLWATFVYFPVA

SEQ ID NO: 18233 - protein, 33 aa, Mycobacterium avium
VSFTVPARGVWWWVGVCVLGVVTLLALVNRLLL

SEQ ID NO: 18234 - protein, 17 aa, Mycobacterium avium
VSGLHLIATFSTLAAAF

SEQ ID NO: 18235 - protein, 18 aa, Mycobacterium avium
VSGSRSFRLTVPGTGTPG

SEQ ID NO: 18236 - protein, 29 aa, Mycobacterium avium
VSHPASPAKRAWLPIAIAVIAVVVVVVLL

SEQ ID NO: 18237 - protein, 17 aa, Mycobacterium avium
VSKGLFYGGGWAQLERQ

SEQ ID NO: 18238 - protein, 26 aa, Mycobacterium avium
VSLAGFQHAWFFLALLAVLLVIGLYV

SEQ ID NO: 18239 - protein, 23 aa, Mycobacterium avium
VSLAGFQHAWFFLFLLAVLLVIG

SEQ ID NO: 18240 - protein, 20 aa, Mycobacterium avium
VSLAPTLLVAIPFTVLVSFT

SEQ ID NO: 18241 - protein, 31 aa, Mycobacterium avium
VSLRTRGRWLRWGLLSVWGPGLVVMLADTDA

SEQ ID NO: 18242 - protein, 25 aa, Mycobacterium avium
VSNLLRTVLGLTRIHPALLHTLSLA

SEQ ID NO: 18243 - protein, 33 aa, Mycobacterium avium
VSPAVLRWSRNRMAFLAALLFMMALCFATTNGW

SEQ ID NO: 18244 - protein, 25 aa, Mycobacterium avium
VSVVGWVFAVRAFLLMAFPHAFMAA

SEQ ID NO: 18245 - protein, 20 aa, Mycobacterium avium
VTALPAVLMAIPFGAMVAVQ

SEQ ID NO: 18246 - protein, 21 aa, Mycobacterium avium
VTAVGGWFFGWLTDRCGSLAA

SEQ ID NO: 18247 - protein, 24 aa, Mycobacterium avium
VTFSDGRTAPFTVVGADPTSDIAV

SEQ ID NO: 18248 - protein, 21 aa, Mycobacterium avium
VTGLAGCFVFSLIRPNGTAGT

SEQ ID NO: 18249 - protein, 17 aa, Mycobacterium avium
VTGQALRDFILEQRKIR

SEQ ID NO: 18250 - protein, 18 aa, Mycobacterium avium
VTLFWVAFILTRPLGATV

SEQ ID NO: 18251 - protein, 17 aa, Mycobacterium avium
VTLLGGTGIMFAVYGRW

SEQ ID NO: 18252 - protein, 23 aa, Mycobacterium avium
VTLMDGRAGFAPVGPSLRYTDFS

SEQ ID NO: 18253 - protein, 23 aa, Mycobacterium avium
VTLRLVARTLPGKQFEVGRQLRV

SEQ ID NO: 18254 - protein, 17 aa, Mycobacterium avium
VTLSIQFALLANQVGAT

SEQ ID NO: 18255 - protein, 24 aa, Mycobacterium avium
VTPGSFWLSFGSFAKMVDLWFTMG

SEQ ID NO: 18256 - protein, 29 aa, Mycobacterium avium
VTPRTGAAPGPWRLLLRDLAHLLDTASIV

SEQ ID NO: 18257 - protein, 22 aa, Mycobacterium avium
VTRPSTFLWLIAAVGTLLVVAG

SEQ ID NO: 18258 - protein, 23 aa, Mycobacterium avium
VTRWLADHRDLWLTTVLQAITVA

SEQ ID NO: 18259 - protein, 21 aa, Mycobacterium avium
VTTAIRCHRGGREAPFAELTV

SEQ ID NO: 18260 - protein, 17 aa, Mycobacterium avium
VTVELPQAGGLYPGGNV

SEQ ID NO: 18261 - protein, 17 aa, Mycobacterium avium
VTVTTAIRCHRGGREAP

SEQ ID NO: 18262 - protein, 24 aa, Mycobacterium avium
VTVVGLAALGGWFGYQTYQSHQAQ

SEQ ID NO: 18263 - protein, 18 aa, Mycobacterium avium
VVAICGPAPASVTAVPRT

SEQ ID NO: 18264 - protein, 27 aa, Mycobacterium avium
VVAQWVWGPGGWLARLGVLDYAGGLVV

SEQ ID NO: 18265 - protein, 21 aa, Mycobacterium avium
VVAWLLGYLMRTQRLLVPEQI

SEQ ID NO: 18266 - protein, 24 aa, Mycobacterium avium
VVFPLPVDIITPFLRNPGLLQGVV

SEQ ID NO: 18267 - protein, 25 aa, Mycobacterium avium
VVFVGRLGDMFGRVRIYNAGFAVFT

SEQ ID NO: 18268 - protein, 19 aa, Mycobacterium avium
VVGACGWAFLIWGLYAYLW

SEQ ID NO: 18269 - protein, 20 aa, Mycobacterium avium
VVGACGWAFLIWGLYAYLWA

SEQ ID NO: 18270 - protein, 23 aa, Mycobacterium avium
VVGACGWAFLIWGLYAYLWAFAQ

SEQ ID NO: 18271 - protein, 21 aa, Mycobacterium avium
VVGELAALVILSGPIDQRLDE

SEQ ID NO: 18272 - protein, 19 aa, Mycobacterium avium
VVHGGLFAATYVLLGLLVM

SEQ ID NO: 18273 - protein, 25 aa, Mycobacterium avium
VVLALSGIVPWWFVVVLLVRDGLLA

SEQ ID NO: 18274 - protein, 23 aa, Mycobacterium avium
VVLGAGLIGYGIFRWQTRHRHSE

SEQ ID NO: 18275 - protein, 19 aa, Mycobacterium avium
VVLLIYLWVGIVAFGAAST

SEQ ID NO: 18276 - protein, 20 aa, Mycobacterium avium
VVLLLAVATLAGWLAAGGTL

SEQ ID NO: 18277 - protein, 19 aa, Mycobacterium avium
VVLLLAVATLAGWLTAGGT

SEQ ID NO: 18278 - protein, 18 aa, Mycobacterium avium
VVMARVAPNTVFLFLLNS

SEQ ID NO: 18279 - protein, 23 aa, Mycobacterium avium
VVRGKVILIDFWAYSCINCQRAI

SEQ ID NO: 18280 - protein, 22 aa, Mycobacterium avium
VVSRLLPDRMLIGIDDLERETS

SEQ ID NO: 18281 - protein, 18 aa, Mycobacterium avium
VVTMLALLVLSTPTFVIA

SEQ ID NO: 18282 - protein, 32 aa, Mycobacterium avium
VVVAGIGGVFSRRWAKVWLPITAAVYTANGLM

SEQ ID NO: 18283 - protein, 26 aa, Mycobacterium avium
VVVDWCATLDGLGGRRVDLPTYGFVR

SEQ ID NO: 18284 - protein, 19 aa, Mycobacterium avium
VVVLRGREAPPSAVPPGVL

SEQ ID NO: 18285 - protein, 24 aa, Mycobacterium avium
VVVYPSWWPPARVRTVSAAAATLA

SEQ ID NO: 18286 - protein, 18 aa, Mycobacterium avium
VWLIGWRVIQGVGGAILM

SEQ ID NO: 18287 - protein, 17 aa, Mycobacterium avium
VYGRWSQKVGWHSAETS

SEQ ID NO: 18288 - protein, 17 aa, Mycobacterium avium
VYHRPHFVQKVVNSDGQ

SEQ ID NO: 18289 - protein, 24 aa, Mycobacterium avium
WAAGVLGALAIIIAVLIVINSRAD

SEQ ID NO: 18290 - protein, 24 aa, Mycobacterium avium
WAARLASVSVDWWATAVAGVIVAL

SEQ ID NO: 18291 - protein, 17 aa, Mycobacterium avium
WAFFSHQVAFLFTFPNN

SEQ ID NO: 18292 - protein, 17 aa, Mycobacterium avium
WAFLIWGLYAYLWAFAQ

SEQ ID NO: 18293 - protein, 21 aa, Mycobacterium avium
WAGGRGDGWRSVPRAVYAFDV

SEQ ID NO: 18294 - protein, 23 aa, Mycobacterium avium
WAGMPLFAARCAATVAVAAASWW

SEQ ID NO: 18295 - protein, 18 aa, Mycobacterium avium
WAGTKSKALLRVLAVAGF

SEQ ID NO: 18296 - protein, 29 aa, Mycobacterium avium
WAGVTSLSIPSWWQPYVLSVASLTPDGQP

SEQ ID NO: 18297 - protein, 17 aa, Mycobacterium avium
WALIPSGVLQAVITLIQ

SEQ ID NO: 18298 - protein, 18 aa, Mycobacterium avium
WAPASPWATPPPLVMVLG

SEQ ID NO: 18299 - protein, 21 aa, Mycobacterium avium
WARARWPRVHPLVLSLVTAGP

SEQ ID NO: 18300 - protein, 17 aa, Mycobacterium avium
WASHGMLERGGWHLVFG

SEQ ID NO: 18301 - protein, 19 aa, Mycobacterium avium
WATTIRYEALFSEAGGLLP

SEQ ID NO: 18302 - protein, 17 aa, Mycobacterium avium
WAYSCINCQRAIPHVID

SEQ ID NO: 18303 - protein, 20 aa, Mycobacterium avium
WCAIRVVPLDVYWMSYYAAD

SEQ ID NO: 18304 - protein, 19 aa, Mycobacterium avium
WCAMLDGLGGRRVDLPTYG

SEQ ID NO: 18305 - protein, 21 aa, Mycobacterium avium
WCAVSLPAAALFAAARAALDR

SEQ ID NO: 18306 - protein, 17 aa, Mycobacterium avium
WCNAKFVLVGAGGDALP

SEQ ID NO: 18307 - protein, 19 aa, Mycobacterium avium
WDEVKQSLTQLAVQLGPTA

SEQ ID NO: 18308 - protein, 17 aa, Mycobacterium avium
WDGHGLLGLEESMDSVL

SEQ ID NO: 18309 - protein, 20 aa, Mycobacterium avium
WEALEHARIPASSLRGEAVG

SEQ ID NO: 18310 - protein, 20 aa, Mycobacterium avium
WEALERAGIDPATLRGSATG

SEQ ID NO: 18311 - protein, 21 aa, Mycobacterium avium
WEAVDNRLGRRVAVKVLKQEF

SEQ ID NO: 18312 - protein, 22 aa, Mycobacterium avium
WEFLDLPRLWQILLTVGLFLWI

SEQ ID NO: 18313 - protein, 26 aa, Mycobacterium avium
WEKHCYDIPICFSLRSIFDAIDGVDE

SEQ ID NO: 18314 - protein, 25 aa, Mycobacterium avium
WERHLDELLELFVAEFHRCGGPALD

SEQ ID NO: 18315 - protein, 17 aa, Mycobacterium avium
WEYEGRIYPYIGLNAVA

SEQ ID NO: 18316 - protein, 22 aa, Mycobacterium avium
WFFGWLTDRCGSLAAPMLAHLA

SEQ ID NO: 18317 - protein, 24 aa, Mycobacterium avium
WFGELGYRSVFSTVLVTRFVVFFI

SEQ ID NO: 18318 - protein, 19 aa, Mycobacterium avium
WFLQTSMCMFFKARSDVAR

SEQ ID NO: 18319 - protein, 25 aa, Mycobacterium avium
WFSERRVGIPFGFGVIFAITGMTAV

SEQ ID NO: 18320 - protein, 17 aa, Mycobacterium avium
WGALNFVAGLGELFTSR

SEQ ID NO: 18321 - protein, 20 aa, Mycobacterium avium
WGGGFERGFEAGRDAAFADA

SEQ ID NO: 18322 - protein, 17 aa, Mycobacterium avium
WGHQWTIVTCWFGVIVW

SEQ ID NO: 18323 - protein, 17 aa, Mycobacterium avium
WGVTCFITVAAGAVQVL

SEQ ID NO: 18324 - protein, 19 aa, Mycobacterium avium
WHPVAPRLADTGRYEVFAP

SEQ ID NO: 18325 - protein, 21 aa, Mycobacterium avium
WIASFFLFPGFNPPMSPSLPA

SEQ ID NO: 18326 - protein, 26 aa, Mycobacterium avium
WKRYGRAALVVAVYAGAFGLAAGLGW

SEQ ID NO: 18327 - protein, 17 aa, Mycobacterium avium
WLAAARIGMGWPLTVLA

SEQ ID NO: 18328 - protein, 19 aa, Mycobacterium avium
WLAAARIGMGWPLTVLAAL

SEQ ID NO: 18329 - protein, 19 aa, Mycobacterium avium
WLAGLRWRRHGIRAALEPL

SEQ ID NO: 18330 - protein, 18 aa, Mycobacterium avium
WLGALGFAALAVYWLYRF

SEQ ID NO: 18331 - protein, 18 aa, Mycobacterium avium
WLGAPGFAALAVYWLYRF

SEQ ID NO: 18332 - protein, 26 aa, Mycobacterium avium
WLIDTSSWRWIFLINVPIGLVTVALA

SEQ ID NO: 18333 - protein, 19 aa, Mycobacterium avium
WLIPGWTGRVLVWALAIGA

SEQ ID NO: 18334 - protein, 17 aa, Mycobacterium avium
WLIVGGAAMFAAFPGWY

SEQ ID NO: 18335 - protein, 24 aa, Mycobacterium avium
WLLFQWRWSIVALWFTAVFLLIMV

SEQ ID NO: 18336 - protein, 18 aa, Mycobacterium avium
WLLIVMLLARLFASHGLA

SEQ ID NO: 18337 - protein, 18 aa, Mycobacterium avium
WLLIVMLLARLFASHGLS

SEQ ID NO: 18338 - protein, 18 aa, Mycobacterium avium
WLPQRPVLVPGTVDENLR

SEQ ID NO: 18339 - protein, 17 aa, Mycobacterium avium
WLRFGIFYYSEAVGPTL

SEQ ID NO: 18340 - protein, 20 aa, Mycobacterium avium
WLRVDHWLNVLFVTLIIRSG

SEQ ID NO: 18341 - protein, 21 aa, Mycobacterium avium
WLTPARWGYAAGASSIDFPSL

SEQ ID NO: 18342 - protein, 17 aa, Mycobacterium avium
WMAAAGIALAVAAALVT

SEQ ID NO: 18343 - protein, 18 aa, Mycobacterium avium
WMGVVIWITYVFNMTMFA

SEQ ID NO: 18344 - protein, 28 aa, Mycobacterium avium
WMRLPDLFAGIVCWLLLSREVLPRLGPA

SEQ ID NO: 18345 - protein, 24 aa, Mycobacterium avium
WPAKRAGTAAALWELSEELTGTSF

SEQ ID NO: 18346 - protein, 20 aa, Mycobacterium avium
WPHRVPGAAACCDFSTASSW

SEQ ID NO: 18347 - protein, 26 aa, Mycobacterium avium
WPPAFALAGIIAFEFNMGVTRQSSWW

SEQ ID NO: 18348 - protein, 18 aa, Mycobacterium avium
WPRSCAANGSGDRQPMAD

SEQ ID NO: 18349 - protein, 34 aa, Mycobacterium avium
WPSMNRGWCLLRTRWARRVARILPVLGLAGLAAA

SEQ ID NO: 18350 - protein, 17 aa, Mycobacterium avium
WPTDPSWLYRATQGLHV

SEQ ID NO: 18351 - protein, 17 aa, Mycobacterium avium
WPVPLLAFIILVAVGAD

SEQ ID NO: 18352 - protein, 17 aa, Mycobacterium avium
WPYLVCAALTGLGGGNY

SEQ ID NO: 18353 - protein, 21 aa, Mycobacterium avium
WQERPCPTIAGNPCIPGPNGT

SEQ ID NO: 18354 - protein, 21 aa, Mycobacterium avium
WQERPCPTIAGNPCVPGPNGT

SEQ ID NO: 18355 - protein, 17 aa, Mycobacterium avium
WQGRRPGPLVAEELPVV

SEQ ID NO: 18356 - protein, 19 aa, Mycobacterium avium
WQRGDEIFAEVALPDDAAA

SEQ ID NO: 18357 - protein, 19 aa, Mycobacterium avium
WQRGDEIFAEVSLPDDAAA

SEQ ID NO: 18358 - protein, 19 aa, Mycobacterium avium
WQRLNGVAVVSVPGQDPVT

SEQ ID NO: 18359 - protein, 19 aa, Mycobacterium avium
WRATARSGLLLIAVWALGS

SEQ ID NO: 18360 - protein, 24 aa, Mycobacterium avium
WRERRDLFSGFAWLAVVALAVAGA

SEQ ID NO: 18361 - protein, 20 aa, Mycobacterium avium
WRGVWAGWWLGTAVVATVGA

SEQ ID NO: 18362 - protein, 17 aa, Mycobacterium avium
WRNPLSYDPLGRVPPPE

SEQ ID NO: 18363 - protein, 23 aa, Mycobacterium avium
WRPIRSYFYWEKHCYDIPICFSL

SEQ ID NO: 18364 - protein, 17 aa, Mycobacterium avium
WRPTVALLTAVVLVTTG

SEQ ID NO: 18365 - protein, 23 aa, Mycobacterium avium
WRQRFVTAWAGFRGAVSLAAAVA

SEQ ID NO: 18366 - protein, 17 aa, Mycobacterium avium
WRRDRNLVYFLFASALF

SEQ ID NO: 18367 - protein, 17 aa, Mycobacterium avium
WRTMPAVIWEVTAPAGR

SEQ ID NO: 18368 - protein, 18 aa, Mycobacterium avium
WRTTVALLTAVVLVTTGA

SEQ ID NO: 18369 - protein, 22 aa, Mycobacterium avium
WSAACALAYLRGFGRKPAWVLA

SEQ ID NO: 18370 - protein, 19 aa, Mycobacterium avium
WSISAEWLAYVLFAGLVLV

SEQ ID NO: 18371 - protein, 17 aa, Mycobacterium avium
WSMHPSLSMFLSRVETL

SEQ ID NO: 18372 - protein, 18 aa, Mycobacterium avium
WSMHPSLSMFLSRVETLI

SEQ ID NO: 18373 - protein, 18 aa, Mycobacterium avium
WSSFPAPSTSVWTNGHRA

SEQ ID NO: 18374 - protein, 17 aa, Mycobacterium avium
WSVALALALRTFPMLID

SEQ ID NO: 18375 - protein, 17 aa, Mycobacterium avium
WSWAGGRGDGWRSVPRA

SEQ ID NO: 18376 - protein, 27 aa, Mycobacterium avium
WTDHPRADQLRRALGDSGVHNVAVLSE

SEQ ID NO: 18377 - protein, 19 aa, Mycobacterium avium
WTLIFEIFCYIAIAVAGVA

SEQ ID NO: 18378 - protein, 17 aa, Mycobacterium avium
WTLLKVTALPAVLMAIP

SEQ ID NO: 18379 - protein, 25 aa, Mycobacterium avium
WTNWLEVFLILVIGFSLPRTFGRMV

SEQ ID NO: 18380 - protein, 17 aa, Mycobacterium avium
WTPCLGPTLAGVITVAS

SEQ ID NO: 18381 - protein, 19 aa, Mycobacterium avium
WTPGTDWGGWLMRRCTRLF

SEQ ID NO: 18382 - protein, 20 aa, Mycobacterium avium
WTPGTNWGGWLMRRCTRLFR

SEQ ID NO: 18383 - protein, 19 aa, Mycobacterium avium
WTRRIFYRLTHVLDPLIAL

SEQ ID NO: 18384 - protein, 25 aa, Mycobacterium avium
WVAAGGLFGALLIGGAVFGTAMLMK

SEQ ID NO: 18385 - protein, 25 aa, Mycobacterium avium
WVAARLPWVVIRSFDGLGPPKAVTL

SEQ ID NO: 18386 - protein, 17 aa, Mycobacterium avium
WVIGSLLLILAMFEGYF

SEQ ID NO: 18387 - protein, 24 aa, Mycobacterium avium
WVLAELVVVVLLMWSNNLVASPHW

SEQ ID NO: 18388 - protein, 19 aa, Mycobacterium avium
WVQAGRLLLRWRRDQAVLM

SEQ ID NO: 18389 - protein, 25 aa, Mycobacterium avium
WVSARFGWSMLKSMLVLAIPVNYIW

SEQ ID NO: 18390 - protein, 17 aa, Mycobacterium avium
WVSLMFLSAALVVDIGG

SEQ ID NO: 18391 - protein, 32 aa, Mycobacterium avium
WWQTFWRITLPSIRWGLTYGIVLTIARTLGEY

SEQ ID NO: 18392 - protein, 18 aa, Mycobacterium avium
WWRLASMLGAILALHLIG

SEQ ID NO: 18393 - protein, 34 aa, Mycobacterium avium
YAAAALGRWAGFSVAWLYWYFWVIVVGFEAVAGG

SEQ ID NO: 18394 - protein, 17 aa, Mycobacterium avium
YAAAHLPYLAWLQQASA

SEQ ID NO: 18395 - protein, 18 aa, Mycobacterium avium
YAAAHLPYLAWLQQASAD

SEQ ID NO: 18396 - protein, 28 aa, Mycobacterium avium
YAAMAADIYKWGEFGMLPSLNARRTPGR

SEQ ID NO: 18397 - protein, 17 aa, Mycobacterium avium
YADRLAWSLTVLVAVAW

SEQ ID NO: 18398 - protein, 30 aa, Mycobacterium avium
YADRLAWSLTVLVAVAWIARGIFLGRPVTT

SEQ ID NO: 18399 - protein, 19 aa, Mycobacterium avium
YAFECPLLLGTTAVLMDRW

SEQ ID NO: 18400 - protein, 32 aa, Mycobacterium avium
YAGAFGLAAGLGWKLWDQRAVAQAGQAAQRTA

SEQ ID NO: 18401 - protein, 18 aa, Mycobacterium avium
YAHARGLLHRDVKPANIL

SEQ ID NO: 18402 - protein, 22 aa, Mycobacterium avium
YALLVNRWPLAESGVRSGLAPA

SEQ ID NO: 18403 - protein, 28 aa, Mycobacterium avium
YALLVNRWPLAESGVRSGLAPAERDSSG

SEQ ID NO: 18404 - protein, 21 aa, Mycobacterium avium
YAVPVLVVFLRPARLAATPRA

SEQ ID NO: 18405 - protein, 26 aa, Mycobacterium avium
YDAAHFRPELTAVLAKHEFSAAAMAD

SEQ ID NO: 18406 - protein, 24 aa, Mycobacterium avium
YDALKKLSHRFSWTAGSPPQERFL

SEQ ID NO: 18407 - protein, 24 aa, Mycobacterium avium
YDDGNRLPGVFGYADALDKVREIE

SEQ ID NO: 18408 - protein, 24 aa, Mycobacterium avium
YDDGNRLPGVFGYAEALDKVREIE

SEQ ID NO: 18409 - protein, 17 aa, Mycobacterium avium
YDLPAEMPNFDWPTAVV

SEQ ID NO: 18410 - protein, 21 aa, Mycobacterium avium
YDPRIGRQFLNAGLGFGGGCL

SEQ ID NO: 18411 - protein, 21 aa, Mycobacterium avium
YEDGFKRKKIVDVLRESLQNV

SEQ ID NO: 18412 - protein, 22 aa, Mycobacterium avium
YEHYFRTFLRPEDVGWAVFEVV

SEQ ID NO: 18413 - protein, 17 aa, Mycobacterium avium
YEIRRLIGKGGMGEVYE

SEQ ID NO: 18414 - protein, 21 aa, Mycobacterium avium
YERYMTLAAIAAMFFDLTVTA

SEQ ID NO: 18415 - protein, 22 aa, Mycobacterium avium
YERYMTLAAIAAMFFDLTVTAG

SEQ ID NO: 18416 - protein, 26 aa, Mycobacterium avium
YETVKGDASMAWMLLGAVVLAGAVLA

SEQ ID NO: 18417 - protein, 17 aa, Mycobacterium avium
YGALDFDAVPLGRSPSV

SEQ ID NO: 18418 - protein, 23 aa, Mycobacterium avium
YGALYLWAFWDPFGHTNKMPVAL

SEQ ID NO: 18419 - protein, 25 aa, Mycobacterium avium
YGDFFSFYLCDIVLKLNGKGGQPVY

SEQ ID NO: 18420 - protein, 36 aa, Mycobacterium avium
YGFGAPRPGDVIVFKGPPSWNLGYKSIRSNNTALRW

SEQ ID NO: 18421 - protein, 18 aa, Mycobacterium avium
YGRIRVMLISGVASSVIG

SEQ ID NO: 18422 - protein, 18 aa, Mycobacterium avium
YGRRVVVLVHHCHREQWP

SEQ ID NO: 18423 - protein, 17 aa, Mycobacterium avium
YGRSLRYSESMSLGSSP

SEQ ID NO: 18424 - protein, 18 aa, Mycobacterium avium
YGSGLPSDIWKATMDGAL

SEQ ID NO: 18425 - protein, 26 aa, Mycobacterium avium
YGVYLWHWPIFLALNGERTGWAGMLL

SEQ ID NO: 18426 - protein, 26 aa, Mycobacterium avium
YGVYLWHWPIFLALNGERTGWAGMPL

SEQ ID NO: 18427 - protein, 22 aa, Mycobacterium avium
YHLATDWRTYWGPGGAGFGAAV

SEQ ID NO: 18428 - protein, 29 aa, Mycobacterium avium
YIFGFSFYTAHYFGAWVFVIGFLMHVTIK

SEQ ID NO: 18429 - protein, 19 aa, Mycobacterium avium
YIPPEVFDNPDFKRGLKMF

SEQ ID NO: 18430 - protein, 18 aa, Mycobacterium avium
YKDDYKAAGVPMLPAVAT

SEQ ID NO: 18431 - protein, 23 aa, Mycobacterium avium
YLAAHAPYLAWLVRASTDSAAVA

SEQ ID NO: 18432 - protein, 20 aa, Mycobacterium avium
YLASLGIGVIVFQWILGHES

SEQ ID NO: 18433 - protein, 17 aa, Mycobacterium avium
YLEVCYKLWEGSWEAGA

SEQ ID NO: 18434 - protein, 20 aa, Mycobacterium avium
YLLLAVPAFLPAVIVVAVVL

SEQ ID NO: 18435 - protein, 18 aa, Mycobacterium avium
YLPAAAIALFQAVVLYCV

SEQ ID NO: 18436 - protein, 18 aa, Mycobacterium avium
YLPPEAFTNPEFKRGLKL

SEQ ID NO: 18437 - protein, 17 aa, Mycobacterium avium
YLPSDGFQPYNVASTVG

SEQ ID NO: 18438 - protein, 23 aa, Mycobacterium avium
YLREFGNLVFHFSLLGLLVAVAV

SEQ ID NO: 18439 - protein, 22 aa, Mycobacterium avium
YLSDRMGRRTLLIVGLVTSGAA

SEQ ID NO: 18440 - protein, 44 aa, Mycobacterium avium
YLTRPGNSLIEWLRLPGDFVFILGGVLPFVWIAWTAIRNVRRAP

SEQ ID NO: 18441 - protein, 17 aa, Mycobacterium avium
YLVCAALTGLGGGNYAA

SEQ ID NO: 18442 - protein, 17 aa, Mycobacterium avium
YLVTRWIQLPGLIAVTA

SEQ ID NO: 18443 - protein, 21 aa, Mycobacterium avium
YMYATRAGKFVVWDRILSDLR

SEQ ID NO: 18444 - protein, 21 aa, Mycobacterium avium
YPEFPSRRPATSGPQESPASA

SEQ ID NO: 18445 - protein, 18 aa, Mycobacterium avium
YPEPFLYTYCRDDDPQVL

SEQ ID NO: 18446 - protein, 19 aa, Mycobacterium avium
YPEPFLYTYCRDDDPQVLV

SEQ ID NO: 18447 - protein, 17 aa, Mycobacterium avium
YPEVAVAVVARFDAQAE

SEQ ID NO: 18448 - protein, 20 aa, Mycobacterium avium
YPGDLRMRFGGETYDEDGPA

SEQ ID NO: 18449 - protein, 29 aa, Mycobacterium avium
YPWQPARRPRPWLAIALAVTAAVAAGALA

SEQ ID NO: 18450 - protein, 17 aa, Mycobacterium avium
YQHDIKFIIAVTCWWCS

SEQ ID NO: 18451 - protein, 19 aa, Mycobacterium avium
YQQQFDWRYRSQPSQTTQF

SEQ ID NO: 18452 - protein, 17 aa, Mycobacterium avium
YRALLVALARLAGTHRA

SEQ ID NO: 18453 - protein, 18 aa, Mycobacterium avium
YRDVAGWFAISSDGPPAP

SEQ ID NO: 18454 - protein, 26 aa, Mycobacterium avium
YRGANLIRPGFIGTVLILLVVAVGLA

SEQ ID NO: 18455 - protein, 25 aa, Mycobacterium avium
YRKETIRLIAEMTMGAGALVMIGGT

SEQ ID NO: 18456 - protein, 20 aa, Mycobacterium avium
YRMVLHPLMLGFVIAFWAAP

SEQ ID NO: 18457 - protein, 21 aa, Mycobacterium avium
YRPTAQPGYPHYFGGGYHNGI

SEQ ID NO: 18458 - protein, 20 aa, Mycobacterium avium
YRRGFVTRHQVSGWRFVMRR

SEQ ID NO: 18459 - protein, 24 aa, Mycobacterium avium
YRSSKFVMRRWAPVGLIVVGLLLL

SEQ ID NO: 18460 - protein, 25 aa, Mycobacterium avium
YRSSKFVMRRWAPVGLIVVGLLLLL

SEQ ID NO: 18461 - protein, 34 aa, Mycobacterium avium
YRTVPGPGSAGWLRLGVLTALIATALALLINRRL

SEQ ID NO: 18462 - protein, 19 aa, Mycobacterium avium
YRYRIRVLITATVAAGVIG

SEQ ID NO: 18463 - protein, 17 aa, Mycobacterium avium
YSLGIALVIARALREMT

SEQ ID NO: 18464 - protein, 19 aa, Mycobacterium avium
YSLVAGIPLAHWEFYMALA

SEQ ID NO: 18465 - protein, 24 aa, Mycobacterium avium
YSMRRMSVSLAFGYSYLVIYSLAA

SEQ ID NO: 18466 - protein, 17 aa, Mycobacterium avium
YSNPGFDFSGFARAVNN

SEQ ID NO: 18467 - protein, 19 aa, Mycobacterium avium
YSPTRLEAFRDRKRTGPQP

SEQ ID NO: 18468 - protein, 21 aa, Mycobacterium avium
YSVDAVFELRELMATDYPNDG

SEQ ID NO: 18469 - protein, 17 aa, Mycobacterium avium
YTAEFAQAASLRAGNPI

SEQ ID NO: 18470 - protein, 18 aa, Mycobacterium avium
YTASRMLFVLAERGEAPA

SEQ ID NO: 18471 - protein, 26 aa, Mycobacterium avium
YTDAVPFPSFKQGEGLILQLPSPTVI

SEQ ID NO: 18472 - protein, 27 aa, Mycobacterium avium
YTNAGEPIFWVVRALELLEDFEQFGYY

SEQ ID NO: 18473 - protein, 27 aa, Mycobacterium avium
YTPDRDWAWSSARGWLEVAPGAATALG

SEQ ID NO: 18474 - protein, 23 aa, Mycobacterium avium
YTRSEGGGMFVLKRVDDARRDGD

SEQ ID NO: 18475 - protein, 25 aa, Mycobacterium avium
YTVADFWRFWVVHLWVEDFLELFTT

SEQ ID NO: 18476 - protein, 21 aa, Mycobacterium avium
YTVTCFAFFFIGGLMALLMRT

SEQ ID NO: 18477 - protein, 19 aa, Mycobacterium avium
YVAAHAPYHAWLLESAAKS

SEQ ID NO: 18478 - protein, 23 aa, Mycobacterium avium
YVAAHAPYQAWLLESAAKSSTAA

SEQ ID NO: 18479 - protein, 18 aa, Mycobacterium avium
YVWHRVRRIMPPYVITVL

SEQ ID NO: 18480 - protein, 17 aa, Mycobacterium avium
YWHPPAQPPYWQQPAHG

SEQ ID NO: 18481 - protein, 30 aa, Mycobacterium avium
YWNSVAVAVVRRPVPLLVISLTILVALSAA

SEQ ID NO: 18482 - protein, 22 aa, Mycobacterium avium
YYDRPAPAGGRRFWQRERTPLH

SEQ ID NO: 18483 - protein, 17 aa, Mycobacterium avium
YYPVSWIMWVWYKLFAA

SEQ ID NO: 18484 - protein, 19 aa, Mycobacterium avium
ASVALELLTGPSLLILDEP

SEQ ID NO: 18485 - protein, 18 aa, Mycobacterium avium
AADLGWRLAFGIGAILGI

SEQ ID NO: 18486 - protein, 17 aa, Mycobacterium avium
AAFLCYIGYFGRRGVKA

SEQ ID NO: 18487 - protein, 18 aa, Mycobacterium avium
AAGLSWYLAHDVLDHPQP

SEQ ID NO: 18488 - protein, 18 aa, Mycobacterium avium
AALVLRFGLAAMVLAVWT

SEQ ID NO: 18489 - protein, 18 aa, Mycobacterium avium
AATIARRLGLTGALGTVA

SEQ ID NO: 18490 - protein, 20 aa, Mycobacterium avium
ACALPLFVLFWFVLPLLLRT

SEQ ID NO: 18491 - protein, 19 aa, Mycobacterium avium
ACEAGDYSLCWSFADGDLK

SEQ ID NO: 18492 - protein, 18 aa, Mycobacterium avium
ACKLWPLVFARVAASLVV

SEQ ID NO: 18493 - protein, 20 aa, Mycobacterium avium
ADFWRFWVVHLWVEDFLELF

SEQ ID NO: 18494 - protein, 21 aa, Mycobacterium avium
ADGLQHWPLLIFPYMILLVVV

SEQ ID NO: 18495 - protein, 18 aa, Mycobacterium avium
ADNPISFWEFTRKGVVVT

SEQ ID NO: 18496 - protein, 20 aa, Mycobacterium avium
AELAFLVAMVMARPDPGALA

SEQ ID NO: 18497 - protein, 17 aa, Mycobacterium avium
AELPRIVGDPMLLTMLW

SEQ ID NO: 18498 - protein, 20 aa, Mycobacterium avium
AEPAAWLRFWFPDPDGSKTE

SEQ ID NO: 18499 - protein, 22 aa, Mycobacterium avium
AEPAHPRWWFISTTPGRILTIG

SEQ ID NO: 18500 - protein, 24 aa, Mycobacterium avium
AEPRLAVPSVYARLVLLWFLCSAF

SEQ ID NO: 18501 - protein, 20 aa, Mycobacterium avium
AESLTEVFFWAAPVALVGFV

SEQ ID NO: 18502 - protein, 26 aa, Mycobacterium avium
AFDQLWRWNSIVALVLSVLVILGLVV

SEQ ID NO: 18503 - protein, 19 aa, Mycobacterium avium
AFMHWGWRVPFLISSGLIG

SEQ ID NO: 18504 - protein, 19 aa, Mycobacterium avium
AGALAVLWRRLVRSRAELD

SEQ ID NO: 18505 - protein, 19 aa, Mycobacterium avium
AGATAAWAIGRWTPGTERR

SEQ ID NO: 18506 - protein, 24 aa, Mycobacterium avium
AGIFVCLFCAFYFMTVTYSLMTFW

SEQ ID NO: 18507 - protein, 24 aa, Mycobacterium avium
AGPRLIDAYVDWLWFGELGYRSVF

SEQ ID NO: 18508 - protein, 18 aa, Mycobacterium avium
AHNLELLGYVGLADTARA

SEQ ID NO: 18509 - protein, 19 aa, Mycobacterium avium
AHVSFAYRPGIRVIDDLSL

SEQ ID NO: 18510 - protein, 25 aa, Mycobacterium avium
AIRIFAVPIILGWLFVTVLVNVIVP

SEQ ID NO: 18511 - protein, 23 aa, Mycobacterium avium
AITKRLPTVFGLIAVVTFMLLFL

SEQ ID NO: 18512 - protein, 19 aa, Mycobacterium avium
AIVSLRLIPAVPFSALNYA

SEQ ID NO: 18513 - protein, 17 aa, Mycobacterium avium
AKAFLRFNVHLLTASTL

SEQ ID NO: 18514 - protein, 21 aa, Mycobacterium avium
AKRRGWPILRFSSRGPVGLRR

SEQ ID NO: 18515 - protein, 20 aa, Mycobacterium avium
AKSRWLVTRMTTITSLDLTP

SEQ ID NO: 18516 - protein, 17 aa, Mycobacterium avium
ALADWFAVTALFRHPLG

SEQ ID NO: 18517 - protein, 24 aa, Mycobacterium avium
ALIRARFPALTARQVMQRIEATAH

SEQ ID NO: 18518 - protein, 26 aa, Mycobacterium avium
ALSGTPAWEVFKPWAITSITVAVAVA

SEQ ID NO: 18519 - protein, 21 aa, Mycobacterium avium
ALTEVSWRLAFLVNVPIGLVM

SEQ ID NO: 18520 - protein, 23 aa, Mycobacterium avium
ALTGVVCFAGFFASYMFNVYFQN

SEQ ID NO: 18521 - protein, 19 aa, Mycobacterium avium
AMATLRIAFLSALVLELLA

SEQ ID NO: 18522 - protein, 20 aa, Mycobacterium avium
APDYYKRAELCRERLGPVLR

SEQ ID NO: 18523 - protein, 20 aa, Mycobacterium avium
APLSALWARFPLPVIPAPGD

SEQ ID NO: 18524 - protein, 18 aa, Mycobacterium avium
APTARLGSMYGYGISYAI

SEQ ID NO: 18525 - protein, 17 aa, Mycobacterium avium
AQLPLRRGVLIGAAQIL

SEQ ID NO: 18526 - protein, 24 aa, Mycobacterium avium
ARHAVELFAAFGLTALIGLERTIQ

SEQ ID NO: 18527 - protein, 19 aa, Mycobacterium avium
ARKRIAWLLLLGNMILAAA

SEQ ID NO: 18528 - protein, 20 aa, Mycobacterium avium
ARLGSMYGYGISYAIASLSC

SEQ ID NO: 18529 - protein, 17 aa, Mycobacterium avium
ARLRGTVRLRIIYANGR

SEQ ID NO: 18530 - protein, 20 aa, Mycobacterium avium
ARRLLRRWRHDVLTANAISL

SEQ ID NO: 18531 - protein, 27 aa, Mycobacterium avium
ARRWRRIGTAIVRWPAPILIATLAVSL

SEQ ID NO: 18532 - protein, 31 aa, Mycobacterium avium
ARRWRRVGTTVARWPGPILVAALGLTLLVAL

SEQ ID NO: 18533 - protein, 22 aa, Mycobacterium avium
ASFMLCAAFNVLLRAVCGRDTS

SEQ ID NO: 18534 - protein, 20 aa, Mycobacterium avium
ASGLCGIAWAGGTLIAARLL

SEQ ID NO: 18535 - protein, 17 aa, Mycobacterium avium
ASGPAWRLIGTTAVGLL

SEQ ID NO: 18536 - protein, 21 aa, Mycobacterium avium
ASLRMSVRFIRRVAFTGYVVT

SEQ ID NO: 18537 - protein, 22 aa, Mycobacterium avium
ATARIGFNLGFAVLDHSQHDVA

SEQ ID NO: 18538 - protein, 17 aa, Mycobacterium avium
ATLGLRFYLRWITSTGY

SEQ ID NO: 18539 - protein, 17 aa, Mycobacterium avium
ATVVFGAFAHRWLARRT

SEQ ID NO: 18540 - protein, 20 aa, Mycobacterium avium
AVCVVLRLARFNALLDDGSQ

SEQ ID NO: 18541 - protein, 21 aa, Mycobacterium avium
AVEMVLLWWARRLFAAPLPLL

SEQ ID NO: 18542 - protein, 26 aa, Mycobacterium avium
AVGPWLFLRLRFFRRKLTVTALAATP

SEQ ID NO: 18543 - protein, 20 aa, Mycobacterium avium
AVLLCLLLGIAIVTQVRQTE

SEQ ID NO: 18544 - protein, 18 aa, Mycobacterium avium
AVPLCLLCSLLVLNQWVG

SEQ ID NO: 18545 - protein, 18 aa, Mycobacterium avium
AVVAREFGFPCVVDVQGA

SEQ ID NO: 18546 - protein, 17 aa, Mycobacterium avium
AYRGRLVLCFQIAIGVG

SEQ ID NO: 18547 - protein, 19 aa, Mycobacterium avium
CAPLAIAVLWRWILAPTDG

SEQ ID NO: 18548 - protein, 17 aa, Mycobacterium avium
CAWVGGLCGIVKRKGRG

SEQ ID NO: 18549 - protein, 19 aa, Mycobacterium avium
CGPAPALTGITGWLNTPDG

SEQ ID NO: 18550 - protein, 17 aa, Mycobacterium avium
CLVKEIQKLSGLSINHF

SEQ ID NO: 18551 - protein, 19 aa, Mycobacterium avium
CQRAIPHVIDWYDRYHDSG

SEQ ID NO: 18552 - protein, 19 aa, Mycobacterium avium
CSLAGYAFARLDFRGRNTL

SEQ ID NO: 18553 - protein, 18 aa, Mycobacterium avium
CSTGGWPTALAAFVMIVF

SEQ ID NO: 18554 - protein, 22 aa, Mycobacterium avium
DALRRYGCNITQGFVHTPPLPP

SEQ ID NO: 18555 - protein, 22 aa, Mycobacterium avium
DCGCKRPTFSNSFYRVLTQPNV

SEQ ID NO: 18556 - protein, 20 aa, Mycobacterium avium
DEAWYAFATAVPWARQRTAM

SEQ ID NO: 18557 - protein, 17 aa, Mycobacterium avium
DGGKRLRQVAVRRAPKP

SEQ ID NO: 18558 - protein, 18 aa, Mycobacterium avium
DHEFGLWAGLSVDNTAET

SEQ ID NO: 18559 - protein, 23 aa, Mycobacterium avium
DHRFGWSSVPAWLSLLGDVLVAT

SEQ ID NO: 18560 - protein, 17 aa, Mycobacterium avium
DKLMGWRSMHTHGRALG

SEQ ID NO: 18561 - protein, 22 aa, Mycobacterium avium
DLARLRLPLIIGEPDDLAALVT

SEQ ID NO: 18562 - protein, 25 aa, Mycobacterium avium
DLCGLSWLYRYAVGVYRDDRGCGQV

SEQ ID NO: 18563 - protein, 18 aa, Mycobacterium avium
DMSRRYGADFGFTSYDPA

SEQ ID NO: 18564 - protein, 18 aa, Mycobacterium avium
DNGLRPEPIIALGSLVTY

SEQ ID NO: 18565 - protein, 20 aa, Mycobacterium avium
DPLLPFPRWHEYAPAVEEPV

SEQ ID NO: 18566 - protein, 19 aa, Mycobacterium avium
DRLQAFNVFSSFWFTAIYV

SEQ ID NO: 18567 - protein, 23 aa, Mycobacterium avium
DSRLYLPMPFFWVGGFGSGILSA

SEQ ID NO: 18568 - protein, 22 aa, Mycobacterium avium
DSTDSLLRFAVRADATLTGLCG

SEQ ID NO: 18569 - protein, 20 aa, Mycobacterium avium
DVRPRLILGAGLIALSVLGL

SEQ ID NO: 18570 - protein, 17 aa, Mycobacterium avium
EAMRGMLQRIWKEQDRT

SEQ ID NO: 18571 - protein, 19 aa, Mycobacterium avium
EDLPHPWLDAVGIPDRVGD

SEQ ID NO: 18572 - protein, 21 aa, Mycobacterium avium
EGRFPGILLIIARDATGKVQA

SEQ ID NO: 18573 - protein, 25 aa, Mycobacterium avium
EGVRFVWNLRVLRTLGLIDLAVTAL

SEQ ID NO: 18574 - protein, 19 aa, Mycobacterium avium
EGVVSLGLYSRIFRNNILA

SEQ ID NO: 18575 - protein, 22 aa, Mycobacterium avium
EHKVFFCVAAILLVMALNLRGV

SEQ ID NO: 18576 - protein, 19 aa, Mycobacterium avium
EIRYSMILFNWFGVCLVPI

SEQ ID NO: 18577 - protein, 25 aa, Mycobacterium avium
EKHCFDIPLCWAFRSLWDTIDHIDH

SEQ ID NO: 18578 - protein, 25 aa, Mycobacterium avium
EKHCYDIPICWSLRSLFDALDGFDQ

SEQ ID NO: 18579 - protein, 24 aa, Mycobacterium avium
EKHCYDIPVCWALRSVFNALDGID

SEQ ID NO: 18580 - protein, 24 aa, Mycobacterium avium
EKHCYDIPVCWSLRSVFDALDGID

SEQ ID NO: 18581 - protein, 19 aa, Mycobacterium avium
EKRPRLTMFDDFGGRIPSD

SEQ ID NO: 18582 - protein, 18 aa, Mycobacterium avium
ELFFRGALYTALGRYHPV

SEQ ID NO: 18583 - protein, 26 aa, Mycobacterium avium
ELLDTWLWRWVAFLIVFGVQVVVGAV

SEQ ID NO: 18584 - protein, 25 aa, Mycobacterium avium
ELLTCPFCLDMWVATGFAIGLVFAP

SEQ ID NO: 18585 - protein, 19 aa, Mycobacterium avium
ELPFYRLLLSYLFVAVFLA

SEQ ID NO: 18586 - protein, 23 aa, Mycobacterium avium
ELQADCYAGIWAHYASTVKQEST

SEQ ID NO: 18587 - protein, 19 aa, Mycobacterium avium
EQIMPLFVVTVMAQLVLCG

SEQ ID NO: 18588 - protein, 25 aa, Mycobacterium avium
EQMRKRFGSTLGYRLVIYPTYAALD

SEQ ID NO: 18589 - protein, 20 aa, Mycobacterium avium
EQRARPGARATLFGMTEAFG

SEQ ID NO: 18590 - protein, 23 aa, Mycobacterium avium
ERDRLPIELAIAVLVLVVLLVVY

SEQ ID NO: 18591 - protein, 19 aa, Mycobacterium avium
ERGEPWPPPAPEPAFKAAI

SEQ ID NO: 18592 - protein, 21 aa, Mycobacterium avium
ETRLSWVLAVLAGVLGATAFT

SEQ ID NO: 18593 - protein, 19 aa, Mycobacterium avium
FAQLGIWRWAFVVMAVLTA

SEQ ID NO: 18594 - protein, 19 aa, Mycobacterium avium
FARRRTGELGNFWVDLVRG

SEQ ID NO: 18595 - protein, 18 aa, Mycobacterium avium
FASLRIASYALWPFGRTI

SEQ ID NO: 18596 - protein, 18 aa, Mycobacterium avium
FASVNGWWYVSNFGVPWS

SEQ ID NO: 18597 - protein, 17 aa, Mycobacterium avium
FAVSLALVLLMLPVIVR

SEQ ID NO: 18598 - protein, 18 aa, Mycobacterium avium
FCGTCKVKVLAGQVDRRG

SEQ ID NO: 18599 - protein, 22 aa, Mycobacterium avium
FDPRASRASDEWTPETGEEPDG

SEQ ID NO: 18600 - protein, 20 aa, Mycobacterium avium
FDTWPGLILPYITFALPLAI

SEQ ID NO: 18601 - protein, 33 aa, Mycobacterium avium
FFRMCVLTGKALFRWPFQWREFVLQCWFIMRVA

SEQ ID NO: 18602 - protein, 18 aa, Mycobacterium avium
FFTMWGFFILLTVYIEAY

SEQ ID NO: 18603 - protein, 18 aa, Mycobacterium avium
FGAPRPGDVIVFKGPPSW

SEQ ID NO: 18604 - protein, 18 aa, Mycobacterium avium
FGCVGLIALVFVKVFGAA

SEQ ID NO: 18605 - protein, 27 aa, Mycobacterium avium
FGGFAVVVGVIAWLLARRSRSEEQNAD

SEQ ID NO: 18606 - protein, 20 aa, Mycobacterium avium
FGGLSVGMGVAWICVISAEM

SEQ ID NO: 18607 - protein, 21 aa, Mycobacterium avium
FGTGMAPFFLTLALFFGALVL

SEQ ID NO: 18608 - protein, 17 aa, Mycobacterium avium
FHYRYTVGLWFRRIWIL

SEQ ID NO: 18609 - protein, 27 aa, Mycobacterium avium
FIHLLGRWTWWAPRPMVWLRERSATGE

SEQ ID NO: 18610 - protein, 20 aa, Mycobacterium avium
FKGPPSWNLGYKSIRSNNTA

SEQ ID NO: 18611 - protein, 20 aa, Mycobacterium avium
FKLAIIAAGIDFRRRMSDQA

SEQ ID NO: 18612 - protein, 23 aa, Mycobacterium avium
FKLYPRRAVLGLALFIGQAFLYN

SEQ ID NO: 18613 - protein, 18 aa, Mycobacterium avium
FKQATWKRVAVLFAGPGA

SEQ ID NO: 18614 - protein, 19 aa, Mycobacterium avium
FLFHDWRYVFWINVPLTLI

SEQ ID NO: 18615 - protein, 23 aa, Mycobacterium avium
FLLRLGVGVGCGALIGLERQWRA

SEQ ID NO: 18616 - protein, 18 aa, Mycobacterium avium
FQNPDFQLGLSLMVSPDG

SEQ ID NO: 18617 - protein, 20 aa, Mycobacterium avium
FRRRNPRPAIVVVSLLAVAT

SEQ ID NO: 18618 - protein, 20 aa, Mycobacterium avium
FSVWMLWSIVVVHMTAGPHG

SEQ ID NO: 18619 - protein, 17 aa, Mycobacterium avium
FTVLVSFTLNILLRELG

SEQ ID NO: 18620 - protein, 24 aa, Mycobacterium avium
FVLIVAFLLVWWVYDTYRPEPAPK

SEQ ID NO: 18621 - protein, 18 aa, Mycobacterium avium
FVSALAFNAVERQLNARL

SEQ ID NO: 18622 - protein, 19 aa, Mycobacterium avium
FWLKAGIVALGSRFVLGDI

SEQ ID NO: 18623 - protein, 22 aa, Mycobacterium avium
FYGRLSCSIFNAAGQRVVASAN

SEQ ID NO: 18624 - protein, 21 aa, Mycobacterium avium
FYPYPFWGPGWGWALGDVLLM

SEQ ID NO: 18625 - protein, 18 aa, Mycobacterium avium
GAGYLRWSAGSADDLAQA

SEQ ID NO: 18626 - protein, 17 aa, Mycobacterium avium
GALAILVMVVWVGTALT

SEQ ID NO: 18627 - protein, 19 aa, Mycobacterium avium
GANTGWWPVLWFTAKMWTF

SEQ ID NO: 18628 - protein, 21 aa, Mycobacterium avium
GCSSWADALALGWPKGITPQA

SEQ ID NO: 18629 - protein, 19 aa, Mycobacterium avium
GDIALAWAFLGAAIGSVIR

SEQ ID NO: 18630 - protein, 18 aa, Mycobacterium avium
GDYSLCWSFADGDLKPGI

SEQ ID NO: 18631 - protein, 17 aa, Mycobacterium avium
GFSRLGPSLVFFVALAF

SEQ ID NO: 18632 - protein, 19 aa, Mycobacterium avium
GFVVYRLHGIFGVHPGSFG

SEQ ID NO: 18633 - protein, 17 aa, Mycobacterium avium
GGDAWVIRDGRRSRIDA

SEQ ID NO: 18634 - protein, 19 aa, Mycobacterium avium
GGPLPRGRGLLMAEDTGVF

SEQ ID NO: 18635 - protein, 18 aa, Mycobacterium avium
GGTLINWRSPIAWLSRYR

SEQ ID NO: 18636 - protein, 17 aa, Mycobacterium avium
GGVLRRRWQLFDFASVA

SEQ ID NO: 18637 - protein, 18 aa, Mycobacterium avium
GHAALSLRLAALGHTVVG

SEQ ID NO: 18638 - protein, 24 aa, Mycobacterium avium
GISHARWLRWPARVYTDVFRGLPE

SEQ ID NO: 18639 - protein, 19 aa, Mycobacterium avium
GLARIWPPWEFYFWHHTIP

SEQ ID NO: 18640 - protein, 24 aa, Mycobacterium avium
GLAYPWCDLMLLALAAGMLPILGW

SEQ ID NO: 18641 - protein, 19 aa, Mycobacterium avium
GLFYRYAWQNPTFADIVAT

SEQ ID NO: 18642 - protein, 22 aa, Mycobacterium avium
GLPWYKRTALVLSVAGAGAAVL

SEQ ID NO: 18643 - protein, 20 aa, Mycobacterium avium
GLRTRSEMIAQLVFAMGGRA

SEQ ID NO: 18644 - protein, 31 aa, Mycobacterium avium
GLVGRSGLVYDMWGGAVSLAYQMHSGSPQPG

SEQ ID NO: 18645 - protein, 22 aa, Mycobacterium avium
GMRLLFPLLIVWATAGLDPVRA

SEQ ID NO: 18646 - protein, 17 aa, Mycobacterium avium
GNVVAVLGMPVGKITKI

SEQ ID NO: 18647 - protein, 26 aa, Mycobacterium avium
GPLEFSGLFAWFAWLVLHLVYLVGFK

SEQ ID NO: 18648 - protein, 17 aa, Mycobacterium avium
GPLPPRRAIEIIADACQ

SEQ ID NO: 18649 - protein, 18 aa, Mycobacterium avium
GRGAVLLAAAKRLPRGRA

SEQ ID NO: 18650 - protein, 23 aa, Mycobacterium avium
GRLTGRYALLVVGLWVLAAAVAN

SEQ ID NO: 18651 - protein, 19 aa, Mycobacterium avium
GRSRFGFGTLAVLLCLLLG

SEQ ID NO: 18652 - protein, 18 aa, Mycobacterium avium
GRSRLRAPFGVRSDNGEL

SEQ ID NO: 18653 - protein, 18 aa, Mycobacterium avium
GSALALAGVSAWLITRAW

SEQ ID NO: 18654 - protein, 18 aa, Mycobacterium avium
GTFNRYWLAAAFGVTALV

SEQ ID NO: 18655 - protein, 17 aa, Mycobacterium avium
GTSFRSALMYPEPNHPR

SEQ ID NO: 18656 - protein, 23 aa, Mycobacterium avium
GVGLGMSVARGFVEAMGGTITAT

SEQ ID NO: 18657 - protein, 25 aa, Mycobacterium avium
GVGSCFRLTLPLVRGHKVTTSPLPM

SEQ ID NO: 18658 - protein, 17 aa, Mycobacterium avium
GVIPVIFASSLIYIPHL

SEQ ID NO: 18659 - protein, 21 aa, Mycobacterium avium
GVLTYEFWLKAGIVALGSRFV

SEQ ID NO: 18660 - protein, 19 aa, Mycobacterium avium
GVLVTWMLVERAIALQRLA

SEQ ID NO: 18661 - protein, 19 aa, Mycobacterium avium
GVPLEWNVFFIFSLFYLFG

SEQ ID NO: 18662 - protein, 18 aa, Mycobacterium avium
GVSVVRRLVVPRFAAAVM

SEQ ID NO: 18663 - protein, 24 aa, Mycobacterium avium
GVVVGGPFLPLAIILYWFANNIWT

SEQ ID NO: 18664 - protein, 25 aa, Mycobacterium avium
GWPADSRWRPATAIVGAVVALGAIA

SEQ ID NO: 18665 - protein, 26 aa, Mycobacterium avium
GYFTDYLSWRWAFWVNVPVSVIVIFV

SEQ ID NO: 18666 - protein, 28 aa, Mycobacterium avium
GYILASLHWYTWIAFSGWVLLALIFYFV

SEQ ID NO: 18667 - protein, 23 aa, Mycobacterium avium
GYRPAALGLFAFVWMELASPNPA

SEQ ID NO: 18668 - protein, 19 aa, Mycobacterium avium
GYSTVLVFWFGWPASEVPG

SEQ ID NO: 18669 - protein, 22 aa, Mycobacterium avium
HEEIRVRIGIHMGRSVRRGDDL

SEQ ID NO: 18670 - protein, 22 aa, Mycobacterium avium
HEGGHTLAAWAMPDIEPIYKVT

SEQ ID NO: 18671 - protein, 19 aa, Mycobacterium avium
HLFWFFGHPEVYIIALPFF

SEQ ID NO: 18672 - protein, 18 aa, Mycobacterium avium
HRIGEPFGSLVLAAAVTI

SEQ ID NO: 18673 - protein, 21 aa, Mycobacterium avium
HRSKCGYLWSHHLPIARRAGL

SEQ ID NO: 18674 - protein, 18 aa, Mycobacterium avium
HTPEFRWLMSSDVCKHCT

SEQ ID NO: 18675 - protein, 24 aa, Mycobacterium avium
HVILGWRPVLLIPFTFALFTPLAV

SEQ ID NO: 18676 - protein, 22 aa, Mycobacterium avium
HVMGRWNWWAPKPLAWLHDRFG

SEQ ID NO: 18677 - protein, 26 aa, Mycobacterium avium
HYHRLKGPILQWWITWVCSYAVSVSA

SEQ ID NO: 18678 - protein, 23 aa, Mycobacterium avium
IAAALGHWFWWPINTIRMTRRTH

SEQ ID NO: 18679 - protein, 23 aa, Mycobacterium avium
IAAPRAKLFAALFLILALVVIGE

SEQ ID NO: 18680 - protein, 21 aa, Mycobacterium avium
IAGALPGIWAFFSHQVAFLFT

SEQ ID NO: 18681 - protein, 19 aa, Mycobacterium avium
IAGAVVWFGITSAWRERLD

SEQ ID NO: 18682 - protein, 21 aa, Mycobacterium avium
IAVVVLLGWSFFYFSDDTRGY

SEQ ID NO: 18683 - protein, 22 aa, Mycobacterium avium
IDVLHWPGYLLVVAGVVGACGS

SEQ ID NO: 18684 - protein, 25 aa, Mycobacterium avium
IGHRNRLAAMFAWGISFLGRTRGQM

SEQ ID NO: 18685 - protein, 22 aa, Mycobacterium avium
IGYGLGVFAVWLYRYLWAKPSS

SEQ ID NO: 18686 - protein, 18 aa, Mycobacterium avium
IHWPESWPLVSLSPTVEP

SEQ ID NO: 18687 - protein, 18 aa, Mycobacterium avium
IIKPAVVVALLFRTLDAF

SEQ ID NO: 18688 - protein, 17 aa, Mycobacterium avium
IIMSPNLVAARFIQLTP

SEQ ID NO: 18689 - protein, 18 aa, Mycobacterium avium
ILLADALRALAYAATGGR

SEQ ID NO: 18690 - protein, 19 aa, Mycobacterium avium
ILVAWRWVPAKVRRVPGPL

SEQ ID NO: 18691 - protein, 19 aa, Mycobacterium avium
IPGLAHFFTMWGFFILLTV

SEQ ID NO: 18692 - protein, 17 aa, Mycobacterium avium
IPQSSFRPSFGGNVGPV

SEQ ID NO: 18693 - protein, 20 aa, Mycobacterium avium
IPVVIGELIAGLAIGRTGFG

SEQ ID NO: 18694 - protein, 21 aa, Mycobacterium avium
IPYYLCMLELRGTDLQGKTVR

SEQ ID NO: 18695 - protein, 17 aa, Mycobacterium avium
ISLNFAMFRSAFEQGAQ

SEQ ID NO: 18696 - protein, 17 aa, Mycobacterium avium
ISLPLLWWRFRRDDRDA

SEQ ID NO: 18697 - protein, 19 aa, Mycobacterium avium
IVAVARWRGLLALVGILVA

SEQ ID NO: 18698 - protein, 18 aa, Mycobacterium avium
IVAVAVSLLAILLIRQLR

SEQ ID NO: 18699 - protein, 17 aa, Mycobacterium avium
IVGWLWPLWDSRRRTFA

SEQ ID NO: 18700 - protein, 19 aa, Mycobacterium avium
KDAKAIIMSPNLVAARFIQ

SEQ ID NO: 18701 - protein, 19 aa, Mycobacterium avium
KDSFPASFIVKLNNPEQHA

SEQ ID NO: 18702 - protein, 21 aa, Mycobacterium avium
KGFLGRFWLVLTIAAVVALSG

SEQ ID NO: 18703 - protein, 23 aa, Mycobacterium avium
KHCYDIPICWSLRNIFETLDGVD

SEQ ID NO: 18704 - protein, 19 aa, Mycobacterium avium
KIPPGSGWRKFIYTISFHK

SEQ ID NO: 18705 - protein, 18 aa, Mycobacterium avium
KPALELFADVALTCVASA

SEQ ID NO: 18706 - protein, 18 aa, Mycobacterium avium
KRALAWVKQHIAGYGGDP

SEQ ID NO: 18707 - protein, 19 aa, Mycobacterium avium
KRFRIPVVIGELIAGLAIG

SEQ ID NO: 18708 - protein, 25 aa, Mycobacterium avium
KRYFDGTSWTGEWAFFTEQRKNGTS

SEQ ID NO: 18709 - protein, 23 aa, Mycobacterium avium
KVVNLRSAPGFSFVGEDLDRLRS

SEQ ID NO: 18710 - protein, 18 aa, Mycobacterium avium
KYLSYRLFMKRAKSRWLV

SEQ ID NO: 18711 - protein, 36 aa, Mycobacterium avium
LAAAVRGPWAWREILEQIWFVARVSIFPTIMLSIPY

SEQ ID NO: 18712 - protein, 20 aa, Mycobacterium avium
LAARGWVCVSIGYRVSPRHT

SEQ ID NO: 18713 - protein, 18 aa, Mycobacterium avium
LAATAVLISPAWKRDEVE

SEQ ID NO: 18714 - protein, 18 aa, Mycobacterium avium
LAAWDVVCTVALLVLLAL

SEQ ID NO: 18715 - protein, 18 aa, Mycobacterium avium
LAELGWICVAINYRHSPR

SEQ ID NO: 18716 - protein, 17 aa, Mycobacterium avium
LAILVMVVWVGTALTIS

SEQ ID NO: 18717 - protein, 17 aa, Mycobacterium avium
LALAGVSAWLITRAWQM

SEQ ID NO: 18718 - protein, 18 aa, Mycobacterium avium
LAVFAGFLAVVFYLVAVA

SEQ ID NO: 18719 - protein, 21 aa, Mycobacterium avium
LAVGLKFKLGFDDSLDVVGVH

SEQ ID NO: 18720 - protein, 22 aa, Mycobacterium avium
LCLTAARLPYFQTMGLPCAIAM

SEQ ID NO: 18721 - protein, 18 aa, Mycobacterium avium
LCMLPGLVLLIWATPRLA

SEQ ID NO: 18722 - protein, 20 aa, Mycobacterium avium
LCVLCAGLALNGWVGYFPTV

SEQ ID NO: 18723 - protein, 18 aa, Mycobacterium avium
LDEYVGFLVAWQRPLAGK

SEQ ID NO: 18724 - protein, 18 aa, Mycobacterium avium
LDNKRLWSNLDCAPSNET

SEQ ID NO: 18725 - protein, 24 aa, Mycobacterium avium
LDPWPRLFLGVTFLFLVSSAFTLA

SEQ ID NO: 18726 - protein, 28 aa, Mycobacterium avium
LDRLPWSRFHWRVVIGLGGVWVLDGLEV

SEQ ID NO: 18727 - protein, 22 aa, Mycobacterium avium
LDVQPRLAILLGDYAVPVEGRV

SEQ ID NO: 18728 - protein, 25 aa, Mycobacterium avium
LEDIVRFQAEFLWRDYFPRGISDDG

SEQ ID NO: 18729 - protein, 21 aa, Mycobacterium avium
LELRTSLLVLFALAALAVATQ

SEQ ID NO: 18730 - protein, 19 aa, Mycobacterium avium
LELSWRWLFGLSIVPALIS

SEQ ID NO: 18731 - protein, 20 aa, Mycobacterium avium
LEPRPSRTARRWRRVGTTVA

SEQ ID NO: 18732 - protein, 18 aa, Mycobacterium avium
LFDACGWRRLVFATPEEL

SEQ ID NO: 18733 - protein, 18 aa, Mycobacterium avium
LFGRIVKILGWIWVATFA

SEQ ID NO: 18734 - protein, 18 aa, Mycobacterium avium
LFMKRAKSRWLVTRMTTI

SEQ ID NO: 18735 - protein, 18 aa, Mycobacterium avium
LFTSFAFAFAFYFATMER

SEQ ID NO: 18736 - protein, 25 aa, Mycobacterium avium
LFVVGRIAAWHGMRVGLRGPAANES

SEQ ID NO: 18737 - protein, 18 aa, Mycobacterium avium
LGDQRLGGGIAWSAGEFP

SEQ ID NO: 18738 - protein, 18 aa, Mycobacterium avium
LGGWRIIRTLGKGLVEIQ

SEQ ID NO: 18739 - protein, 21 aa, Mycobacterium avium
LGLRFYLRWITSTGYTYGALS

SEQ ID NO: 18740 - protein, 17 aa, Mycobacterium avium
LGWLRRHTRAIQIFGGV

SEQ ID NO: 18741 - protein, 20 aa, Mycobacterium avium
LHLGGICWRGRNQRPVITGT

SEQ ID NO: 18742 - protein, 17 aa, Mycobacterium avium
LIPAVPFSALNYAAGAS

SEQ ID NO: 18743 - protein, 20 aa, Mycobacterium avium
LKFTRLPYFSSLAFPCAVGL

SEQ ID NO: 18744 - protein, 23 aa, Mycobacterium avium
LLGKSAYHALTFGWLMSGLGRAV

SEQ ID NO: 18745 - protein, 21 aa, Mycobacterium avium
LLHERWGFRPAWQCGECVEDM

SEQ ID NO: 18746 - protein, 17 aa, Mycobacterium avium
LLLCLAVPLLPVRQTTA

SEQ ID NO: 18747 - protein, 20 aa, Mycobacterium avium
LLLFRLTCYYYRGAYYRTVW

SEQ ID NO: 18748 - protein, 21 aa, Mycobacterium avium
LLPAWFIPALLDWNQHRRSRI

SEQ ID NO: 18749 - protein, 18 aa, Mycobacterium avium
LLPVLWIFSLSLKPTSTV

SEQ ID NO: 18750 - protein, 18 aa, Mycobacterium avium
LLQPYLLRHHELIKFAIV

SEQ ID NO: 18751 - protein, 19 aa, Mycobacterium avium
LLRVTRWDVVLAMAVAGTV

SEQ ID NO: 18752 - protein, 18 aa, Mycobacterium avium
LMFFAGLFAMYFTARAQS

SEQ ID NO: 18753 - protein, 17 aa, Mycobacterium avium
LMTLCIPGALFMLGCFF

SEQ ID NO: 18754 - protein, 17 aa, Mycobacterium avium
LNMTWGGLPLFVPIGYI

SEQ ID NO: 18755 - protein, 18 aa, Mycobacterium avium
LPCAIAMVVIVLAALTLA

SEQ ID NO: 18756 - protein, 17 aa, Mycobacterium avium
LPCAIGILATMVAALTL

SEQ ID NO: 18757 - protein, 18 aa, Mycobacterium avium
LPCSVGMLISVFIALTLV

SEQ ID NO: 18758 - protein, 23 aa, Mycobacterium avium
LPGFRHSIGLARWWHLGVDVLWL

SEQ ID NO: 18759 - protein, 26 aa, Mycobacterium avium
LPILGWRNEIRWALLVAGLVLFAVAD

SEQ ID NO: 18760 - protein, 17 aa, Mycobacterium avium
LPIVLVWLGIVFITNTV

SEQ ID NO: 18761 - protein, 17 aa, Mycobacterium avium
LPPEVFKNPDFKRGLKM

SEQ ID NO: 18762 - protein, 17 aa, Mycobacterium avium
LPSPRRWIWIVLAVGGI

SEQ ID NO: 18763 - protein, 18 aa, Mycobacterium avium
LPYTFAVPVFGGRNWTTI

SEQ ID NO: 18764 - protein, 20 aa, Mycobacterium avium
LQHGFKLVKWIKGIEFVADY

SEQ ID NO: 18765 - protein, 17 aa, Mycobacterium avium
LQIDHFWWTAIWAAIVL

SEQ ID NO: 18766 - protein, 21 aa, Mycobacterium avium
LQMAFRFWAFRRWVFPDQFAR

SEQ ID NO: 18767 - protein, 17 aa, Mycobacterium avium
LRFTRLNYFQSLGIPAA

SEQ ID NO: 18768 - protein, 18 aa, Mycobacterium avium
LRKDLTWWDLVVFGVAVV

SEQ ID NO: 18769 - protein, 19 aa, Mycobacterium avium
LRSGWYRLPARDKARPLLV

SEQ ID NO: 18770 - protein, 17 aa, Mycobacterium avium
LSDRTWAALGERLDDRQ

SEQ ID NO: 18771 - protein, 20 aa, Mycobacterium avium
LSEWDWRAIFWVGVPVGVLG

SEQ ID NO: 18772 - protein, 18 aa, Mycobacterium avium
LSFTRLPYFQPLGIPVAV

SEQ ID NO: 18773 - protein, 22 aa, Mycobacterium avium
LTAALSLMWGWRLAVVCVTVAA

SEQ ID NO: 18774 - protein, 18 aa, Mycobacterium avium
LTDVSWRLAFLVNVPIGL

SEQ ID NO: 18775 - protein, 25 aa, Mycobacterium avium
LTGGRFRLGIGLGWNAVEYEALGET

SEQ ID NO: 18776 - protein, 20 aa, Mycobacterium avium
LTLGDGRVVIWGTTDRTDEK

SEQ ID NO: 18777 - protein, 19 aa, Mycobacterium avium
LTPPYRGGPVLGNHDTIGL

SEQ ID NO: 18778 - protein, 21 aa, Mycobacterium avium
LTSPEFVPWLLVALTGMIFQQ

SEQ ID NO: 18779 - protein, 18 aa, Mycobacterium avium
LTVGWWVIQRNYYVAEYN

SEQ ID NO: 18780 - protein, 19 aa, Mycobacterium avium
LVAEIGVACAVAIAVDATV

SEQ ID NO: 18781 - protein, 18 aa, Mycobacterium avium
LVAIPFTVLVSFTLNILL

SEQ ID NO: 18782 - protein, 17 aa, Mycobacterium avium
LVAWRWVPARLAIVPGP

SEQ ID NO: 18783 - protein, 17 aa, Mycobacterium avium
LVFARVAASLVVFAMAG

SEQ ID NO: 18784 - protein, 22 aa, Mycobacterium avium
LVGWASGLGFGWIYTLGTANVV

SEQ ID NO: 18785 - protein, 17 aa, Mycobacterium avium
LVLCFQIAIGVGILTAT

SEQ ID NO: 18786 - protein, 27 aa, Mycobacterium avium
LVLLIWVLFVWRRRRPGPEATGYGVDH

SEQ ID NO: 18787 - protein, 18 aa, Mycobacterium avium
LVPLPLFFCHGGWPVTVA

SEQ ID NO: 18788 - protein, 17 aa, Mycobacterium avium
LVRPRPASTMLRPTGPR

SEQ ID NO: 18789 - protein, 19 aa, Mycobacterium avium
LYGLHAMFFDQPRVNEKDQ

SEQ ID NO: 18790 - protein, 18 aa, Mycobacterium avium
LYLDGGLQFSTRDEYRYT

SEQ ID NO: 18791 - protein, 23 aa, Mycobacterium avium
MFIPRFLFGVSFCGVLVATACYL

SEQ ID NO: 18792 - protein, 17 aa, Mycobacterium avium
MLALPIVPLFAYSRTAA

SEQ ID NO: 18793 - protein, 18 aa, Mycobacterium avium
MQGGCRFTAQLGSMRIAE

SEQ ID NO: 18794 - protein, 23 aa, Mycobacterium avium
MRPDCRLDVAGLWGVLRINRYTQ

SEQ ID NO: 18795 - protein, 20 aa, Mycobacterium avium
MSHMLPLFRRMQALIDGVNR

SEQ ID NO: 18796 - protein, 28 aa, Mycobacterium avium
MTAMGRWFWWPKRVRVRPASQMLRSVGP

SEQ ID NO: 18797 - protein, 17 aa, Mycobacterium avium
MWVWYKLFAAMLGPSNF

SEQ ID NO: 18798 - protein, 24 aa, Mycobacterium avium
NGLRPEPIIALGILLTWCSVERAV

SEQ ID NO: 18799 - protein, 25 aa, Mycobacterium avium
NGLRPEPLIALGVLVTWMLVERAIA

SEQ ID NO: 18800 - protein, 18 aa, Mycobacterium avium
NHDGRRLVAVLLHGTRQP

SEQ ID NO: 18801 - protein, 17 aa, Mycobacterium avium
PAALPWYYSWPLAVLAP

SEQ ID NO: 18802 - protein, 23 aa, Mycobacterium avium
PADPRLVEVLGWLLYAVPVLVVF

SEQ ID NO: 18803 - protein, 23 aa, Mycobacterium avium
PAGHPGPGWGLIVAWITVLVLIY

SEQ ID NO: 18804 - protein, 20 aa, Mycobacterium avium
PAWGSLRLALPMTGNGDAAF

SEQ ID NO: 18805 - protein, 23 aa, Mycobacterium avium
PAYRFPGYLGFHIVERWQFHYSQ

SEQ ID NO: 18806 - protein, 17 aa, Mycobacterium avium
PDAVFVVGSGIDIPLIK

SEQ ID NO: 18807 - protein, 22 aa, Mycobacterium avium
PDLFAGIVCWLLLSREVLPRLG

SEQ ID NO: 18808 - protein, 18 aa, Mycobacterium avium
PDVLRPDLTIAYTDTDGH

SEQ ID NO: 18809 - protein, 22 aa, Mycobacterium avium
PEDKRLPTVLFQTTVSKLRDLL

SEQ ID NO: 18810 - protein, 18 aa, Mycobacterium avium
PEPIIALGSLVTYVLIER

SEQ ID NO: 18811 - protein, 26 aa, Mycobacterium avium
PFLPRMIHRLALPIVLVWLGIVFITN

SEQ ID NO: 18812 - protein, 19 aa, Mycobacterium avium
PFRCFYLSAPFVVPKTKEV

SEQ ID NO: 18813 - protein, 23 aa, Mycobacterium avium
PGPAWLRRWWLAVVVAAAATIWL

SEQ ID NO: 18814 - protein, 17 aa, Mycobacterium avium
PHPSRWRHVPTILLATS

SEQ ID NO: 18815 - protein, 22 aa, Mycobacterium avium
PLAHWEFYMALAYFKLAIIAAG

SEQ ID NO: 18816 - protein, 19 aa, Mycobacterium avium
PLIRYLIKVPREFINDYLF

SEQ ID NO: 18817 - protein, 19 aa, Mycobacterium avium
PLLAVCGRRLFWPFIPVDR

SEQ ID NO: 18818 - protein, 20 aa, Mycobacterium avium
PLLLLVGLFVMFSRMQGGAR

SEQ ID NO: 18819 - protein, 19 aa, Mycobacterium avium
PLMLGALWASARLARRADS

SEQ ID NO: 18820 - protein, 17 aa, Mycobacterium avium
PLVPAMFSGVLSRLRRT

SEQ ID NO: 18821 - protein, 19 aa, Mycobacterium avium
PQHVRPRPASTMLRPYGPR

SEQ ID NO: 18822 - protein, 20 aa, Mycobacterium avium
PQRVRPRPASTMLRPYGPRP

SEQ ID NO: 18823 - protein, 18 aa, Mycobacterium avium
PRDLAPLLAAWVISVGVM

SEQ ID NO: 18824 - protein, 21 aa, Mycobacterium avium
PRGPLPTEIYWRRRGLAVGIA

SEQ ID NO: 18825 - protein, 17 aa, Mycobacterium avium
PRISRAHLILRFEQGRW

SEQ ID NO: 18826 - protein, 19 aa, Mycobacterium avium
PRLRALGWTGILDKGPDVD

SEQ ID NO: 18827 - protein, 20 aa, Mycobacterium avium
PRLSWLDALYFTAETITTVG

SEQ ID NO: 18828 - protein, 21 aa, Mycobacterium avium
PRPASTMLRPYGPRPAVRQLL

SEQ ID NO: 18829 - protein, 24 aa, Mycobacterium avium
PTLAMALTCWWVISREVMPRLGHA

SEQ ID NO: 18830 - protein, 26 aa, Mycobacterium avium
PTPWYRRPAMLIAWVVSVVVLIGLIV

SEQ ID NO: 18831 - protein, 19 aa, Mycobacterium avium
PVAPEAYALYGLSRVMPQG

SEQ ID NO: 18832 - protein, 23 aa, Mycobacterium avium
PVFLDWLVGLAFPCQRPFGHQNG

SEQ ID NO: 18833 - protein, 17 aa, Mycobacterium avium
PWAWLALVVAGLVVGIF

SEQ ID NO: 18834 - protein, 17 aa, Mycobacterium avium
PWSNAFPAWHYAFATAL

SEQ ID NO: 18835 - protein, 23 aa, Mycobacterium avium
QEWLKSIFPFGGFPWGSVAFGQT

SEQ ID NO: 18836 - protein, 17 aa, Mycobacterium avium
QLMPRYTRPHVRLFTGR

SEQ ID NO: 18837 - protein, 20 aa, Mycobacterium avium
QRLGGGIAWSAGEFPLVIVM

SEQ ID NO: 18838 - protein, 23 aa, Mycobacterium avium
QSLGVPCAVGMLVAVLAALTLAP

SEQ ID NO: 18839 - protein, 19 aa, Mycobacterium avium
QSPVPLIVAVAVSLLAILL

SEQ ID NO: 18840 - protein, 18 aa, Mycobacterium avium
QSVGPWFPLAFLLAHIVV

SEQ ID NO: 18841 - protein, 22 aa, Mycobacterium avium
QTRLRAGSPILFYPAGALAATV

SEQ ID NO: 18842 - protein, 23 aa, Mycobacterium avium
QVKSGDAIERWARNLNRLGAQSA

SEQ ID NO: 18843 - protein, 18 aa, Mycobacterium avium
RATLHFLWLRLARVWPVY

SEQ ID NO: 18844 - protein, 18 aa, Mycobacterium avium
RDNLRWPPASALVTPEEA

SEQ ID NO: 18845 - protein, 20 aa, Mycobacterium avium
RDRNRLVTFIAIFLAGGVMF

SEQ ID NO: 18846 - protein, 18 aa, Mycobacterium avium
RDRVALQAVHFFMADMEA

SEQ ID NO: 18847 - protein, 25 aa, Mycobacterium avium
RFLLYGFLCCAAFLVVRIEERHTRS

SEQ ID NO: 18848 - protein, 17 aa, Mycobacterium avium
RFVMRRIASGIALHDTR

SEQ ID NO: 18849 - protein, 18 aa, Mycobacterium avium
RFWQRMFLTIGILVAVFG

SEQ ID NO: 18850 - protein, 17 aa, Mycobacterium avium
RGGLFVRQVHHWAALIF

SEQ ID NO: 18851 - protein, 17 aa, Mycobacterium avium
RGLRDAWVRPALVLGCG

SEQ ID NO: 18852 - protein, 18 aa, Mycobacterium avium
RHKRGCVIVVGLAAVAAS

SEQ ID NO: 18853 - protein, 19 aa, Mycobacterium avium
RILLPHARPAVMVLAVLTW

SEQ ID NO: 18854 - protein, 19 aa, Mycobacterium avium
RIPLNRAVVMLVIDVSESM

SEQ ID NO: 18855 - protein, 18 aa, Mycobacterium avium
RIPLSFGDVAKRVFLGKP

SEQ ID NO: 18856 - protein, 20 aa, Mycobacterium avium
RIRELIKLSGPDIYRDPAPV

SEQ ID NO: 18857 - protein, 19 aa, Mycobacterium avium
RIVGDPMLLTMLWQNLIGN

SEQ ID NO: 18858 - protein, 21 aa, Mycobacterium avium
RKGYPSLYAWMFGLVVTELPL

SEQ ID NO: 18859 - protein, 23 aa, Mycobacterium avium
RKVGTAVVRWPKPIIVVTAAIAV

SEQ ID NO: 18860 - protein, 19 aa, Mycobacterium avium
RLAQLGGLVFVSAFTVVTL

SEQ ID NO: 18861 - protein, 20 aa, Mycobacterium avium
RLGLERQLLWAASRALVQLL

SEQ ID NO: 18862 - protein, 21 aa, Mycobacterium avium
RLGNAFGLAWRLDRAALLLWT

SEQ ID NO: 18863 - protein, 19 aa, Mycobacterium avium
RLKAWRRGLIFAMFVFAAI

SEQ ID NO: 18864 - protein, 23 aa, Mycobacterium avium
RLWRGLLLFFSRWWQLETLYRSN

SEQ ID NO: 18865 - protein, 26 aa, Mycobacterium avium
RLYRRIGASVVRWPVPILVASSAIVM

SEQ ID NO: 18866 - protein, 20 aa, Mycobacterium avium
RPASTMLRPTGPRPLVRSLL

SEQ ID NO: 18867 - protein, 20 aa, Mycobacterium avium
RPASTMLRPYGPRRAVRELI

SEQ ID NO: 18868 - protein, 17 aa, Mycobacterium avium
RPAVMVLAVLTWVNVWN

SEQ ID NO: 18869 - protein, 19 aa, Mycobacterium avium
RPGSTLYGLHAMFFDQPRV

SEQ ID NO: 18870 - protein, 17 aa, Mycobacterium avium
RPIVFGAVSGLGVGTLG

SEQ ID NO: 18871 - protein, 17 aa, Mycobacterium avium
RPTGPRPLVRSLLLKQP

SEQ ID NO: 18872 - protein, 19 aa, Mycobacterium avium
RPYGPRPAVRQLLLWEDGD

SEQ ID NO: 18873 - protein, 25 aa, Mycobacterium avium
RPYQWWRVALVIASGLAYVVIFSLP

SEQ ID NO: 18874 - protein, 19 aa, Mycobacterium avium
RRHRLRVVLLLGAYVLLTV

SEQ ID NO: 18875 - protein, 17 aa, Mycobacterium avium
RRLGRLMSILSIPMLLA

SEQ ID NO: 18876 - protein, 18 aa, Mycobacterium avium
RRLVAVLLHGTRQPIAPW

SEQ ID NO: 18877 - protein, 22 aa, Mycobacterium avium
RRMGTAVVRWPAPVLAVTIAVA

SEQ ID NO: 18878 - protein, 25 aa, Mycobacterium avium
RRTAMALTRWRVRMEVEPGRRQNLA

SEQ ID NO: 18879 - protein, 25 aa, Mycobacterium avium
RRTPLRSRFRFGIQSKILITMLLSS

SEQ ID NO: 18880 - protein, 18 aa, Mycobacterium avium
RTIYRLIGVDARSEQTWG

SEQ ID NO: 18881 - protein, 22 aa, Mycobacterium avium
RTWKTRLLTLLAIVGPGIIVMV

SEQ ID NO: 18882 - protein, 23 aa, Mycobacterium avium
RVLALPIVLGWLVLAVGVNVFVP

SEQ ID NO: 18883 - protein, 19 aa, Mycobacterium avium
RWRHVPTILLATSLVLLTT

SEQ ID NO: 18884 - protein, 19 aa, Mycobacterium avium
RYFRFLPRRLVERIVPKPG

SEQ ID NO: 18885 - protein, 20 aa, Mycobacterium avium
RYGPMSVRLLFLVFGVGLIA

SEQ ID NO: 18886 - protein, 20 aa, Mycobacterium avium
SAKSLRPGDVIDLAAPEVVP

SEQ ID NO: 18887 - protein, 18 aa, Mycobacterium avium
SALPRWLWTRGSALVSAM

SEQ ID NO: 18888 - protein, 19 aa, Mycobacterium avium
SATNWARTALLLVEPTSAT

SEQ ID NO: 18889 - protein, 17 aa, Mycobacterium avium
SEFAVSLALVLLMLPVI

SEQ ID NO: 18890 - protein, 19 aa, Mycobacterium avium
SFLEYGIPSMEVFRRRKFG

SEQ ID NO: 18891 - protein, 23 aa, Mycobacterium avium
SFPVVAYRSWRWWVATGAAFFAV

SEQ ID NO: 18892 - protein, 17 aa, Mycobacterium avium
SGFSRFPIVDGDLDETV

SEQ ID NO: 18893 - protein, 24 aa, Mycobacterium avium
SIATLLGRWFWWPMVVHPRGDNAR

SEQ ID NO: 18894 - protein, 23 aa, Mycobacterium avium
SIDRPECWGSIAAGSPDAYTPGA

SEQ ID NO: 18895 - protein, 24 aa, Mycobacterium avium
SLATLLGRWFWWPQHVRPRPASTM

SEQ ID NO: 18896 - protein, 22 aa, Mycobacterium avium
SMIFFWGWGRLTAAMIFGSVRN

SEQ ID NO: 18897 - protein, 23 aa, Mycobacterium avium
SMLGELPWWITVLILAREFGVTV

SEQ ID NO: 18898 - protein, 23 aa, Mycobacterium avium
SNVLRYGYYPALIVGLTIAVMIL

SEQ ID NO: 18899 - protein, 21 aa, Mycobacterium avium
SPPGPRIGAFFDLDGTLVAGF

SEQ ID NO: 18900 - protein, 20 aa, Mycobacterium avium
SPYLRIALRSAISPQIETTK

SEQ ID NO: 18901 - protein, 18 aa, Mycobacterium avium
SRLRRPGAVVLEIDDEDP

SEQ ID NO: 18902 - protein, 21 aa, Mycobacterium avium
SRPRAAFAFALPVLPVLLTLA

SEQ ID NO: 18903 - protein, 23 aa, Mycobacterium avium
SRREFGRPAGLRGSFVAERVRPK

SEQ ID NO: 18904 - protein, 17 aa, Mycobacterium avium
SVFGVFWGAFGLVTGAA

SEQ ID NO: 18905 - protein, 18 aa, Mycobacterium avium
SVILWRFFGDALSKRSHT

SEQ ID NO: 18906 - protein, 23 aa, Mycobacterium avium
TADLYPRYVCDYGTPAHASSAAD

SEQ ID NO: 18907 - protein, 18 aa, Mycobacterium avium
TAHLPRRRVLVASLTCLT

SEQ ID NO: 18908 - protein, 20 aa, Mycobacterium avium
TALQRLGIRISIDDYGTGWS

SEQ ID NO: 18909 - protein, 19 aa, Mycobacterium avium
TCPWPPPTVFLMRHGANNT

SEQ ID NO: 18910 - protein, 17 aa, Mycobacterium avium
TGACVRLHPRFDIDKVL

SEQ ID NO: 18911 - protein, 23 aa, Mycobacterium avium
TGARLRWVPSQGPSAMPAQGLES

SEQ ID NO: 18912 - protein, 17 aa, Mycobacterium avium
TGSVVIWYSPRRCDRSA

SEQ ID NO: 18913 - protein, 20 aa, Mycobacterium avium
TKLNSAFAFGGPKCLVKEIQ

SEQ ID NO: 18914 - protein, 24 aa, Mycobacterium avium
TKTPLSFLCYWIIPFALLGLAAVV

SEQ ID NO: 18915 - protein, 18 aa, Mycobacterium avium
TNPEFKRGLKLFLSPDGK

SEQ ID NO: 18916 - protein, 23 aa, Mycobacterium avium
TPEFPWTGLTIFLLIAVFAAAVG

SEQ ID NO: 18917 - protein, 18 aa, Mycobacterium avium
TPGTWLLDMGMLAALALC

SEQ ID NO: 18918 - protein, 18 aa, Mycobacterium avium
TPIFKRPIVFGAVSGLGV

SEQ ID NO: 18919 - protein, 28 aa, Mycobacterium avium
TRGWRRIGTAIVRWPGPILVVATGVALV

SEQ ID NO: 18920 - protein, 21 aa, Mycobacterium avium
TRILFDWRFDLIFGTAAIVLA

SEQ ID NO: 18921 - protein, 23 aa, Mycobacterium avium
TRRFSAIALWCWVAMALSGLVNA

SEQ ID NO: 18922 - protein, 17 aa, Mycobacterium avium
TTALRVGVATVWLSVIV

SEQ ID NO: 18923 - protein, 19 aa, Mycobacterium avium
TVFLACWVPLFASFAALLV

SEQ ID NO: 18924 - protein, 18 aa, Mycobacterium avium
TVVVRWPGPILVLTIGVA

SEQ ID NO: 18925 - protein, 18 aa, Mycobacterium avium
TWFAWLTVIWLWLTVLFA

SEQ ID NO: 18926 - protein, 23 aa, Mycobacterium avium
TWLGRFVSTYGWRAYALPALVVL

SEQ ID NO: 18927 - protein, 19 aa, Mycobacterium avium
VAAGLAWYLAHDVLDHREP

SEQ ID NO: 18928 - protein, 22 aa, Mycobacterium avium
VAAGNPWWANWFPTTKNPPEAP

SEQ ID NO: 18929 - protein, 23 aa, Mycobacterium avium
VAALLGRWFWWPQRVRPRPASTM

SEQ ID NO: 18930 - protein, 17 aa, Mycobacterium avium
VACAVAIAVDATVVRLV

SEQ ID NO: 18931 - protein, 18 aa, Mycobacterium avium
VADLRPAQMWSLAGLITT

SEQ ID NO: 18932 - protein, 18 aa, Mycobacterium avium
VAGPWRWSATMLAEAVPE

SEQ ID NO: 18933 - protein, 17 aa, Mycobacterium avium
VALSFASVNGWWYVSNF

SEQ ID NO: 18934 - protein, 19 aa, Mycobacterium avium
VAQHLGFRAAFLLLAGLSL

SEQ ID NO: 18935 - protein, 17 aa, Mycobacterium avium
VATSFYGRLSCSIFNAA

SEQ ID NO: 18936 - protein, 19 aa, Mycobacterium avium
VAVAVLVDFAAKRTREARR

SEQ ID NO: 18937 - protein, 24 aa, Mycobacterium avium
VDRYHPRPVLGFGFSLLAIALTWL

SEQ ID NO: 18938 - protein, 18 aa, Mycobacterium avium
VEHALNFWGQRFTSSGVE

SEQ ID NO: 18939 - protein, 20 aa, Mycobacterium avium
VEVPNALPLILGGLRSATLQ

SEQ ID NO: 18940 - protein, 19 aa, Mycobacterium avium
VFFWRDWVRILAGFFSSLR

SEQ ID NO: 18941 - protein, 19 aa, Mycobacterium avium
VFGRGDIALAWAFLGAAIG

SEQ ID NO: 18942 - protein, 18 aa, Mycobacterium avium
VGFIPFVIAMGIGLGVSS

SEQ ID NO: 18943 - protein, 26 aa, Mycobacterium avium
VGGCARIPYTLGIAAFGGRKWTTFSA

SEQ ID NO: 18944 - protein, 17 aa, Mycobacterium avium
VGLWFRRIWILQPHGEV

SEQ ID NO: 18945 - protein, 17 aa, Mycobacterium avium
VGMAFVWSPLTATATRN

SEQ ID NO: 18946 - protein, 20 aa, Mycobacterium avium
VGRVRPRLYLALGPPALSIS

SEQ ID NO: 18947 - protein, 18 aa, Mycobacterium avium
VGSAGMLRRVFVIASAIT

SEQ ID NO: 18948 - protein, 18 aa, Mycobacterium avium
VHPRLRVHWVARRDEKSL

SEQ ID NO: 18949 - protein, 21 aa, Mycobacterium avium
VKGDASMAWMLLGAVVLAGAV

SEQ ID NO: 18950 - protein, 17 aa, Mycobacterium avium
VLLALIFYFVWGRHHSA

SEQ ID NO: 18951 - protein, 19 aa, Mycobacterium avium
VLLFCIAFGLAMDYEVFLV

SEQ ID NO: 18952 - protein, 20 aa, Mycobacterium avium
VLLFCIAFGLSMDYEVFLLS

SEQ ID NO: 18953 - protein, 18 aa, Mycobacterium avium
VLVILRLLYGIGMGGEWG

SEQ ID NO: 18954 - protein, 23 aa, Mycobacterium avium
VMLLCLFGMLVILLRRGHVPGVA

SEQ ID NO: 18955 - protein, 20 aa, Mycobacterium avium
VMNKLRWVLLIVGGVGVAVA

SEQ ID NO: 18956 - protein, 18 aa, Mycobacterium avium
VPEIPRLPSGKVLRRVLK

SEQ ID NO: 18957 - protein, 21 aa, Mycobacterium avium
VPGLHCWRPVTLAGLGVGVLG

SEQ ID NO: 18958 - protein, 29 aa, Mycobacterium avium
VPSIVALLGRWFWWPSPLPRRGVARVVKT

SEQ ID NO: 18959 - protein, 19 aa, Mycobacterium avium
VPTLRRWLATEVRPKLDEV

SEQ ID NO: 18960 - protein, 20 aa, Mycobacterium avium
VQGLYRWFPPITVWTGLSLL

SEQ ID NO: 18961 - protein, 23 aa, Mycobacterium avium
VRAKAAFIWAKFPKFVLGFLVVS

SEQ ID NO: 18962 - protein, 18 aa, Mycobacterium avium
VRALPDFWRLLQVRVASQ

SEQ ID NO: 18963 - protein, 24 aa, Mycobacterium avium
VRGTLRILLPISIVGAVLLVAGGA

SEQ ID NO: 18964 - protein, 22 aa, Mycobacterium avium
VRPELLPALSGQNWAALPGLQT

SEQ ID NO: 18965 - protein, 19 aa, Mycobacterium avium
VRSYFYWEKHCFDIPACFA

SEQ ID NO: 18966 - protein, 17 aa, Mycobacterium avium
VSIFPTIMLSIPYTVLI

SEQ ID NO: 18967 - protein, 19 aa, Mycobacterium avium
VSLTLTWLVYVSLRRDVAG

SEQ ID NO: 18968 - protein, 17 aa, Mycobacterium avium
VSVLLTFFPGWVTVGLM

SEQ ID NO: 18969 - protein, 23 aa, Mycobacterium avium
VTSNELVAWVCIAASVVGVVLLI

SEQ ID NO: 18970 - protein, 20 aa, Mycobacterium avium
VVLYCVVRFALGMHAVHPVA

SEQ ID NO: 18971 - protein, 19 aa, Mycobacterium avium
VVVALLFRTLDAFRIFDNI

SEQ ID NO: 18972 - protein, 17 aa, Mycobacterium avium
WAQLSWLPQRPVLVPGT

SEQ ID NO: 18973 - protein, 18 aa, Mycobacterium avium
WAVMFLVAVGFWNFLGAG

SEQ ID NO: 18974 - protein, 17 aa, Mycobacterium avium
WDVVLAMAVAGTVNAAM

SEQ ID NO: 18975 - protein, 25 aa, Mycobacterium avium
WEKHCFDIPACFAFRSVFDALDGID

SEQ ID NO: 18976 - protein, 25 aa, Mycobacterium avium
WEKHCFDIPVCWSMRSLFDALDGID

SEQ ID NO: 18977 - protein, 25 aa, Mycobacterium avium
WGNCTIKVMVGFLFLYPAFVAKAHQ

SEQ ID NO: 18978 - protein, 17 aa, Mycobacterium avium
WIPGAPLLWDLVVTLSA

SEQ ID NO: 18979 - protein, 18 aa, Mycobacterium avium
WLALAALVPLTCWIAGLY

SEQ ID NO: 18980 - protein, 17 aa, Mycobacterium avium
WLRRHTRAIQIFGGVLL

SEQ ID NO: 18981 - protein, 20 aa, Mycobacterium avium
WLSLCRWDLLGPLRFVGLSN

SEQ ID NO: 18982 - protein, 21 aa, Mycobacterium avium
WPLFAWFCVYAYRKFVRYEEE

SEQ ID NO: 18983 - protein, 25 aa, Mycobacterium avium
WPTAPRWLGVPLYLLLGWVAIWYAP

SEQ ID NO: 18984 - protein, 20 aa, Mycobacterium avium
WRPMLICAALVLTSQVADFM

SEQ ID NO: 18985 - protein, 25 aa, Mycobacterium avium
WRSDRLFCIAVGFLALVFAATTVSG

SEQ ID NO: 18986 - protein, 18 aa, Mycobacterium avium
WRSRRWRTVWVPVAALAG

SEQ ID NO: 18987 - protein, 17 aa, Mycobacterium avium
WSRRARPIVLIPDAAAA

SEQ ID NO: 18988 - protein, 19 aa, Mycobacterium avium
WTRYGALMVTDAVIRVMVA

SEQ ID NO: 18989 - protein, 17 aa, Mycobacterium avium
WVTVGLMLALLVAAARL

SEQ ID NO: 18990 - protein, 28 aa, Mycobacterium avium
YARLVLLWFLCSAFPIAVIAALVVLRSY

SEQ ID NO: 18991 - protein, 22 aa, Mycobacterium avium
YCLSFSRLPWFNTMGAPVAIGM

SEQ ID NO: 18992 - protein, 19 aa, Mycobacterium avium
YDNFGLRWGLFGAAAIMVV

SEQ ID NO: 18993 - protein, 21 aa, Mycobacterium avium
YETIGGLVLREIGHIPAAGET

SEQ ID NO: 18994 - protein, 27 aa, Mycobacterium avium
YKVGPTIAWYQDWLRYYFLTVESNPDG

SEQ ID NO: 18995 - protein, 17 aa, Mycobacterium avium
YLMCGLARHRRLLSQEA

SEQ ID NO: 18996 - protein, 18 aa, Mycobacterium avium
YNGRISIVRGIQGSLLGV

SEQ ID NO: 18997 - protein, 17 aa, Mycobacterium avium
YNMPLELVLTVTPFLII

SEQ ID NO: 18998 - protein, 24 aa, Mycobacterium avium
YPGFPADVLYEFRLVSLAAQLVLW

SEQ ID NO: 18999 - protein, 20 aa, Mycobacterium avium
YPPCPFKWLTGWNCPFCGGL

SEQ ID NO: 19000 - protein, 23 aa, Mycobacterium avium
YRIGALCPYCMVVWVVTIALLVV

SEQ ID NO: 19001 - protein, 20 aa, Mycobacterium avium
YRPNLFVTYWSFRLMIGFLA

SEQ ID NO: 19002 - protein, 19 aa, Mycobacterium avium
YSHNFYLWWLAKAGAVGMA

SEQ ID NO: 19003 - protein, 17 aa, Mycobacterium avium
YSLPVRRLVGFVATGLD

SEQ ID NO: 19004 - protein, 19 aa, Mycobacterium avium
YTLKAELPASGGLYPTANV

SEQ ID NO: 19005 - protein, 17 aa, Mycobacterium avium
YTRPHVRLFTGRVNTGC

SEQ ID NO: 19006 - protein, 27 aa, Mycobacterium avium
YTRWRRLATAIVRWPAPILATSVILAI

SEQ ID NO: 19007 - protein, 22 aa, Mycobacterium avium
AAAVGIGWWLLRPDDDTITVTA

SEQ ID NO: 19008 - protein, 18 aa, Mycobacterium avium
AALGRWAGFSVAWLYWYF

SEQ ID NO: 19009 - protein, 24 aa, Mycobacterium avium
AALLAIGVVLGWPLWWVSACSVLV

SEQ ID NO: 19010 - protein, 18 aa, Mycobacterium avium
AAPFIWLAWLLRIPAVFV

SEQ ID NO: 19011 - protein, 18 aa, Mycobacterium avium
AAQLDWGALVIVGGVATL

SEQ ID NO: 19012 - protein, 17 aa, Mycobacterium avium
AARPGHWSLFDGGYTFA

SEQ ID NO: 19013 - protein, 23 aa, Mycobacterium avium
AAVPRPPLGPVWVALLIIGASSG

SEQ ID NO: 19014 - protein, 17 aa, Mycobacterium avium
ADCPRYGQLQGPSCFTA

SEQ ID NO: 19015 - protein, 22 aa, Mycobacterium avium
ADRLPGVRLDWFTAEHTATARQ

SEQ ID NO: 19016 - protein, 22 aa, Mycobacterium avium
AFRFLTPWGRQFWRITRGYFVG

SEQ ID NO: 19017 - protein, 20 aa, Mycobacterium avium
AGFCVYRLHGIFGSHNNTSA

SEQ ID NO: 19018 - protein, 21 aa, Mycobacterium avium
AIALASIWLKGPLVLGLGAIQ

SEQ ID NO: 19019 - protein, 20 aa, Mycobacterium avium
AKGGTPGWVIRKHVVKNAAG

SEQ ID NO: 19020 - protein, 18 aa, Mycobacterium avium
ALGVPGWITQRLWWALLL

SEQ ID NO: 19021 - protein, 18 aa, Mycobacterium avium
ALLRRLQPDWSMTFVERL

SEQ ID NO: 19022 - protein, 25 aa, Mycobacterium avium
ALPPRPEVRLLWALIAAAAMIEGAL

SEQ ID NO: 19023 - protein, 17 aa, Mycobacterium avium
ALRSRLLVRLSGRGGMV

SEQ ID NO: 19024 - protein, 18 aa, Mycobacterium avium
ALVAFAWRRPRFDPLKPG

SEQ ID NO: 19025 - protein, 18 aa, Mycobacterium avium
AMRFRPFIRLTVEWVEVL

SEQ ID NO: 19026 - protein, 17 aa, Mycobacterium avium
APIPVPIPLPIPGLGGP

SEQ ID NO: 19027 - protein, 18 aa, Mycobacterium avium
APKSLWLSAFAHPERDKR

SEQ ID NO: 19028 - protein, 18 aa, Mycobacterium avium
APLSILLALWAVRAVAHW

SEQ ID NO: 19029 - protein, 17 aa, Mycobacterium avium
APPGWLPDWLRPAGSRR

SEQ ID NO: 19030 - protein, 19 aa, Mycobacterium avium
APTAFRFLGLHWSLPLGVA

SEQ ID NO: 19031 - protein, 19 aa, Mycobacterium avium
APTMRLGHMLVFFVRAVLA

SEQ ID NO: 19032 - protein, 17 aa, Mycobacterium avium
AQAWARRHRQLRAALTP

SEQ ID NO: 19033 - protein, 18 aa, Mycobacterium avium
ARARWPLRAPRAAMVLWQ

SEQ ID NO: 19034 - protein, 18 aa, Mycobacterium avium
ARETVGWMRAELPKVSEA

SEQ ID NO: 19035 - protein, 18 aa, Mycobacterium avium
ARLLTWRASWMAANNVPF

SEQ ID NO: 19036 - protein, 20 aa, Mycobacterium avium
ARSQLWLSLLSWAVVVALYF

SEQ ID NO: 19037 - protein, 24 aa, Mycobacterium avium
ARSRRRLRLPSWSVAWKAAVIALI

SEQ ID NO: 19038 - protein, 18 aa, Mycobacterium avium
ARYLSVFLLLLVGVYLLV

SEQ ID NO: 19039 - protein, 24 aa, Mycobacterium avium
ASALCFLPGLILGLFAQFTIPYAI

SEQ ID NO: 19040 - protein, 18 aa, Mycobacterium avium
ASIGLLVWFWPRLGPDKL

SEQ ID NO: 19041 - protein, 20 aa, Mycobacterium avium
ASLGALWAWIAPPIRAVVAL

SEQ ID NO: 19042 - protein, 20 aa, Mycobacterium avium
ATLWWVVGLVMLRAISPPFL

SEQ ID NO: 19043 - protein, 18 aa, Mycobacterium avium
ATRFEYRDALLLDTRGNV

SEQ ID NO: 19044 - protein, 17 aa, Mycobacterium avium
AVFCVLAVLPLMVLTQL

SEQ ID NO: 19045 - protein, 18 aa, Mycobacterium avium
AVGAEWAGSVLLSAEYAP

SEQ ID NO: 19046 - protein, 19 aa, Mycobacterium avium
AVLATAGYEGWLLFEQHQK

SEQ ID NO: 19047 - protein, 25 aa, Mycobacterium avium
AVLRWSRNRMAFLAALLFMMALCFA

SEQ ID NO: 19048 - protein, 19 aa, Mycobacterium avium
AVLVCADFILLQVVTGAWT

SEQ ID NO: 19049 - protein, 20 aa, Mycobacterium avium
AVQAPWPLLRTFAAGPALSR

SEQ ID NO: 19050 - protein, 19 aa, Mycobacterium avium
AVTYPAHWESAAVEALGAA

SEQ ID NO: 19051 - protein, 19 aa, Mycobacterium avium
AVVALEIALAISIRPTVAL

SEQ ID NO: 19052 - protein, 18 aa, Mycobacterium avium
CLIAPMFLAMYLRAFYSP

SEQ ID NO: 19053 - protein, 20 aa, Mycobacterium avium
CWWAPRWARRLQNKIGLGEI

SEQ ID NO: 19054 - protein, 22 aa, Mycobacterium avium
DALELRGRILGAFEAAEVATDP

SEQ ID NO: 19055 - protein, 17 aa, Mycobacterium avium
DELYARVGFVLQETQLV

SEQ ID NO: 19056 - protein, 20 aa, Mycobacterium avium
DFSEPTALNWARHGTDVDFG

SEQ ID NO: 19057 - protein, 23 aa, Mycobacterium avium
DGDRAHWDWLKWLPHNRHPTHDD

SEQ ID NO: 19058 - protein, 23 aa, Mycobacterium avium
DSEPRRRPVLLVGSGLAVVGISA

SEQ ID NO: 19059 - protein, 23 aa, Mycobacterium avium
DTSKPVGITMLWPLADRPRLAPG

SEQ ID NO: 19060 - protein, 18 aa, Mycobacterium avium
DTSSWRWIFLINVPIGLL

SEQ ID NO: 19061 - protein, 19 aa, Mycobacterium avium
DVVSWKLKPGVVSTMTAQA

SEQ ID NO: 19062 - protein, 17 aa, Mycobacterium avium
EALRLKGYLLMCRNSRR

SEQ ID NO: 19063 - protein, 17 aa, Mycobacterium avium
EILGRLGPYRVNSTVNG

SEQ ID NO: 19064 - protein, 19 aa, Mycobacterium avium
EIQKLSGLSINHFIAVDFA

SEQ ID NO: 19065 - protein, 20 aa, Mycobacterium avium
EKHCYDIPICFSLRSIFDAL

SEQ ID NO: 19066 - protein, 21 aa, Mycobacterium avium
EKHCYDIPVCIGLRSLFDTFD

SEQ ID NO: 19067 - protein, 19 aa, Mycobacterium avium
ELGEILGFGGMSEVHLARD

SEQ ID NO: 19068 - protein, 25 aa, Mycobacterium avium
ELPGCPGSVCAGKIKQAYGLAYQQS

SEQ ID NO: 19069 - protein, 19 aa, Mycobacterium avium
EMRSWPAPLSILLALWAVR

SEQ ID NO: 19070 - protein, 19 aa, Mycobacterium avium
EMTVRLGIVTGRGHGSLIR

SEQ ID NO: 19071 - protein, 19 aa, Mycobacterium avium
EPPNRVRIGLMGIVVTVLV

SEQ ID NO: 19072 - protein, 17 aa, Mycobacterium avium
ERLRPPPGYKDTTVPGI

SEQ ID NO: 19073 - protein, 23 aa, Mycobacterium avium
ERSRQGWKIQRWRSRVRNHTIVI

SEQ ID NO: 19074 - protein, 24 aa, Mycobacterium avium
ESGYRLRVKMALAEGQYKISKLDQ

SEQ ID NO: 19075 - protein, 20 aa, Mycobacterium avium
FGAFAHRWLARRTRRRINPG

SEQ ID NO: 19076 - protein, 18 aa, Mycobacterium avium
FGAGLAWLAMDRRRIRQE

SEQ ID NO: 19077 - protein, 17 aa, Mycobacterium avium
FGDFRFGPESTYHATFV

SEQ ID NO: 19078 - protein, 22 aa, Mycobacterium avium
FGEYLPMPWLFKHLSGYADRAG

SEQ ID NO: 19079 - protein, 26 aa, Mycobacterium avium
FGRWRRIGTAIVRWPAPILTATIAVA

SEQ ID NO: 19080 - protein, 18 aa, Mycobacterium avium
FLLVFGIFVRRVRDIIIG

SEQ ID NO: 19081 - protein, 19 aa, Mycobacterium avium
FLSRVETLIPMYAHNPAQL

SEQ ID NO: 19082 - protein, 18 aa, Mycobacterium avium
FNVALPWSKQVSLSKSAV

SEQ ID NO: 19083 - protein, 17 aa, Mycobacterium avium
FPGLPGMVFARLGASLL

SEQ ID NO: 19084 - protein, 25 aa, Mycobacterium avium
FRVIGRAGGIYGDFYNFYLCDISIK

SEQ ID NO: 19085 - protein, 18 aa, Mycobacterium avium
FSIDELPQFINVIKGDMS

SEQ ID NO: 19086 - protein, 17 aa, Mycobacterium avium
FSWLRRRSGSLIAPIAL

SEQ ID NO: 19087 - protein, 18 aa, Mycobacterium avium
FTALRIAFLAVLVGTTLE

SEQ ID NO: 19088 - protein, 18 aa, Mycobacterium avium
FTARRAAVLAAVICVLTL

SEQ ID NO: 19089 - protein, 17 aa, Mycobacterium avium
FVGRLGDMFGRVRIYNA

SEQ ID NO: 19090 - protein, 18 aa, Mycobacterium avium
FVRQHFWLPGGSTGSSDV

SEQ ID NO: 19091 - protein, 19 aa, Mycobacterium avium
FWIRRARRLLPALVLMVLT

SEQ ID NO: 19092 - protein, 17 aa, Mycobacterium avium
FWLGLVVLQVFSVQLGL

SEQ ID NO: 19093 - protein, 17 aa, Mycobacterium avium
GAGLIGYGIFRWHTRHR

SEQ ID NO: 19094 - protein, 22 aa, Mycobacterium avium
GAGRGRPTWRVLLIGLGVIVAW

SEQ ID NO: 19095 - protein, 17 aa, Mycobacterium avium
GAIGLAIVAALAVLVTV

SEQ ID NO: 19096 - protein, 24 aa, Mycobacterium avium
GANFVICLVLLYAIALIWGLPNLH

SEQ ID NO: 19097 - protein, 27 aa, Mycobacterium avium
GAPGGLWARRKWEVVRLVSPLALLALW

SEQ ID NO: 19098 - protein, 17 aa, Mycobacterium avium
GAPITIAVPAYWSDDQF

SEQ ID NO: 19099 - protein, 19 aa, Mycobacterium avium
GARNYPCMGHPGKRAPTVE

SEQ ID NO: 19100 - protein, 18 aa, Mycobacterium avium
GAVALVLLGGFAILGGIL

SEQ ID NO: 19101 - protein, 19 aa, Mycobacterium avium
GAVLCLRFTRLNYFQSLGI

SEQ ID NO: 19102 - protein, 17 aa, Mycobacterium avium
GAWGLAEVFGWKHTLNQ

SEQ ID NO: 19103 - protein, 21 aa, Mycobacterium avium
GCLPAVIWWACHRPNRLWWRY

SEQ ID NO: 19104 - protein, 23 aa, Mycobacterium avium
GEDYLRLAALGAYGSFFNIYFCS

SEQ ID NO: 19105 - protein, 17 aa, Mycobacterium avium
GFAGFPIGGRFLRADNP

SEQ ID NO: 19106 - protein, 17 aa, Mycobacterium avium
GFLPPFVTWFAALLFAV

SEQ ID NO: 19107 - protein, 21 aa, Mycobacterium avium
GGARLLLPIALGALLGGSAAA

SEQ ID NO: 19108 - protein, 22 aa, Mycobacterium avium
GGLRAALPVTFVTFGLGYLAII

SEQ ID NO: 19109 - protein, 17 aa, Mycobacterium avium
GGPPRAVIMVAVALAVT

SEQ ID NO: 19110 - protein, 17 aa, Mycobacterium avium
GIVPWWFVVVLLVRDGL

SEQ ID NO: 19111 - protein, 21 aa, Mycobacterium avium
GKQPRPAIGPLRRTGLSGMLR

SEQ ID NO: 19112 - protein, 17 aa, Mycobacterium avium
GLASFFGQLGFSPALST

SEQ ID NO: 19113 - protein, 18 aa, Mycobacterium avium
GLDARRGWAHRPFIGSFV

SEQ ID NO: 19114 - protein, 23 aa, Mycobacterium avium
GLGMPIDLSWELWAYGVFAIAAV

SEQ ID NO: 19115 - protein, 19 aa, Mycobacterium avium
GLHQCWRGAPAVTVSVVGW

SEQ ID NO: 19116 - protein, 23 aa, Mycobacterium avium
GLLKRRWPAVVVFILLVVFSALV

SEQ ID NO: 19117 - protein, 18 aa, Mycobacterium avium
GPAAGHRSDPHWTRPEDS

SEQ ID NO: 19118 - protein, 19 aa, Mycobacterium avium
GPFFKVVLHNLALYQISQP

SEQ ID NO: 19119 - protein, 18 aa, Mycobacterium avium
GPLLRPGYLLLRDAVSTP

SEQ ID NO: 19120 - protein, 25 aa, Mycobacterium avium
GPPGQRPSGNRVWWVVGTLIAVGVL

SEQ ID NO: 19121 - protein, 18 aa, Mycobacterium avium
GPPPAMPPSLAWWASSLQ

SEQ ID NO: 19122 - protein, 19 aa, Mycobacterium avium
GPYHLKRLLGRGGMGEVYE

SEQ ID NO: 19123 - protein, 19 aa, Mycobacterium avium
GQLRAGTALIARGEFSLII

SEQ ID NO: 19124 - protein, 18 aa, Mycobacterium avium
GRGDFFAVVRSLALFVNA

SEQ ID NO: 19125 - protein, 18 aa, Mycobacterium avium
GRMKDLLIVYGRNHYPED

SEQ ID NO: 19126 - protein, 17 aa, Mycobacterium avium
GRPWAWLALVVAGLVVG

SEQ ID NO: 19127 - protein, 19 aa, Mycobacterium avium
GRWALCLVDGSPLRATQSL

SEQ ID NO: 19128 - protein, 17 aa, Mycobacterium avium
GRWRRLRTLAVITGPGL

SEQ ID NO: 19129 - protein, 23 aa, Mycobacterium avium
GTARWPWVVGVAAIVAAIALVVS

SEQ ID NO: 19130 - protein, 17 aa, Mycobacterium avium
GTQHLGLLVLRAGLGVV

SEQ ID NO: 19131 - protein, 17 aa, Mycobacterium avium
GTVLRPAATIAVLLAAV

SEQ ID NO: 19132 - protein, 18 aa, Mycobacterium avium
GVIVAWLLIVMLLARLFA

SEQ ID NO: 19133 - protein, 19 aa, Mycobacterium avium
GWEIRDFRTARKAARIGVP

SEQ ID NO: 19134 - protein, 19 aa, Mycobacterium avium
HAAVWWKALLALVVAVAMT

SEQ ID NO: 19135 - protein, 26 aa, Mycobacterium avium
HPKKFSWHWWWLMAAIPVAVLLVLLI

SEQ ID NO: 19136 - protein, 25 aa, Mycobacterium avium
HSDLDWLWWFGAGWLAVAVVGAGVI

SEQ ID NO: 19137 - protein, 18 aa, Mycobacterium avium
HTTHWGLQIDHFWWTAIW

SEQ ID NO: 19138 - protein, 24 aa, Mycobacterium avium
IAALLGRWFWWPQLVRRRPASQLL

SEQ ID NO: 19139 - protein, 19 aa, Mycobacterium avium
IAAWLAVLVCADFILLQVV

SEQ ID NO: 19140 - protein, 21 aa, Mycobacterium avium
IAGMFMWIAIIWRGIRGRLKG

SEQ ID NO: 19141 - protein, 18 aa, Mycobacterium avium
IANILRNLGIDWDPAKGT

SEQ ID NO: 19142 - protein, 20 aa, Mycobacterium avium
IAVAVGAIWLGRRLLHGRQQ

SEQ ID NO: 19143 - protein, 23 aa, Mycobacterium avium
IAVKVDWPHFWSLITSPSSRTAL

SEQ ID NO: 19144 - protein, 20 aa, Mycobacterium avium
ICVAALLVAQMFVRPIRRLQ

SEQ ID NO: 19145 - protein, 23 aa, Mycobacterium avium
IELPPGYLPLRIPIEVNFTQRVA

SEQ ID NO: 19146 - protein, 18 aa, Mycobacterium avium
IGQPLATEFVWGRQYGEN

SEQ ID NO: 19147 - protein, 17 aa, Mycobacterium avium
IGRHRVLVVTILMMTVS

SEQ ID NO: 19148 - protein, 20 aa, Mycobacterium avium
IGVALGWGWADAVAGIVVTG

SEQ ID NO: 19149 - protein, 17 aa, Mycobacterium avium
IKFFNWIGTMWKGQLTF

SEQ ID NO: 19150 - protein, 17 aa, Mycobacterium avium
ILALWAAVAGAFVSVLY

SEQ ID NO: 19151 - protein, 18 aa, Mycobacterium avium
ILGPWFWWPTLVRSRPLP

SEQ ID NO: 19152 - protein, 17 aa, Mycobacterium avium
ILRILVRRHRVVGTWPL

SEQ ID NO: 19153 - protein, 21 aa, Mycobacterium avium
IPALFTLVGDRIWWPNNPSRH

SEQ ID NO: 19154 - protein, 21 aa, Mycobacterium avium
IPGDSVVAWWVRLVMPALAVV

SEQ ID NO: 19155 - protein, 17 aa, Mycobacterium avium
IPVCIGLRSLFDTFDGF

SEQ ID NO: 19156 - protein, 17 aa, Mycobacterium avium
IRDKELRAKLTPDYDCG

SEQ ID NO: 19157 - protein, 24 aa, Mycobacterium avium
IRRLSVPILLVWVAVAAISNIAVP

SEQ ID NO: 19158 - protein, 23 aa, Mycobacterium avium
IVGWLTLWPFFGWLTTHFVVTNR

SEQ ID NO: 19159 - protein, 19 aa, Mycobacterium avium
KGADFTAAMAFEIGSTNLV

SEQ ID NO: 19160 - protein, 20 aa, Mycobacterium avium
KIRRAACVERYLRGAFIRLD

SEQ ID NO: 19161 - protein, 17 aa, Mycobacterium avium
KLSRLPLGWFTARGSGS

SEQ ID NO: 19162 - protein, 18 aa, Mycobacterium avium
KLVVFWSVLAMFTVMIIV

SEQ ID NO: 19163 - protein, 23 aa, Mycobacterium avium
KLYTDRHIRLWVVYVDTFSGQTA

SEQ ID NO: 19164 - protein, 18 aa, Mycobacterium avium
KMNMPWLFFFSGLAIPAF

SEQ ID NO: 19165 - protein, 20 aa, Mycobacterium avium
KPVARPAHRWVMVPDDGPPP

SEQ ID NO: 19166 - protein, 20 aa, Mycobacterium avium
KRPLIPRMVRAFAIPIIFFW

SEQ ID NO: 19167 - protein, 17 aa, Mycobacterium avium
KRPSTWRHLPAILLVAS

SEQ ID NO: 19168 - protein, 18 aa, Mycobacterium avium
KRRRLKLVRAIAAGILAA

SEQ ID NO: 19169 - protein, 23 aa, Mycobacterium avium
KRYGRAALVVAVYAGAFGLAGGL

SEQ ID NO: 19170 - protein, 18 aa, Mycobacterium avium
KVCSHLGCPASLYEEQSY

SEQ ID NO: 19171 - protein, 20 aa, Mycobacterium avium
KVSLLLSVALFFVWMIAVAF

SEQ ID NO: 19172 - protein, 17 aa, Mycobacterium avium
KYYPAWLPSRRFIAAVI

SEQ ID NO: 19173 - protein, 18 aa, Mycobacterium avium
LAAFAAMFLAGGVFFTLT

SEQ ID NO: 19174 - protein, 19 aa, Mycobacterium avium
LACPVWFYQLWAFITPGLY

SEQ ID NO: 19175 - protein, 17 aa, Mycobacterium avium
LADGRPVTIGSFFKPRN

SEQ ID NO: 19176 - protein, 18 aa, Mycobacterium avium
LAGLLGWTLSRPAVTADT

SEQ ID NO: 19177 - protein, 19 aa, Mycobacterium avium
LALLAWFGFYLYKISHGNV

SEQ ID NO: 19178 - protein, 20 aa, Mycobacterium avium
LCDTYRLAARAVQIETNGKN

SEQ ID NO: 19179 - protein, 19 aa, Mycobacterium avium
LDAGPFLSYGIQWIAFGIL

SEQ ID NO: 19180 - protein, 22 aa, Mycobacterium avium
LDGRKLLWWTLSRFTTLRNLPF

SEQ ID NO: 19181 - protein, 20 aa, Mycobacterium avium
LDLGCGRGAVLLAAAKRLPR

SEQ ID NO: 19182 - protein, 17 aa, Mycobacterium avium
LDLPRLWQILLIAGMFM

SEQ ID NO: 19183 - protein, 17 aa, Mycobacterium avium
LDPVLRWQARVIRMDGR

SEQ ID NO: 19184 - protein, 20 aa, Mycobacterium avium
LEIALAIGIRTTGTVALQPT

SEQ ID NO: 19185 - protein, 19 aa, Mycobacterium avium
LELPATGGLYRFSNVTYRG

SEQ ID NO: 19186 - protein, 19 aa, Mycobacterium avium
LEPLRRLAVIVGIAVAIGC

SEQ ID NO: 19187 - protein, 25 aa, Mycobacterium avium
LFVVLGCASGLCLREGLIDLEAAAP

SEQ ID NO: 19188 - protein, 17 aa, Mycobacterium avium
LGAALWYAATVKDAVVV

SEQ ID NO: 19189 - protein, 23 aa, Mycobacterium avium
LGFGWRIPFLLSIFLVAVGLFVR

SEQ ID NO: 19190 - protein, 27 aa, Mycobacterium avium
LGGKLRTSRQINWGWILALVVIVLALA

SEQ ID NO: 19191 - protein, 19 aa, Mycobacterium avium
LGIFCLLAALWVTRFMADV

SEQ ID NO: 19192 - protein, 18 aa, Mycobacterium avium
LGVLPLLPVLLMVWATAR

SEQ ID NO: 19193 - protein, 22 aa, Mycobacterium avium
LHRLDAIVLYLGFIVVAWLLGY

SEQ ID NO: 19194 - protein, 18 aa, Mycobacterium avium
LLAAGLSWAAIQLAHLTG

SEQ ID NO: 19195 - protein, 21 aa, Mycobacterium avium
LLAKVCVYTVFAIVQSAIVTT

SEQ ID NO: 19196 - protein, 17 aa, Mycobacterium avium
LLCSLLVLNQWVGYFQT

SEQ ID NO: 19197 - protein, 19 aa, Mycobacterium avium
LLDRIAAYERYWLYPGAEN

SEQ ID NO: 19198 - protein, 17 aa, Mycobacterium avium
LLGTGFCGGLTTFSTMQ

SEQ ID NO: 19199 - protein, 17 aa, Mycobacterium avium
LLIMGGFMYFASRRQRR

SEQ ID NO: 19200 - protein, 19 aa, Mycobacterium avium
LLLEPMAGLALFLVVTACV

SEQ ID NO: 19201 - protein, 21 aa, Mycobacterium avium
LLPLVYGALYLWAFWDPFGHT

SEQ ID NO: 19202 - protein, 17 aa, Mycobacterium avium
LLQGFAVGAEWAGSVLL

SEQ ID NO: 19203 - protein, 17 aa, Mycobacterium avium
LLTGPSLLILDEPTSGL

SEQ ID NO: 19204 - protein, 18 aa, Mycobacterium avium
LLVVFAMSLLLTVFPGWV

SEQ ID NO: 19205 - protein, 18 aa, Mycobacterium avium
LMGLGWPVVVLVSIVVAR

SEQ ID NO: 19206 - protein, 17 aa, Mycobacterium avium
LPAWIGWTHFFNLFMMM

SEQ ID NO: 19207 - protein, 20 aa, Mycobacterium avium
LPDVRRYGATYANYVGKPLS

SEQ ID NO: 19208 - protein, 17 aa, Mycobacterium avium
LPGCVMVSVSHRPTVEQ

SEQ ID NO: 19209 - protein, 19 aa, Mycobacterium avium
LPIPRFLAGQSWRRTPSIF

SEQ ID NO: 19210 - protein, 24 aa, Mycobacterium avium
LPKPARPAPPWPTAQREVCATLTA

SEQ ID NO: 19211 - protein, 17 aa, Mycobacterium avium
LPPRRVAAPAIPPIPGL

SEQ ID NO: 19212 - protein, 17 aa, Mycobacterium avium
LPRGGAVALVLLGGFAI

SEQ ID NO: 19213 - protein, 19 aa, Mycobacterium avium
LPVLRWSWAPVLLAASLTT

SEQ ID NO: 19214 - protein, 20 aa, Mycobacterium avium
LQTRAVWRLVNFLLEGVVFL

SEQ ID NO: 19215 - protein, 21 aa, Mycobacterium avium
LRLLYGIGMGGEWGLGAALAM

SEQ ID NO: 19216 - protein, 19 aa, Mycobacterium avium
LRLPKVSARVLVIAALAAV

SEQ ID NO: 19217 - protein, 17 aa, Mycobacterium avium
LRPARAGATLGLPSGAW

SEQ ID NO: 19218 - protein, 20 aa, Mycobacterium avium
LRPGPDWEPLGMLLAGAVLI

SEQ ID NO: 19219 - protein, 18 aa, Mycobacterium avium
LRPLWGIDQRLKRFGTMA

SEQ ID NO: 19220 - protein, 19 aa, Mycobacterium avium
LRVRAYRSALLSNFATGWS

SEQ ID NO: 19221 - protein, 17 aa, Mycobacterium avium
LRYDQFMGLGWKLLIPA

SEQ ID NO: 19222 - protein, 19 aa, Mycobacterium avium
LSALRPGSLQALLPPEQRA

SEQ ID NO: 19223 - protein, 20 aa, Mycobacterium avium
LSNWPVRWKVLAIVLVPLML

SEQ ID NO: 19224 - protein, 23 aa, Mycobacterium avium
LSSFKVPSVWLVLRSDDDLPRGV

SEQ ID NO: 19225 - protein, 18 aa, Mycobacterium avium
LSVAFGWSMFNWIADVAC

SEQ ID NO: 19226 - protein, 23 aa, Mycobacterium avium
LSYGWRIPLLLGLPFGLVALYLR

SEQ ID NO: 19227 - protein, 18 aa, Mycobacterium avium
LTLGHGRLFALYVAGYCV

SEQ ID NO: 19228 - protein, 18 aa, Mycobacterium avium
LTLGSWAVAAGWAFALAM

SEQ ID NO: 19229 - protein, 19 aa, Mycobacterium avium
LVGRSSLVYDMWGAAVNLA

SEQ ID NO: 19230 - protein, 23 aa, Mycobacterium avium
LVLGWRTARRWRRGAAVLAVPLC

SEQ ID NO: 19231 - protein, 23 aa, Mycobacterium avium
LVPRIRWPMWLRTLLATVALGAV

SEQ ID NO: 19232 - protein, 22 aa, Mycobacterium avium
LWMVLRPLQYRAIAAEVIAIRV

SEQ ID NO: 19233 - protein, 22 aa, Mycobacterium avium
LWQYILGLKLHWMVLAMAVILL

SEQ ID NO: 19234 - protein, 18 aa, Mycobacterium avium
LWWRSRRTYLLTVAGDSL

SEQ ID NO: 19235 - protein, 17 aa, Mycobacterium avium
LYARVGFVLQETQLVHG

SEQ ID NO: 19236 - protein, 24 aa, Mycobacterium avium
MAVFYLRLPATFGIGTYGVSADFV

SEQ ID NO: 19237 - protein, 18 aa, Mycobacterium avium
MCASGSFIGFAFAFGQVI

SEQ ID NO: 19238 - protein, 18 aa, Mycobacterium avium
MGSADWSAVLARVGADPD

SEQ ID NO: 19239 - protein, 17 aa, Mycobacterium avium
MIGRAIGSYGDFVNFYA

SEQ ID NO: 19240 - protein, 23 aa, Mycobacterium avium
MISRPRPGPSLLAYWIGGLTVCV

SEQ ID NO: 19241 - protein, 17 aa, Mycobacterium avium
MQAGCRFTAQLGAMRIA

SEQ ID NO: 19242 - protein, 22 aa, Mycobacterium avium
MRIPRNRAVIMLVIDMSQSMRA

SEQ ID NO: 19243 - protein, 17 aa, Mycobacterium avium
NAMGWNFTAAKNMFAWI

SEQ ID NO: 19244 - protein, 24 aa, Mycobacterium avium
NFWRSAGLPAFRWPDPNGTRLPNG

SEQ ID NO: 19245 - protein, 20 aa, Mycobacterium avium
NISASLTWGGERYRYPTNLP

SEQ ID NO: 19246 - protein, 23 aa, Mycobacterium avium
NTESRWKLGLYAAGRASQMRRLR

SEQ ID NO: 19247 - protein, 17 aa, Mycobacterium avium
NVFKSWRYGEVVTVDDP

SEQ ID NO: 19248 - protein, 18 aa, Mycobacterium avium
NYLVWAILCTVLCCLPLG

SEQ ID NO: 19249 - protein, 19 aa, Mycobacterium avium
PAGLLSFFLSNPVYTLALT

SEQ ID NO: 19250 - protein, 25 aa, Mycobacterium avium
PAIAALAGRANWWPSRIAVRRNPVS

SEQ ID NO: 19251 - protein, 21 aa, Mycobacterium avium
PAPRPIALGLFNAIPEAPSLS

SEQ ID NO: 19252 - protein, 25 aa, Mycobacterium avium
PASPAKRAWLPIAIAVIAVVVVVVV

SEQ ID NO: 19253 - protein, 23 aa, Mycobacterium avium
PAVVAWAALIGWVDLHGTWASWM

SEQ ID NO: 19254 - protein, 22 aa, Mycobacterium avium
PAWRNLRFPLAWAPPEANVARI

SEQ ID NO: 19255 - protein, 23 aa, Mycobacterium avium
PDGRFPWPTALVFTAGVLLAALR

SEQ ID NO: 19256 - protein, 22 aa, Mycobacterium avium
PDLEGADQLLLRWRQANDRITS

SEQ ID NO: 19257 - protein, 17 aa, Mycobacterium avium
PDLPCRRGRQIAPELAG

SEQ ID NO: 19258 - protein, 23 aa, Mycobacterium avium
PDRREFAGALAFVAGFSVLVRPE

SEQ ID NO: 19259 - protein, 25 aa, Mycobacterium avium
PEDFWRSAGLPAYRFPDPNGTRFPN

SEQ ID NO: 19260 - protein, 20 aa, Mycobacterium avium
PEGMAAWIIGMVAAIGLALW

SEQ ID NO: 19261 - protein, 28 aa, Mycobacterium avium
PEPPTPWYRRPAALVAFGALGVLLLGAV

SEQ ID NO: 19262 - protein, 19 aa, Mycobacterium avium
PEQAVRCGIELQRALRRNA

SEQ ID NO: 19263 - protein, 19 aa, Mycobacterium avium
PGDVIVFKGPPSWNLGYKS

SEQ ID NO: 19264 - protein, 23 aa, Mycobacterium avium
PGRRLFCTAAPQLRRVLFAPQTV

SEQ ID NO: 19265 - protein, 17 aa, Mycobacterium avium
PGRYGLDARRGWAHRPF

SEQ ID NO: 19266 - protein, 24 aa, Mycobacterium avium
PIAARGDIGWGFGDHGLLTNIGVT

SEQ ID NO: 19267 - protein, 19 aa, Mycobacterium avium
PKSPRWLWIAAGAAVLLVV

SEQ ID NO: 19268 - protein, 17 aa, Mycobacterium avium
PLIERFPLMLGTAGAVL

SEQ ID NO: 19269 - protein, 21 aa, Mycobacterium avium
PLPPPRAVAIITQIASALDAA

SEQ ID NO: 19270 - protein, 23 aa, Mycobacterium avium
PLSRIPRRWVIAALGVLVVAAGL

SEQ ID NO: 19271 - protein, 18 aa, Mycobacterium avium
PLYLNIAVVALGFAAYLL

SEQ ID NO: 19272 - protein, 17 aa, Mycobacterium avium
PMAGLALFLVVTACVAG

SEQ ID NO: 19273 - protein, 29 aa, Mycobacterium avium
PNSKFTVSLLWPGDRAWRQGGDRRMLCGL

SEQ ID NO: 19274 - protein, 23 aa, Mycobacterium avium
PPGFPPDRPEGFEQPGNVDPFDQ

SEQ ID NO: 19275 - protein, 19 aa, Mycobacterium avium
PPREWRMRIEVRSVGDDAK

SEQ ID NO: 19276 - protein, 18 aa, Mycobacterium avium
PRRKRLFTRSRLFPTAAV

SEQ ID NO: 19277 - protein, 17 aa, Mycobacterium avium
PRRPWSMLLAGGALAGI

SEQ ID NO: 19278 - protein, 23 aa, Mycobacterium avium
PRRWVLLKGRLVASVASAFVMAV

SEQ ID NO: 19279 - protein, 22 aa, Mycobacterium avium
PRSRTWPAVALAAVAVLLGGAA

SEQ ID NO: 19280 - protein, 24 aa, Mycobacterium avium
PRVIPPSFLRRAMPYVLVILIVGM

SEQ ID NO: 19281 - protein, 23 aa, Mycobacterium avium
PRWSRRRLFVVIALAVMLVLAGL

SEQ ID NO: 19282 - protein, 17 aa, Mycobacterium avium
PSPGRWRALLLAAVAAC

SEQ ID NO: 19283 - protein, 27 aa, Mycobacterium avium
PSSPPPPRWAWKILIPVGAVGMVLMAI

SEQ ID NO: 19284 - protein, 24 aa, Mycobacterium avium
PSTWRHLPAILLVASLVLFTIAMA

SEQ ID NO: 19285 - protein, 17 aa, Mycobacterium avium
PSWGEWRTAGAAATAGA

SEQ ID NO: 19286 - protein, 24 aa, Mycobacterium avium
PVAFWACGLLLCMFIGPSQSSSRA

SEQ ID NO: 19287 - protein, 18 aa, Mycobacterium avium
PVRSVLRAIPPLFGAVPT

SEQ ID NO: 19288 - protein, 23 aa, Mycobacterium avium
PWLPARWRHWWWALLLAFVPIHL

SEQ ID NO: 19289 - protein, 19 aa, Mycobacterium avium
PWSTLKVSLLLSVALFFVW

SEQ ID NO: 19290 - protein, 23 aa, Mycobacterium avium
QAARYGGGYGEYGGYEDRPPPEP

SEQ ID NO: 19291 - protein, 24 aa, Mycobacterium avium
QATLLRWLWYGARREGLRLDGAED

SEQ ID NO: 19292 - protein, 26 aa, Mycobacterium avium
QNSLLPRWLPGAPEHRGWVARIRADP

SEQ ID NO: 19293 - protein, 22 aa, Mycobacterium avium
QRLWRECRAVTRLQEPHVLPLH

SEQ ID NO: 19294 - protein, 17 aa, Mycobacterium avium
QRWDVFTPPKFVGLKNF

SEQ ID NO: 19295 - protein, 17 aa, Mycobacterium avium
QRWKAIRGEAGWMTTYA

SEQ ID NO: 19296 - protein, 17 aa, Mycobacterium avium
RAARIIGALSMLAAVLS

SEQ ID NO: 19297 - protein, 25 aa, Mycobacterium avium
RAARLRLALNVPYLLLVLAFVGFDA

SEQ ID NO: 19298 - protein, 19 aa, Mycobacterium avium
RAATLIAHLAWLVLLLGSG

SEQ ID NO: 19299 - protein, 17 aa, Mycobacterium avium
RAAVKFLLYNLFGGLIM

SEQ ID NO: 19300 - protein, 17 aa, Mycobacterium avium
RAAVLAAVICVLTLTIA

SEQ ID NO: 19301 - protein, 20 aa, Mycobacterium avium
RAHPGFVRRVLSSALPSGLI

SEQ ID NO: 19302 - protein, 25 aa, Mycobacterium avium
RALVLSRLRLVSVGVPVAIGLLAGI

SEQ ID NO: 19303 - protein, 19 aa, Mycobacterium avium
RARHGWLDHLIRAYQRFDD

SEQ ID NO: 19304 - protein, 17 aa, Mycobacterium avium
RESRDWSLADLAAATGV

SEQ ID NO: 19305 - protein, 26 aa, Mycobacterium avium
RFIRTFAVPIIIGWIALIAVLNVVVP

SEQ ID NO: 19306 - protein, 19 aa, Mycobacterium avium
RFLGLHWSLPLGVAILLAA

SEQ ID NO: 19307 - protein, 23 aa, Mycobacterium avium
RFLRDPVSVLLIFIIVFALIIAG

SEQ ID NO: 19308 - protein, 22 aa, Mycobacterium avium
RGTWLVRRFRVAAEGIADDEVA

SEQ ID NO: 19309 - protein, 24 aa, Mycobacterium avium
RISRFQTLLLKWAMMVLLGLLTSA

SEQ ID NO: 19310 - protein, 19 aa, Mycobacterium avium
RITMPMLRPTTFFVLVTGI

SEQ ID NO: 19311 - protein, 17 aa, Mycobacterium avium
RKALLPGVRISGTNGFD

SEQ ID NO: 19312 - protein, 19 aa, Mycobacterium avium
RKLRVGFAKAGRLMDLMET

SEQ ID NO: 19313 - protein, 18 aa, Mycobacterium avium
RKRVVAVSFPRDLAITPM

SEQ ID NO: 19314 - protein, 22 aa, Mycobacterium avium
RKYRWLVFAGWLLALVPAVYLA

SEQ ID NO: 19315 - protein, 17 aa, Mycobacterium avium
RLDNARFLLPVVGVPPD

SEQ ID NO: 19316 - protein, 20 aa, Mycobacterium avium
RLSGLTRWGPWLSLGSAALC

SEQ ID NO: 19317 - protein, 21 aa, Mycobacterium avium
RMVRAFAIPIIFFWGLLAVTT

SEQ ID NO: 19318 - protein, 21 aa, Mycobacterium avium
RNWPAWLGIYGFMTLDRWLLF

SEQ ID NO: 19319 - protein, 20 aa, Mycobacterium avium
RPADLPRIWELINATRDDAL

SEQ ID NO: 19320 - protein, 18 aa, Mycobacterium avium
RPGWRRLKHFNGFVTSLW

SEQ ID NO: 19321 - protein, 20 aa, Mycobacterium avium
RPRVSGWLWQALAALLIATV

SEQ ID NO: 19322 - protein, 24 aa, Mycobacterium avium
RPRWLRLPGRRAIAAGAGILLASA

SEQ ID NO: 19323 - protein, 20 aa, Mycobacterium avium
RPWRRYLRRSVLPLLLVASL

SEQ ID NO: 19324 - protein, 22 aa, Mycobacterium avium
RQRLRIGVVATMCAGAFLGATM

SEQ ID NO: 19325 - protein, 17 aa, Mycobacterium avium
RRLKPRPAPAAPVAEEH

SEQ ID NO: 19326 - protein, 22 aa, Mycobacterium avium
RRLPGWPVWFALLWAAQEWLKS

SEQ ID NO: 19327 - protein, 24 aa, Mycobacterium avium
RRPWRRLRFSQLIIGMSAAVAMTA

SEQ ID NO: 19328 - protein, 19 aa, Mycobacterium avium
RRWELPVLRWVDGGRGNRR

SEQ ID NO: 19329 - protein, 19 aa, Mycobacterium avium
RSGPGWLLFQWRWSIVALW

SEQ ID NO: 19330 - protein, 21 aa, Mycobacterium avium
RSRIGMVLQDTWLFDGTIAEN

SEQ ID NO: 19331 - protein, 22 aa, Mycobacterium avium
RTDRWGHWLGCATAVAAFVVGV

SEQ ID NO: 19332 - protein, 18 aa, Mycobacterium avium
RVCPRRWPLRGAVGAADR

SEQ ID NO: 19333 - protein, 17 aa, Mycobacterium avium
RVGLMGALVTVLVVGVG

SEQ ID NO: 19334 - protein, 19 aa, Mycobacterium avium
RVLLIGLGVIVAWLLIVML

SEQ ID NO: 19335 - protein, 20 aa, Mycobacterium avium
RWKVLAIVLVPLMLATVFGV

SEQ ID NO: 19336 - protein, 19 aa, Mycobacterium avium
RYLRFGWAAAKLDDIANYP

SEQ ID NO: 19337 - protein, 21 aa, Mycobacterium avium
SAGWLRLGVLTALIATALALL

SEQ ID NO: 19338 - protein, 23 aa, Mycobacterium avium
SAIPRQSLAPGFWGNVLHDLSHA

SEQ ID NO: 19339 - protein, 25 aa, Mycobacterium avium
SALRLKGRLLFMPGVMVTSVPWQLS

SEQ ID NO: 19340 - protein, 28 aa, Mycobacterium avium
SARPEHWQRLALCWRLAGDHGLGIATLM

SEQ ID NO: 19341 - protein, 20 aa, Mycobacterium avium
SAWESGASWVAWVIGVISVP

SEQ ID NO: 19342 - protein, 17 aa, Mycobacterium avium
SEERLRPPPGYKDTTVP

SEQ ID NO: 19343 - protein, 18 aa, Mycobacterium avium
SFLRPPLAPNYGRVARAV

SEQ ID NO: 19344 - protein, 20 aa, Mycobacterium avium
SGGFPRWFPSSLRRQLLFGV

SEQ ID NO: 19345 - protein, 19 aa, Mycobacterium avium
SGLAVPRPLPAVIGEATQA

SEQ ID NO: 19346 - protein, 20 aa, Mycobacterium avium
SGTPHRALVWLGWLTAATAI

SEQ ID NO: 19347 - protein, 22 aa, Mycobacterium avium
SGWRSGALGSLLSFVGVLLGAI

SEQ ID NO: 19348 - protein, 27 aa, Mycobacterium avium
SLAAGWRSWRWRLLWLPSAAVLGVTTA

SEQ ID NO: 19349 - protein, 24 aa, Mycobacterium avium
SLFMAIAIAVTWMVYATLRRDVAG

SEQ ID NO: 19350 - protein, 19 aa, Mycobacterium avium
SLLDVCWPASSVLIAMASW

SEQ ID NO: 19351 - protein, 17 aa, Mycobacterium avium
SLWGLFAVLTKGVVDQL

SEQ ID NO: 19352 - protein, 18 aa, Mycobacterium avium
SQQLRPGSTLPLGQSTTP

SEQ ID NO: 19353 - protein, 21 aa, Mycobacterium avium
SRLTEVLSRIYGHPVSVQLQI

SEQ ID NO: 19354 - protein, 22 aa, Mycobacterium avium
SRPGEKNMPFWGTSFSAAYVSG

SEQ ID NO: 19355 - protein, 21 aa, Mycobacterium avium
SSGRGGLQFMLIIWLQGIWLP

SEQ ID NO: 19356 - protein, 21 aa, Mycobacterium avium
STDILKRWKRGVMSTVGDVAA

SEQ ID NO: 19357 - protein, 19 aa, Mycobacterium avium
TAAMPPLWVIVSCALAMAT

SEQ ID NO: 19358 - protein, 18 aa, Mycobacterium avium
TAFRVPFLRNWKYSRAYL

SEQ ID NO: 19359 - protein, 18 aa, Mycobacterium avium
TAGYEGWLLFEQHQKDVA

SEQ ID NO: 19360 - protein, 20 aa, Mycobacterium avium
TALCLFTAVFIMLRRKRIPG

SEQ ID NO: 19361 - protein, 18 aa, Mycobacterium avium
TARACLRLGLTPDVVTVA

SEQ ID NO: 19362 - protein, 20 aa, Mycobacterium avium
TATRRFLVDAAHELRTPIAG

SEQ ID NO: 19363 - protein, 23 aa, Mycobacterium avium
TAVVMGWVWSRWGRPEWITRALP

SEQ ID NO: 19364 - protein, 24 aa, Mycobacterium avium
TCALAALCYAEFASTLPVAGSAYT

SEQ ID NO: 19365 - protein, 18 aa, Mycobacterium avium
TDWTLNWAHGLIANAPQP

SEQ ID NO: 19366 - protein, 20 aa, Mycobacterium avium
TEIYWRRRGLAVGIAVVVIG

SEQ ID NO: 19367 - protein, 36 aa, Mycobacterium avium
TETINLPAGFAIGWAMWPLVACVVLQAIAAVVVVLL

SEQ ID NO: 19368 - protein, 17 aa, Mycobacterium avium
TGMALSIAALVPIGAAL

SEQ ID NO: 19369 - protein, 24 aa, Mycobacterium avium
TGPVARLALVGSRGTDVIDQSVVD

SEQ ID NO: 19370 - protein, 17 aa, Mycobacterium avium
TPLRRLDLLIAYGTAFS

SEQ ID NO: 19371 - protein, 22 aa, Mycobacterium avium
TRDFPGTITITFAYIGLTCPRW

SEQ ID NO: 19372 - protein, 21 aa, Mycobacterium avium
TRGRIALRWARIAVLIVTGLV

SEQ ID NO: 19373 - protein, 19 aa, Mycobacterium avium
TRLATWVAVPGHTASPAGS

SEQ ID NO: 19374 - protein, 17 aa, Mycobacterium avium
TRLFAGAALPMAPGSSA

SEQ ID NO: 19375 - protein, 24 aa, Mycobacterium avium
TRLWPTVICLLGYAVSFALLAVSI

SEQ ID NO: 19376 - protein, 24 aa, Mycobacterium avium
TRSFRLVRRGFWRVLGIRALAFLV

SEQ ID NO: 19377 - protein, 21 aa, Mycobacterium avium
TSRGGSFVFRHRAGNVVMLVA

SEQ ID NO: 19378 - protein, 18 aa, Mycobacterium avium
TVIIRFWLLTAIACGLGV

SEQ ID NO: 19379 - protein, 19 aa, Mycobacterium avium
TVVRMFLVPSVMKLLGDDC

SEQ ID NO: 19380 - protein, 20 aa, Mycobacterium avium
TWTLPVLGAWVIVSTWILPG

SEQ ID NO: 19381 - protein, 25 aa, Mycobacterium avium
VAALLGRWFWWPQLVRPRPASTMLR

SEQ ID NO: 19382 - protein, 22 aa, Mycobacterium avium
VATACPFCRVMVTDGVNDRQEE

SEQ ID NO: 19383 - protein, 17 aa, Mycobacterium avium
VAVLGMPVGKITKINPR

SEQ ID NO: 19384 - protein, 21 aa, Mycobacterium avium
VDAIICFIGFLFPLWDSKRQT

SEQ ID NO: 19385 - protein, 31 aa, Mycobacterium avium
VEMRRIADFVVRWPWLVIGFWAALAVALPLA

SEQ ID NO: 19386 - protein, 18 aa, Mycobacterium avium
VFLGFDIVGGIAWGGGAT

SEQ ID NO: 19387 - protein, 19 aa, Mycobacterium avium
VFQVAAWVAIVAGIVFIVA

SEQ ID NO: 19388 - protein, 20 aa, Mycobacterium avium
VFSRRWAKVWLPITAAVYTA

SEQ ID NO: 19389 - protein, 28 aa, Mycobacterium avium
VFVRWWGQPAWSWAVLWRRGRRPIDWSA

SEQ ID NO: 19390 - protein, 19 aa, Mycobacterium avium
VGLMALWLAGLRWRRHGVR

SEQ ID NO: 19391 - protein, 17 aa, Mycobacterium avium
VIWKGVISKAIIPAIVS

SEQ ID NO: 19392 - protein, 18 aa, Mycobacterium avium
VLALEIALAIGIRTTGTV

SEQ ID NO: 19393 - protein, 18 aa, Mycobacterium avium
VLAVLPLMVLTQLGIIVG

SEQ ID NO: 19394 - protein, 24 aa, Mycobacterium avium
VLPSVPRWLWIFLGVVGVTAALAG

SEQ ID NO: 19395 - protein, 17 aa, Mycobacterium avium
VLRRKFKPPLVLQDIEK

SEQ ID NO: 19396 - protein, 20 aa, Mycobacterium avium
VLTGKALFRRPFQWRETIEQ

SEQ ID NO: 19397 - protein, 17 aa, Mycobacterium avium
VLVGFSMPGKTIGAQSR

SEQ ID NO: 19398 - protein, 18 aa, Mycobacterium avium
VLWRRGRRPIDWSAPITV

SEQ ID NO: 19399 - protein, 19 aa, Mycobacterium avium
VPMTTEWIHVPLLPVPIPV

SEQ ID NO: 19400 - protein, 17 aa, Mycobacterium avium
VPRRVRRVFMVLGGLVS

SEQ ID NO: 19401 - protein, 18 aa, Mycobacterium avium
VQAAVPFYGIYDFTRFDD

SEQ ID NO: 19402 - protein, 17 aa, Mycobacterium avium
VQLPGLIGVTARWDFAP

SEQ ID NO: 19403 - protein, 17 aa, Mycobacterium avium
VSACSVLVLLIVEGVLI

SEQ ID NO: 19404 - protein, 17 aa, Mycobacterium avium
VSTSLAWTGRLTPPGTF

SEQ ID NO: 19405 - protein, 19 aa, Mycobacterium avium
VTVALCLLGGVFGISLGKH

SEQ ID NO: 19406 - protein, 21 aa, Mycobacterium avium
VVGWCGRPFHAAAWANLKHGV

SEQ ID NO: 19407 - protein, 20 aa, Mycobacterium avium
VVLRRLRAALVLALACAPCN

SEQ ID NO: 19408 - protein, 19 aa, Mycobacterium avium
VWGPGGWLARLGVLDYAGG

SEQ ID NO: 19409 - protein, 19 aa, Mycobacterium avium
VWLGRPLIWLSFNNEKLNA

SEQ ID NO: 19410 - protein, 18 aa, Mycobacterium avium
VWRLVNFLLEGVVFLLIG

SEQ ID NO: 19411 - protein, 22 aa, Mycobacterium avium
VYLWHWPIFLALNGERTGWAGM

SEQ ID NO: 19412 - protein, 17 aa, Mycobacterium avium
VYVCGPTAMLEAVRTAR

SEQ ID NO: 19413 - protein, 17 aa, Mycobacterium avium
VYVLPLLLLVGLFVMFS

SEQ ID NO: 19414 - protein, 18 aa, Mycobacterium avium
WAFALAMIDGWQRGFAGR

SEQ ID NO: 19415 - protein, 18 aa, Mycobacterium avium
WAGTKLLVVFAMSLLLTV

SEQ ID NO: 19416 - protein, 17 aa, Mycobacterium avium
WAVILARFAPFVRTFVP

SEQ ID NO: 19417 - protein, 21 aa, Mycobacterium avium
WCMLRTRWARRVARILPVLGL

SEQ ID NO: 19418 - protein, 19 aa, Mycobacterium avium
WELARPPLWLFLLFLLTAT

SEQ ID NO: 19419 - protein, 17 aa, Mycobacterium avium
WEWLCARSELSGAQQAA

SEQ ID NO: 19420 - protein, 18 aa, Mycobacterium avium
WFPSSLRRQLLFGVLAVV

SEQ ID NO: 19421 - protein, 24 aa, Mycobacterium avium
WFSERRLGIPFGFGVIFAITGMTA

SEQ ID NO: 19422 - protein, 18 aa, Mycobacterium avium
WITQRLWWALLLTVGFWG

SEQ ID NO: 19423 - protein, 17 aa, Mycobacterium avium
WLKQYTQNFAWPVSKDL

SEQ ID NO: 19424 - protein, 22 aa, Mycobacterium avium
WLLKRWGEYFAVIATSVFLPLE

SEQ ID NO: 19425 - protein, 19 aa, Mycobacterium avium
WLNRLRALAHRTCVAPLPY

SEQ ID NO: 19426 - protein, 20 aa, Mycobacterium avium
WLVLHLVYLVGFKTKVSTLL

SEQ ID NO: 19427 - protein, 22 aa, Mycobacterium avium
WNFTAAKNMFAWIGPVLAALQG

SEQ ID NO: 19428 - protein, 19 aa, Mycobacterium avium
WPEKLARISFWCMNIGLAW

SEQ ID NO: 19429 - protein, 17 aa, Mycobacterium avium
WPLWWVSACSVLVLLIV

SEQ ID NO: 19430 - protein, 19 aa, Mycobacterium avium
WPVLLAVGGGALLLQRLNR

SEQ ID NO: 19431 - protein, 23 aa, Mycobacterium avium
WRITLPSIRWGLTYGIVLTIARS

SEQ ID NO: 19432 - protein, 17 aa, Mycobacterium avium
WRPVLAYALPGTPAVVL

SEQ ID NO: 19433 - protein, 18 aa, Mycobacterium avium
WRRLSLRTASIAGWGGLA

SEQ ID NO: 19434 - protein, 24 aa, Mycobacterium avium
WRRVGTAVVRWPAPVLAVSAAVVL

SEQ ID NO: 19435 - protein, 25 aa, Mycobacterium avium
WSVAWKAAVIALICAFVAASGYMMW

SEQ ID NO: 19436 - protein, 21 aa, Mycobacterium avium
WWRQIRWRPVLAYALPGTPAV

SEQ ID NO: 19437 - protein, 26 aa, Mycobacterium avium
YAGAFGLAGGLGWKLWDQRAVAQAGQ

SEQ ID NO: 19438 - protein, 20 aa, Mycobacterium avium
YLCLMPIFPLALWLMNVYAA

SEQ ID NO: 19439 - protein, 17 aa, Mycobacterium avium
YLLNFGPTFTIGADLGP

SEQ ID NO: 19440 - protein, 18 aa, Mycobacterium avium
YMRYPVFLGFDIVGGIAW

SEQ ID NO: 19441 - protein, 17 aa, Mycobacterium avium
YPGDRVQIMGVRVGSID

SEQ ID NO: 19442 - protein, 20 aa, Mycobacterium avium
YRTERLWSAIGLVPQRGYLF

SEQ ID NO: 19443 - protein, 18 aa, Mycobacterium avium
YSVLKCVVFVWLSSTVQC

SEQ ID NO: 19444 - protein, 22 aa, Mycobacterium avium
YWFRSIRQTVQFERAVRGAAEA

SEQ ID NO: 19445 - protein, 20 aa, Mycobacterium avium
AAALGRWAGFSVAWLYWYFW

SEQ ID NO: 19446 - protein, 25 aa, Mycobacterium avium
AAALLGRWFWWPQLVRPRPASTMLR

SEQ ID NO: 19447 - protein, 19 aa, Mycobacterium avium
AADLLEWLALAALVPLTCW

SEQ ID NO: 19448 - protein, 20 aa, Mycobacterium avium
AADLLEWLALAALVPLTCWI

SEQ ID NO: 19449 - protein, 25 aa, Mycobacterium avium
AAGWRSRRWRLLWLPSAAVLGVTTA

SEQ ID NO: 19450 - protein, 19 aa, Mycobacterium avium
AALAGLSGWLGYRAYQQHD

SEQ ID NO: 19451 - protein, 20 aa, Mycobacterium avium
AALAGLSGWLGYRAYQQHDA

SEQ ID NO: 19452 - protein, 17 aa, Mycobacterium avium
AALAGMTLVALSANVPA

SEQ ID NO: 19453 - protein, 18 aa, Mycobacterium avium
AALMGRWFWWPQQVRTRP

SEQ ID NO: 19454 - protein, 18 aa, Mycobacterium avium
AALRAGGVVVVFPGGDYD

SEQ ID NO: 19455 - protein, 18 aa, Mycobacterium avium
AAMPPLWVIVSCALAMAT

SEQ ID NO: 19456 - protein, 18 aa, Mycobacterium avium
AAMPVRWRGVWAGWWLGT

SEQ ID NO: 19457 - protein, 18 aa, Mycobacterium avium
AAPGPWRLLLRDLAHLLD

SEQ ID NO: 19458 - protein, 17 aa, Mycobacterium avium
AAPRLGNAFGLAWRLDR

SEQ ID NO: 19459 - protein, 17 aa, Mycobacterium avium
AAQGGAVPLVIVGVVAS

SEQ ID NO: 19460 - protein, 20 aa, Mycobacterium avium
AARFVNWVALQVSRQLTTGF

SEQ ID NO: 19461 - protein, 19 aa, Mycobacterium avium
AARLLTWRASWMAANNVPF

SEQ ID NO: 19462 - protein, 18 aa, Mycobacterium avium
AARLPWVVIRSFDGLGPP

SEQ ID NO: 19463 - protein, 23 aa, Mycobacterium avium
AASLAVSGFLGWRQWQEHQVKAA

SEQ ID NO: 19464 - protein, 18 aa, Mycobacterium avium
AAVLRLKPGYGMPTMAEV

SEQ ID NO: 19465 - protein, 18 aa, Mycobacterium avium
AAWSVFRLFWLVYLGMTF

SEQ ID NO: 19466 - protein, 18 aa, Mycobacterium avium
ACPDRTAAMLAEIVGLLR

SEQ ID NO: 19467 - protein, 18 aa, Mycobacterium avium
ACRGCRSWLIGAAVQTRR

SEQ ID NO: 19468 - protein, 20 aa, Mycobacterium avium
ADCPRYGQLQGPSCFTAPTI

SEQ ID NO: 19469 - protein, 25 aa, Mycobacterium avium
ADKWPEKWARLSFWCMNIGLAWMVF

SEQ ID NO: 19470 - protein, 18 aa, Mycobacterium avium
ADLLEWLALAALVPLTCW

SEQ ID NO: 19471 - protein, 22 aa, Mycobacterium avium
ADPAGWPRLDWSMDAALLLAAL

SEQ ID NO: 19472 - protein, 17 aa, Mycobacterium avium
ADRLIVIYADFKGEAGA

SEQ ID NO: 19473 - protein, 22 aa, Mycobacterium avium
ADRLPGVRLDWFTVEHTATARQ

SEQ ID NO: 19474 - protein, 20 aa, Mycobacterium avium
AELPGFRPPTAVGHTGELVS

SEQ ID NO: 19475 - protein, 18 aa, Mycobacterium avium
AETLRLIATMSLGVGALA

SEQ ID NO: 19476 - protein, 26 aa, Mycobacterium avium
AGAFGLAAGLGWKLWDQRAVAQAGQA

SEQ ID NO: 19477 - protein, 18 aa, Mycobacterium avium
AGALWSSLIAGFVILILL

SEQ ID NO: 19478 - protein, 19 aa, Mycobacterium avium
AGALWSSLIAGFVILILLL

SEQ ID NO: 19479 - protein, 20 aa, Mycobacterium avium
AGAVLCLRFTRLNYFQSLGI

SEQ ID NO: 19480 - protein, 21 aa, Mycobacterium avium
AGFCVYRLHGIFGSHNNTSAA

SEQ ID NO: 19481 - protein, 17 aa, Mycobacterium avium
AGFIAWLAWLLLHLYYL

SEQ ID NO: 19482 - protein, 18 aa, Mycobacterium avium
AGFQHAWFFLALLAVLLV

SEQ ID NO: 19483 - protein, 22 aa, Mycobacterium avium
AGGARLLLPIALGALLGGSAAA

SEQ ID NO: 19484 - protein, 20 aa, Mycobacterium avium
AGLIGWRAASALAYLRGFGR

SEQ ID NO: 19485 - protein, 18 aa, Mycobacterium avium
AGMFMWIAIIWRGIRGRL

SEQ ID NO: 19486 - protein, 18 aa, Mycobacterium avium
AGMSWRARPKLAITPDGL

SEQ ID NO: 19487 - protein, 17 aa, Mycobacterium avium
AGTKLLVVFAMSLLLTV

SEQ ID NO: 19488 - protein, 26 aa, Mycobacterium avium
AGVAVSVCWWLLLRVYRRLNTAKFTV

SEQ ID NO: 19489 - protein, 19 aa, Mycobacterium avium
AHFRPELTAVLAKHEFSAA

SEQ ID NO: 19490 - protein, 20 aa, Mycobacterium avium
AIALASIWLKGPLVLGLGAI

SEQ ID NO: 19491 - protein, 21 aa, Mycobacterium avium
AIGVAVGAIWLGRRLLQGRQQ

SEQ ID NO: 19492 - protein, 22 aa, Mycobacterium avium
AIWLRRRLANLAARLVTSLCGL

SEQ ID NO: 19493 - protein, 24 aa, Mycobacterium avium
AKATFLRWAWYAARREELHLDGAD

SEQ ID NO: 19494 - protein, 21 aa, Mycobacterium avium
AKGGTPGWVIRKHVVKNAAGP

SEQ ID NO: 19495 - protein, 18 aa, Mycobacterium avium
ALCLFTAVFIMLRRKRIP

SEQ ID NO: 19496 - protein, 17 aa, Mycobacterium avium
ALELTWEALEHARIPAS

SEQ ID NO: 19497 - protein, 21 aa, Mycobacterium avium
ALFCAACWLIQILVHHHSNPS

SEQ ID NO: 19498 - protein, 23 aa, Mycobacterium avium
ALGDSRSGPGWLLFQWRWSIVAL

SEQ ID NO: 19499 - protein, 24 aa, Mycobacterium avium
ALGSWWPPCWRGSSWSWSTTRICC

SEQ ID NO: 19500 - protein, 19 aa, Mycobacterium avium
ALKKLSHRFSWTAGSPPQE

SEQ ID NO: 19501 - protein, 17 aa, Mycobacterium avium
ALKTLGIDPVRRLVVPR

SEQ ID NO: 19502 - protein, 23 aa, Mycobacterium avium
ALLANLFLPWGIAGGHPSAVDVA

SEQ ID NO: 19503 - protein, 27 aa, Mycobacterium avium
ALLMLVAAIHWRARGWLKRVLPAALVA

SEQ ID NO: 19504 - protein, 30 aa, Mycobacterium avium
ALLMLVAAIHWRARGWLKRVLPAALVAAVA

SEQ ID NO: 19505 - protein, 17 aa, Mycobacterium avium
ALLWRVGVVEIRHDDRT

SEQ ID NO: 19506 - protein, 24 aa, Mycobacterium avium
ALPPRPEVRLLWALIAAAAIIEGA

SEQ ID NO: 19507 - protein, 21 aa, Mycobacterium avium
ALRLKGRLLFTPGVMVTSVPW

SEQ ID NO: 19508 - protein, 19 aa, Mycobacterium avium
ALRRHFNWVRSWYDFAVPD

SEQ ID NO: 19509 - protein, 23 aa, Mycobacterium avium
ALSRIPRRWVIAALGVLVVAAGL

SEQ ID NO: 19510 - protein, 17 aa, Mycobacterium avium
ALTWLLLISVPVMALTN

SEQ ID NO: 19511 - protein, 17 aa, Mycobacterium avium
ALTWLLLISVPVMAVTN

SEQ ID NO: 19512 - protein, 19 aa, Mycobacterium avium
ALVAFAWRRPRFDPLKPGR

SEQ ID NO: 19513 - protein, 17 aa, Mycobacterium avium
ALVGPGFGRLLLVSAAL

SEQ ID NO: 19514 - protein, 17 aa, Mycobacterium avium
ALVGVDVDEMWDIRNRG

SEQ ID NO: 19515 - protein, 24 aa, Mycobacterium avium
APAKLSRRSLVIGNAVIAFAVIGL

SEQ ID NO: 19516 - protein, 18 aa, Mycobacterium avium
APGPWRLLLRDLAHLLDT

SEQ ID NO: 19517 - protein, 20 aa, Mycobacterium avium
APMFHAWGFGQLVFAAMMAC

SEQ ID NO: 19518 - protein, 18 aa, Mycobacterium avium
APPGWLPDWLRPAGSRRG

SEQ ID NO: 19519 - protein, 17 aa, Mycobacterium avium
AQWNWWLPPWLSRVLPS

SEQ ID NO: 19520 - protein, 17 aa, Mycobacterium avium
ARACLRLGLTPDVVTVA

SEQ ID NO: 19521 - protein, 18 aa, Mycobacterium avium
ARGWLKRVLPAALVAAVA

SEQ ID NO: 19522 - protein, 18 aa, Mycobacterium avium
ARKALLPGVRISGTNGFD

SEQ ID NO: 19523 - protein, 21 aa, Mycobacterium avium
ARPGLCARLRLRPGRDRRGDH

SEQ ID NO: 19524 - protein, 20 aa, Mycobacterium avium
ARPPLRPARAIAAVAGLGAA

SEQ ID NO: 19525 - protein, 17 aa, Mycobacterium avium
ARRFGCVVQDGFGSTEG

SEQ ID NO: 19526 - protein, 21 aa, Mycobacterium avium
ARRLEARLGPWNARLLSAAAY

SEQ ID NO: 19527 - protein, 19 aa, Mycobacterium avium
ARVRARLVLRLARNYIPLR

SEQ ID NO: 19528 - protein, 17 aa, Mycobacterium avium
ARVRWRPRPPVARIPAR

SEQ ID NO: 19529 - protein, 24 aa, Mycobacterium avium
ASALCFLPGLILGLFAQFTIAYAI

SEQ ID NO: 19530 - protein, 17 aa, Mycobacterium avium
ASDRGAGALGFAGTARK

SEQ ID NO: 19531 - protein, 17 aa, Mycobacterium avium
ASIGLLVWFWPRLGPDK

SEQ ID NO: 19532 - protein, 17 aa, Mycobacterium avium
ASLAVSGFLGWRQWQEH

SEQ ID NO: 19533 - protein, 17 aa, Mycobacterium avium
ASLPAPHWTFWRIFAYG

SEQ ID NO: 19534 - protein, 19 aa, Mycobacterium avium
ASLVGWWALSRVLERLRGI

SEQ ID NO: 19535 - protein, 20 aa, Mycobacterium avium
ASPCAYFLVYESTAGNKAPE

SEQ ID NO: 19536 - protein, 17 aa, Mycobacterium avium
ASQMLRPYGPRPAVRTL

SEQ ID NO: 19537 - protein, 17 aa, Mycobacterium avium
ASSLPYWLGDSLRAATA

SEQ ID NO: 19538 - protein, 20 aa, Mycobacterium avium
ASYIRRTWLVLRMNPQRNVA

SEQ ID NO: 19539 - protein, 19 aa, Mycobacterium avium
ATRFEYRDALLLDTRGNVV

SEQ ID NO: 19540 - protein, 17 aa, Mycobacterium avium
AVAYWLDRYELLSHTRG

SEQ ID NO: 19541 - protein, 17 aa, Mycobacterium avium
AVFCVLAVLPLVVLTQL

SEQ ID NO: 19542 - protein, 18 aa, Mycobacterium avium
AVGLACWRSRRRSDPVTL

SEQ ID NO: 19543 - protein, 20 aa, Mycobacterium avium
AVGRPRWLAERGLRPDAALA

SEQ ID NO: 19544 - protein, 19 aa, Mycobacterium avium
AVKVDWPHFWWLITSPSSR

SEQ ID NO: 19545 - protein, 17 aa, Mycobacterium avium
AVLARFGGDEFAVCIAD

SEQ ID NO: 19546 - protein, 22 aa, Mycobacterium avium
AVLATAGYEGWLLFEQHQKDVA

SEQ ID NO: 19547 - protein, 24 aa, Mycobacterium avium
AVLRWSRNRMAFLAALLFMMALCF

SEQ ID NO: 19548 - protein, 17 aa, Mycobacterium avium
AVPRLRGAHKLWLLLAA

SEQ ID NO: 19549 - protein, 17 aa, Mycobacterium avium
AVPRPPLGPVWVALLII

SEQ ID NO: 19550 - protein, 18 aa, Mycobacterium avium
AWEWLCARSELSGAQQAA

SEQ ID NO: 19551 - protein, 21 aa, Mycobacterium avium
AWPWRLVFLVGVSALFAQQAV

SEQ ID NO: 19552 - protein, 21 aa, Mycobacterium avium
AWRNLRFPLAWAPPEANVARI

SEQ ID NO: 19553 - protein, 20 aa, Mycobacterium avium
AWSAANVRFDFYVRDIATRF

SEQ ID NO: 19554 - protein, 20 aa, Mycobacterium avium
AWVMVCVLIAFPMRIAAAIG

SEQ ID NO: 19555 - protein, 28 aa, Mycobacterium avium
AWWSPRRCGWARRISRRWCRTPESSGTG

SEQ ID NO: 19556 - protein, 18 aa, Mycobacterium avium
AYLLNFGPTFTIGADLGP

SEQ ID NO: 19557 - protein, 19 aa, Mycobacterium avium
CLLATLGIWRWSQGTVSVA

SEQ ID NO: 19558 - protein, 18 aa, Mycobacterium avium
CLLATLGLWRWSQGTVSV

SEQ ID NO: 19559 - protein, 19 aa, Mycobacterium avium
CLLATLGLWRWSQGTVSVA

SEQ ID NO: 19560 - protein, 19 aa, Mycobacterium avium
CLLCSLLVLNQWVGYFQTV

SEQ ID NO: 19561 - protein, 20 aa, Mycobacterium avium
CLSFTRLPYFQTLGVPCAVG

SEQ ID NO: 19562 - protein, 17 aa, Mycobacterium avium
CPRYGQLQGPSCFTAPT

SEQ ID NO: 19563 - protein, 18 aa, Mycobacterium avium
CPRYGQLQGPSCFTAPTI

SEQ ID NO: 19564 - protein, 20 aa, Mycobacterium avium
CSALLSWRVLRWEKQSAKAA

SEQ ID NO: 19565 - protein, 21 aa, Mycobacterium avium
CVKAELLAASSWRVAVNAGAD

SEQ ID NO: 19566 - protein, 22 aa, Mycobacterium avium
CVKAELLAASSWRVAVNAGADS

SEQ ID NO: 19567 - protein, 21 aa, Mycobacterium avium
CVKAELLAASSWRVAVNAGTD

SEQ ID NO: 19568 - protein, 23 aa, Mycobacterium avium
DALELRGRILGAFEAAEVATDPA

SEQ ID NO: 19569 - protein, 17 aa, Mycobacterium avium
DATKAAARWIRPLAPPL

SEQ ID NO: 19570 - protein, 21 aa, Mycobacterium avium
DATKAAARWIRPLVPPLVARM

SEQ ID NO: 19571 - protein, 22 aa, Mycobacterium avium
DATKAAARWIRPLVPPLVARMM

SEQ ID NO: 19572 - protein, 18 aa, Mycobacterium avium
DEVRAALAAGDWSSDSES

SEQ ID NO: 19573 - protein, 18 aa, Mycobacterium avium
DLAAPWFIGTAMGLQVLG

SEQ ID NO: 19574 - protein, 21 aa, Mycobacterium avium
DLEGADQLLLRWRQANDRITS

SEQ ID NO: 19575 - protein, 23 aa, Mycobacterium avium
DLPGELMGALSQGLSQFGINLPP

SEQ ID NO: 19576 - protein, 20 aa, Mycobacterium avium
DLRGSLRLLIRALRGHRRPV

SEQ ID NO: 19577 - protein, 18 aa, Mycobacterium avium
DLRYPVVVAVLFVVIAGI

SEQ ID NO: 19578 - protein, 20 aa, Mycobacterium avium
DLSVAFGWSMFNWIADVACL

SEQ ID NO: 19579 - protein, 17 aa, Mycobacterium avium
DNVMLVSAFLAAAALAQ

SEQ ID NO: 19580 - protein, 23 aa, Mycobacterium avium
DPAELYRHVAFVFQDAELLRMSI

SEQ ID NO: 19581 - protein, 22 aa, Mycobacterium avium
DPKGALARWNWVLDGMVETKAL

SEQ ID NO: 19582 - protein, 22 aa, Mycobacterium avium
DRFDRCRAFAAAVRRECDGAAA

SEQ ID NO: 19583 - protein, 21 aa, Mycobacterium avium
DRFDRCRAFAAAVSRECDGAA

SEQ ID NO: 19584 - protein, 22 aa, Mycobacterium avium
DRFDRCRAFAAAVSRECDGAAA

SEQ ID NO: 19585 - protein, 17 aa, Mycobacterium avium
DRREFAGALAFVAGFSV

SEQ ID NO: 19586 - protein, 18 aa, Mycobacterium avium
DTSSWRWIFLINVPIGLV

SEQ ID NO: 19587 - protein, 24 aa, Mycobacterium avium
DVTRRIGLGIGRLVFRALNSVEVV

SEQ ID NO: 19588 - protein, 17 aa, Mycobacterium avium
DWSWLKWLPHIDIPGEL

SEQ ID NO: 19589 - protein, 19 aa, Mycobacterium avium
EAALTWLLLISVPVMAVTN

SEQ ID NO: 19590 - protein, 20 aa, Mycobacterium avium
EDEPRPAPPDVVRDLAAQSW

SEQ ID NO: 19591 - protein, 21 aa, Mycobacterium avium
EDEPRPAPPDVVRDLAAQSWK

SEQ ID NO: 19592 - protein, 22 aa, Mycobacterium avium
EDEPRPAPPDVVRDLAAQSWKD

SEQ ID NO: 19593 - protein, 21 aa, Mycobacterium avium
EEGRPRFEALIAKPGLAQGLK

SEQ ID NO: 19594 - protein, 20 aa, Mycobacterium avium
EKHCYDIPICFSLRSIFDAI

SEQ ID NO: 19595 - protein, 23 aa, Mycobacterium avium
EKHCYDIPVCIGLRSLFDTFDGF

SEQ ID NO: 19596 - protein, 18 aa, Mycobacterium avium
ELGEILGFGGMSEVHLAR

SEQ ID NO: 19597 - protein, 18 aa, Mycobacterium avium
ELLAGSFLLALLAVTAAN

SEQ ID NO: 19598 - protein, 23 aa, Mycobacterium avium
ELPVRRWELPVLRWVDGGRGNRR

SEQ ID NO: 19599 - protein, 19 aa, Mycobacterium avium
EMRSWPAPLSILLALWAIR

SEQ ID NO: 19600 - protein, 18 aa, Mycobacterium avium
EPLRRLAVIVGIAVAIGC

SEQ ID NO: 19601 - protein, 22 aa, Mycobacterium avium
EPSIAWPRVFGYGILPGLALVL

SEQ ID NO: 19602 - protein, 19 aa, Mycobacterium avium
EPVLMIGMIYIWMPLAMGK

SEQ ID NO: 19603 - protein, 18 aa, Mycobacterium avium
EQAVRCGIELQRALRRNA

SEQ ID NO: 19604 - protein, 21 aa, Mycobacterium avium
ERAHPGFVRRVLSSALPSGLI

SEQ ID NO: 19605 - protein, 19 aa, Mycobacterium avium
ERFARGCLLLVYPNVIAVE

SEQ ID NO: 19606 - protein, 23 aa, Mycobacterium avium
ERQRLRIGVVATMCAGAFLGATM

SEQ ID NO: 19607 - protein, 35 aa, Mycobacterium avium
ETINLPAGFAIGWAMWPLVACVVLQAIAAVVVVLL

SEQ ID NO: 19608 - protein, 18 aa, Mycobacterium avium
EVGWLRLPVFDWPTDPSW

SEQ ID NO: 19609 - protein, 19 aa, Mycobacterium avium
EWLEALFPFNPFSPQGWSM

SEQ ID NO: 19610 - protein, 17 aa, Mycobacterium avium
FAILILLGRYINYTLDL

SEQ ID NO: 19611 - protein, 17 aa, Mycobacterium avium
FAMLPAYLLLVVRGAGA

SEQ ID NO: 19612 - protein, 18 aa, Mycobacterium avium
FAMLPAYLLLVVRGAGAR

SEQ ID NO: 19613 - protein, 17 aa, Mycobacterium avium
FAMLPAYLLLVVRGAGT

SEQ ID NO: 19614 - protein, 19 aa, Mycobacterium avium
FARRFGCVVQDGFGSTEGG

SEQ ID NO: 19615 - protein, 17 aa, Mycobacterium avium
FARVNPRTMTPVNNTVI

SEQ ID NO: 19616 - protein, 17 aa, Mycobacterium avium
FCLIELRAPQPMVNVRL

SEQ ID NO: 19617 - protein, 19 aa, Mycobacterium avium
FCMGGGFALLTANTGYDAA

SEQ ID NO: 19618 - protein, 17 aa, Mycobacterium avium
FCTPDRCPLIVGNTLVF

SEQ ID NO: 19619 - protein, 17 aa, Mycobacterium avium
FERFGRFWGAFSVGDLL

SEQ ID NO: 19620 - protein, 18 aa, Mycobacterium avium
FFWLPGLVCLLALGELLW

SEQ ID NO: 19621 - protein, 19 aa, Mycobacterium avium
FGAFAHRWLARRTRRRINP

SEQ ID NO: 19622 - protein, 26 aa, Mycobacterium avium
FGRWRRIGTAIVRWPTPILTATIAVA

SEQ ID NO: 19623 - protein, 25 aa, Mycobacterium avium
FIRAFAVPIIIGWIALIAVLNVVVP

SEQ ID NO: 19624 - protein, 25 aa, Mycobacterium avium
FLGFGWRIPFLLSIFLVAVGLFVRL

SEQ ID NO: 19625 - protein, 17 aa, Mycobacterium avium
FMVELPPDFSAAIASPV

SEQ ID NO: 19626 - protein, 17 aa, Mycobacterium avium
FNGHLWISMDYVEGTDA

SEQ ID NO: 19627 - protein, 17 aa, Mycobacterium avium
FNGRTGYHLGLRAGINT

SEQ ID NO: 19628 - protein, 20 aa, Mycobacterium avium
FPGLEVCVYAAPSQTVIGGP

SEQ ID NO: 19629 - protein, 17 aa, Mycobacterium avium
FPGTITITFAYIGLTCP

SEQ ID NO: 19630 - protein, 20 aa, Mycobacterium avium
FPRIDPAVICLVHDGGDRAV

SEQ ID NO: 19631 - protein, 18 aa, Mycobacterium avium
FQRWDVFTPPKFVGLKNF

SEQ ID NO: 19632 - protein, 17 aa, Mycobacterium avium
FQTLGVPCAVGMLVAVF

SEQ ID NO: 19633 - protein, 18 aa, Mycobacterium avium
FRLFWLVYLGMTFGWLFG

SEQ ID NO: 19634 - protein, 17 aa, Mycobacterium avium
FRPPTAVGHTGELVSMR

SEQ ID NO: 19635 - protein, 21 aa, Mycobacterium avium
FRTRLWLPYLPLILAAAVGWG

SEQ ID NO: 19636 - protein, 23 aa, Mycobacterium avium
FSERRVGIPFGFGVIFAITGMTA

SEQ ID NO: 19637 - protein, 17 aa, Mycobacterium avium
FTARRAAVLAAVICVLT

SEQ ID NO: 19638 - protein, 17 aa, Mycobacterium avium
FTPRWLVRRAEGIAMSS

SEQ ID NO: 19639 - protein, 17 aa, Mycobacterium avium
FTRSRLFPTAAVVIAAA

SEQ ID NO: 19640 - protein, 20 aa, Mycobacterium avium
FTTLLRRRLAIIGRHNAVRP

SEQ ID NO: 19641 - protein, 17 aa, Mycobacterium avium
FVMRRWAPVGLIVVGLL

SEQ ID NO: 19642 - protein, 17 aa, Mycobacterium avium
FWLVLTIAAVVALSGFV

SEQ ID NO: 19643 - protein, 17 aa, Mycobacterium avium
FWVVRALELLEDFEQFG

SEQ ID NO: 19644 - protein, 19 aa, Mycobacterium avium
GAAFPLVWTTLYADIAATS

SEQ ID NO: 19645 - protein, 19 aa, Mycobacterium avium
GAAPGPWRLLLRDLAHLLD

SEQ ID NO: 19646 - protein, 23 aa, Mycobacterium avium
GALKNVFAIAVGMGYSLGIALVI

SEQ ID NO: 19647 - protein, 17 aa, Mycobacterium avium
GALWSSLIAGFVILILL

SEQ ID NO: 19648 - protein, 18 aa, Mycobacterium avium
GAPITIAVPAYWSDDQFA

SEQ ID NO: 19649 - protein, 17 aa, Mycobacterium avium
GDMFGRVRIYNAGFAVF

SEQ ID NO: 19650 - protein, 18 aa, Mycobacterium avium
GEAMLFGEYIRFMALVEY

SEQ ID NO: 19651 - protein, 17 aa, Mycobacterium avium
GFHRIPGAVGFAIAQDH

SEQ ID NO: 19652 - protein, 18 aa, Mycobacterium avium
GGALAYACAIGLKRAGAD

SEQ ID NO: 19653 - protein, 19 aa, Mycobacterium avium
GGAVALVLLGGFAILGGIL

SEQ ID NO: 19654 - protein, 17 aa, Mycobacterium avium
GGFAYAGGWLRPDSPLT

SEQ ID NO: 19655 - protein, 20 aa, Mycobacterium avium
GGPPRPRKRRRLKLVRAIAA

SEQ ID NO: 19656 - protein, 18 aa, Mycobacterium avium
GGSLAFGAALAWSGLVFT

SEQ ID NO: 19657 - protein, 29 aa, Mycobacterium avium
GGVTLLAVVAWRWRRFRAAAAAALLIDLA

SEQ ID NO: 19658 - protein, 25 aa, Mycobacterium avium
GHARPLYGPGLRWLIPLVDKMIRVD

SEQ ID NO: 19659 - protein, 18 aa, Mycobacterium avium
GIKFFNWIGTMWKGQLTF

SEQ ID NO: 19660 - protein, 18 aa, Mycobacterium avium
GIVPWWFVVVLLVRDGLL

SEQ ID NO: 19661 - protein, 17 aa, Mycobacterium avium
GKMLAGLRCHSDAGSQF

SEQ ID NO: 19662 - protein, 21 aa, Mycobacterium avium
GKQPRPAIGPLRRTGLSGVLR

SEQ ID NO: 19663 - protein, 22 aa, Mycobacterium avium
GLCVSRLRAAFANRDDRPISSG

SEQ ID NO: 19664 - protein, 20 aa, Mycobacterium avium
GLHRCWRGAPAVTVSVVGWV

SEQ ID NO: 19665 - protein, 25 aa, Mycobacterium avium
GLIGWSAACALAYLRGFGRKPAWVL

SEQ ID NO: 19666 - protein, 21 aa, Mycobacterium avium
GLLALACWCLILATAALAGVL

SEQ ID NO: 19667 - protein, 28 aa, Mycobacterium avium
GLLILIFGFPWYWFSPRSSAPAPSVAAP

SEQ ID NO: 19668 - protein, 23 aa, Mycobacterium avium
GLLKRRWPAVVVFILLLVFSALV

SEQ ID NO: 19669 - protein, 18 aa, Mycobacterium avium
GLPRGGAVALVLLGGFAI

SEQ ID NO: 19670 - protein, 17 aa, Mycobacterium avium
GLRLDWPDDGTIGASGF

SEQ ID NO: 19671 - protein, 24 aa, Mycobacterium avium
GLTCPRWRIVALLADEVGHRLLIG

SEQ ID NO: 19672 - protein, 20 aa, Mycobacterium avium
GLTCPRWRSLAFVPLGVAAF

SEQ ID NO: 19673 - protein, 17 aa, Mycobacterium avium
GMSWRARPKLAITPGGL

SEQ ID NO: 19674 - protein, 17 aa, Mycobacterium avium
GMTCASCAARIEKKLNK

SEQ ID NO: 19675 - protein, 17 aa, Mycobacterium avium
GPAAGHRSDPHWTRPED

SEQ ID NO: 19676 - protein, 18 aa, Mycobacterium avium
GPAGWSMRLNVIDPPKPR

SEQ ID NO: 19677 - protein, 18 aa, Mycobacterium avium
GPDGRPPIHLPLDDPYQA

SEQ ID NO: 19678 - protein, 17 aa, Mycobacterium avium
GPDGRPTIHLPLEDPYQ

SEQ ID NO: 19679 - protein, 18 aa, Mycobacterium avium
GPFFKAYVVNLFPGQFVQ

SEQ ID NO: 19680 - protein, 19 aa, Mycobacterium avium
GPFWRRLLSAAGFTAVSHV

SEQ ID NO: 19681 - protein, 17 aa, Mycobacterium avium
GPGARWIAMNDVTAGNA

SEQ ID NO: 19682 - protein, 19 aa, Mycobacterium avium
GPGGAPGCWQKITRDLWPA

SEQ ID NO: 19683 - protein, 21 aa, Mycobacterium avium
GPGPRWWAITLLVVGGVSAVY

SEQ ID NO: 19684 - protein, 23 aa, Mycobacterium avium
GPGRCPRCGFDVATQGHRRDCED

SEQ ID NO: 19685 - protein, 17 aa, Mycobacterium avium
GPPPPPPRRGWSGGPGG

SEQ ID NO: 19686 - protein, 18 aa, Mycobacterium avium
GQLRAGTALIARGEFSLI

SEQ ID NO: 19687 - protein, 18 aa, Mycobacterium avium
GQPDHFDWLTGYLQDHGF

SEQ ID NO: 19688 - protein, 18 aa, Mycobacterium avium
GRARVLGVIHLKDVVKQG

SEQ ID NO: 19689 - protein, 18 aa, Mycobacterium avium
GRGGLQFMLIIWLQGIWL

SEQ ID NO: 19690 - protein, 18 aa, Mycobacterium avium
GRLGWPLWTAYIGVFALT

SEQ ID NO: 19691 - protein, 19 aa, Mycobacterium avium
GRMKDLLIVYGRNHYPEDI

SEQ ID NO: 19692 - protein, 20 aa, Mycobacterium avium
GRNPLGWGILGLFFSILTLI

SEQ ID NO: 19693 - protein, 22 aa, Mycobacterium avium
GRRLFCTAAPQLRRVLFAPQTV

SEQ ID NO: 19694 - protein, 21 aa, Mycobacterium avium
GRVPEKMTFLLAGGVRLTAAA

SEQ ID NO: 19695 - protein, 21 aa, Mycobacterium avium
GRVPEKMTFLLAGGVRLTATA

SEQ ID NO: 19696 - protein, 23 aa, Mycobacterium avium
GRWRPLPAPVWVSATAVLLVATT

SEQ ID NO: 19697 - protein, 20 aa, Mycobacterium avium
GSLLDVCWPASSVLIAMASW

SEQ ID NO: 19698 - protein, 18 aa, Mycobacterium avium
GSSFKVFCLIAALEQGIG

SEQ ID NO: 19699 - protein, 20 aa, Mycobacterium avium
GSYVLDWRVGLAFTAGALLC

SEQ ID NO: 19700 - protein, 17 aa, Mycobacterium avium
GTTIEWYDFYLYATASA

SEQ ID NO: 19701 - protein, 22 aa, Mycobacterium avium
GVAGLVEWPVLLAVGGGALLLQ

SEQ ID NO: 19702 - protein, 26 aa, Mycobacterium avium
GVAGLVEWPVLLAVGGGALLLQRLNR

SEQ ID NO: 19703 - protein, 23 aa, Mycobacterium avium
GVALGLRFSYGWIAALAFVLVPV

SEQ ID NO: 19704 - protein, 17 aa, Mycobacterium avium
GVLPFVWIAWTAIRNVR

SEQ ID NO: 19705 - protein, 18 aa, Mycobacterium avium
GVSVIRRLVVPRFAAAIM

SEQ ID NO: 19706 - protein, 22 aa, Mycobacterium avium
GYDWTRWLTVVAFDIAIVFLLF

SEQ ID NO: 19707 - protein, 23 aa, Mycobacterium avium
HARPLYGPGLRFLIPLLDKMIRV

SEQ ID NO: 19708 - protein, 23 aa, Mycobacterium avium
HHRSVWWSWLVGVLTVVGLGLGL

SEQ ID NO: 19709 - protein, 17 aa, Mycobacterium avium
HLLTMICGFALLGYVVA

SEQ ID NO: 19710 - protein, 21 aa, Mycobacterium avium
HLRAGVLYNIAFPGAYLCLSA

SEQ ID NO: 19711 - protein, 24 aa, Mycobacterium avium
HMDDRKIHLVIARRPLAALGAGVA

SEQ ID NO: 19712 - protein, 19 aa, Mycobacterium avium
HPDLLALRARYERVAESMS

SEQ ID NO: 19713 - protein, 25 aa, Mycobacterium avium
HPKKFSWHWWWLMAAVPVAVLLVLL

SEQ ID NO: 19714 - protein, 22 aa, Mycobacterium avium
HRFGAPTARPFRPYPRCGKGFA

SEQ ID NO: 19715 - protein, 22 aa, Mycobacterium avium
HSAWESGASWVAWVIGVISVPV

SEQ ID NO: 19716 - protein, 26 aa, Mycobacterium avium
HSDLDWLWWFGAGWLAVAVVGAGVIL

SEQ ID NO: 19717 - protein, 21 aa, Mycobacterium avium
HVVAGSWSFRLTVPGTGTPGP

SEQ ID NO: 19718 - protein, 17 aa, Mycobacterium avium
HVVDARFARDLRSALLR

SEQ ID NO: 19719 - protein, 21 aa, Mycobacterium avium
HWKITEAPLFYGGYAVLLAAS

SEQ ID NO: 19720 - protein, 21 aa, Mycobacterium avium
HWKITEAPLFYGGYAVLLAVS

SEQ ID NO: 19721 - protein, 25 aa, Mycobacterium avium
IAALLGRWFWWPQLVRRRPASQLLR

SEQ ID NO: 19722 - protein, 18 aa, Mycobacterium avium
IAFGLSMDYEVFLLSRIR

SEQ ID NO: 19723 - protein, 17 aa, Mycobacterium avium
IAGELGIGEVISGALPA

SEQ ID NO: 19724 - protein, 18 aa, Mycobacterium avium
IAGELGIGEVISGALPAD

SEQ ID NO: 19725 - protein, 18 aa, Mycobacterium avium
IDNVMLVSAFLAAAALAQ

SEQ ID NO: 19726 - protein, 17 aa, Mycobacterium avium
IFLCGVCSIPGRHTVAD

SEQ ID NO: 19727 - protein, 18 aa, Mycobacterium avium
IGAGCLWQTEPLVGLMAC

SEQ ID NO: 19728 - protein, 18 aa, Mycobacterium avium
IGTTIEWYDFYLYATASA

SEQ ID NO: 19729 - protein, 21 aa, Mycobacterium avium
IGYRHGWGWLARMDWSFLNGT

SEQ ID NO: 19730 - protein, 24 aa, Mycobacterium avium
IIHRLSVPIILGWLAVAVLITIGV

SEQ ID NO: 19731 - protein, 17 aa, Mycobacterium avium
INGVLYIDMRLVQGQTL

SEQ ID NO: 19732 - protein, 21 aa, Mycobacterium avium
INPVQRLLVPRVLALCLNGLL

SEQ ID NO: 19733 - protein, 21 aa, Mycobacterium avium
IPALFTLVGDRIWWPNNPARH

SEQ ID NO: 19734 - protein, 22 aa, Mycobacterium avium
IPGDSVVAWWVRLVMPALAVVA

SEQ ID NO: 19735 - protein, 26 aa, Mycobacterium avium
IPLLTARLSGRFGVPVHSTAQPGLSA

SEQ ID NO: 19736 - protein, 20 aa, Mycobacterium avium
IPRFLRKLLRELAPAPDTDR

SEQ ID NO: 19737 - protein, 17 aa, Mycobacterium avium
IQLPGLIAVTARWDFAP

SEQ ID NO: 19738 - protein, 18 aa, Mycobacterium avium
IRDKELRAKLTPDYDCGC

SEQ ID NO: 19739 - protein, 19 aa, Mycobacterium avium
IRIPIVLGVAQLLGRIPLP

SEQ ID NO: 19740 - protein, 20 aa, Mycobacterium avium
IRIPIVLGVAQLLGRIPLPG

SEQ ID NO: 19741 - protein, 18 aa, Mycobacterium avium
IRLLLANRLYFAFLALLP

SEQ ID NO: 19742 - protein, 22 aa, Mycobacterium avium
IRNWPAWLGIYGFMTLDRWLLF

SEQ ID NO: 19743 - protein, 17 aa, Mycobacterium avium
IRPGFIGTVLILLVVAV

SEQ ID NO: 19744 - protein, 19 aa, Mycobacterium avium
IRRAACVEHYLRGAFIRLD

SEQ ID NO: 19745 - protein, 17 aa, Mycobacterium avium
IRSGGSFRLGASSAGAQ

SEQ ID NO: 19746 - protein, 17 aa, Mycobacterium avium
ISVGLTRDGGQLKMSKV

SEQ ID NO: 19747 - protein, 18 aa, Mycobacterium avium
IYRLISWLLIAAVGWVVF

SEQ ID NO: 19748 - protein, 20 aa, Mycobacterium avium
KEIQKLSGLSINHFIAVDFA

SEQ ID NO: 19749 - protein, 19 aa, Mycobacterium avium
KFWNRWIGWVMRRPWMSAL

SEQ ID NO: 19750 - protein, 17 aa, Mycobacterium avium
KGSVLWSLIAGIAPAIK

SEQ ID NO: 19751 - protein, 18 aa, Mycobacterium avium
KLSRLPLGWFTARGSGSI

SEQ ID NO: 19752 - protein, 24 aa, Mycobacterium avium
KLYTDRHIRLWVVYVDTFSGQTAT

SEQ ID NO: 19753 - protein, 17 aa, Mycobacterium avium
KMNMPWLFFFSGLAIPA

SEQ ID NO: 19754 - protein, 20 aa, Mycobacterium avium
KMSGGQGFAIPIGRAMAVAN

SEQ ID NO: 19755 - protein, 23 aa, Mycobacterium avium
KPSIAWPRVFGYGILPGLALILA

SEQ ID NO: 19756 - protein, 23 aa, Mycobacterium avium
KPSIAWPRVFGYGILPGLALVLA

SEQ ID NO: 19757 - protein, 17 aa, Mycobacterium avium
KQYTQNFAWPVSKDLNP

SEQ ID NO: 19758 - protein, 19 aa, Mycobacterium avium
KQYTQNFAWPVSKDLNPGG

SEQ ID NO: 19759 - protein, 19 aa, Mycobacterium avium
KRPLIPRMVRAFAIPIIFF

SEQ ID NO: 19760 - protein, 23 aa, Mycobacterium avium
KRYGRAALVVAVYAGAFGLAAGL

SEQ ID NO: 19761 - protein, 18 aa, Mycobacterium avium
KTGWDFGPAQRWTAQATS

SEQ ID NO: 19762 - protein, 17 aa, Mycobacterium avium
LAAFAAMFLAGGVFFTL

SEQ ID NO: 19763 - protein, 21 aa, Mycobacterium avium
LAALCYAEFASTLPVAGSAYT

SEQ ID NO: 19764 - protein, 17 aa, Mycobacterium avium
LACPVWFYQLWAFITPG

SEQ ID NO: 19765 - protein, 21 aa, Mycobacterium avium
LAFGAGLAWLAMDRRRIRQEQ

SEQ ID NO: 19766 - protein, 18 aa, Mycobacterium avium
LAKLLPFNLARTWHVQLS

SEQ ID NO: 19767 - protein, 17 aa, Mycobacterium avium
LALVPVLIGLAIALPLG

SEQ ID NO: 19768 - protein, 17 aa, Mycobacterium avium
LARRTAMALTRWRVRME

SEQ ID NO: 19769 - protein, 17 aa, Mycobacterium avium
LATDLSYGVYIYAFPVQ

SEQ ID NO: 19770 - protein, 28 aa, Mycobacterium avium
LATIKLWAGRCAARWRSIVATALVAGAV

SEQ ID NO: 19771 - protein, 20 aa, Mycobacterium avium
LAVLCSKAWNDFHLDEWAAT

SEQ ID NO: 19772 - protein, 17 aa, Mycobacterium avium
LCGVCSIPGRHTVADRY

SEQ ID NO: 19773 - protein, 17 aa, Mycobacterium avium
LDARRGWAHRPFIGSFV

SEQ ID NO: 19774 - protein, 21 aa, Mycobacterium avium
LDGRKLLWWTLSRFTTLGNLP

SEQ ID NO: 19775 - protein, 21 aa, Mycobacterium avium
LDGRWLIRIAQLLLVIAAVGL

SEQ ID NO: 19776 - protein, 22 aa, Mycobacterium avium
LDGRWLIRIAQLLLVIAAVGLW

SEQ ID NO: 19777 - protein, 19 aa, Mycobacterium avium
LDLGCGRGAVLLAAAKRLP

SEQ ID NO: 19778 - protein, 17 aa, Mycobacterium avium
LDLPRLWQILLTVGLFL

SEQ ID NO: 19779 - protein, 18 aa, Mycobacterium avium
LDRIAAYERYWLYPGAEN

SEQ ID NO: 19780 - protein, 20 aa, Mycobacterium avium
LELPATGGLYRFSNVTYRGV

SEQ ID NO: 19781 - protein, 28 aa, Mycobacterium avium
LEPAPAAGRSWARTCGYAALIGVVPAGL

SEQ ID NO: 19782 - protein, 17 aa, Mycobacterium avium
LEPMAGLALFLVVTACV

SEQ ID NO: 19783 - protein, 17 aa, Mycobacterium avium
LFADVALTCVASAMLGL

SEQ ID NO: 19784 - protein, 23 aa, Mycobacterium avium
LFDWPTHILEIFMSQPELLAPAL

SEQ ID NO: 19785 - protein, 20 aa, Mycobacterium avium
LFRVPELLAGSFLLALLAVT

SEQ ID NO: 19786 - protein, 18 aa, Mycobacterium avium
LFTRSRLFPAAAVVIPAA

SEQ ID NO: 19787 - protein, 18 aa, Mycobacterium avium
LFTRSRLFPTAAVVIAAA

SEQ ID NO: 19788 - protein, 24 aa, Mycobacterium avium
LFVVLGCASGLCLREGLIDLGGRR

SEQ ID NO: 19789 - protein, 20 aa, Mycobacterium avium
LFYSGFYLPMYWSSRAKLTN

SEQ ID NO: 19790 - protein, 18 aa, Mycobacterium avium
LGAITAAMPVRWRGVWAG

SEQ ID NO: 19791 - protein, 27 aa, Mycobacterium avium
LGGKLRTSRQFNWGWILALVVIVLALA

SEQ ID NO: 19792 - protein, 17 aa, Mycobacterium avium
LGLANAWLFVVAAELIA

SEQ ID NO: 19793 - protein, 21 aa, Mycobacterium avium
LGMPIDLSWELWAYGVFAIAA

SEQ ID NO: 19794 - protein, 18 aa, Mycobacterium avium
LGVFCVGGALAIGVLGKR

SEQ ID NO: 19795 - protein, 17 aa, Mycobacterium avium
LGVLPLLPVLLMVWATA

SEQ ID NO: 19796 - protein, 21 aa, Mycobacterium avium
LGVPCAVGMLVAVFAALTLGP

SEQ ID NO: 19797 - protein, 21 aa, Mycobacterium avium
LHRLDAIVLYLGFIVAAWLLG

SEQ ID NO: 19798 - protein, 17 aa, Mycobacterium avium
LIAPMFLAMYLRAFYSP

SEQ ID NO: 19799 - protein, 19 aa, Mycobacterium avium
LIGALALFCAACWLIQILV

SEQ ID NO: 19800 - protein, 26 aa, Mycobacterium avium
LIGALGLFCAACWLIQILVHHHSNPS

SEQ ID NO: 19801 - protein, 21 aa, Mycobacterium avium
LIVFCFIELRAPQPMVNVRLF

SEQ ID NO: 19802 - protein, 17 aa, Mycobacterium avium
LKPGYGMPTMAEVREHF

SEQ ID NO: 19803 - protein, 19 aa, Mycobacterium avium
LKRDLLRAVAWVLTFNATY

SEQ ID NO: 19804 - protein, 30 aa, Mycobacterium avium
LKRFGAFGWAVPWIPGTAFGNLVTRDGSTD

SEQ ID NO: 19805 - protein, 21 aa, Mycobacterium avium
LKVSLLLSVALFFVWMIAVAF

SEQ ID NO: 19806 - protein, 20 aa, Mycobacterium avium
LLALACWCLILATAALAGVL

SEQ ID NO: 19807 - protein, 23 aa, Mycobacterium avium
LLCALTLRLLMVVIHRNDDQYDH

SEQ ID NO: 19808 - protein, 18 aa, Mycobacterium avium
LLESFLFYSGFYLPMYWS

SEQ ID NO: 19809 - protein, 18 aa, Mycobacterium avium
LLESKGLYARLWEHDRRV

SEQ ID NO: 19810 - protein, 19 aa, Mycobacterium avium
LLFGIPYDRIEVVVHPQSI

SEQ ID NO: 19811 - protein, 22 aa, Mycobacterium avium
LLIVFCFIELRAPQPMVNVRLF

SEQ ID NO: 19812 - protein, 20 aa, Mycobacterium avium
LLLAAGLSWAAIQLAHLTGL

SEQ ID NO: 19813 - protein, 17 aa, Mycobacterium avium
LLLEPMAGLALFLVVTA

SEQ ID NO: 19814 - protein, 19 aa, Mycobacterium avium
LLLEVSWEALERAGIDPAT

SEQ ID NO: 19815 - protein, 29 aa, Mycobacterium avium
LLMLVAAIHWRARGWLKRVLPAALVAAVA

SEQ ID NO: 19816 - protein, 17 aa, Mycobacterium avium
LLQGFAVGGEWAGSVLL

SEQ ID NO: 19817 - protein, 17 aa, Mycobacterium avium
LLSGFFILAERQYGFGD

SEQ ID NO: 19818 - protein, 24 aa, Mycobacterium avium
LLSSFKIPTVWLVLRSDDDLPRGG

SEQ ID NO: 19819 - protein, 20 aa, Mycobacterium avium
LLVRYRKSWSDLAAVVTVGG

SEQ ID NO: 19820 - protein, 20 aa, Mycobacterium avium
LMVSTSLAWTGRLTPPGTFT

SEQ ID NO: 19821 - protein, 17 aa, Mycobacterium avium
LNLNWPPPCTTGFLPIQ

SEQ ID NO: 19822 - protein, 22 aa, Mycobacterium avium
LPFGEVIVQAWTLLKVTALPAV

SEQ ID NO: 19823 - protein, 17 aa, Mycobacterium avium
LPFILARYPRTFAGIGR

SEQ ID NO: 19824 - protein, 18 aa, Mycobacterium avium
LPIPRFLAGQSWRRTPSI

SEQ ID NO: 19825 - protein, 17 aa, Mycobacterium avium
LPPRFARVNPRTMTPVN

SEQ ID NO: 19826 - protein, 19 aa, Mycobacterium avium
LPSVPRWLWIFLGVVGVTA

SEQ ID NO: 19827 - protein, 19 aa, Mycobacterium avium
LPTELFVKFSRDFDNPVRD

SEQ ID NO: 19828 - protein, 18 aa, Mycobacterium avium
LPVLRWSWAPVLVAASLT

SEQ ID NO: 19829 - protein, 24 aa, Mycobacterium avium
LQLHGRPGPIPSYDAAAALRADAA

SEQ ID NO: 19830 - protein, 23 aa, Mycobacterium avium
LQTRAVWRLVNFLLEGVVFLLIG

SEQ ID NO: 19831 - protein, 22 aa, Mycobacterium avium
LRAGAVCWLAIAVCCLAAAGLA

SEQ ID NO: 19832 - protein, 19 aa, Mycobacterium avium
LRAGVLYNIAFPGAYLCLS

SEQ ID NO: 19833 - protein, 17 aa, Mycobacterium avium
LRCVCLAPLNAHHDTLA

SEQ ID NO: 19834 - protein, 18 aa, Mycobacterium avium
LRCVCLAPLNAHHDTLAM

SEQ ID NO: 19835 - protein, 18 aa, Mycobacterium avium
LRIAGLLPDVIAESQRRQ

SEQ ID NO: 19836 - protein, 20 aa, Mycobacterium avium
LRILGPWFWWPTLVRSRPLP

SEQ ID NO: 19837 - protein, 17 aa, Mycobacterium avium
LRLPKVSARVLVIAALA

SEQ ID NO: 19838 - protein, 17 aa, Mycobacterium avium
LRLVSIGVPVAIGLLAG

SEQ ID NO: 19839 - protein, 18 aa, Mycobacterium avium
LRPARAGATLGLPSGAWR

SEQ ID NO: 19840 - protein, 18 aa, Mycobacterium avium
LRPLWGIDQRLKRFGTLA

SEQ ID NO: 19841 - protein, 20 aa, Mycobacterium avium
LRPRAVIYHRGLGPKFADVL

SEQ ID NO: 19842 - protein, 18 aa, Mycobacterium avium
LRPWVPVVSLVKGLEQGT

SEQ ID NO: 19843 - protein, 17 aa, Mycobacterium avium
LRTPELYVWVLLAIAAT

SEQ ID NO: 19844 - protein, 27 aa, Mycobacterium avium
LRTRGRWLRWGLLSVWGPGLVVMLADT

SEQ ID NO: 19845 - protein, 20 aa, Mycobacterium avium
LRYILSSVRPRVFITAEGFG

SEQ ID NO: 19846 - protein, 18 aa, Mycobacterium avium
LSALRPGSLQALLPPEQR

SEQ ID NO: 19847 - protein, 21 aa, Mycobacterium avium
LSFLLRPGWVVLALVVVAFAY

SEQ ID NO: 19848 - protein, 20 aa, Mycobacterium avium
LSIPSWWQPYVLSVASLTPD

SEQ ID NO: 19849 - protein, 25 aa, Mycobacterium avium
LSLFMAIAIAVTWMVYATLRRDVAG

SEQ ID NO: 19850 - protein, 19 aa, Mycobacterium avium
LSLTWPRLTTVFLVDIVIM

SEQ ID NO: 19851 - protein, 17 aa, Mycobacterium avium
LSLVPVLIGLAIALPLG

SEQ ID NO: 19852 - protein, 23 aa, Mycobacterium avium
LTAAGYLLWWAVLFPAISVPIIA

SEQ ID NO: 19853 - protein, 17 aa, Mycobacterium avium
LTAGFALTVPIVTATSA

SEQ ID NO: 19854 - protein, 19 aa, Mycobacterium avium
LTCPRWRSLAFVPLGVAAF

SEQ ID NO: 19855 - protein, 27 aa, Mycobacterium avium
LTCWAVTAGGIWWPIGRELAWCCVGLL

SEQ ID NO: 19856 - protein, 18 aa, Mycobacterium avium
LTGGAVWLIGWRVIQGVG

SEQ ID NO: 19857 - protein, 17 aa, Mycobacterium avium
LTGGAVWLIGWRVVQGV

SEQ ID NO: 19858 - protein, 18 aa, Mycobacterium avium
LTGGAVWLIGWRVVQGVG

SEQ ID NO: 19859 - protein, 19 aa, Mycobacterium avium
LTLGHGRLFALYVAGYCVG

SEQ ID NO: 19860 - protein, 20 aa, Mycobacterium avium
LTMICGFALLGYVVAVMKPD

SEQ ID NO: 19861 - protein, 23 aa, Mycobacterium avium
LTQLTVRGWLALVLWIMGTTVLI

SEQ ID NO: 19862 - protein, 23 aa, Mycobacterium avium
LTQLTVRGWLALVLWIMGTTVLV

SEQ ID NO: 19863 - protein, 24 aa, Mycobacterium avium
LTTGLWRRSGIRIVRRPRAHLVAS

SEQ ID NO: 19864 - protein, 17 aa, Mycobacterium avium
LTVFPGWVAVGLATALA

SEQ ID NO: 19865 - protein, 17 aa, Mycobacterium avium
LVCCLALILALPDLVWG

SEQ ID NO: 19866 - protein, 19 aa, Mycobacterium avium
LVRYRKSWSDLAAVVTVGG

SEQ ID NO: 19867 - protein, 17 aa, Mycobacterium avium
LVTCGVVLLAVFAAFIA

SEQ ID NO: 19868 - protein, 17 aa, Mycobacterium avium
LVTLKFLLEQPLLYVVG

SEQ ID NO: 19869 - protein, 17 aa, Mycobacterium avium
LWLRLARVWPVYLVTLH

SEQ ID NO: 19870 - protein, 21 aa, Mycobacterium avium
LWMVLRPLQYRAIAAEVIAIR

SEQ ID NO: 19871 - protein, 21 aa, Mycobacterium avium
LWQYLLGLKLHWMVLAMAVIL

SEQ ID NO: 19872 - protein, 17 aa, Mycobacterium avium
LWSAIGLVPQRGYLFSG

SEQ ID NO: 19873 - protein, 18 aa, Mycobacterium avium
LWTHLRASGWRVLAGYAS

SEQ ID NO: 19874 - protein, 17 aa, Mycobacterium avium
LWWRSRRTYLLTVAGDR

SEQ ID NO: 19875 - protein, 19 aa, Mycobacterium avium
LYGPGLRFLIPLLDKMIRV

SEQ ID NO: 19876 - protein, 17 aa, Mycobacterium avium
LYLNIAVVALGFAAYLL

SEQ ID NO: 19877 - protein, 17 aa, Mycobacterium avium
LYWAAAVVFGLPLLLIV

SEQ ID NO: 19878 - protein, 19 aa, Mycobacterium avium
MAVLWLHGWPTRRQSVVFA

SEQ ID NO: 19879 - protein, 17 aa, Mycobacterium avium
MCGFPLVLLGTWDALWS

SEQ ID NO: 19880 - protein, 23 aa, Mycobacterium avium
MDDRKIHLVIARRPLAALGAGVA

SEQ ID NO: 19881 - protein, 18 aa, Mycobacterium avium
MGPRLGALMIDWLISYGL

SEQ ID NO: 19882 - protein, 20 aa, Mycobacterium avium
MKARETVGWMRAELPKVPEA

SEQ ID NO: 19883 - protein, 17 aa, Mycobacterium avium
MLFAKPSYYGQFTDSGG

SEQ ID NO: 19884 - protein, 18 aa, Mycobacterium avium
MLFAKPSYYGQFTDSGGI

SEQ ID NO: 19885 - protein, 24 aa, Mycobacterium avium
MLFDWPTHILEIFMSQPELLAPAL

SEQ ID NO: 19886 - protein, 20 aa, Mycobacterium avium
MLIYRLISWLLIAAVGWVVF

SEQ ID NO: 19887 - protein, 17 aa, Mycobacterium avium
MLYCLTRALIALAATMA

SEQ ID NO: 19888 - protein, 24 aa, Mycobacterium avium
MNLAGGRPRLVWYAPHFVEGESSS

SEQ ID NO: 19889 - protein, 25 aa, Mycobacterium avium
MNLAGGRPRLVWYAPHFVEGESSSK

SEQ ID NO: 19890 - protein, 17 aa, Mycobacterium avium
MPGSGLGLAIVKKVVLN

SEQ ID NO: 19891 - protein, 18 aa, Mycobacterium avium
MQAGCRFTAQLGAMRIAE

SEQ ID NO: 19892 - protein, 17 aa, Mycobacterium avium
MRLWLLRPGMRLWDLPL

SEQ ID NO: 19893 - protein, 17 aa, Mycobacterium avium
MSVSLAFGYSYLVIYSL

SEQ ID NO: 19894 - protein, 18 aa, Mycobacterium avium
MTVRLGIVTGRGHGSLIR

SEQ ID NO: 19895 - protein, 20 aa, Mycobacterium avium
NAGEPIFWVVRALELLEDFE

SEQ ID NO: 19896 - protein, 23 aa, Mycobacterium avium
NAGEPIFWVVRALELLEDFEQFG

SEQ ID NO: 19897 - protein, 21 aa, Mycobacterium avium
NAHGLKAFVLVGAVAVVIVAT

SEQ ID NO: 19898 - protein, 19 aa, Mycobacterium avium
NAMGWNFTAAKNMFAWIGP

SEQ ID NO: 19899 - protein, 18 aa, Mycobacterium avium
NHEPGWVVAPGMQGIDVQ

SEQ ID NO: 19900 - protein, 18 aa, Mycobacterium avium
NHEPGWVVAPGMQGTDVQ

SEQ ID NO: 19901 - protein, 19 aa, Mycobacterium avium
NHEPGWVVAPGMQGTDVQP

SEQ ID NO: 19902 - protein, 19 aa, Mycobacterium avium
NISASLTWGGERYRYPTNL

SEQ ID NO: 19903 - protein, 23 aa, Mycobacterium avium
NLAGGRPRLIWYAPHFVEGESSS

SEQ ID NO: 19904 - protein, 21 aa, Mycobacterium avium
NLPAAWRFSRGDGQLVAVLDT

SEQ ID NO: 19905 - protein, 22 aa, Mycobacterium avium
NPLVPVPIPIPVPIPGWNPPYN

SEQ ID NO: 19906 - protein, 19 aa, Mycobacterium avium
NPWLPGYMSQALALLTRDT

SEQ ID NO: 19907 - protein, 22 aa, Mycobacterium avium
NRLWWRYTGWWLVALVLATLWW

SEQ ID NO: 19908 - protein, 19 aa, Mycobacterium avium
NSRLLKSWVRRYTLRRGAL

SEQ ID NO: 19909 - protein, 23 aa, Mycobacterium avium
NTESHWKLGLYAAGRASQMRRLR

SEQ ID NO: 19910 - protein, 23 aa, Mycobacterium avium
NYYICGLTFRVTDLQGRTAVYPW

SEQ ID NO: 19911 - protein, 17 aa, Mycobacterium avium
PAAANTWADFTAAHIGT

SEQ ID NO: 19912 - protein, 18 aa, Mycobacterium avium
PADLPRIWELINATRDDA

SEQ ID NO: 19913 - protein, 17 aa, Mycobacterium avium
PAGWSMRLNVIDPPKPR

SEQ ID NO: 19914 - protein, 25 aa, Mycobacterium avium
PAIAALAGRANWWPSRMAVRRNPVS

SEQ ID NO: 19915 - protein, 17 aa, Mycobacterium avium
PAKLSRRSLVIGNAVIA

SEQ ID NO: 19916 - protein, 18 aa, Mycobacterium avium
PAKRAGTAAALWELSEEL

SEQ ID NO: 19917 - protein, 19 aa, Mycobacterium avium
PAPLSILLALWAIRAVAHW

SEQ ID NO: 19918 - protein, 21 aa, Mycobacterium avium
PAPRPIALGLFNAIPEAPPLT

SEQ ID NO: 19919 - protein, 25 aa, Mycobacterium avium
PASPAKRAWLPIAIAVIAVVVVVVL

SEQ ID NO: 19920 - protein, 23 aa, Mycobacterium avium
PAVVAWAALIGWIDLHGTWASWM

SEQ ID NO: 19921 - protein, 23 aa, Mycobacterium avium
PDGRFPWPTALVFAAGVLLAALR

SEQ ID NO: 19922 - protein, 20 aa, Mycobacterium avium
PDLLRPVLGWVLFAGLIGWR

SEQ ID NO: 19923 - protein, 20 aa, Mycobacterium avium
PDLLRPVLGWVLFAGLIGWS

SEQ ID NO: 19924 - protein, 24 aa, Mycobacterium avium
PDMRLPISLALGWPHRVPGAAACC

SEQ ID NO: 19925 - protein, 24 aa, Mycobacterium avium
PDRDWAWSSARGWLEVAPGAATAL

SEQ ID NO: 19926 - protein, 22 aa, Mycobacterium avium
PDVVSWKLKPGVVSTMTAQARY

SEQ ID NO: 19927 - protein, 17 aa, Mycobacterium avium
PEFLAVLLAIWRLAATA

SEQ ID NO: 19928 - protein, 19 aa, Mycobacterium avium
PEGMAAWIIGMVAAIGLAL

SEQ ID NO: 19929 - protein, 17 aa, Mycobacterium avium
PELYVWVLLAIAATAWE

SEQ ID NO: 19930 - protein, 23 aa, Mycobacterium avium
PFGEYLPMPWLFKHLSGYADRAG

SEQ ID NO: 19931 - protein, 25 aa, Mycobacterium avium
PGANFVICLVLLYAIALIWGLPNLH

SEQ ID NO: 19932 - protein, 20 aa, Mycobacterium avium
PGDVIVFKGPPSWNLGYKSI

SEQ ID NO: 19933 - protein, 19 aa, Mycobacterium avium
PGGWPFPPVPFVNGLASFF

SEQ ID NO: 19934 - protein, 20 aa, Mycobacterium avium
PGGWPFPPVPFVNGLASFFG

SEQ ID NO: 19935 - protein, 18 aa, Mycobacterium avium
PGPIPSYDAAAALRADAA

SEQ ID NO: 19936 - protein, 22 aa, Mycobacterium avium
PGSALRAVWRAGLRLWVPSLAL

SEQ ID NO: 19937 - protein, 23 aa, Mycobacterium avium
PGSALRAVWRAGLRLWVPSLALT

SEQ ID NO: 19938 - protein, 23 aa, Mycobacterium avium
PIAARGDIGWGIGDHGLLTNIGV

SEQ ID NO: 19939 - protein, 17 aa, Mycobacterium avium
PILLCGTAMMIVADVVL

SEQ ID NO: 19940 - protein, 21 aa, Mycobacterium avium
PKPAFSVGEAFGWAWNAFTKN

SEQ ID NO: 19941 - protein, 25 aa, Mycobacterium avium
PLLTARLSGRFGVPVHSTAQPGLSA

SEQ ID NO: 19942 - protein, 25 aa, Mycobacterium avium
PLLTPRLSGRFGVPVHSTAQPGLSA

SEQ ID NO: 19943 - protein, 21 aa, Mycobacterium avium
PLVPVPIPIPVPIPGWNPPYN

SEQ ID NO: 19944 - protein, 17 aa, Mycobacterium avium
PMAGLALFLVVTACVGG

SEQ ID NO: 19945 - protein, 24 aa, Mycobacterium avium
PMGPRLGALMIDWLISYGLAALAM

SEQ ID NO: 19946 - protein, 26 aa, Mycobacterium avium
PNPLVPVPIPIPVPIPGWNPPYNPPY

SEQ ID NO: 19947 - protein, 25 aa, Mycobacterium avium
PPPGFPPDRPEGFEQPGNVDPFDQQ

SEQ ID NO: 19948 - protein, 18 aa, Mycobacterium avium
PPPPPRRGWSGGPGGPGG

SEQ ID NO: 19949 - protein, 19 aa, Mycobacterium avium
PPRRKRLFTRSRLFPAAAV

SEQ ID NO: 19950 - protein, 20 aa, Mycobacterium avium
PPSFPIVVLACGIWSAVWAS

SEQ ID NO: 19951 - protein, 17 aa, Mycobacterium avium
PRFARVNPRTMTPVNNT

SEQ ID NO: 19952 - protein, 19 aa, Mycobacterium avium
PRGPSRLGRGWLAAIAAVL

SEQ ID NO: 19953 - protein, 20 aa, Mycobacterium avium
PRGPSRLGRGWLAAIAAVLV

SEQ ID NO: 19954 - protein, 22 aa, Mycobacterium avium
PRGRYWWVRWVILGVVAIVLAV

SEQ ID NO: 19955 - protein, 20 aa, Mycobacterium avium
PRPPLGPVWVALLIIGASSG

SEQ ID NO: 19956 - protein, 17 aa, Mycobacterium avium
PRPVARAGLATAALAGS

SEQ ID NO: 19957 - protein, 20 aa, Mycobacterium avium
PRQSLAPGFGGNVLHDLSHA

SEQ ID NO: 19958 - protein, 21 aa, Mycobacterium avium
PRSRTWPAVALAAVAVLLGGA

SEQ ID NO: 19959 - protein, 19 aa, Mycobacterium avium
PRVSGWLWQALAALLIATV

SEQ ID NO: 19960 - protein, 18 aa, Mycobacterium avium
PRWLWIFLGVVGVTAALA

SEQ ID NO: 19961 - protein, 17 aa, Mycobacterium avium
PSWGEWRTAGAAATAGV

SEQ ID NO: 19962 - protein, 17 aa, Mycobacterium avium
PVALRWVATTVMMAMMV

SEQ ID NO: 19963 - protein, 17 aa, Mycobacterium avium
PVIRLGHLLVFFVRALV

SEQ ID NO: 19964 - protein, 17 aa, Mycobacterium avium
PVLMIGMIYIWMPLAMG

SEQ ID NO: 19965 - protein, 17 aa, Mycobacterium avium
PVRPSRCRWRRRWPSSP

SEQ ID NO: 19966 - protein, 19 aa, Mycobacterium avium
PVRRDGRFVVALGMGGMGY

SEQ ID NO: 19967 - protein, 18 aa, Mycobacterium avium
PVRYPRGWPAVAAAINAR

SEQ ID NO: 19968 - protein, 17 aa, Mycobacterium avium
PVTIGSFFKPRNFGMVF

SEQ ID NO: 19969 - protein, 21 aa, Mycobacterium avium
PWHSPRDYWLLGIAAAVLIVL

SEQ ID NO: 19970 - protein, 23 aa, Mycobacterium avium
PWLPARWRRWWWALLLAFVPIHL

SEQ ID NO: 19971 - protein, 18 aa, Mycobacterium avium
PYGPRPAVRTLLLPENRD

SEQ ID NO: 19972 - protein, 20 aa, Mycobacterium avium
QEWLEALFPFNPFSPQGWSM

SEQ ID NO: 19973 - protein, 21 aa, Mycobacterium avium
QRDDWAWLKAAFVIAGIALAT

SEQ ID NO: 19974 - protein, 18 aa, Mycobacterium avium
QVWADLWYDIPYSIETFQ

SEQ ID NO: 19975 - protein, 18 aa, Mycobacterium avium
RAAVLAAVICVLTLTIAG

SEQ ID NO: 19976 - protein, 18 aa, Mycobacterium avium
RADQLRRALGDSGVHNVA

SEQ ID NO: 19977 - protein, 19 aa, Mycobacterium avium
RAGTAAALWELSEELTGTS

SEQ ID NO: 19978 - protein, 19 aa, Mycobacterium avium
RALGAALWYAATVKDAVVV

SEQ ID NO: 19979 - protein, 22 aa, Mycobacterium avium
RALVLSRLRLVSIGVPVAIGLL

SEQ ID NO: 19980 - protein, 17 aa, Mycobacterium avium
RAPRFPIAVPRPQFADY

SEQ ID NO: 19981 - protein, 19 aa, Mycobacterium avium
RAPTVQLCRDPKGYVPIGR

SEQ ID NO: 19982 - protein, 20 aa, Mycobacterium avium
RDDWAWLKAAFVIAGIALAT

SEQ ID NO: 19983 - protein, 20 aa, Mycobacterium avium
RDDWAWLKAAFVIAGITLAT

SEQ ID NO: 19984 - protein, 17 aa, Mycobacterium avium
RDFPGTITITFAYIGLT

SEQ ID NO: 19985 - protein, 17 aa, Mycobacterium avium
REEGLRLTVAVNLSTTN

SEQ ID NO: 19986 - protein, 20 aa, Mycobacterium avium
REFAGALAFVAGFSVLVRPE

SEQ ID NO: 19987 - protein, 23 aa, Mycobacterium avium
RFLRDPVSVLLIFIIVFALLIAG

SEQ ID NO: 19988 - protein, 19 aa, Mycobacterium avium
RGAGALGFAGTARKDAAGA

SEQ ID NO: 19989 - protein, 20 aa, Mycobacterium avium
RGARNYPCMGHPGKRAPTVE

SEQ ID NO: 19990 - protein, 18 aa, Mycobacterium avium
RGPGARWIAMNDVTAGNA

SEQ ID NO: 19991 - protein, 19 aa, Mycobacterium avium
RGPGARWIAMNDVTAGNAG

SEQ ID NO: 19992 - protein, 17 aa, Mycobacterium avium
RHCVRRFGGISGDVLGA

SEQ ID NO: 19993 - protein, 18 aa, Mycobacterium avium
RHCVRRFGGISGDVLGAA

SEQ ID NO: 19994 - protein, 22 aa, Mycobacterium avium
RHRGRAGAWVLLPVELLNNPPV

SEQ ID NO: 19995 - protein, 18 aa, Mycobacterium avium
RIPIVLGVAQLLGRIPLP

SEQ ID NO: 19996 - protein, 25 aa, Mycobacterium avium
RISRFQTLLLKWAMMLLLGLLTSAV

SEQ ID NO: 19997 - protein, 20 aa, Mycobacterium avium
RKGADFTAAMAFEIGSTNLV

SEQ ID NO: 19998 - protein, 18 aa, Mycobacterium avium
RKLRVGFAKAGRLMDLME

SEQ ID NO: 19999 - protein, 21 aa, Mycobacterium avium
RKPVARPAHRWVMVPDDGPPP

SEQ ID NO: 20000 - protein, 18 aa, Mycobacterium avium
RKRLPTIFIDVARLALIC

SEQ ID NO: 20001 - protein, 24 aa, Mycobacterium avium
RKRPWRRYLRRSVLPLLLAASLAV

SEQ ID NO: 20002 - protein, 17 aa, Mycobacterium avium
RKRVVAVSFPRDLAITP

SEQ ID NO: 20003 - protein, 20 aa, Mycobacterium avium
RLGALMIDWLISYGLAALAM

SEQ ID NO: 20004 - protein, 17 aa, Mycobacterium avium
RLGARFGPYELRSLIGT

SEQ ID NO: 20005 - protein, 17 aa, Mycobacterium avium
RLGWPLWTAYIGVFALT

SEQ ID NO: 20006 - protein, 17 aa, Mycobacterium avium
RLLLANRLYFAFLALLP

SEQ ID NO: 20007 - protein, 20 aa, Mycobacterium avium
RLLYGIGMGGEWGLGAALAM

SEQ ID NO: 20008 - protein, 19 aa, Mycobacterium avium
RLPVFDWPTDPSWLYRATQ

SEQ ID NO: 20009 - protein, 18 aa, Mycobacterium avium
RLQARLGPWNARLLSAAA

SEQ ID NO: 20010 - protein, 18 aa, Mycobacterium avium
RLRYDQFMGLGWKLLIPA

SEQ ID NO: 20011 - protein, 23 aa, Mycobacterium avium
RLVVPRFLGLLLITPSLVVIVIA

SEQ ID NO: 20012 - protein, 21 aa, Mycobacterium avium
RLWWRYTGWWLVALVLATLWW

SEQ ID NO: 20013 - protein, 19 aa, Mycobacterium avium
RNRRLRLATDLSYGVYIYA

SEQ ID NO: 20014 - protein, 18 aa, Mycobacterium avium
RPAHQVRWAVLLDGPVRI

SEQ ID NO: 20015 - protein, 19 aa, Mycobacterium avium
RPGPDWEPLGMLLAGAVLI

SEQ ID NO: 20016 - protein, 17 aa, Mycobacterium avium
RPGWRRLKHFNGFVTSL

SEQ ID NO: 20017 - protein, 18 aa, Mycobacterium avium
RPLRRLAAIAAHVAAMPL

SEQ ID NO: 20018 - protein, 22 aa, Mycobacterium avium
RPPVVWRISVGLTRDGGQLKMS

SEQ ID NO: 20019 - protein, 24 aa, Mycobacterium avium
RPPVVWRISVGLTRDGGQLKMSKV

SEQ ID NO: 20020 - protein, 25 aa, Mycobacterium avium
RPPVVWRISVGLTRDGGQLKMSKVD

SEQ ID NO: 20021 - protein, 24 aa, Mycobacterium avium
RPRWSRRRLFIVIALAVMLVLAGL

SEQ ID NO: 20022 - protein, 24 aa, Mycobacterium avium
RQAVWPERMFSLLAGFVEAGESFE

SEQ ID NO: 20023 - protein, 17 aa, Mycobacterium avium
RRARPIVLIPDAAAALL

SEQ ID NO: 20024 - protein, 17 aa, Mycobacterium avium
RRLPFILARYPRTFAGI

SEQ ID NO: 20025 - protein, 20 aa, Mycobacterium avium
RRLRVKAKMLGRGYEYMDLE

SEQ ID NO: 20026 - protein, 17 aa, Mycobacterium avium
RRRGPGRVIAAVTHRFS

SEQ ID NO: 20027 - protein, 20 aa, Mycobacterium avium
RRRLAPPVARKGTIVIEPPP

SEQ ID NO: 20028 - protein, 19 aa, Mycobacterium avium
RRSGSLIAPIALHWSLNGL

SEQ ID NO: 20029 - protein, 21 aa, Mycobacterium avium
RRTVWIPWALGPAAAVLRMLP

SEQ ID NO: 20030 - protein, 22 aa, Mycobacterium avium
RRVGTAIVRWPGPVLAVSVAVA

SEQ ID NO: 20031 - protein, 23 aa, Mycobacterium avium
RRVGTAVVRWPAPVLAVSAAVVL

SEQ ID NO: 20032 - protein, 20 aa, Mycobacterium avium
RSAARPGHWSLFDGGYTFAS

SEQ ID NO: 20033 - protein, 17 aa, Mycobacterium avium
RSAGWGFIVFGLVAPNV

SEQ ID NO: 20034 - protein, 22 aa, Mycobacterium avium
RSRIGMVLQDTWLFDGTIAENI

SEQ ID NO: 20035 - protein, 21 aa, Mycobacterium avium
RSRQGWKIQRWRSRVRNHTIV

SEQ ID NO: 20036 - protein, 24 aa, Mycobacterium avium
RSRWLRLPGRRAIAAGAGILLASA

SEQ ID NO: 20037 - protein, 18 aa, Mycobacterium avium
RTFYCGWLAVYVIEFPLE

SEQ ID NO: 20038 - protein, 25 aa, Mycobacterium avium
RTGIYGHARACGWAIRDGVVGPSST

SEQ ID NO: 20039 - protein, 19 aa, Mycobacterium avium
RTVWIPWALGPAATVLRML

SEQ ID NO: 20040 - protein, 18 aa, Mycobacterium avium
RVAHDFTLIPAFIEEILR

SEQ ID NO: 20041 - protein, 17 aa, Mycobacterium avium
RVCPRRWPLRGAVGAAD

SEQ ID NO: 20042 - protein, 19 aa, Mycobacterium avium
RVIALAGVVGFLVNSVPES

SEQ ID NO: 20043 - protein, 22 aa, Mycobacterium avium
RVIPPSFLRRAMPYVLVILIVG

SEQ ID NO: 20044 - protein, 19 aa, Mycobacterium avium
RVSYFYDFRGPSVAVDTAC

SEQ ID NO: 20045 - protein, 19 aa, Mycobacterium avium
RWGHWLGCATAVAAFVVGV

SEQ ID NO: 20046 - protein, 20 aa, Mycobacterium avium
RWRFEILRLGAWFIIFQVTF

SEQ ID NO: 20047 - protein, 22 aa, Mycobacterium avium
RWRPLPAPVWVSATAVLLVATT

SEQ ID NO: 20048 - protein, 18 aa, Mycobacterium avium
RYGGYALAGVSSFGFGGA

SEQ ID NO: 20049 - protein, 17 aa, Mycobacterium avium
RYLSVFLLLLVGVYLLV

SEQ ID NO: 20050 - protein, 23 aa, Mycobacterium avium
SAGWLRLGVLTALIATALALLIN

SEQ ID NO: 20051 - protein, 18 aa, Mycobacterium avium
SAIPRQSLAPGFGGNVLH

SEQ ID NO: 20052 - protein, 19 aa, Mycobacterium avium
SAKKWVIWSAVIGVVVGII

SEQ ID NO: 20053 - protein, 17 aa, Mycobacterium avium
SALCFVGAGVLLYVDID

SEQ ID NO: 20054 - protein, 18 aa, Mycobacterium avium
SALCFVGAGVLLYVDIDR

SEQ ID NO: 20055 - protein, 19 aa, Mycobacterium avium
SAPKSLWLSAFAHPERDKW

SEQ ID NO: 20056 - protein, 17 aa, Mycobacterium avium
SARRLPFILARYPRTFA

SEQ ID NO: 20057 - protein, 20 aa, Mycobacterium avium
SFLLRPGWVVLALVVVAFAY

SEQ ID NO: 20058 - protein, 17 aa, Mycobacterium avium
SFLRPPLAPNYGRVARA

SEQ ID NO: 20059 - protein, 28 aa, Mycobacterium avium
SFTVPARGVWWWVGVCMLGVVTLLALVN

SEQ ID NO: 20060 - protein, 30 aa, Mycobacterium avium
SFTVPARGVWWWVGVCVLGVVTLLALVNRL

SEQ ID NO: 20061 - protein, 30 aa, Mycobacterium avium
SFTVPARGVWWWVGVCVLGVVTLLVLVNRL

SEQ ID NO: 20062 - protein, 20 aa, Mycobacterium avium
SGAPHRALVWLGWLTAATAI

SEQ ID NO: 20063 - protein, 18 aa, Mycobacterium avium
SGPLAWCRFQGFDRDHCA

SEQ ID NO: 20064 - protein, 20 aa, Mycobacterium avium
SGSIGLGFAIPVDQAKRIAD

SEQ ID NO: 20065 - protein, 23 aa, Mycobacterium avium
SGVMWACVFMRTGARRCISARPK

SEQ ID NO: 20066 - protein, 17 aa, Mycobacterium avium
SGWRSGALGSLLSFVGV

SEQ ID NO: 20067 - protein, 18 aa, Mycobacterium avium
SLLLCLAVTLGADALGSS

SEQ ID NO: 20068 - protein, 21 aa, Mycobacterium avium
SLSIPSWWQPYVLSVASLTPD

SEQ ID NO: 20069 - protein, 26 aa, Mycobacterium avium
SMNRGWCLLRTRWARRVARILPVLGL

SEQ ID NO: 20070 - protein, 19 aa, Mycobacterium avium
SNWPVRWKVLAIVLVPLML

SEQ ID NO: 20071 - protein, 17 aa, Mycobacterium avium
SPAPWPLLTLLPAGPEL

SEQ ID NO: 20072 - protein, 20 aa, Mycobacterium avium
SPLPIPWSVLSLFAKGPTLS

SEQ ID NO: 20073 - protein, 21 aa, Mycobacterium avium
SPLPIPWSVLSLFAKGPTLSR

SEQ ID NO: 20074 - protein, 19 aa, Mycobacterium avium
SPVPIPWSVLSLFASGPTL

SEQ ID NO: 20075 - protein, 17 aa, Mycobacterium avium
SRFAALGPRLVESTRKL

SEQ ID NO: 20076 - protein, 22 aa, Mycobacterium avium
SRGRYWWVRWVILGVVAIVLAV

SEQ ID NO: 20077 - protein, 17 aa, Mycobacterium avium
SRLLKSWVRRYTLRRGA

SEQ ID NO: 20078 - protein, 18 aa, Mycobacterium avium
SRLLKSWVRRYTLRRGAL

SEQ ID NO: 20079 - protein, 21 aa, Mycobacterium avium
SRLTIRGAWALIGFFGTVQLV

SEQ ID NO: 20080 - protein, 21 aa, Mycobacterium avium
SRPGEKNMPFWGTSFSAAYVS

SEQ ID NO: 20081 - protein, 19 aa, Mycobacterium avium
SRRLRLPSWSVAWKAAVIA

SEQ ID NO: 20082 - protein, 25 aa, Mycobacterium avium
SSEISIAVPAHWKPGTVQALRDALR

SEQ ID NO: 20083 - protein, 26 aa, Mycobacterium avium
SSPPPPRWAWKILIPVGAVGMVLMAI

SEQ ID NO: 20084 - protein, 27 aa, Mycobacterium avium
SVLFSWPTLLWVLDFIAGRIFDILVTL

SEQ ID NO: 20085 - protein, 18 aa, Mycobacterium avium
SVVAAWRYRSWRPVLLAV

SEQ ID NO: 20086 - protein, 26 aa, Mycobacterium avium
SWSVAWKAAVIALICAFVAASGYMMW

SEQ ID NO: 20087 - protein, 20 aa, Mycobacterium avium
SYGWRIPLLLGLPFGLVALY

SEQ ID NO: 20088 - protein, 24 aa, Mycobacterium avium
SYMRYPLFLGFDIVGGIAWGGGAT

SEQ ID NO: 20089 - protein, 22 aa, Mycobacterium avium
TADELYARIGFVLQETQLVHGT

SEQ ID NO: 20090 - protein, 28 aa, Mycobacterium avium
TALEATWKYVIICSVGIAIAFLGTVLLY

SEQ ID NO: 20091 - protein, 18 aa, Mycobacterium avium
TAQAWARRHRQLRAALTP

SEQ ID NO: 20092 - protein, 18 aa, Mycobacterium avium
TCALAALCYAEFASTLPV

SEQ ID NO: 20093 - protein, 23 aa, Mycobacterium avium
TCGRALRAGWMLAARGTGGAARS

SEQ ID NO: 20094 - protein, 18 aa, Mycobacterium avium
TDFYARFGYDRPVYTLTH

SEQ ID NO: 20095 - protein, 17 aa, Mycobacterium avium
TDWTLNWAHGLIANAPQ

SEQ ID NO: 20096 - protein, 19 aa, Mycobacterium avium
TEILGRLGPYRVNSTVNGS

SEQ ID NO: 20097 - protein, 20 aa, Mycobacterium avium
TEIYWRRRGLAVGIAVVVMG

SEQ ID NO: 20098 - protein, 18 aa, Mycobacterium avium
TEVGVLPGTDFRLQPKYM

SEQ ID NO: 20099 - protein, 19 aa, Mycobacterium avium
TEVGVLPGTDFRLQPKYMD

SEQ ID NO: 20100 - protein, 18 aa, Mycobacterium avium
TGCLRVRASLTISPDDLV

SEQ ID NO: 20101 - protein, 20 aa, Mycobacterium avium
TGFDWTRWLTIVAFDVAIVF

SEQ ID NO: 20102 - protein, 19 aa, Mycobacterium avium
TGMTCASCAARIEKKLNKL

SEQ ID NO: 20103 - protein, 19 aa, Mycobacterium avium
THALWCWIVAIAVAVVAHH

SEQ ID NO: 20104 - protein, 22 aa, Mycobacterium avium
THLRAGVLYNIAFPGAYLCLSA

SEQ ID NO: 20105 - protein, 17 aa, Mycobacterium avium
TKAAARWIRPLAPPLVA

SEQ ID NO: 20106 - protein, 17 aa, Mycobacterium avium
TLGSWAVAAGWAFALAM

SEQ ID NO: 20107 - protein, 17 aa, Mycobacterium avium
TLTKGWQRLLGTMLGVP

SEQ ID NO: 20108 - protein, 19 aa, Mycobacterium avium
TMRFRPFIRLTVEWVEVLA

SEQ ID NO: 20109 - protein, 18 aa, Mycobacterium avium
TPLRRLDLLIAYGTAFSI

SEQ ID NO: 20110 - protein, 18 aa, Mycobacterium avium
TRAAIRFADLTGGRYVAL

SEQ ID NO: 20111 - protein, 17 aa, Mycobacterium avium
TRLFAGAALPMAQGSSA

SEQ ID NO: 20112 - protein, 21 aa, Mycobacterium avium
TRLTEVLSRIYGHPVSVQLQI

SEQ ID NO: 20113 - protein, 17 aa, Mycobacterium avium
TRLWLPYLPLILAAAVG

SEQ ID NO: 20114 - protein, 23 aa, Mycobacterium avium
TRLWPTVICLLGYAASFALLAVS

SEQ ID NO: 20115 - protein, 18 aa, Mycobacterium avium
TRRLKPRPAPAAPVAEEH

SEQ ID NO: 20116 - protein, 17 aa, Mycobacterium avium
TSPSWAFFSLPTRAWEL

SEQ ID NO: 20117 - protein, 19 aa, Mycobacterium avium
TSYIRRTWLVLRMNPQRNV

SEQ ID NO: 20118 - protein, 23 aa, Mycobacterium avium
TTGLWRRSGIRIVRRPRAHLVAS

SEQ ID NO: 20119 - protein, 22 aa, Mycobacterium avium
TTGLWRRSGIRIVRRPRTHLVA

SEQ ID NO: 20120 - protein, 17 aa, Mycobacterium avium
TTHWGLQIDHFWWTAIW

SEQ ID NO: 20121 - protein, 21 aa, Mycobacterium avium
TWAVALLIWRYGRIEERWAGA

SEQ ID NO: 20122 - protein, 22 aa, Mycobacterium avium
TWRHLPAILLVASLVLFTIAMA

SEQ ID NO: 20123 - protein, 23 aa, Mycobacterium avium
VAAAVGIGWWLLRPDDDTITVTA

SEQ ID NO: 20124 - protein, 18 aa, Mycobacterium avium
VACLFWRLFMQDNRKRPE

SEQ ID NO: 20125 - protein, 23 aa, Mycobacterium avium
VAFAARLAHRMGRVLPGENSVTV

SEQ ID NO: 20126 - protein, 22 aa, Mycobacterium avium
VAFWACGLLLCMFIGPSQSSSR

SEQ ID NO: 20127 - protein, 21 aa, Mycobacterium avium
VAGLVEWPVLLAVGGGALLLQ

SEQ ID NO: 20128 - protein, 18 aa, Mycobacterium avium
VALRSRLLVRLSGRGGMV

SEQ ID NO: 20129 - protein, 17 aa, Mycobacterium avium
VAPAGAVLARFGGDEFA

SEQ ID NO: 20130 - protein, 18 aa, Mycobacterium avium
VARREIRLLLANRLYFAF

SEQ ID NO: 20131 - protein, 22 aa, Mycobacterium avium
VATACPFCRVMVTDRVNDRQEE

SEQ ID NO: 20132 - protein, 17 aa, Mycobacterium avium
VATSAWGALNFVAGLGE

SEQ ID NO: 20133 - protein, 18 aa, Mycobacterium avium
VAWLYWYFWVIVVGFEAV

SEQ ID NO: 20134 - protein, 17 aa, Mycobacterium avium
VCSHLGCPASLYEEQSY

SEQ ID NO: 20135 - protein, 18 aa, Mycobacterium avium
VDVDEMWDIRNRGVISPS

SEQ ID NO: 20136 - protein, 17 aa, Mycobacterium avium
VFAEHMHRCAGALAEHV

SEQ ID NO: 20137 - protein, 17 aa, Mycobacterium avium
VFRWQRRDNLLAESDPA

SEQ ID NO: 20138 - protein, 21 aa, Mycobacterium avium
VFSRRWAKVWLPITAAVYTAN

SEQ ID NO: 20139 - protein, 20 aa, Mycobacterium avium
VFSWPRRRSGSLIAPIALHW

SEQ ID NO: 20140 - protein, 24 aa, Mycobacterium avium
VFVICVAALLVPRCSCGPSAGCRP

SEQ ID NO: 20141 - protein, 17 aa, Mycobacterium avium
VGAGWPLIVEQISVKPN

SEQ ID NO: 20142 - protein, 17 aa, Mycobacterium avium
VGEAFGWAWNAFTKNPV

SEQ ID NO: 20143 - protein, 18 aa, Mycobacterium avium
VGGALAIGVLGKRAADRE

SEQ ID NO: 20144 - protein, 19 aa, Mycobacterium avium
VGLMALWLAGLRWRRHGIR

SEQ ID NO: 20145 - protein, 22 aa, Mycobacterium avium
VGWLTLWPFFGWLTTHFVVTNR

SEQ ID NO: 20146 - protein, 18 aa, Mycobacterium avium
VIGFCMGGGFALLTANTG

SEQ ID NO: 20147 - protein, 17 aa, Mycobacterium avium
VIIRFWLLTAIACGLGV

SEQ ID NO: 20148 - protein, 22 aa, Mycobacterium avium
VLAARFVNWVALQVSRQLTTGF

SEQ ID NO: 20149 - protein, 22 aa, Mycobacterium avium
VLAARFVNWVALQVSRQPTTGF

SEQ ID NO: 20150 - protein, 18 aa, Mycobacterium avium
VLAVLPLVVLTQLGIIVG

SEQ ID NO: 20151 - protein, 22 aa, Mycobacterium avium
VLGWRTARRWRRGAAVLAVPLC

SEQ ID NO: 20152 - protein, 17 aa, Mycobacterium avium
VLGWVLFAGLIGWRAAS

SEQ ID NO: 20153 - protein, 17 aa, Mycobacterium avium
VLPRLGPAVAASRPANR

SEQ ID NO: 20154 - protein, 17 aa, Mycobacterium avium
VLPRLGPAVAASRPANW

SEQ ID NO: 20155 - protein, 25 aa, Mycobacterium avium
VLSRLSVWLRPDWTRTVLARRIAAG

SEQ ID NO: 20156 - protein, 19 aa, Mycobacterium avium
VLTGKALFRRPFQWRETIE

SEQ ID NO: 20157 - protein, 17 aa, Mycobacterium avium
VLVAVAWIARGIFLGRP

SEQ ID NO: 20158 - protein, 17 aa, Mycobacterium avium
VLVCADFILLQVVTGAW

SEQ ID NO: 20159 - protein, 18 aa, Mycobacterium avium
VNGLRLGLANAWLFVVAA

SEQ ID NO: 20160 - protein, 20 aa, Mycobacterium avium
VNGLRLGLANAWLFVVAAEL

SEQ ID NO: 20161 - protein, 23 aa, Mycobacterium avium
VNGLRLGLANAWLFVVAAELIAS

SEQ ID NO: 20162 - protein, 23 aa, Mycobacterium avium
VRKTAAWAWRLLVILAAALALFW

SEQ ID NO: 20163 - protein, 23 aa, Mycobacterium avium
VRKTAAWAWRLLVILAAALAVFW

SEQ ID NO: 20164 - protein, 17 aa, Mycobacterium avium
VRLGAGVARPATERAPH

SEQ ID NO: 20165 - protein, 17 aa, Mycobacterium avium
VRQHFWLPGGSTGSSDV

SEQ ID NO: 20166 - protein, 19 aa, Mycobacterium avium
VRRGARFVVTVAVIVAAVA

SEQ ID NO: 20167 - protein, 25 aa, Mycobacterium avium
VRRLPGWPVWFALLWAAQEWLKSIF

SEQ ID NO: 20168 - protein, 18 aa, Mycobacterium avium
VRSAGLFYAVMTQLGFVA

SEQ ID NO: 20169 - protein, 18 aa, Mycobacterium avium
VRVPARWQYAGAEHAGDV

SEQ ID NO: 20170 - protein, 21 aa, Mycobacterium avium
VRWPWLVIGFWAALAVALPLA

SEQ ID NO: 20171 - protein, 22 aa, Mycobacterium avium
VTEPVRRRWLTWSRYTRTWEST

SEQ ID NO: 20172 - protein, 24 aa, Mycobacterium avium
VTLLAVVAWRWRRFRAAAAAALLV

SEQ ID NO: 20173 - protein, 18 aa, Mycobacterium avium
VTVPARWSVDGIEHTGDV

SEQ ID NO: 20174 - protein, 18 aa, Mycobacterium avium
VTYPAHWESAAVEALGAA

SEQ ID NO: 20175 - protein, 17 aa, Mycobacterium avium
VVACGLAALFLASSLYS

SEQ ID NO: 20176 - protein, 18 aa, Mycobacterium avium
VVLACGIWSAVWASNHRH

SEQ ID NO: 20177 - protein, 19 aa, Mycobacterium avium
VVLRRLRAALALALACAPC

SEQ ID NO: 20178 - protein, 18 aa, Mycobacterium avium
VVPGFLLTLIVSFFTCDL

SEQ ID NO: 20179 - protein, 24 aa, Mycobacterium avium
VVRRARFAAAFTFQYSKRPGTPAA

SEQ ID NO: 20180 - protein, 22 aa, Mycobacterium avium
VYLWHWPIFLALNGERSGWAGM

SEQ ID NO: 20181 - protein, 17 aa, Mycobacterium avium
VYPSWWPPARVRTVSAA

SEQ ID NO: 20182 - protein, 18 aa, Mycobacterium avium
VYSTRWWLSGLLVGLAAG

SEQ ID NO: 20183 - protein, 18 aa, Mycobacterium avium
VYVLPLLLLVGLFVMFSR

SEQ ID NO: 20184 - protein, 19 aa, Mycobacterium avium
WAFALAMIDGWQRGFAGRL

SEQ ID NO: 20185 - protein, 20 aa, Mycobacterium avium
WAVALLIWRYGRIEERWAGA

SEQ ID NO: 20186 - protein, 18 aa, Mycobacterium avium
WEIRDFRTARKAARIGVP

SEQ ID NO: 20187 - protein, 25 aa, Mycobacterium avium
WEKHCFDIPACWSLRSVFDTLDGID

SEQ ID NO: 20188 - protein, 20 aa, Mycobacterium avium
WELARPPLWLFLLFLLTATA

SEQ ID NO: 20189 - protein, 17 aa, Mycobacterium avium
WFIGTAMGLQVLGTFSV

SEQ ID NO: 20190 - protein, 18 aa, Mycobacterium avium
WGPGGWLARLGVLDYAGG

SEQ ID NO: 20191 - protein, 21 aa, Mycobacterium avium
WIGYRHGWGWLARMDWSLLNG

SEQ ID NO: 20192 - protein, 22 aa, Mycobacterium avium
WIGYRHGWGWLARMDWSLLNGT

SEQ ID NO: 20193 - protein, 17 aa, Mycobacterium avium
WIRRARRLLPALVLMVL

SEQ ID NO: 20194 - protein, 20 aa, Mycobacterium avium
WKITEAPLFYGGYAVLLAVS

SEQ ID NO: 20195 - protein, 18 aa, Mycobacterium avium
WKVLAIVLVPLMLATVFG

SEQ ID NO: 20196 - protein, 23 aa, Mycobacterium avium
WLARRLEVRLGPWNARLLSAAAY

SEQ ID NO: 20197 - protein, 18 aa, Mycobacterium avium
WLKAAFVIAGITLATAGL

SEQ ID NO: 20198 - protein, 25 aa, Mycobacterium avium
WLPKPARPAPPWPTAQREVCATLTA

SEQ ID NO: 20199 - protein, 19 aa, Mycobacterium avium
WLVLHLVYLVGFKTKVSTL

SEQ ID NO: 20200 - protein, 19 aa, Mycobacterium avium
WLVRRFRVAAEGIADVEVA

SEQ ID NO: 20201 - protein, 23 aa, Mycobacterium avium
WNFTAAKNMFAWIGPVLAALQGN

SEQ ID NO: 20202 - protein, 17 aa, Mycobacterium avium
WNVFFIFSLFYLFGHYA

SEQ ID NO: 20203 - protein, 18 aa, Mycobacterium avium
WNVFFIFSLFYLFGHYAG

SEQ ID NO: 20204 - protein, 19 aa, Mycobacterium avium
WNVFFIFSLFYLFGHYAGV

SEQ ID NO: 20205 - protein, 18 aa, Mycobacterium avium
WPPPCTTGFLPIQQQRAA

SEQ ID NO: 20206 - protein, 26 aa, Mycobacterium avium
WQPARRPRPWLAIALAVTAAVAAGAL

SEQ ID NO: 20207 - protein, 20 aa, Mycobacterium avium
WRAASALAYLRGFGRKPAWV

SEQ ID NO: 20208 - protein, 28 aa, Mycobacterium avium
WRDWSWTQQINWLWVRRAAYLCAAVLVL

SEQ ID NO: 20209 - protein, 23 aa, Mycobacterium avium
WRITLPSIRWGLTYGIVLTIART

SEQ ID NO: 20210 - protein, 20 aa, Mycobacterium avium
WRITMPMLRPTTFFVLVTGI

SEQ ID NO: 20211 - protein, 20 aa, Mycobacterium avium
WRPLPAPVWVSATAVLLVAT

SEQ ID NO: 20212 - protein, 20 aa, Mycobacterium avium
WRQIRWRPVLAYALPGTPAV

SEQ ID NO: 20213 - protein, 21 aa, Mycobacterium avium
WRRDLRAIVGLLAWQGVALAA

SEQ ID NO: 20214 - protein, 17 aa, Mycobacterium avium
WRRLSLRTASIARWGGL

SEQ ID NO: 20215 - protein, 20 aa, Mycobacterium avium
WRSGALGSLLSFVGVLLGAI

SEQ ID NO: 20216 - protein, 21 aa, Mycobacterium avium
WSAACALAYLRGFGRKPAWVL

SEQ ID NO: 20217 - protein, 18 aa, Mycobacterium avium
WSLLVGYGCLPWVATAML

SEQ ID NO: 20218 - protein, 19 aa, Mycobacterium avium
WSLLVGYGCLPWVATAMLG

SEQ ID NO: 20219 - protein, 18 aa, Mycobacterium avium
WSTLKVSLLLSVALFFVW

SEQ ID NO: 20220 - protein, 18 aa, Mycobacterium avium
WYLPVGVAGTLGDPTAAE

SEQ ID NO: 20221 - protein, 19 aa, Mycobacterium avium
YFTGTGLKGWFQRWFFTAV

SEQ ID NO: 20222 - protein, 23 aa, Mycobacterium avium
YGGLRAALPVTFVTFGLGYLAII

SEQ ID NO: 20223 - protein, 18 aa, Mycobacterium avium
YGPGLRFLIPLLDKMIRV

SEQ ID NO: 20224 - protein, 20 aa, Mycobacterium avium
YIRMCRRLAGFSVINHGSTL

SEQ ID NO: 20225 - protein, 17 aa, Mycobacterium avium
YIRRTWLVLRMNPQRNV

SEQ ID NO: 20226 - protein, 21 aa, Mycobacterium avium
YLCLMPIFPLALWLMNVYAAI

SEQ ID NO: 20227 - protein, 22 aa, Mycobacterium avium
YLLAKVCIYTVFAIVQSAIVTT

SEQ ID NO: 20228 - protein, 19 aa, Mycobacterium avium
YLPLVVRRRITFLAKSEYF

SEQ ID NO: 20229 - protein, 18 aa, Mycobacterium avium
YRAPRVFQVAAWVAIVAG

SEQ ID NO: 20230 - protein, 17 aa, Mycobacterium avium
YRLISWLLIAAVGWVVF

SEQ ID NO: 20231 - protein, 19 aa, Mycobacterium avium
YRLRVKMALAEGQYKISKL

SEQ ID NO: 20232 - protein, 22 aa, Mycobacterium avium
YRTERLWSAIGLVPQRGYLFSG

SEQ ID NO: 20233 - protein, 17 aa, Mycobacterium avium
YRTGLIIVGLARCIAMV

SEQ ID NO: 20234 - protein, 19 aa, Mycobacterium avium
YRTPRVFQVAAWVAIVAGI

SEQ ID NO: 20235 - protein, 17 aa, Mycobacterium avium
YTQNFAWPVSKDLNPGG

SEQ ID NO: 20236 - protein, 20 aa, Mycobacterium avium
YVAAAALTWARYVRPRRAPE

SEQ ID NO: 20237 - protein, 21 aa, Mycobacterium avium
YVAAAALTWARYVRPRRAPEP

SEQ ID NO: 20238 - protein, 23 aa, Mycobacterium avium
YWFRSIRQTVQFERAVRGAAEAG

SEQ ID NO: 20239 - protein, 22 aa, Mycobacterium avium
AAAMLGLLLSALARSHEQIMPL

SEQ ID NO: 20240 - protein, 30 aa, Mycobacterium avium
AAARRFALSPIPVYLLAGLALGKGGLLPLA

SEQ ID NO: 20241 - protein, 17 aa, Mycobacterium avium
AAATIRRAPRRVWATVM

SEQ ID NO: 20242 - protein, 25 aa, Mycobacterium avium
AAATLIFIIMLVITRSVVAAFVIVG

SEQ ID NO: 20243 - protein, 17 aa, Mycobacterium avium
AADFYLPQRALTDPRYT

SEQ ID NO: 20244 - protein, 23 aa, Mycobacterium avium
AAFAFALPVLPVLLTLAILADVY

SEQ ID NO: 20245 - protein, 33 aa, Mycobacterium avium
AAFGGIFLLMLFLDFLLIDRDIKWLKWIEVPFA

SEQ ID NO: 20246 - protein, 20 aa, Mycobacterium avium
AAFLNWMHLQGVGAGLKRYV

SEQ ID NO: 20247 - protein, 21 aa, Mycobacterium avium
AAGVLVFFFLAAILAYIGHGA

SEQ ID NO: 20248 - protein, 26 aa, Mycobacterium avium
AAHWQPWIWALIVAGVGFVTVFVFWQ

SEQ ID NO: 20249 - protein, 29 aa, Mycobacterium avium
AAIYGMNFHFMPELNWTWGYPAVMAGMAV

SEQ ID NO: 20250 - protein, 26 aa, Mycobacterium avium
AALDGDYWFRSIRQTVQFERAVRGAA

SEQ ID NO: 20251 - protein, 27 aa, Mycobacterium avium
AALIFSRYLWAFELTSALLITAAVGAM

SEQ ID NO: 20252 - protein, 22 aa, Mycobacterium avium
AAMPPLWVIVSCALAMATGTYL

SEQ ID NO: 20253 - protein, 26 aa, Mycobacterium avium
AAQDRVWFVFLLLPSFVIYLISMVGE

SEQ ID NO: 20254 - protein, 19 aa, Mycobacterium avium
AAQLAFIGPLLGSVARIYG

SEQ ID NO: 20255 - protein, 25 aa, Mycobacterium avium
AARKSWSVLYLLLAAIAGALPGIWA

SEQ ID NO: 20256 - protein, 17 aa, Mycobacterium avium
AARPYLVIAGLVCSFSV

SEQ ID NO: 20257 - protein, 27 aa, Mycobacterium avium
AAVEAGALAVLWRRLVRSRAELDELRQ

SEQ ID NO: 20258 - protein, 27 aa, Mycobacterium avium
AAWTAAGMFLAVWLPLDNGLRPEPIIA

SEQ ID NO: 20259 - protein, 20 aa, Mycobacterium avium
AAYLPLFAVLASGGGWLHAV

SEQ ID NO: 20260 - protein, 21 aa, Mycobacterium avium
ACALWLGIAGWALWAANSPGM

SEQ ID NO: 20261 - protein, 28 aa, Mycobacterium avium
ADFEDFFRPMRSYFYWEKHCYDIPVCWS

SEQ ID NO: 20262 - protein, 19 aa, Mycobacterium avium
ADHAVGDTVLFPGAGFVEL

SEQ ID NO: 20263 - protein, 25 aa, Mycobacterium avium
ADKLTKPVWLLILGGAVALTSVLGY

SEQ ID NO: 20264 - protein, 19 aa, Mycobacterium avium
ADLGWRLAFGIGAILGIFV

SEQ ID NO: 20265 - protein, 30 aa, Mycobacterium avium
ADLSLATRLTLITLIPIVAFMTVGGPAMGS

SEQ ID NO: 20266 - protein, 26 aa, Mycobacterium avium
ADPGNPLAILVPLTAAALDLVAMGAA

SEQ ID NO: 20267 - protein, 27 aa, Mycobacterium avium
ADVVVAVLVALWVLPRAISLARDALRI

SEQ ID NO: 20268 - protein, 18 aa, Mycobacterium avium
ADYPTVLLSGSWLTREQA

SEQ ID NO: 20269 - protein, 24 aa, Mycobacterium avium
AEAIALIVVIVRYLEPFTTISELA

SEQ ID NO: 20270 - protein, 21 aa, Mycobacterium avium
AELLTLFAGSVLRGADLETLL

SEQ ID NO: 20271 - protein, 18 aa, Mycobacterium avium
AELTFPMLQFTLLGVVCM

SEQ ID NO: 20272 - protein, 24 aa, Mycobacterium avium
AENPIVPFNLFLDRNRLAAFAAMF

SEQ ID NO: 20273 - protein, 27 aa, Mycobacterium avium
AEVERIWLPFTIWLTAAAALLPVRTHR

SEQ ID NO: 20274 - protein, 17 aa, Mycobacterium avium
AFALQIWVNNSWVSAQC

SEQ ID NO: 20275 - protein, 21 aa, Mycobacterium avium
AFAVAGFYWFDGYTLVQQRYW

SEQ ID NO: 20276 - protein, 19 aa, Mycobacterium avium
AFFAVVVIVALWVAGNPEV

SEQ ID NO: 20277 - protein, 18 aa, Mycobacterium avium
AFFGDNIPLLLKGLTRVG

SEQ ID NO: 20278 - protein, 25 aa, Mycobacterium avium
AFGLGLAVLFIHLYPGRTATSFALL

SEQ ID NO: 20279 - protein, 20 aa, Mycobacterium avium
AFIAAISGWRSGALGSLLSF

SEQ ID NO: 20280 - protein, 18 aa, Mycobacterium avium
AFLPRRIRYTAQVTLALG

SEQ ID NO: 20281 - protein, 27 aa, Mycobacterium avium
AFSVGLPMLLTARLLLGLTIGVTVVVV

SEQ ID NO: 20282 - protein, 25 aa, Mycobacterium avium
AFVVRGAMRAAWDKLRAPAGKLGAP

SEQ ID NO: 20283 - protein, 18 aa, Mycobacterium avium
AGAIHPDLRRVYLEEAVQ

SEQ ID NO: 20284 - protein, 24 aa, Mycobacterium avium
AGAMYCLSFCRLPYFQSLGVPCAV

SEQ ID NO: 20285 - protein, 40 aa, Mycobacterium avium
AGANTGWWPVLWFTAKMWTFLFIYFWLRASLPRLRYDQFM

SEQ ID NO: 20286 - protein, 28 aa, Mycobacterium avium
AGATFCLHFTNLPYFQTLGIPLAIGMVV

SEQ ID NO: 20287 - protein, 25 aa, Mycobacterium avium
AGAVIGYVLLRRTLLPGGGHLIGVG

SEQ ID NO: 20288 - protein, 22 aa, Mycobacterium avium
AGDYSLCWSFADGDLKPGIHTG

SEQ ID NO: 20289 - protein, 20 aa, Mycobacterium avium
AGEARARPRSWLLARASRAA

SEQ ID NO: 20290 - protein, 24 aa, Mycobacterium avium
AGESLIDVLHWPGYLLVVAGVVGA

SEQ ID NO: 20291 - protein, 23 aa, Mycobacterium avium
AGFVILILLLIFITQNTAPTAFR

SEQ ID NO: 20292 - protein, 34 aa, Mycobacterium avium
AGGIALLLIAVVLVLGFWQPGFFVTTKLDVNKAQ

SEQ ID NO: 20293 - protein, 27 aa, Mycobacterium avium
AGISHARWLRWPARVYTDVFRGLPEVV

SEQ ID NO: 20294 - protein, 29 aa, Mycobacterium avium
AGISSLCLIFIIMLIITRGVVASAVIVGT

SEQ ID NO: 20295 - protein, 18 aa, Mycobacterium avium
AGLLATMADFTLFYAPNI

SEQ ID NO: 20296 - protein, 19 aa, Mycobacterium avium
AGLLSVPLVARPLDHRPKS

SEQ ID NO: 20297 - protein, 22 aa, Mycobacterium avium
AGMGPFLGVLLQSRGWTTGAIG

SEQ ID NO: 20298 - protein, 23 aa, Mycobacterium avium
AGQRRRLLLARAVISPARIVLLD

SEQ ID NO: 20299 - protein, 31 aa, Mycobacterium avium
AGRWHAIGLIAFLWLVGIYSVKARLGGAGDP

SEQ ID NO: 20300 - protein, 24 aa, Mycobacterium avium
AGSSLPLLLLFSVANRSLTDVLTG

SEQ ID NO: 20301 - protein, 31 aa, Mycobacterium avium
AGTALLRLCMLPGLVLLIWATPRLARHLGAD

SEQ ID NO: 20302 - protein, 24 aa, Mycobacterium avium
AGTAVFAVLVPRSRFFTPKPASVR

SEQ ID NO: 20303 - protein, 24 aa, Mycobacterium avium
AGTGWRVSGLLRIDEVAAATGFRA

SEQ ID NO: 20304 - protein, 29 aa, Mycobacterium avium
AGWVFGYAGIFWLAAGFAVATIAAVLAIP

SEQ ID NO: 20305 - protein, 27 aa, Mycobacterium avium
AHDDLLHSLLQVSPIFFREAANLTGDG

SEQ ID NO: 20306 - protein, 23 aa, Mycobacterium avium
AHEDLPFVFVSSASLAASGLAMV

SEQ ID NO: 20307 - protein, 21 aa, Mycobacterium avium
AHLNRELWIGAVIASLVVGAI

SEQ ID NO: 20308 - protein, 37 aa, Mycobacterium avium
AHRPGLVLGLLVIAILVAWRWVPARLAIVPGPLVAIV

SEQ ID NO: 20309 - protein, 24 aa, Mycobacterium avium
AIALHILFGLPLLAGGLITGVVAL

SEQ ID NO: 20310 - protein, 21 aa, Mycobacterium avium
AIEMLVPLPLFFCHGGWPVTV

SEQ ID NO: 20311 - protein, 33 aa, Mycobacterium avium
AIFVWELARPPLWLFLLFLLTATAAHGLKVLAQ

SEQ ID NO: 20312 - protein, 17 aa, Mycobacterium avium
AIGLWQLLTADKVRLLL

SEQ ID NO: 20313 - protein, 19 aa, Mycobacterium avium
AIIAISLPLLWWRFRRDDR

SEQ ID NO: 20314 - protein, 34 aa, Mycobacterium avium
AISMLIVVLFVPAALPWYYSWPLAVLAPLAQSRR

SEQ ID NO: 20315 - protein, 26 aa, Mycobacterium avium
AISYVRQILLVQLWFVPFFDDSSWDG

SEQ ID NO: 20316 - protein, 25 aa, Mycobacterium avium
AIVFYPLHLLPFGLVALGWQLATIA

SEQ ID NO: 20317 - protein, 26 aa, Mycobacterium avium
AKGPLIFDLGICLVLISLPTLALLVA

SEQ ID NO: 20318 - protein, 49 aa, Mycobacterium avium
AKIGPLEFSGLFAWFAWLVLHLVYLVGFKTKVSTLLSWTVTFLSTRRGQ

SEQ ID NO: 20319 - protein, 25 aa, Mycobacterium avium
AKLSRRSLVIGNAVIAFAVIGLASL

SEQ ID NO: 20320 - protein, 19 aa, Mycobacterium avium
AKSSTLAFSKPFFAQGLLN

SEQ ID NO: 20321 - protein, 23 aa, Mycobacterium avium
AKTRKIVGYFTSAVGLYPGDQVR

SEQ ID NO: 20322 - protein, 23 aa, Mycobacterium avium
AKTTESLWWLTDAGARFGVDDTR

SEQ ID NO: 20323 - protein, 30 aa, Mycobacterium avium
AKVDYADILYISPWLFVLGVSIAGLTAYAT

SEQ ID NO: 20324 - protein, 26 aa, Mycobacterium avium
AKVSLVVPAIFLVLVSAFVGLQVKAA

SEQ ID NO: 20325 - protein, 22 aa, Mycobacterium avium
ALAAFVMIVFHLNILLAFPMGV

SEQ ID NO: 20326 - protein, 31 aa, Mycobacterium avium
ALDVLLFYVFFEAMLIPMYFLIGGFGAGSGR

SEQ ID NO: 20327 - protein, 26 aa, Mycobacterium avium
ALFVMLPLVWALNRLGWHAAAQVPLW

SEQ ID NO: 20328 - protein, 23 aa, Mycobacterium avium
ALGAWPHWTFTALGAGVIGAVLG

SEQ ID NO: 20329 - protein, 18 aa, Mycobacterium avium
ALHFAKPIFGPAARALAQ

SEQ ID NO: 20330 - protein, 19 aa, Mycobacterium avium
ALIGLVALVFAVVTSNELV

SEQ ID NO: 20331 - protein, 32 aa, Mycobacterium avium
ALITYYALVSLFPLLLLLTTGLGVILAGRPDL

SEQ ID NO: 20332 - protein, 27 aa, Mycobacterium avium
ALLVAFLADLLLSRRFLQSAGLRRARH

SEQ ID NO: 20333 - protein, 19 aa, Mycobacterium avium
ALPGFRVPAPRNSALHRSA

SEQ ID NO: 20334 - protein, 24 aa, Mycobacterium avium
ALRSRLLVRLSGRGGMVSLACGRS

SEQ ID NO: 20335 - protein, 30 aa, Mycobacterium avium
ALSAVLSGLLLNYYLIAPRHSFTIAEPNSA

SEQ ID NO: 20336 - protein, 26 aa, Mycobacterium avium
ALSENIAALPPLLRELAAGPTRRVID

SEQ ID NO: 20337 - protein, 38 aa, Mycobacterium avium
ALSTLAHHPALAKAFLRFNVHLLTASTLPPRVRELAIL

SEQ ID NO: 20338 - protein, 31 aa, Mycobacterium avium
ALTLFMIVSLTLTWLVYVSLRRDVAGDTARY

SEQ ID NO: 20339 - protein, 26 aa, Mycobacterium avium
ALTLGLSLAVILALGFVLTSQVTNRV

SEQ ID NO: 20340 - protein, 17 aa, Mycobacterium avium
ALTLLVTFGVPRLEIVG

SEQ ID NO: 20341 - protein, 30 aa, Mycobacterium avium
ALTLSRLMSGLASRLSPALAVAAAVVCVLI

SEQ ID NO: 20342 - protein, 18 aa, Mycobacterium avium
ALTYTRLPWRPLPAPQRA

SEQ ID NO: 20343 - protein, 29 aa, Mycobacterium avium
ALVGLVLIAAFILHAWYRTEHPLIDLRLF

SEQ ID NO: 20344 - protein, 29 aa, Mycobacterium avium
ALVSIVVIFVMLLVVYRSIVTTVLSLVII

SEQ ID NO: 20345 - protein, 22 aa, Mycobacterium avium
ALWARFPLPVIPAPGDPTPSAP

SEQ ID NO: 20346 - protein, 21 aa, Mycobacterium avium
AMVVVPVMLSRILDTLEKMDK

SEQ ID NO: 20347 - protein, 27 aa, Mycobacterium avium
ANGSVRARFLTDRLLFDSQYTKEICNL

SEQ ID NO: 20348 - protein, 24 aa, Mycobacterium avium
ANQADLRLVLLRPGKDDDEPQQHI

SEQ ID NO: 20349 - protein, 22 aa, Mycobacterium avium
APAVVLIDLPDPIAGAAELGPL

SEQ ID NO: 20350 - protein, 20 aa, Mycobacterium avium
APGRLLGKSAYHALTFGWLM

SEQ ID NO: 20351 - protein, 22 aa, Mycobacterium avium
APHACKLWPLVFARVAASLVVF

SEQ ID NO: 20352 - protein, 26 aa, Mycobacterium avium
APLDPDKFFLPPRLVSLYGTPMWDEM

SEQ ID NO: 20353 - protein, 21 aa, Mycobacterium avium
APLDWTWPAVSLLVLQLLASL

SEQ ID NO: 20354 - protein, 18 aa, Mycobacterium avium
APNFAFELAVRKTTDADL

SEQ ID NO: 20355 - protein, 25 aa, Mycobacterium avium
APPLLTLWMARLLLFRVEFGAGLIK

SEQ ID NO: 20356 - protein, 17 aa, Mycobacterium avium
APYNTRIVRRSNALLDW

SEQ ID NO: 20357 - protein, 25 aa, Mycobacterium avium
AQSVGPWFPLAFLLAHIVVTVVPVP

SEQ ID NO: 20358 - protein, 40 aa, Mycobacterium avium
AQVGRVEFAGFIAWLAWLLLHLYYLIGHRNRLAAMFAWGI

SEQ ID NO: 20359 - protein, 35 aa, Mycobacterium avium
ARDERDRLALWSRVLPITFTAVGLIALVGGGLLAS

SEQ ID NO: 20360 - protein, 24 aa, Mycobacterium avium
ARDQVVHGWVLASASFMLCAAFNV

SEQ ID NO: 20361 - protein, 21 aa, Mycobacterium avium
ARGTWWGWHGAGWFLLTVMAL

SEQ ID NO: 20362 - protein, 29 aa, Mycobacterium avium
ARIWPPWEFYFWHHTIPAVVWVALIMGAV

SEQ ID NO: 20363 - protein, 20 aa, Mycobacterium avium
ARLRGTVRLRIIYANGRGVL

SEQ ID NO: 20364 - protein, 20 aa, Mycobacterium avium
ARLRLPLIIGEPDDLAALVT

SEQ ID NO: 20365 - protein, 28 aa, Mycobacterium avium
ARQHNRRMVLVWLALVLAVTGMVATAAW

SEQ ID NO: 20366 - protein, 20 aa, Mycobacterium avium
ARRESLPPSAYLPEVVDRVV

SEQ ID NO: 20367 - protein, 27 aa, Mycobacterium avium
ARVAAWWRQIRWRPVLAYALPGTPAVV

SEQ ID NO: 20368 - protein, 24 aa, Mycobacterium avium
ASAPSLRARRLDWRGGHRSEGGRR

SEQ ID NO: 20369 - protein, 29 aa, Mycobacterium avium
ASATVFLACWVPLFASFAALLVYPADGAG

SEQ ID NO: 20370 - protein, 23 aa, Mycobacterium avium
ASCPDVLLVNVPGTWESAPQDDP

SEQ ID NO: 20371 - protein, 23 aa, Mycobacterium avium
ASFGVTPLMLWQQATKHYTNISV

SEQ ID NO: 20372 - protein, 23 aa, Mycobacterium avium
ASGPAWRLIGTTAVGLLLLTFTP

SEQ ID NO: 20373 - protein, 27 aa, Mycobacterium avium
ASIGACVWLMLNLTALTWVRFGIWLVV

SEQ ID NO: 20374 - protein, 26 aa, Mycobacterium avium
ASIVLIFIIMVIVTRALVAAGVIVGT

SEQ ID NO: 20375 - protein, 33 aa, Mycobacterium avium
ASPVGLLIVVLLLISTLFLLRSMNRQLRKVPES

SEQ ID NO: 20376 - protein, 22 aa, Mycobacterium avium
ASRALVQLLLVGGALTLLFEPG

SEQ ID NO: 20377 - protein, 31 aa, Mycobacterium avium
ATAAALLVFFWRDWVRILAGFFSSLRHRRIR

SEQ ID NO: 20378 - protein, 20 aa, Mycobacterium avium
ATACACLVLLNVIPAPVGHG

SEQ ID NO: 20379 - protein, 27 aa, Mycobacterium avium
ATAGACIGFLWWNAAPAKIFMGDTGSL

SEQ ID NO: 20380 - protein, 32 aa, Mycobacterium avium
ATALLGLTVLVLLLAAWFHFVAPDDGPPKTRW

SEQ ID NO: 20381 - protein, 18 aa, Mycobacterium avium
ATALRLLERKIAHLPPKK

SEQ ID NO: 20382 - protein, 25 aa, Mycobacterium avium
ATGEPIRCLLFPNPLETQRMGSFAL

SEQ ID NO: 20383 - protein, 27 aa, Mycobacterium avium
ATHDRVLLIPAILAVILIVLAVLLRSV

SEQ ID NO: 20384 - protein, 18 aa, Mycobacterium avium
ATHVLPKVDFEFDPAVRR

SEQ ID NO: 20385 - protein, 20 aa, Mycobacterium avium
ATILSDRYWWTALAVTLGIT

SEQ ID NO: 20386 - protein, 17 aa, Mycobacterium avium
ATLDRGWMLYSHKPPRG

SEQ ID NO: 20387 - protein, 26 aa, Mycobacterium avium
ATRGYWPAILIALTALPVRGVLAASV

SEQ ID NO: 20388 - protein, 26 aa, Mycobacterium avium
ATRIASHMPLLLGLAFALLVARERVG

SEQ ID NO: 20389 - protein, 31 aa, Mycobacterium avium
ATVVLGWRLVGFLWATVAGAVAWLILLAASP

SEQ ID NO: 20390 - protein, 25 aa, Mycobacterium avium
AVAATWSVLYSFQPGAPPANPALAS

SEQ ID NO: 20391 - protein, 20 aa, Mycobacterium avium
AVAIVVAVLLFPADPRTVLG

SEQ ID NO: 20392 - protein, 30 aa, Mycobacterium avium
AVASLAMPLVLAGLLLYVCLAVAVTALVTL

SEQ ID NO: 20393 - protein, 23 aa, Mycobacterium avium
AVAVFFALSGFLLWRGHAAAARD

SEQ ID NO: 20394 - protein, 17 aa, Mycobacterium avium
AVAVRMFAISRGVLHYC

SEQ ID NO: 20395 - protein, 22 aa, Mycobacterium avium
AVAWLILLAASPATRATARLLT

SEQ ID NO: 20396 - protein, 29 aa, Mycobacterium avium
AVGGGGLGLIILLGALFLGVDPGRVMPQQ

SEQ ID NO: 20397 - protein, 25 aa, Mycobacterium avium
AVIPARWRAAWVGWWVAAGIASAIV

SEQ ID NO: 20398 - protein, 23 aa, Mycobacterium avium
AVKYLFRRPFQWREFLEQSWFVA

SEQ ID NO: 20399 - protein, 28 aa, Mycobacterium avium
AVLCLSFTRLPYFQPLGIPVAVGISIAV

SEQ ID NO: 20400 - protein, 30 aa, Mycobacterium avium
AVLIVTLVFAPRFWVPIVAMAILVASHEVV

SEQ ID NO: 20401 - protein, 26 aa, Mycobacterium avium
AVLLLPLVFRMPDTARWYLLKGRVDD

SEQ ID NO: 20402 - protein, 27 aa, Mycobacterium avium
AVLPAKLILMAIALICAAAVFSAITMR

SEQ ID NO: 20403 - protein, 25 aa, Mycobacterium avium
AVLVLFTLIFFLYGGRNIWRYVVQI

SEQ ID NO: 20404 - protein, 21 aa, Mycobacterium avium
AVLVLLALVAVWIVVALNPGI

SEQ ID NO: 20405 - protein, 24 aa, Mycobacterium avium
AVMAVFPMYFLKSSAYTIVATAII

SEQ ID NO: 20406 - protein, 32 aa, Mycobacterium avium
AVPSVYARLVLLWFLCSAFPIAVIAALVVLRS

SEQ ID NO: 20407 - protein, 18 aa, Mycobacterium avium
AVQALFREVTNSLIVWSG

SEQ ID NO: 20408 - protein, 26 aa, Mycobacterium avium
AVRASMAIPFFYRPVKLARADGTACT

SEQ ID NO: 20409 - protein, 23 aa, Mycobacterium avium
AVRELYGPLLDAGVPFLVTDLQT

SEQ ID NO: 20410 - protein, 23 aa, Mycobacterium avium
AVSLLVLQLLASLALLRALHVIL

SEQ ID NO: 20411 - protein, 21 aa, Mycobacterium avium
AVTFRYFYNGAYQQAYLARGA

SEQ ID NO: 20412 - protein, 24 aa, Mycobacterium avium
AVTIFVFILISNWLSVLPLQYTDK

SEQ ID NO: 20413 - protein, 27 aa, Mycobacterium avium
AVVAAQLLFSALLTPAIRLTNGAANWI

SEQ ID NO: 20414 - protein, 29 aa, Mycobacterium avium
AVVIVAVARWRGLLALVGILVAFVVLVTF

SEQ ID NO: 20415 - protein, 18 aa, Mycobacterium avium
AVVRWPAPVLAVSAAVVL

SEQ ID NO: 20416 - protein, 22 aa, Mycobacterium avium
AWALSVMFLVFTLRALLYKPFV

SEQ ID NO: 20417 - protein, 18 aa, Mycobacterium avium
AWPSAQIAVMGASGAVGF

SEQ ID NO: 20418 - protein, 19 aa, Mycobacterium avium
AWQWFVTEVPQRSLHNWQN

SEQ ID NO: 20419 - protein, 20 aa, Mycobacterium avium
AWRYWRTVVGVLAAVAVLVI

SEQ ID NO: 20420 - protein, 20 aa, Mycobacterium avium
AWSFVLALLAAALTARKRIA

SEQ ID NO: 20421 - protein, 31 aa, Mycobacterium avium
AYRPLARKGYPSLYAWMFGLVVTELPLQTML

SEQ ID NO: 20422 - protein, 23 aa, Mycobacterium avium
CAGIGLAIVMPALALSAIGQAAS

SEQ ID NO: 20423 - protein, 17 aa, Mycobacterium avium
CAMLALPIVPLFAYSRT

SEQ ID NO: 20424 - protein, 26 aa, Mycobacterium avium
CAVAPNILLLILFRVVQGVGGGMLLP

SEQ ID NO: 20425 - protein, 27 aa, Mycobacterium avium
CGALIGLERQWRARRAGLRTNALVAAG

SEQ ID NO: 20426 - protein, 18 aa, Mycobacterium avium
CGTKWSGLYFVLFFAAMS

SEQ ID NO: 20427 - protein, 20 aa, Mycobacterium avium
CVLTGKALFRRPFQWRETIE

SEQ ID NO: 20428 - protein, 20 aa, Mycobacterium avium
DALFWVYIATLMVPGTVTIV

SEQ ID NO: 20429 - protein, 23 aa, Mycobacterium avium
DATNRSVLLPLGLTPEQVSMAKP

SEQ ID NO: 20430 - protein, 25 aa, Mycobacterium avium
DDATSWLVRRPPLHGLTPSAHDMAR

SEQ ID NO: 20431 - protein, 18 aa, Mycobacterium avium
DDLSYSPALAPLRAPLQN

SEQ ID NO: 20432 - protein, 20 aa, Mycobacterium avium
DELPATGARLRWVPSQGPSA

SEQ ID NO: 20433 - protein, 24 aa, Mycobacterium avium
DERLAWLIVVGTIPVGLAGLALEQ

SEQ ID NO: 20434 - protein, 25 aa, Mycobacterium avium
DESLDAFRRFHTALFSTAIQPSETG

SEQ ID NO: 20435 - protein, 22 aa, Mycobacterium avium
DGDRLWIRFIPDTEHRSQVIEH

SEQ ID NO: 20436 - protein, 26 aa, Mycobacterium avium
DGENPFALLLVSLLGPIAATVVRLAV

SEQ ID NO: 20437 - protein, 25 aa, Mycobacterium avium
DGHRWAWFLIAFMVLFHLNIASTIP

SEQ ID NO: 20438 - protein, 30 aa, Mycobacterium avium
DGVAILARNHRWFLIANYGAARVGARIILL

SEQ ID NO: 20439 - protein, 24 aa, Mycobacterium avium
DGVPATDWTLNWAHGLIANAPQPK

SEQ ID NO: 20440 - protein, 24 aa, Mycobacterium avium
DHGKYYFMVELPPDFSAAIASPVT

SEQ ID NO: 20441 - protein, 31 aa, Mycobacterium avium
DHYFNTFLIPSDLLWSFLQAIVMSIAVMLVH

SEQ ID NO: 20442 - protein, 21 aa, Mycobacterium avium
DILDPALLRPGRFDRQIPVSN

SEQ ID NO: 20443 - protein, 19 aa, Mycobacterium avium
DILRLGMALIFLAVVITGS

SEQ ID NO: 20444 - protein, 19 aa, Mycobacterium avium
DIWRRPDLDLTGRAPVLFQ

SEQ ID NO: 20445 - protein, 23 aa, Mycobacterium avium
DLAKINRFRWIRDKELRAKLTPD

SEQ ID NO: 20446 - protein, 25 aa, Mycobacterium avium
DLAVVIWTGLWILVGLAVYDAIATI

SEQ ID NO: 20447 - protein, 19 aa, Mycobacterium avium
DLILSCGIALQHCVTAFAA

SEQ ID NO: 20448 - protein, 20 aa, Mycobacterium avium
DLVYQFIPVLKANGYRLVTV

SEQ ID NO: 20449 - protein, 18 aa, Mycobacterium avium
DPDGRDLILSCGIALQHC

SEQ ID NO: 20450 - protein, 17 aa, Mycobacterium avium
DPGALRRLDRVKVVVID

SEQ ID NO: 20451 - protein, 25 aa, Mycobacterium avium
DPQLLLLTLVLLTSAGVLAVVGITR

SEQ ID NO: 20452 - protein, 23 aa, Mycobacterium avium
DPRPPLWPLVIIAYCAIAVSPPL

SEQ ID NO: 20453 - protein, 24 aa, Mycobacterium avium
DPTAAINTAWRAAGGPGGPLGAKQ

SEQ ID NO: 20454 - protein, 20 aa, Mycobacterium avium
DQLIRITADFTPVLGVLAQK

SEQ ID NO: 20455 - protein, 29 aa, Mycobacterium avium
DQLRKIDFQPYRLWQPPLDQPIAIDELVN

SEQ ID NO: 20456 - protein, 22 aa, Mycobacterium avium
DQNAPVWLFTAGSIVVLCLTLM

SEQ ID NO: 20457 - protein, 23 aa, Mycobacterium avium
DQRRDLAELLDLAPLVADNAYNM

SEQ ID NO: 20458 - protein, 20 aa, Mycobacterium avium
DRATMLLFMQGRRGAAPEVR

SEQ ID NO: 20459 - protein, 19 aa, Mycobacterium avium
DRDIKWLKWIEVPFARIGR

SEQ ID NO: 20460 - protein, 25 aa, Mycobacterium avium
DRHIQLWVVYVDNFNKFKPDNWADR

SEQ ID NO: 20461 - protein, 23 aa, Mycobacterium avium
DRLFAALSWFGAALSAAIVAGAA

SEQ ID NO: 20462 - protein, 18 aa, Mycobacterium avium
DRLFAVLDGLRNAAFAVA

SEQ ID NO: 20463 - protein, 26 aa, Mycobacterium avium
DRMTGQRLPLGPLRPVLRAAEGPAGL

SEQ ID NO: 20464 - protein, 21 aa, Mycobacterium avium
DRPIQLVHLDDALRLLESAVL

SEQ ID NO: 20465 - protein, 18 aa, Mycobacterium avium
DRVKVVVIDGAALRGDHR

SEQ ID NO: 20466 - protein, 21 aa, Mycobacterium avium
DSFFDWDMYRQAIPTLLRTGL

SEQ ID NO: 20467 - protein, 37 aa, Mycobacterium avium
DSLLSQDRFWLHTPGTWLLDMGMLAALALCYAVFVRW

SEQ ID NO: 20468 - protein, 27 aa, Mycobacterium avium
DSTFHEPFVLFGYLAAITSLELVTGVI

SEQ ID NO: 20469 - protein, 17 aa, Mycobacterium avium
DTPVLILKGAPEVILPR

SEQ ID NO: 20470 - protein, 30 aa, Mycobacterium avium
DTVDHGLWVAFWFFLAQLNLILGAINLVPL

SEQ ID NO: 20471 - protein, 17 aa, Mycobacterium avium
DTVLFPGAGFVELAIRA

SEQ ID NO: 20472 - protein, 30 aa, Mycobacterium avium
DVAFPRLNAFSFWLFLFGGLIAASGFIVPG

SEQ ID NO: 20473 - protein, 27 aa, Mycobacterium avium
DVDAEPAAWLRFWFPDPDGSKTEFQRA

SEQ ID NO: 20474 - protein, 18 aa, Mycobacterium avium
DVFYLLVDELDALPADVA

SEQ ID NO: 20475 - protein, 25 aa, Mycobacterium avium
DVIPYIMICLIAFMLFNGGGLQLMG

SEQ ID NO: 20476 - protein, 35 aa, Mycobacterium avium
DVRPRLILGAGLIALSVLGLRHLWSGSPGDPDARR

SEQ ID NO: 20477 - protein, 23 aa, Mycobacterium avium
DVRRAMTMLLIACPCAVGLATPT

SEQ ID NO: 20478 - protein, 25 aa, Mycobacterium avium
DVVYLVYGLAIVALPFMILIGLIAA

SEQ ID NO: 20479 - protein, 27 aa, Mycobacterium avium
DVYSLGCVLYEILTGEPPFTGDSPVAV

SEQ ID NO: 20480 - protein, 18 aa, Mycobacterium avium
DYLRYVLSRITLPGSIYL

SEQ ID NO: 20481 - protein, 35 aa, Mycobacterium avium
DYRPNLFVTYWSFRLMIGFLAIPVLFALTVLWVTR

SEQ ID NO: 20482 - protein, 22 aa, Mycobacterium avium
EAGYRAFIECSPHPVLTAAIEE

SEQ ID NO: 20483 - protein, 23 aa, Mycobacterium avium
EAILLLMIVNVAISQLYIMLSPR

SEQ ID NO: 20484 - protein, 27 aa, Mycobacterium avium
EAVMNKLRWVLLIVGGVGVAVAAVAGG

SEQ ID NO: 20485 - protein, 18 aa, Mycobacterium avium
ECGHMWVARATGMKVRRY

SEQ ID NO: 20486 - protein, 28 aa, Mycobacterium avium
EEAARRGFYSPLFYRDLIGDPTGISLPM

SEQ ID NO: 20487 - protein, 24 aa, Mycobacterium avium
EELLSRNWWSGPEIFLIVDDIQQL

SEQ ID NO: 20488 - protein, 24 aa, Mycobacterium avium
EENLLDFAPIMLVTFGIGALNTSF

SEQ ID NO: 20489 - protein, 39 aa, Mycobacterium avium
EFAILAVIAVLLYYVMLTFVARPYLIPSESMEPTLHGCT

SEQ ID NO: 20490 - protein, 33 aa, Mycobacterium avium
EFHRYLYPAYSHNFYLWWLAKAGAVGMAAFVLF

SEQ ID NO: 20491 - protein, 19 aa, Mycobacterium avium
EFLDQTWMIARVSLVPTLL

SEQ ID NO: 20492 - protein, 18 aa, Mycobacterium avium
EFYDFLIYGTAAALVFPA

SEQ ID NO: 20493 - protein, 23 aa, Mycobacterium avium
EGADQLLLRWRQANDRITSYISV

SEQ ID NO: 20494 - protein, 29 aa, Mycobacterium avium
EGYPIKASARYGLYYTPGSDLYRDTLPEL

SEQ ID NO: 20495 - protein, 23 aa, Mycobacterium avium
EHKVFFCVAAILLVMALNLRGVR

SEQ ID NO: 20496 - protein, 25 aa, Mycobacterium avium
EHPSLAMQIILFVAVVFGTLNVIGG

SEQ ID NO: 20497 - protein, 28 aa, Mycobacterium avium
EHSPAFMHWGWRVPFLISSGLIGIALYV

SEQ ID NO: 20498 - protein, 24 aa, Mycobacterium avium
EHYFRTFLRPDDVFWSFLEAIIIT

SEQ ID NO: 20499 - protein, 24 aa, Mycobacterium avium
EHYGLTLLVFFFGFTDQIAAFKII

SEQ ID NO: 20500 - protein, 23 aa, Mycobacterium avium
EIAGLPECSLLGAAAGGAIHLFA

SEQ ID NO: 20501 - protein, 25 aa, Mycobacterium avium
EIAMYSFIVLLLTGVYLTLFFDPSM

SEQ ID NO: 20502 - protein, 19 aa, Mycobacterium avium
EIIPPRYIEYRGGRFPELD

SEQ ID NO: 20503 - protein, 18 aa, Mycobacterium avium
EILAKLQKRYLAIVTAGG

SEQ ID NO: 20504 - protein, 24 aa, Mycobacterium avium
EIRVRIGIHMGRSVRRGDDLFGRN

SEQ ID NO: 20505 - protein, 23 aa, Mycobacterium avium
EKKTYPYFDPIAQKPFDVNYDSQ

SEQ ID NO: 20506 - protein, 19 aa, Mycobacterium avium
ELADPLTPILAVGAAASAI

SEQ ID NO: 20507 - protein, 38 aa, Mycobacterium avium
ELCAQYLAPILDAIKFNYPPFGLNLFSTAETLPKEVAY

SEQ ID NO: 20508 - protein, 33 aa, Mycobacterium avium
ELFAGLLRSQRWWWGAVLLLASIGLQAAALGGG

SEQ ID NO: 20509 - protein, 20 aa, Mycobacterium avium
ELGWICVAINYRHSPRNTWP

SEQ ID NO: 20510 - protein, 21 aa, Mycobacterium avium
ELIPMLPAALILAAATAATKV

SEQ ID NO: 20511 - protein, 19 aa, Mycobacterium avium
ELLGYVGLADTARASARPL

SEQ ID NO: 20512 - protein, 17 aa, Mycobacterium avium
ELQADCYAGIWAHYAST

SEQ ID NO: 20513 - protein, 29 aa, Mycobacterium avium
ELVAGVLLVLGLFTPLAAAGALAFLINGL

SEQ ID NO: 20514 - protein, 21 aa, Mycobacterium avium
ELWVGFTAVTALLILGLAQTL

SEQ ID NO: 20515 - protein, 29 aa, Mycobacterium avium
EMVLLWWARRLFAAPLPLLGVPLPARAAE

SEQ ID NO: 20516 - protein, 22 aa, Mycobacterium avium
EPGLVLRGFVERVGDRAPLVAA

SEQ ID NO: 20517 - protein, 23 aa, Mycobacterium avium
EPGRSLWWSWAWVAGMVGYAGDV

SEQ ID NO: 20518 - protein, 23 aa, Mycobacterium avium
EPYLLLFTLFLAPAEHWLGQLRW

SEQ ID NO: 20519 - protein, 29 aa, Mycobacterium avium
EQDAFDWVRDLLSYLPPNNATDPPRYAEP

SEQ ID NO: 20520 - protein, 27 aa, Mycobacterium avium
EQITMTRFYAAQRTFWVDPVSGTIVKQ

SEQ ID NO: 20521 - protein, 24 aa, Mycobacterium avium
ERDTHVISLLYIATFGSWIGFSFA

SEQ ID NO: 20522 - protein, 26 aa, Mycobacterium avium
EREPRNIWVMIGVPALIVALIGTIVM

SEQ ID NO: 20523 - protein, 34 aa, Mycobacterium avium
ERFLGLFDTWPGLILPYITFALPLAIYTLSAFFR

SEQ ID NO: 20524 - protein, 26 aa, Mycobacterium avium
ERGFKAPWVPVLPIASIGACVWLMLN

SEQ ID NO: 20525 - protein, 23 aa, Mycobacterium avium
ERRDLFSGFAWLAVVALAVAGAC

SEQ ID NO: 20526 - protein, 30 aa, Mycobacterium avium
ESKGRVALYLLITIAPFAVIAPLIGPALDR

SEQ ID NO: 20527 - protein, 19 aa, Mycobacterium avium
ESKPWSWPMSLRPVLYAID

SEQ ID NO: 20528 - protein, 24 aa, Mycobacterium avium
ETARPADLLVLLDSLRQREGTLSA

SEQ ID NO: 20529 - protein, 29 aa, Mycobacterium avium
ETERMTRLVEDLLLLARLDSGRPLEREPV

SEQ ID NO: 20530 - protein, 24 aa, Mycobacterium avium
ETLEVAVRLLRSRGTLVKAGVHAP

SEQ ID NO: 20531 - protein, 21 aa, Mycobacterium avium
EVAVFVFFGLVAVLGTEYTQA

SEQ ID NO: 20532 - protein, 29 aa, Mycobacterium avium
EVGMLLRNRPWQVAAFLGVLLGGGTVVVV

SEQ ID NO: 20533 - protein, 31 aa, Mycobacterium avium
EVLAIKPDICFLWDEAWYAFATAVPWARQRT

SEQ ID NO: 20534 - protein, 21 aa, Mycobacterium avium
EVLVYAWLMPVSTVVQAVIGG

SEQ ID NO: 20535 - protein, 24 aa, Mycobacterium avium
EVPGIYFSASLLDALRRGRRGDFA

SEQ ID NO: 20536 - protein, 23 aa, Mycobacterium avium
EVPILSGLGLTMTGARPGGFGDL

SEQ ID NO: 20537 - protein, 17 aa, Mycobacterium avium
FAAFGLTALIGLERTIQ

SEQ ID NO: 20538 - protein, 19 aa, Mycobacterium avium
FAAGRLYTTLSVADAAAAT

SEQ ID NO: 20539 - protein, 25 aa, Mycobacterium avium
FADIDRQMYFFYAATMAPFLAMAIA

SEQ ID NO: 20540 - protein, 19 aa, Mycobacterium avium
FAGAISLWRRLGLERQLLW

SEQ ID NO: 20541 - protein, 27 aa, Mycobacterium avium
FAIMHLLTHGFFKAGLFLGSGAVIHAM

SEQ ID NO: 20542 - protein, 20 aa, Mycobacterium avium
FAISGFLITASWLSNPQLRA

SEQ ID NO: 20543 - protein, 17 aa, Mycobacterium avium
FALFFIANCRVALDPRV

SEQ ID NO: 20544 - protein, 20 aa, Mycobacterium avium
FALLVGMSALIVFVGSLFGR

SEQ ID NO: 20545 - protein, 24 aa, Mycobacterium avium
FANHEKWINLIIHIGQEGRGANVF

SEQ ID NO: 20546 - protein, 28 aa, Mycobacterium avium
FANQTVVSALLVLALYRGGAGPERIFDA

SEQ ID NO: 20547 - protein, 18 aa, Mycobacterium avium
FDAGYFWHYNELWVGGAA

SEQ ID NO: 20548 - protein, 19 aa, Mycobacterium avium
FDDFLRPIRSYFYWEKHCY

SEQ ID NO: 20549 - protein, 25 aa, Mycobacterium avium
FDPKRKFNYTRWRRLATAIVRWPAP

SEQ ID NO: 20550 - protein, 17 aa, Mycobacterium avium
FDSLLTTVRPWLDKNRG

SEQ ID NO: 20551 - protein, 20 aa, Mycobacterium avium
FERAGRLGDGWFPMTEPGPG

SEQ ID NO: 20552 - protein, 17 aa, Mycobacterium avium
FFSHQVAFLFTFPNNIT

SEQ ID NO: 20553 - protein, 20 aa, Mycobacterium avium
FFVIAFQGVLCLFLLEMGMT

SEQ ID NO: 20554 - protein, 23 aa, Mycobacterium avium
FGALLRVVYVALPPLHDQWRPVL

SEQ ID NO: 20555 - protein, 17 aa, Mycobacterium avium
FGARLLGIAYGLGGIRA

SEQ ID NO: 20556 - protein, 23 aa, Mycobacterium avium
FGAVYLVPFVKYPPNPPAVGQAD

SEQ ID NO: 20557 - protein, 17 aa, Mycobacterium avium
FGEFLDQTWMIARVSLV

SEQ ID NO: 20558 - protein, 19 aa, Mycobacterium avium
FGFTAFAVGLMALWLAGLR

SEQ ID NO: 20559 - protein, 18 aa, Mycobacterium avium
FGLPLFLWGVRLLRRAQR

SEQ ID NO: 20560 - protein, 20 aa, Mycobacterium avium
FGLWGIFVLAPQLEPVAAFL

SEQ ID NO: 20561 - protein, 42 aa, Mycobacterium avium
FGQRRLLKWSIPGLAHFFTMWGFFILLTVYIEAYGLLFQDNF

SEQ ID NO: 20562 - protein, 25 aa, Mycobacterium avium
FGRGWAWLSAFTLFASAIGALLTEF

SEQ ID NO: 20563 - protein, 26 aa, Mycobacterium avium
FGRRNLFILTLALYLIATVATAFAFA

SEQ ID NO: 20564 - protein, 26 aa, Mycobacterium avium
FGSWVDITVVIWVLVALAISMVLYIG

SEQ ID NO: 20565 - protein, 30 aa, Mycobacterium avium
FGVSRWVSIPVATIALLALALTGSYRRVER

SEQ ID NO: 20566 - protein, 19 aa, Mycobacterium avium
FHYRYTVGLWFRRIWILQP

SEQ ID NO: 20567 - protein, 20 aa, Mycobacterium avium
FIAGFFFLTALLYGVLTALF

SEQ ID NO: 20568 - protein, 17 aa, Mycobacterium avium
FIGVLLIGLMELCFDST

SEQ ID NO: 20569 - protein, 18 aa, Mycobacterium avium
FIMAIAGPVLARYTGPRP

SEQ ID NO: 20570 - protein, 29 aa, Mycobacterium avium
FINDYLFNFPDTSIAWSFVLALLAAALTA

SEQ ID NO: 20571 - protein, 25 aa, Mycobacterium avium
FISAGELFIVGRMKDLLIVYGRNHY

SEQ ID NO: 20572 - protein, 28 aa, Mycobacterium avium
FIVIHLSMIFFWGWGRLTAAMIFGSVRN

SEQ ID NO: 20573 - protein, 26 aa, Mycobacterium avium
FLAMTMIILAVFYMIQDALFLGVVQV

SEQ ID NO: 20574 - protein, 33 aa, Mycobacterium avium
FLHELDTPEFPWTGLTIFLLIAVFAAAVGTRVL

SEQ ID NO: 20575 - protein, 27 aa, Mycobacterium avium
FLTLGLLIPVMLWPPSAPLLLLPVLLS

SEQ ID NO: 20576 - protein, 17 aa, Mycobacterium avium
FLTYLVAEKLSASGVLA

SEQ ID NO: 20577 - protein, 31 aa, Mycobacterium avium
FMFAFAIKAPLWPFHRWLPDAAVEATPATAV

SEQ ID NO: 20578 - protein, 23 aa, Mycobacterium avium
FNNACLVLLGLFPLFVMFIITAI

SEQ ID NO: 20579 - protein, 20 aa, Mycobacterium avium
FPMLQFTLLGVVCMAGTLWL

SEQ ID NO: 20580 - protein, 18 aa, Mycobacterium avium
FPTLNYAVSVEEACERAD

SEQ ID NO: 20581 - protein, 25 aa, Mycobacterium avium
FQAMTWLLQIMPLFFFAGAAACVSS

SEQ ID NO: 20582 - protein, 17 aa, Mycobacterium avium
FQFGEFLDQTWMIARVS

SEQ ID NO: 20583 - protein, 18 aa, Mycobacterium avium
FQMLTTLLEDWRDNLRWP

SEQ ID NO: 20584 - protein, 32 aa, Mycobacterium avium
FRPHNLPFVMLGAGLLWFGWYGFNAGSATSSN

SEQ ID NO: 20585 - protein, 18 aa, Mycobacterium avium
FSVSLHAITRHPPPRSGR

SEQ ID NO: 20586 - protein, 17 aa, Mycobacterium avium
FSVVQLLFFMTPIIWND

SEQ ID NO: 20587 - protein, 44 aa, Mycobacterium avium
FSYAGAFGLSILFWQHLIGLHLHWLVLPLTFIILVAVGSDYNLL

SEQ ID NO: 20588 - protein, 35 aa, Mycobacterium avium
FSYATFGEFLAWIIGWNLLLELAIGAAVVAKGWSS

SEQ ID NO: 20589 - protein, 17 aa, Mycobacterium avium
FTAPLIPVRPDLPDVLL

SEQ ID NO: 20590 - protein, 23 aa, Mycobacterium avium
FTEKYGIPVLTSYAATEFGGGVA

SEQ ID NO: 20591 - protein, 30 aa, Mycobacterium avium
FTGTTVGLVFIWFSLTPSLLPRGAIFQGLV

SEQ ID NO: 20592 - protein, 33 aa, Mycobacterium avium
FTHNLFKPLLLFFYFGFLIPILKVRFEFPYVIY

SEQ ID NO: 20593 - protein, 23 aa, Mycobacterium avium
FTLSAWLGLYLAARDPRKPVLVL

SEQ ID NO: 20594 - protein, 26 aa, Mycobacterium avium
FTRSQIIQLVLFGALVYVAYPFISTA

SEQ ID NO: 20595 - protein, 18 aa, Mycobacterium avium
FTVNQLLHGLLMHSGNDA

SEQ ID NO: 20596 - protein, 19 aa, Mycobacterium avium
FTYYFFLTGIHFVHLLIGF

SEQ ID NO: 20597 - protein, 21 aa, Mycobacterium avium
FVARRAVFHAMMRSLSSLVDT

SEQ ID NO: 20598 - protein, 19 aa, Mycobacterium avium
FVFNVFVAALIVYVGDQLG

SEQ ID NO: 20599 - protein, 17 aa, Mycobacterium avium
FVGTLVVWFFVLFDMLD

SEQ ID NO: 20600 - protein, 17 aa, Mycobacterium avium
FVGVQIPGALRGIAGVD

SEQ ID NO: 20601 - protein, 38 aa, Mycobacterium avium
FVMRRWAPVGLIVVGLLLLLGLPFFSVKWGFPDDRVLP

SEQ ID NO: 20602 - protein, 31 aa, Mycobacterium avium
FVRTCDCFNIPIIMLVDVPGFLPGTGQEYNG

SEQ ID NO: 20603 - protein, 17 aa, Mycobacterium avium
FWAKVRKGALVKAAAVL

SEQ ID NO: 20604 - protein, 18 aa, Mycobacterium avium
FYCPVDQTAYFDTDFFQE

SEQ ID NO: 20605 - protein, 20 aa, Mycobacterium avium
FYEWFRIMPTAVDVLDSIGR

SEQ ID NO: 20606 - protein, 19 aa, Mycobacterium avium
GAAVWGLVRSAQAEHPGRL

SEQ ID NO: 20607 - protein, 26 aa, Mycobacterium avium
GACGWAFLIWGLYAYLWAFAQYAVQM

SEQ ID NO: 20608 - protein, 22 aa, Mycobacterium avium
GAEVPLLMTLLQRGRTAGPADA

SEQ ID NO: 20609 - protein, 28 aa, Mycobacterium avium
GAGAAVLIALVLAINLLLTKSTQDRPTS

SEQ ID NO: 20610 - protein, 33 aa, Mycobacterium avium
GAGHHSDLDWLWWFGAGWLAVAVVGAGVILWRV

SEQ ID NO: 20611 - protein, 17 aa, Mycobacterium avium
GAIFPIFMIGGVAMMMF

SEQ ID NO: 20612 - protein, 21 aa, Mycobacterium avium
GALFMLGCFFVFGSLYHLHGA

SEQ ID NO: 20613 - protein, 22 aa, Mycobacterium avium
GALFPFLFITIACGALSGFHAL

SEQ ID NO: 20614 - protein, 25 aa, Mycobacterium avium
GALPSPRRWIWIVLAVGGITAALGA

SEQ ID NO: 20615 - protein, 19 aa, Mycobacterium avium
GAPAIVPPVRWHSGRRVHL

SEQ ID NO: 20616 - protein, 17 aa, Mycobacterium avium
GARLRWVPSQGPSAMPA

SEQ ID NO: 20617 - protein, 38 aa, Mycobacterium avium
GASFGLSVLIWQYIFGIQLYWMVLPMSVIVLLAVGSDY

SEQ ID NO: 20618 - protein, 25 aa, Mycobacterium avium
GASLVGWWALSRVLERLRGIPDVHK

SEQ ID NO: 20619 - protein, 24 aa, Mycobacterium avium
GATAAWAIGRWTPGTERRTATMGL

SEQ ID NO: 20620 - protein, 25 aa, Mycobacterium avium
GATYCLSFSRLPWFNTMGAPVAIGM

SEQ ID NO: 20621 - protein, 17 aa, Mycobacterium avium
GAVPWLVLAAVSALFPA

SEQ ID NO: 20622 - protein, 24 aa, Mycobacterium avium
GAVTYWIVHLIGGYPGAIIGFALL

SEQ ID NO: 20623 - protein, 24 aa, Mycobacterium avium
GAWAPVLLLVLRVLQGFALGGEWG

SEQ ID NO: 20624 - protein, 27 aa, Mycobacterium avium
GCGYEFRLETSCYNPVFGANREARVFI

SEQ ID NO: 20625 - protein, 27 aa, Mycobacterium avium
GDAIMAFLALLIVTSVSMVFGELVPKY

SEQ ID NO: 20626 - protein, 23 aa, Mycobacterium avium
GDFVNFYACDITLKINGLQAGGP

SEQ ID NO: 20627 - protein, 17 aa, Mycobacterium avium
GDHRGVAGPWRWSATML

SEQ ID NO: 20628 - protein, 28 aa, Mycobacterium avium
GDLDRTLLLWVLPLLIAPPMYSKDVYSY

SEQ ID NO: 20629 - protein, 24 aa, Mycobacterium avium
GDPRPIVAALRRASGPVTIIAGEQ

SEQ ID NO: 20630 - protein, 25 aa, Mycobacterium avium
GEAGTILTLLTMAAAFMGTALTIRD

SEQ ID NO: 20631 - protein, 26 aa, Mycobacterium avium
GFAVHIVAIVLLVLAYREFWAKVRKG

SEQ ID NO: 20632 - protein, 18 aa, Mycobacterium avium
GFLMLAHHWGTMAATPVF

SEQ ID NO: 20633 - protein, 25 aa, Mycobacterium avium
GFTARRAAVLAAVICVLTLTIAGPV

SEQ ID NO: 20634 - protein, 25 aa, Mycobacterium avium
GGAAVSTLALLRRASLRQAVADGVA

SEQ ID NO: 20635 - protein, 27 aa, Mycobacterium avium
GGAGLKAFWYHFAIMFEALFILTAVDA

SEQ ID NO: 20636 - protein, 25 aa, Mycobacterium avium
GGDFMHARVLLAPLFCLLAPVAVVP

SEQ ID NO: 20637 - protein, 27 aa, Mycobacterium avium
GGESALFFVGVLLVGLLGGIAPAALSA

SEQ ID NO: 20638 - protein, 24 aa, Mycobacterium avium
GGFAVVVGVIAWLLARRSRSEEQN

SEQ ID NO: 20639 - protein, 26 aa, Mycobacterium avium
GGLAVVFSILLFPKNPLAVLHDASGE

SEQ ID NO: 20640 - protein, 35 aa, Mycobacterium avium
GGNQRNGIDPIWWAPTLFIVIGGLVALTAASFSGK

SEQ ID NO: 20641 - protein, 23 aa, Mycobacterium avium
GGPKSLYLLLVLAALEVSLSFDN

SEQ ID NO: 20642 - protein, 27 aa, Mycobacterium avium
GGPLMIVVLALLFRLFVRPRLVDAARA

SEQ ID NO: 20643 - protein, 25 aa, Mycobacterium avium
GGRRAWTIPLAVLGIIAIGATLLTG

SEQ ID NO: 20644 - protein, 24 aa, Mycobacterium avium
GGSLTFLDCVYFSAVSLSTTGYGD

SEQ ID NO: 20645 - protein, 31 aa, Mycobacterium avium
GGVIAFLIAGLGSLFMLVDCAWVGGLCGIVK

SEQ ID NO: 20646 - protein, 26 aa, Mycobacterium avium
GGVLLWQHLFWFFGHPEVYIIALPFF

SEQ ID NO: 20647 - protein, 37 aa, Mycobacterium avium
GGVLSGAWLGLFIGLVLGFFSPNPWGALATGLVAGVF

SEQ ID NO: 20648 - protein, 27 aa, Mycobacterium avium
GHKVTTSPLPMKPIPQPSPSGGQSPST

SEQ ID NO: 20649 - protein, 40 aa, Mycobacterium avium
GHRQQVWLSVAGLVLILVVATAYLLIGALRVTPFASSYRV

SEQ ID NO: 20650 - protein, 18 aa, Mycobacterium avium
GHVVDFLSVGWWPVFNVA

SEQ ID NO: 20651 - protein, 24 aa, Mycobacterium avium
GIIGMLFLGFFILEGFDFGVGMLM

SEQ ID NO: 20652 - protein, 20 aa, Mycobacterium avium
GIKSISFLVSTRILGGLAVI

SEQ ID NO: 20653 - protein, 23 aa, Mycobacterium avium
GINTLFPLFGIANQLLAAIALTV

SEQ ID NO: 20654 - protein, 20 aa, Mycobacterium avium
GIPLLLVIVLSVLIWSHKGP

SEQ ID NO: 20655 - protein, 31 aa, Mycobacterium avium
GISRALSWAMPLAPWVFASATLGFVTIPGRL

SEQ ID NO: 20656 - protein, 33 aa, Mycobacterium avium
GIVQTPVLSQFFGCTPLGPVAWTGVLGSTAGAT

SEQ ID NO: 20657 - protein, 19 aa, Mycobacterium avium
GIWVFGPLRRRATAALAVA

SEQ ID NO: 20658 - protein, 30 aa, Mycobacterium avium
GIYFLPLDPWPRLFLGVTFLFLVSSAFTLA

SEQ ID NO: 20659 - protein, 25 aa, Mycobacterium avium
GKAQQPINLLLLAGAVAAAVVIGLH

SEQ ID NO: 20660 - protein, 24 aa, Mycobacterium avium
GKGGLLLGLLAPHGLLELTAVFLA

SEQ ID NO: 20661 - protein, 28 aa, Mycobacterium avium
GKNWMDGWNGLLISLLLGLAGAIGQLVI

SEQ ID NO: 20662 - protein, 26 aa, Mycobacterium avium
GKSKLPLYLNIAVVALGFAAYLLNFG

SEQ ID NO: 20663 - protein, 23 aa, Mycobacterium avium
GKTTLMLILAGRQPTSGTVHRPG

SEQ ID NO: 20664 - protein, 17 aa, Mycobacterium avium
GLAALIFSRYLWAFELT

SEQ ID NO: 20665 - protein, 31 aa, Mycobacterium avium
GLAPTLWGWRRTPVLRWFVLGAGVGVTGAWL

SEQ ID NO: 20666 - protein, 19 aa, Mycobacterium avium
GLCAVAILRALYPEVAVAV

SEQ ID NO: 20667 - protein, 19 aa, Mycobacterium avium
GLFPLFVMFIITAITMQRE

SEQ ID NO: 20668 - protein, 18 aa, Mycobacterium avium
GLFVMFSRMQGGARMGFG

SEQ ID NO: 20669 - protein, 21 aa, Mycobacterium avium
GLGFGVLIFGLAMGALFAVLF

SEQ ID NO: 20670 - protein, 20 aa, Mycobacterium avium
GLGVGLYFGGLRLNLGRFFR

SEQ ID NO: 20671 - protein, 19 aa, Mycobacterium avium
GLHRFRIHLDIAVVVVVLV

SEQ ID NO: 20672 - protein, 17 aa, Mycobacterium avium
GLLAPLTFVCVFGYMAQ

SEQ ID NO: 20673 - protein, 18 aa, Mycobacterium avium
GLLLATGWVANHFVGLMP

SEQ ID NO: 20674 - protein, 17 aa, Mycobacterium avium
GLMLIAWLSLGRRVLAG

SEQ ID NO: 20675 - protein, 17 aa, Mycobacterium avium
GLQDFIRKSADPAKPIA

SEQ ID NO: 20676 - protein, 25 aa, Mycobacterium avium
GLRNTFWALVLPFMFGSPYAIFLLR

SEQ ID NO: 20677 - protein, 25 aa, Mycobacterium avium
GLRRWYVITFLMGLFFVLGQGYEYY

SEQ ID NO: 20678 - protein, 23 aa, Mycobacterium avium
GLSATLFYLLAYSFSTVGAFAIV

SEQ ID NO: 20679 - protein, 22 aa, Mycobacterium avium
GLSRAVLNLLDNAAKWSPPGGH

SEQ ID NO: 20680 - protein, 27 aa, Mycobacterium avium
GLSVLIWQHLIGIELHWMVLAMSVIIL

SEQ ID NO: 20681 - protein, 18 aa, Mycobacterium avium
GLSVLMWQDLIGLGVQWI

SEQ ID NO: 20682 - protein, 36 aa, Mycobacterium avium
GLSVLVWQDILGIKLYWICLALSVIILLAVGSDYNL

SEQ ID NO: 20683 - protein, 25 aa, Mycobacterium avium
GLTLSPTLIFDYPTPVVLAEHLDSR

SEQ ID NO: 20684 - protein, 29 aa, Mycobacterium avium
GLVGGVVWNLLTWLLGIPSSSSHALIGGI

SEQ ID NO: 20685 - protein, 26 aa, Mycobacterium avium
GLVIAGVVLLFARPRLRIGPAGVSVR

SEQ ID NO: 20686 - protein, 17 aa, Mycobacterium avium
GLWFRRIWILQPHGEVM

SEQ ID NO: 20687 - protein, 18 aa, Mycobacterium avium
GMAVIIGNLLYTAAAVVL

SEQ ID NO: 20688 - protein, 24 aa, Mycobacterium avium
GMLLPLGFMILTREAGPRRLGRLM

SEQ ID NO: 20689 - protein, 18 aa, Mycobacterium avium
GMSYVWWALAVIVAAGVT

SEQ ID NO: 20690 - protein, 20 aa, Mycobacterium avium
GMVIVPPIVYFVTYRWCIGL

SEQ ID NO: 20691 - protein, 18 aa, Mycobacterium avium
GNIDLVFHGGTLARRDQT

SEQ ID NO: 20692 - protein, 33 aa, Mycobacterium avium
GNNFLVPNGTFFFVLAIFLIVLAVIGTFVVPPV

SEQ ID NO: 20693 - protein, 18 aa, Mycobacterium avium
GNPLPQYFQSRPSAAGTG

SEQ ID NO: 20694 - protein, 29 aa, Mycobacterium avium
GNPQLLINSDLLKQLLYGPIAGPPRNSAQ

SEQ ID NO: 20695 - protein, 35 aa, Mycobacterium avium
GPAWRLMGVIFGTMFFLMFTPTKWVHHFGLFAAVG

SEQ ID NO: 20696 - protein, 27 aa, Mycobacterium avium
GPERTAMLLVPPYLAYVRAARPFIAFY

SEQ ID NO: 20697 - protein, 23 aa, Mycobacterium avium
GPLQIAVSLMWPAGIAALVYAVR

SEQ ID NO: 20698 - protein, 36 aa, Mycobacterium avium
GPLYGIFIVFLFHDWRYVFWINVPLTLIAMVMIQFS

SEQ ID NO: 20699 - protein, 24 aa, Mycobacterium avium
GPSDRQLFGIGIAVLVVSALLTTV

SEQ ID NO: 20700 - protein, 23 aa, Mycobacterium avium
GPSLVALMLLGVPALLAGTYAGI

SEQ ID NO: 20701 - protein, 22 aa, Mycobacterium avium
GQLTVWLTWPFHAAGALAGFGV

SEQ ID NO: 20702 - protein, 25 aa, Mycobacterium avium
GQPSQVPPLPPFKPSADVGANCQYP

SEQ ID NO: 20703 - protein, 22 aa, Mycobacterium avium
GQPTAALLIALVAGGWFSAAVL

SEQ ID NO: 20704 - protein, 24 aa, Mycobacterium avium
GRGANVFFMLGGQRLDLSSLQKVK

SEQ ID NO: 20705 - protein, 31 aa, Mycobacterium avium
GRGGLQFMLIIWLQGIWLPLHGYRFESTPLW

SEQ ID NO: 20706 - protein, 24 aa, Mycobacterium avium
GRLRRPLLGLPMAHPGAVDVVYDT

SEQ ID NO: 20707 - protein, 27 aa, Mycobacterium avium
GRLTGRYALLVVGLWVLAAAVANVAVP

SEQ ID NO: 20708 - protein, 25 aa, Mycobacterium avium
GRMGVAWLVTLPLAGLVGAVTYWIV

SEQ ID NO: 20709 - protein, 19 aa, Mycobacterium avium
GRPAVLVVRCTVAVTAVAL

SEQ ID NO: 20710 - protein, 23 aa, Mycobacterium avium
GRQFLNAGLGFGGGCLPKDIRAF

SEQ ID NO: 20711 - protein, 29 aa, Mycobacterium avium
GRRVDLPTYGFVRQHFWLPGGSTGSSDVA

SEQ ID NO: 20712 - protein, 23 aa, Mycobacterium avium
GRSGLVYDMWGGAVSLAYQMHSG

SEQ ID NO: 20713 - protein, 19 aa, Mycobacterium avium
GRTAMFFAVLFAIGMNVYT

SEQ ID NO: 20714 - protein, 26 aa, Mycobacterium avium
GRWSYGLFIWHLAALAMVFPVLGTFP

SEQ ID NO: 20715 - protein, 24 aa, Mycobacterium avium
GSGTLITFPTLVALGYPPVTATMS

SEQ ID NO: 20716 - protein, 24 aa, Mycobacterium avium
GSGWWQTFWRITLPSIRWGLTYGI

SEQ ID NO: 20717 - protein, 23 aa, Mycobacterium avium
GSIGPYLHYFTMMLSAKDIAYSV

SEQ ID NO: 20718 - protein, 18 aa, Mycobacterium avium
GSLWVFVGVQIPGALRGI

SEQ ID NO: 20719 - protein, 18 aa, Mycobacterium avium
GSPLLSYGAPTSPTVRIV

SEQ ID NO: 20720 - protein, 25 aa, Mycobacterium avium
GSPLTAALSLMWGWRLAVVCVTVAA

SEQ ID NO: 20721 - protein, 24 aa, Mycobacterium avium
GSQYGYLLLWVIVAANVLAGLVQY

SEQ ID NO: 20722 - protein, 17 aa, Mycobacterium avium
GSRISVAMPMFHGLGLG

SEQ ID NO: 20723 - protein, 24 aa, Mycobacterium avium
GSVAATLMLLSGFGAMVVEARPGS

SEQ ID NO: 20724 - protein, 20 aa, Mycobacterium avium
GSVGVWHYLKRPGANDRVAT

SEQ ID NO: 20725 - protein, 23 aa, Mycobacterium avium
GSVVAMLSLVPWGTTGVSLDLMR

SEQ ID NO: 20726 - protein, 26 aa, Mycobacterium avium
GTAADWLGYFLLFASFVVGATVGGFI

SEQ ID NO: 20727 - protein, 26 aa, Mycobacterium avium
GTAIVRWPAPILIATLAVSLVGLLAL

SEQ ID NO: 20728 - protein, 25 aa, Mycobacterium avium
GTFSATRVLRLPDPTPQPLTAWHAL

SEQ ID NO: 20729 - protein, 25 aa, Mycobacterium avium
GTGLFRTVYVLPWICAPLAIAVLWR

SEQ ID NO: 20730 - protein, 19 aa, Mycobacterium avium
GTGRYLLLQTIVVAVWIVV

SEQ ID NO: 20731 - protein, 31 aa, Mycobacterium avium
GTIGVISMVLFYIQAPTLLGIGRMTVTLELP

SEQ ID NO: 20732 - protein, 20 aa, Mycobacterium avium
GTLINWRSPIAWLSRYRPGT

SEQ ID NO: 20733 - protein, 26 aa, Mycobacterium avium
GTRHRRFLPARWWSIGGLDALVIAVL

SEQ ID NO: 20734 - protein, 27 aa, Mycobacterium avium
GTTIGLGLLFDTLIVRSLMTPSIAALL

SEQ ID NO: 20735 - protein, 28 aa, Mycobacterium avium
GVAGLVEWPVLLAVGGGALLLQRLNRKE

SEQ ID NO: 20736 - protein, 30 aa, Mycobacterium avium
GVAVVAAAVGIGWWLLRPDDDTITVTAQFD

SEQ ID NO: 20737 - protein, 24 aa, Mycobacterium avium
GVGAFLRLPYTFAVPVFGGRNWTT

SEQ ID NO: 20738 - protein, 19 aa, Mycobacterium avium
GVIAGLMFPAGKGGLLLGL

SEQ ID NO: 20739 - protein, 36 aa, Mycobacterium avium
GVIWGIWLVIVGWLTLWPFFGWLTTHFVVTNRRVMF

SEQ ID NO: 20740 - protein, 19 aa, Mycobacterium avium
GVLIGFVALYLIGSLAGFS

SEQ ID NO: 20741 - protein, 25 aa, Mycobacterium avium
GVLPLLPVLLMVWATARNTARATSP

SEQ ID NO: 20742 - protein, 23 aa, Mycobacterium avium
GVLTIAAVLALRFTGRRLAIYTA

SEQ ID NO: 20743 - protein, 27 aa, Mycobacterium avium
GVNFRDVLVALGMYPGGGRLGAEGAGV

SEQ ID NO: 20744 - protein, 18 aa, Mycobacterium avium
GVPYFPNLVLPIVVGGIG

SEQ ID NO: 20745 - protein, 25 aa, Mycobacterium avium
GVQLVVVLTAAWLLATPLTQSKDQP

SEQ ID NO: 20746 - protein, 19 aa, Mycobacterium avium
GVVLLVIVAAVVVLRGREA

SEQ ID NO: 20747 - protein, 17 aa, Mycobacterium avium
GVVRRDLLPTGYALGFI

SEQ ID NO: 20748 - protein, 23 aa, Mycobacterium avium
GVWAFIGVLIVAFFLASAGASAA

SEQ ID NO: 20749 - protein, 25 aa, Mycobacterium avium
GWEVDPYAIPLFQTAHRTGARVVLR

SEQ ID NO: 20750 - protein, 18 aa, Mycobacterium avium
GWFFLFKTGNVSLAGGGT

SEQ ID NO: 20751 - protein, 18 aa, Mycobacterium avium
GWVTRLPAAPQTTRAAAA

SEQ ID NO: 20752 - protein, 26 aa, Mycobacterium avium
GWWTSPLFLCIWITGTSILMVSKIPM

SEQ ID NO: 20753 - protein, 26 aa, Mycobacterium avium
GYAFARLRFPGRDALFWVYIATLMVP

SEQ ID NO: 20754 - protein, 21 aa, Mycobacterium avium
HADDPWRDPGAPAALGTPAVA

SEQ ID NO: 20755 - protein, 17 aa, Mycobacterium avium
HAIAHYLDLAAAGRVDL

SEQ ID NO: 20756 - protein, 17 aa, Mycobacterium avium
HALGYLHATIAMFLGST

SEQ ID NO: 20757 - protein, 25 aa, Mycobacterium avium
HAYPRTGSVVIWYSPRRCDRSAVLA

SEQ ID NO: 20758 - protein, 29 aa, Mycobacterium avium
HFVDAIICFIGFLFPLWDSKRQTLADKIM

SEQ ID NO: 20759 - protein, 20 aa, Mycobacterium avium
HGIVSALHRPVPLSGEGSDT

SEQ ID NO: 20760 - protein, 19 aa, Mycobacterium avium
HGRGILLTALGYGITVAGS

SEQ ID NO: 20761 - protein, 27 aa, Mycobacterium avium
HGVDPVIVLLFVALLGLSAGGVYQQRF

SEQ ID NO: 20762 - protein, 21 aa, Mycobacterium avium
HGYTYGLLWVAGAAVIVGAAA

SEQ ID NO: 20763 - protein, 22 aa, Mycobacterium avium
HHEALLFFAFSGVGVLLSMAPL

SEQ ID NO: 20764 - protein, 30 aa, Mycobacterium avium
HIAAPRAKLFAALFLILALVVIGEVAGVVL

SEQ ID NO: 20765 - protein, 28 aa, Mycobacterium avium
HINTYDMDLFLRIAPELYLKRLCVGGVE

SEQ ID NO: 20766 - protein, 25 aa, Mycobacterium avium
HLAAPMADGWLDRGRLVCPWHGSWF

SEQ ID NO: 20767 - protein, 35 aa, Mycobacterium avium
HLGVDVLWLLNGAVFYVLLFATGQWRHIVPTSWDV

SEQ ID NO: 20768 - protein, 20 aa, Mycobacterium avium
HLRSGWYRLPARDKARPLLV

SEQ ID NO: 20769 - protein, 26 aa, Mycobacterium avium
HLSMTLPILIPFVYFSHALNKVWRRH

SEQ ID NO: 20770 - protein, 27 aa, Mycobacterium avium
HNQVWQVNWIYPVSWHYAFDIILRQYF

SEQ ID NO: 20771 - protein, 22 aa, Mycobacterium avium
HPGESSFYWLTLGLAAVWTVGA

SEQ ID NO: 20772 - protein, 38 aa, Mycobacterium avium
HRPYLPHAIRIFAVPIILGWLFVTVLVNVIVPTLEKVG

SEQ ID NO: 20773 - protein, 24 aa, Mycobacterium avium
HRSDAVLVTGPWMAGVTAVAAALQ

SEQ ID NO: 20774 - protein, 31 aa, Mycobacterium avium
HSKHIFVFDMAMLALLSIGYTGFVRWHIRLK

SEQ ID NO: 20775 - protein, 25 aa, Mycobacterium avium
HTAVQYRLPVAFVLINNNAQAMCAM

SEQ ID NO: 20776 - protein, 29 aa, Mycobacterium avium
HVAFSIWTLWPVMALFMPAAVYGFSAGDK

SEQ ID NO: 20777 - protein, 19 aa, Mycobacterium avium
HWMVLAMSVIILLAVGADY

SEQ ID NO: 20778 - protein, 19 aa, Mycobacterium avium
HYIAMWFAVFYTGDHAWLA

SEQ ID NO: 20779 - protein, 25 aa, Mycobacterium avium
IAAFKIIMLALWWGAATSKLNHHFP

SEQ ID NO: 20780 - protein, 27 aa, Mycobacterium avium
IAAGVLYFFFVLPRWPELMGDTTHSLG

SEQ ID NO: 20781 - protein, 31 aa, Mycobacterium avium
IAAIAAFVLIFLIMLFITRSLVAALVIPGTV

SEQ ID NO: 20782 - protein, 21 aa, Mycobacterium avium
IADCLPRRTPWPRGLLLGLGM

SEQ ID NO: 20783 - protein, 29 aa, Mycobacterium avium
IADFDDFFRPIRSYFYWEKHCFDIPVCWS

SEQ ID NO: 20784 - protein, 29 aa, Mycobacterium avium
IADFDDFWRPIRSYFYWEKHCYDIPICWS

SEQ ID NO: 20785 - protein, 20 aa, Mycobacterium avium
IAGVVIIRRALAPLRRVAQT

SEQ ID NO: 20786 - protein, 19 aa, Mycobacterium avium
IAIRVVLASYLPAAAIALF

SEQ ID NO: 20787 - protein, 21 aa, Mycobacterium avium
IANFYNIYDPAQGTLNGLLSI

SEQ ID NO: 20788 - protein, 24 aa, Mycobacterium avium
IARAHVLLRFEQGRWRAVDNNTLN

SEQ ID NO: 20789 - protein, 19 aa, Mycobacterium avium
IASIVVLVVALRRPKQPAR

SEQ ID NO: 20790 - protein, 29 aa, Mycobacterium avium
IATGVVVGIFWMGRRLVSPWWAVGLGMIL

SEQ ID NO: 20791 - protein, 24 aa, Mycobacterium avium
IAVLPPLPVILGLCAVTGVVYGPI

SEQ ID NO: 20792 - protein, 27 aa, Mycobacterium avium
IAVLVYLYTVVLFAPVLIVLERLPVLD

SEQ ID NO: 20793 - protein, 19 aa, Mycobacterium avium
IAVLWRWILAPTDGAVSAV

SEQ ID NO: 20794 - protein, 25 aa, Mycobacterium avium
IAVRPDLPEVLLPQNYHPPTDLAPP

SEQ ID NO: 20795 - protein, 24 aa, Mycobacterium avium
IAVTAMIFVICVASMFVAQAAVRP

SEQ ID NO: 20796 - protein, 29 aa, Mycobacterium avium
IDARLWQAIIVLAAITAVALAISCLSARR

SEQ ID NO: 20797 - protein, 20 aa, Mycobacterium avium
IDDRWGLDALTKFAGQITAA

SEQ ID NO: 20798 - protein, 20 aa, Mycobacterium avium
IDGRFFVEMRLVDGIDLGSL

SEQ ID NO: 20799 - protein, 35 aa, Mycobacterium avium
IDLGSLLHREGPLAPPRAIAIIRQVAAALDAAHAA

SEQ ID NO: 20800 - protein, 17 aa, Mycobacterium avium
IDVHRGWREVLAANRDT

SEQ ID NO: 20801 - protein, 33 aa, Mycobacterium avium
IESEASRMGLLVDDLLLLARLDVQRPLEHHRVD

SEQ ID NO: 20802 - protein, 17 aa, Mycobacterium avium
IFSRELFQEVFLNPGLV

SEQ ID NO: 20803 - protein, 24 aa, Mycobacterium avium
IGAALYALLVNRWPLAESGVRSGL

SEQ ID NO: 20804 - protein, 26 aa, Mycobacterium avium
IGASVLIWQHLLHQELHWAVAPIAFI

SEQ ID NO: 20805 - protein, 24 aa, Mycobacterium avium
IGCWLIISHWVLRRLGPGRGGLAA

SEQ ID NO: 20806 - protein, 18 aa, Mycobacterium avium
IGLKLQFGDGWWTSPLFL

SEQ ID NO: 20807 - protein, 17 aa, Mycobacterium avium
IGLLFDTFVVRSLITPS

SEQ ID NO: 20808 - protein, 26 aa, Mycobacterium avium
IGLLPAWKIVLILLVLAVLGLRDKVI

SEQ ID NO: 20809 - protein, 21 aa, Mycobacterium avium
IGTIVVFTLIMMARSMNRRPQ

SEQ ID NO: 20810 - protein, 28 aa, Mycobacterium avium
IGTTIALGLLFDTLIVRSFMTPSVAALL

SEQ ID NO: 20811 - protein, 18 aa, Mycobacterium avium
IGTYYYMAPERFTDDEVT

SEQ ID NO: 20812 - protein, 30 aa, Mycobacterium avium
IGVLPVLALMVVAVWLLGVGTLKDLALVQL

SEQ ID NO: 20813 - protein, 18 aa, Mycobacterium avium
IGVSVFILYEAIQRLREA

SEQ ID NO: 20814 - protein, 19 aa, Mycobacterium avium
IHLLGRPLGRLIDRDSSAD

SEQ ID NO: 20815 - protein, 19 aa, Mycobacterium avium
IIGQRYLGLSLGETGSRTT

SEQ ID NO: 20816 - protein, 25 aa, Mycobacterium avium
IIIAIMLMFVYRSIGTVLLTMVILF

SEQ ID NO: 20817 - protein, 27 aa, Mycobacterium avium
IIPRMYALHILLLPGIILALIGLHLAM

SEQ ID NO: 20818 - protein, 19 aa, Mycobacterium avium
IIRAAPLDWTWPAVSLLVL

SEQ ID NO: 20819 - protein, 24 aa, Mycobacterium avium
IIVPRALMPHWLQWISNVLPASYA

SEQ ID NO: 20820 - protein, 17 aa, Mycobacterium avium
IIVVITALAFDFTNGFH

SEQ ID NO: 20821 - protein, 18 aa, Mycobacterium avium
IKALPASAVVGLWTFDGH

SEQ ID NO: 20822 - protein, 24 aa, Mycobacterium avium
ILGAAPLLLMALYVLVAEANSRIP

SEQ ID NO: 20823 - protein, 23 aa, Mycobacterium avium
ILGAHWKLALTALLACTVGAAFV

SEQ ID NO: 20824 - protein, 17 aa, Mycobacterium avium
ILGGWLFASATRGLGGF

SEQ ID NO: 20825 - protein, 29 aa, Mycobacterium avium
ILVAVFGMRLLFPLLIVWATAGLDPVRAL

SEQ ID NO: 20826 - protein, 28 aa, Mycobacterium avium
ILWLVPLAGSVLIILMPPGLRQLAKWTG

SEQ ID NO: 20827 - protein, 18 aa, Mycobacterium avium
IMLGWVGLGPVPWLVEPR

SEQ ID NO: 20828 - protein, 20 aa, Mycobacterium avium
IMLSIPYTVLIVFVLNILLV

SEQ ID NO: 20829 - protein, 27 aa, Mycobacterium avium
IMVSIPLTVLLIFTLNVLLAQFGAADL

SEQ ID NO: 20830 - protein, 25 aa, Mycobacterium avium
INLAKVRPLPRLPRSLPLADGLSRM

SEQ ID NO: 20831 - protein, 23 aa, Mycobacterium avium
IPAIALASIWLKGPLVLGLGAIQ

SEQ ID NO: 20832 - protein, 21 aa, Mycobacterium avium
IPTDRLWGAALTLILVIATIN

SEQ ID NO: 20833 - protein, 19 aa, Mycobacterium avium
IPVCWSMRSLFDALDGIDE

SEQ ID NO: 20834 - protein, 18 aa, Mycobacterium avium
IQAFIQYVRQFNSPLSQL

SEQ ID NO: 20835 - protein, 23 aa, Mycobacterium avium
IRANARIIVFLSVALVIATAVAV

SEQ ID NO: 20836 - protein, 24 aa, Mycobacterium avium
IRAYALFIIAGIVAALLIGDRRWE

SEQ ID NO: 20837 - protein, 24 aa, Mycobacterium avium
ISGATIFFFLFVHVLDAAMLRVSP

SEQ ID NO: 20838 - protein, 19 aa, Mycobacterium avium
ISLATPFLTYLVAEKLSAS

SEQ ID NO: 20839 - protein, 21 aa, Mycobacterium avium
ISLTYFPPLWRKVMDHRVLAH

SEQ ID NO: 20840 - protein, 24 aa, Mycobacterium avium
ISMTQIVPLLFVLLSLEFLPRRRH

SEQ ID NO: 20841 - protein, 30 aa, Mycobacterium avium
ITAATIGLILLLLLVVYRSPVAAAIPLISV

SEQ ID NO: 20842 - protein, 30 aa, Mycobacterium avium
ITAIAVVVLLGWSFFYFSDDTRGYKPVDTS

SEQ ID NO: 20843 - protein, 25 aa, Mycobacterium avium
ITAYMLTFGGLMLLGGRLGDTIGRK

SEQ ID NO: 20844 - protein, 25 aa, Mycobacterium avium
ITAYVLTFGGLMLLGGRLGDTIGRK

SEQ ID NO: 20845 - protein, 24 aa, Mycobacterium avium
ITHGLLWSVIAPIATRLVPPSHAG

SEQ ID NO: 20846 - protein, 18 aa, Mycobacterium avium
ITLLQIPMLLMSHPQWGR

SEQ ID NO: 20847 - protein, 35 aa, Mycobacterium avium
ITMRDLRIPAIGLVLLLLSSLIVGAGWPLIVEQIS

SEQ ID NO: 20848 - protein, 17 aa, Mycobacterium avium
ITRISLNFAMFRSAFEQ

SEQ ID NO: 20849 - protein, 25 aa, Mycobacterium avium
ITYHPSLEQLLVLLPSAVAIEQAAA

SEQ ID NO: 20850 - protein, 25 aa, Mycobacterium avium
IVALPFMILIGLIAAGQWKLLGAYA

SEQ ID NO: 20851 - protein, 26 aa, Mycobacterium avium
IVGVMFSMFLLAFAGIPLTSGFVSKL

SEQ ID NO: 20852 - protein, 18 aa, Mycobacterium avium
IVNKRLVWIIDGYTTLDN

SEQ ID NO: 20853 - protein, 25 aa, Mycobacterium avium
IWQIGRPWYLAWAGLVYIVAAVATL

SEQ ID NO: 20854 - protein, 19 aa, Mycobacterium avium
IYLLIVEPPLYFPTVFRVD

SEQ ID NO: 20855 - protein, 22 aa, Mycobacterium avium
KAASELGYKGLLAPLTFVCVFG

SEQ ID NO: 20856 - protein, 20 aa, Mycobacterium avium
KALFRRPFQWRETIEQGWFI

SEQ ID NO: 20857 - protein, 20 aa, Mycobacterium avium
KAPVLLQVPGGAWAIGMRRP

SEQ ID NO: 20858 - protein, 26 aa, Mycobacterium avium
KAWMSMYEANWWWLLASVVAAAASMH

SEQ ID NO: 20859 - protein, 43 aa, Mycobacterium avium
KDLGFYAFELPFYRLLLSYLFVAVFLAFVANLLAHYIFGGIRL

SEQ ID NO: 20860 - protein, 24 aa, Mycobacterium avium
KDPVFLDWLVGLAFPCQRPFGHQN

SEQ ID NO: 20861 - protein, 35 aa, Mycobacterium avium
KFTEGAWLVVVVFPLLVFVLTRLNREYRAEAAILE

SEQ ID NO: 20862 - protein, 45 aa, Mycobacterium avium
KGTRVGLIMPNNTRWVLIAIALTRIGAVLVPLSTLLRAGELVAQL

SEQ ID NO: 20863 - protein, 24 aa, Mycobacterium avium
KHCFDIPLCWAFRSLWDTIDHIDH

SEQ ID NO: 20864 - protein, 24 aa, Mycobacterium avium
KHCYDIPICWSLRSLFDALDGFDQ

SEQ ID NO: 20865 - protein, 23 aa, Mycobacterium avium
KHCYDIPVCWALRSVFNALDGID

SEQ ID NO: 20866 - protein, 23 aa, Mycobacterium avium
KHCYDIPVCWSLRSVFDALDGID

SEQ ID NO: 20867 - protein, 18 aa, Mycobacterium avium
KLFGWWGGSGVTGLRNSL

SEQ ID NO: 20868 - protein, 20 aa, Mycobacterium avium
KLPQLYGVLTPAAAMGDALL

SEQ ID NO: 20869 - protein, 21 aa, Mycobacterium avium
KLVTWFPPRVVVIASGGLILG

SEQ ID NO: 20870 - protein, 26 aa, Mycobacterium avium
KNLVSTTFVVPYPPGFPVLVPGQVVS

SEQ ID NO: 20871 - protein, 26 aa, Mycobacterium avium
KRWGYRPAALGLFAFVWMELASPNPA

SEQ ID NO: 20872 - protein, 22 aa, Mycobacterium avium
KSSYAQFIYLLSGADHDQMDRM

SEQ ID NO: 20873 - protein, 20 aa, Mycobacterium avium
KTMGIIFLALISYGSVSKTA

SEQ ID NO: 20874 - protein, 18 aa, Mycobacterium avium
KTSINSVLLIFTIGVTWS

SEQ ID NO: 20875 - protein, 23 aa, Mycobacterium avium
KTTTHLFQPLLYQVATGILSEGD

SEQ ID NO: 20876 - protein, 20 aa, Mycobacterium avium
KTVFVFPGQGSQWPGMGAQL

SEQ ID NO: 20877 - protein, 18 aa, Mycobacterium avium
KVLPLTLAGGAAVSTLAL

SEQ ID NO: 20878 - protein, 23 aa, Mycobacterium avium
KVNEVAPPWLKTVPKRLSALLNT

SEQ ID NO: 20879 - protein, 21 aa, Mycobacterium avium
KWTKGIRYWQAGYTAVFIAFV

SEQ ID NO: 20880 - protein, 25 aa, Mycobacterium avium
LAAVVLLMWAYFAWTYGHLVGRRIR

SEQ ID NO: 20881 - protein, 31 aa, Mycobacterium avium
LACLKFTRLPYFSSLAFPCAVGLLVVVAAGV

SEQ ID NO: 20882 - protein, 19 aa, Mycobacterium avium
LADAVRILSAIPVARSASE

SEQ ID NO: 20883 - protein, 24 aa, Mycobacterium avium
LADPHGGLLPSWTPGAHIDVRLPS

SEQ ID NO: 20884 - protein, 23 aa, Mycobacterium avium
LAFGGYFYWDDLILIGKAGTHNL

SEQ ID NO: 20885 - protein, 26 aa, Mycobacterium avium
LAFSKPFFAQGLLNRRAVLKSSYAQF

SEQ ID NO: 20886 - protein, 19 aa, Mycobacterium avium
LAGALKMHYPRFLTANVSG

SEQ ID NO: 20887 - protein, 23 aa, Mycobacterium avium
LAGLLIVIGIQLLKPAHIETAMK

SEQ ID NO: 20888 - protein, 28 aa, Mycobacterium avium
LAIARAFTVLFLPYSLLGPFAGALMDRW

SEQ ID NO: 20889 - protein, 17 aa, Mycobacterium avium
LAILVLSGFVGFAVISK

SEQ ID NO: 20890 - protein, 24 aa, Mycobacterium avium
LAKMTIITIIIIAIMLMFVYRSIG

SEQ ID NO: 20891 - protein, 29 aa, Mycobacterium avium
LALAALGVVVLLLIFAKSWAFDPEKAARA

SEQ ID NO: 20892 - protein, 21 aa, Mycobacterium avium
LAPLTFVCVFGYMAQSSFFKH

SEQ ID NO: 20893 - protein, 22 aa, Mycobacterium avium
LAPQHWIALTPPRIPQLRTLQD

SEQ ID NO: 20894 - protein, 23 aa, Mycobacterium avium
LAPYVLIWVIIVAYLCHVPFAVR

SEQ ID NO: 20895 - protein, 18 aa, Mycobacterium avium
LAQTLLTRRHSPLVVATA

SEQ ID NO: 20896 - protein, 41 aa, Mycobacterium avium
LASLIVIFVTLLLVYRSVITVILLLLIVGLELQIARGMVAL

SEQ ID NO: 20897 - protein, 22 aa, Mycobacterium avium
LASRHHAFLIQTPLGTEIRDAH

SEQ ID NO: 20898 - protein, 27 aa, Mycobacterium avium
LAVAIPLTVLIIFTLNILLAEFGAADI

SEQ ID NO: 20899 - protein, 27 aa, Mycobacterium avium
LAVITQLLLLPVAWYLAVGSHQPGFGI

SEQ ID NO: 20900 - protein, 31 aa, Mycobacterium avium
LAVRGRVTVGRRVVSLPWRLANVADLPAVDA

SEQ ID NO: 20901 - protein, 28 aa, Mycobacterium avium
LCAQYLAPVLDAIKFNYPPAGLNPFNSA

SEQ ID NO: 20902 - protein, 18 aa, Mycobacterium avium
LCGIVKRKGRGTPTVALL

SEQ ID NO: 20903 - protein, 19 aa, Mycobacterium avium
LDAALYGALLVLLVGALVS

SEQ ID NO: 20904 - protein, 21 aa, Mycobacterium avium
LDAAPAVLPPMGPKLGLKAQR

SEQ ID NO: 20905 - protein, 26 aa, Mycobacterium avium
LDETAGFAIPFLPRGLNEIPRSPKDQ

SEQ ID NO: 20906 - protein, 33 aa, Mycobacterium avium
LDGLRPYFTGYLPTLMLAAILTPATVAVIAAYD

SEQ ID NO: 20907 - protein, 23 aa, Mycobacterium avium
LDPDGLLDPVLRWQARVIRMDGR

SEQ ID NO: 20908 - protein, 21 aa, Mycobacterium avium
LDREIVVTRYLTVPAEDAGPR

SEQ ID NO: 20909 - protein, 20 aa, Mycobacterium avium
LDRLTLFITGIWLVCIIGMA

SEQ ID NO: 20910 - protein, 30 aa, Mycobacterium avium
LEDIVRFQAEFLWRDYFPRGISDDGEEAPA

SEQ ID NO: 20911 - protein, 24 aa, Mycobacterium avium
LELRTSLLVLFALAALAVATQVSI

SEQ ID NO: 20912 - protein, 30 aa, Mycobacterium avium
LEVGGRALLFLPPAWLLGTTMLGLSKILDN

SEQ ID NO: 20913 - protein, 28 aa, Mycobacterium avium
LFERVITGLLLVIAIGFAASFFVKTAPP

SEQ ID NO: 20914 - protein, 36 aa, Mycobacterium avium
LFGVLAFLLLPILVVIWLSLCRWDLLGPLRFVGLSN

SEQ ID NO: 20915 - protein, 25 aa, Mycobacterium avium
LFRMSLRDTRWWLGGLAAITNYSLQ

SEQ ID NO: 20916 - protein, 18 aa, Mycobacterium avium
LFTLGIVVLYRVGAALPS

SEQ ID NO: 20917 - protein, 36 aa, Mycobacterium avium
LGAGPVARLWRGLLLFFSRWWQLETLYRSNMKYQPD

SEQ ID NO: 20918 - protein, 19 aa, Mycobacterium avium
LGAVVVGILFLLWERFART

SEQ ID NO: 20919 - protein, 19 aa, Mycobacterium avium
LGFGGMSEVHLARDVRLHR

SEQ ID NO: 20920 - protein, 26 aa, Mycobacterium avium
LGFTATWYTLLFGFTAFAVGLMALWL

SEQ ID NO: 20921 - protein, 24 aa, Mycobacterium avium
LGGILAFVVLQFIDGLPGLTEQVT

SEQ ID NO: 20922 - protein, 18 aa, Mycobacterium avium
LGKWWRETRFQAYQGVSM

SEQ ID NO: 20923 - protein, 21 aa, Mycobacterium avium
LGLAEILWDVIPFDWANDSNT

SEQ ID NO: 20924 - protein, 20 aa, Mycobacterium avium
LHHRTVWTVIAILALFGWPQ

SEQ ID NO: 20925 - protein, 19 aa, Mycobacterium avium
LHSSLLVAYLALIVGLGFG

SEQ ID NO: 20926 - protein, 40 aa, Mycobacterium avium
LHWAALRALLVLTVITGLAYPLLVWVVAQFPGLRDHAEGS

SEQ ID NO: 20927 - protein, 26 aa, Mycobacterium avium
LIAAYGYWLIHYWRQDVLSQKHNVLG

SEQ ID NO: 20928 - protein, 19 aa, Mycobacterium avium
LIAIERITRHIMAVPGVRA

SEQ ID NO: 20929 - protein, 21 aa, Mycobacterium avium
LIGMVLFTLWPFTRLVHVFSA

SEQ ID NO: 20930 - protein, 22 aa, Mycobacterium avium
LILALLAFRHFGQGYAILLLAI

SEQ ID NO: 20931 - protein, 17 aa, Mycobacterium avium
LILPILNIYRKYYGTRM

SEQ ID NO: 20932 - protein, 17 aa, Mycobacterium avium
LILRLVLGVTLAAHGYN

SEQ ID NO: 20933 - protein, 19 aa, Mycobacterium avium
LIPANWRTFTLADVAVIFG

SEQ ID NO: 20934 - protein, 18 aa, Mycobacterium avium
LIPRMVMAAAILAAFFVV

SEQ ID NO: 20935 - protein, 30 aa, Mycobacterium avium
LIVAALAARRVLWLFKLITSGKPAPGHTDD

SEQ ID NO: 20936 - protein, 26 aa, Mycobacterium avium
LIVALIGTIVMLYVSGVRSLSTGFFP

SEQ ID NO: 20937 - protein, 20 aa, Mycobacterium avium
LKAHPVIGPWLDRLQAFNVF

SEQ ID NO: 20938 - protein, 21 aa, Mycobacterium avium
LKGNWYLLGPAFVAAIAYVDP

SEQ ID NO: 20939 - protein, 25 aa, Mycobacterium avium
LKGPILQWWITWVCSYAVSVSAIAT

SEQ ID NO: 20940 - protein, 28 aa, Mycobacterium avium
LKTKPSVAPWVALRLLPQGPTLSRADAL

SEQ ID NO: 20941 - protein, 20 aa, Mycobacterium avium
LLAALLAGLGLLPKAKSYVG

SEQ ID NO: 20942 - protein, 19 aa, Mycobacterium avium
LLAISFVVLLILRVVGGRA

SEQ ID NO: 20943 - protein, 27 aa, Mycobacterium avium
LLAVCGRRLFWPFIPVDRPATESGAWR

SEQ ID NO: 20944 - protein, 19 aa, Mycobacterium avium
LLAVTAARWPGRTAIIDDD

SEQ ID NO: 20945 - protein, 29 aa, Mycobacterium avium
LLDTASIVGWLWPLWDSRRRTFADMLAGT

SEQ ID NO: 20946 - protein, 24 aa, Mycobacterium avium
LLERVLANLIDNALRYAPNCVVRV

SEQ ID NO: 20947 - protein, 31 aa, Mycobacterium avium
LLGGYFTDYLSWRWAFWVNVPVSVIVIFVAA

SEQ ID NO: 20948 - protein, 25 aa, Mycobacterium avium
LLNGFEPLFTLLNPKDADDLTKGVL

SEQ ID NO: 20949 - protein, 29 aa, Mycobacterium avium
LLPAFIALFGIVAALFLVGFRPWAHRDGG

SEQ ID NO: 20950 - protein, 24 aa, Mycobacterium avium
LLQMAFRFWAFRRWVFPDQFARDP

SEQ ID NO: 20951 - protein, 51 aa, Mycobacterium avium
LLRALHVILGWRPVLLIPFTFALFTPLAVPGFAWWAAALNSLPLLAALAWV

SEQ ID NO: 20952 - protein, 17 aa, Mycobacterium avium
LLRTWRLRAVGAAFLSS

SEQ ID NO: 20953 - protein, 18 aa, Mycobacterium avium
LLSFERWAPDMPWEVSTG

SEQ ID NO: 20954 - protein, 32 aa, Mycobacterium avium
LLVAGISCLILIFTIMLIITRSVVAALVIVGT

SEQ ID NO: 20955 - protein, 19 aa, Mycobacterium avium
LLVALPLAGMRIGFNEPAA

SEQ ID NO: 20956 - protein, 17 aa, Mycobacterium avium
LLVLYTATGRYAGALGA

SEQ ID NO: 20957 - protein, 25 aa, Mycobacterium avium
LLVQGLYRWFPPITVWTGLSLLAVA

SEQ ID NO: 20958 - protein, 17 aa, Mycobacterium avium
LLVSRLKEEIPAGLNTG

SEQ ID NO: 20959 - protein, 17 aa, Mycobacterium avium
LLVYLLFVFTQTVRHRD

SEQ ID NO: 20960 - protein, 17 aa, Mycobacterium avium
LPFALPTIVASLVMLAL

SEQ ID NO: 20961 - protein, 27 aa, Mycobacterium avium
LPGPAWLRRWWLAVVVAAAATIWLEPI

SEQ ID NO: 20962 - protein, 29 aa, Mycobacterium avium
LPILVAVGPWLFLRLRFFRRKLTVTALAA

SEQ ID NO: 20963 - protein, 18 aa, Mycobacterium avium
LPPEIFQNPDFQLGLSLM

SEQ ID NO: 20964 - protein, 19 aa, Mycobacterium avium
LPTEIYWRRRGLAVGIAVV

SEQ ID NO: 20965 - protein, 17 aa, Mycobacterium avium
LPTLAVAIPLTVLIIFT

SEQ ID NO: 20966 - protein, 36 aa, Mycobacterium avium
LPTPLSIPPPEGKPWWLVVVGVLVVGLLIGMVGMTF

SEQ ID NO: 20967 - protein, 29 aa, Mycobacterium avium
LPVVGWWLYDIFYITPFLAIPYLHTVNRE

SEQ ID NO: 20968 - protein, 19 aa, Mycobacterium avium
LQIDTELLGGLLIAVADEV

SEQ ID NO: 20969 - protein, 19 aa, Mycobacterium avium
LQINPIWNLGPYKPSHVSA

SEQ ID NO: 20970 - protein, 19 aa, Mycobacterium avium
LQLKIQPGPFRYLPSNLEA

SEQ ID NO: 20971 - protein, 25 aa, Mycobacterium avium
LQRITWIITMYLLGYIAAMPLLGRA

SEQ ID NO: 20972 - protein, 20 aa, Mycobacterium avium
LRELTSKVLPLTLAGGAAVS

SEQ ID NO: 20973 - protein, 24 aa, Mycobacterium avium
LRGRRAIMLPAGALVYIALPPSRD

SEQ ID NO: 20974 - protein, 18 aa, Mycobacterium avium
LRNALFDAFGPKGADGKP

SEQ ID NO: 20975 - protein, 28 aa, Mycobacterium avium
LRPDRNLYVPLAFHLGYHSVPIGGVMPG

SEQ ID NO: 20976 - protein, 26 aa, Mycobacterium avium
LRTPELYVWVLLAIAATAWEQSAFRA

SEQ ID NO: 20977 - protein, 35 aa, Mycobacterium avium
LSAAINFVIIAAVVYFLVVLPYTTLRKRGEVEPAD

SEQ ID NO: 20978 - protein, 27 aa, Mycobacterium avium
LSAFTLIPYGLVLLQLRVFYAREQPWT

SEQ ID NO: 20979 - protein, 48 aa, Mycobacterium avium
LSIMACGYILASLHWYTWIAFSGWVLLALIFYFVWGRHHSALNDAAVD

SEQ ID NO: 20980 - protein, 22 aa, Mycobacterium avium
LSLDWLVFGKNWMDGWNGLLIS

SEQ ID NO: 20981 - protein, 20 aa, Mycobacterium avium
LSPSYSILAIGDPPTLAAAM

SEQ ID NO: 20982 - protein, 25 aa, Mycobacterium avium
LSSAVLVLLYWQWRTMPAVIWEVTA

SEQ ID NO: 20983 - protein, 18 aa, Mycobacterium avium
LSSLLLAAGLSWAAIQLA

SEQ ID NO: 20984 - protein, 25 aa, Mycobacterium avium
LSVLVWQYLLHMQLHWTVLSTSVIV

SEQ ID NO: 20985 - protein, 27 aa, Mycobacterium avium
LTARKRIAWLLLLGNMILAAALNVADI

SEQ ID NO: 20986 - protein, 29 aa, Mycobacterium avium
LTDVSWRLAFLVNVPIGLAVIYLVLITRQ

SEQ ID NO: 20987 - protein, 23 aa, Mycobacterium avium
LTGGLQKPILWGPGKAAAVQRFA

SEQ ID NO: 20988 - protein, 27 aa, Mycobacterium avium
LTIYAYHLAAFLAICYLIPAAKPRSSD

SEQ ID NO: 20989 - protein, 19 aa, Mycobacterium avium
LTSAWYRLPAPDDGHPLVV

SEQ ID NO: 20990 - protein, 19 aa, Mycobacterium avium
LTTRFLITATGFLSQPHTP

SEQ ID NO: 20991 - protein, 25 aa, Mycobacterium avium
LTVAFAYLLLPQVLAYGLTSVFMAI

SEQ ID NO: 20992 - protein, 17 aa, Mycobacterium avium
LTVIAVLVYLYTVVLFA

SEQ ID NO: 20993 - protein, 30 aa, Mycobacterium avium
LTVLYGLVDTMFIPRFLFGVSFCGVLVATA

SEQ ID NO: 20994 - protein, 17 aa, Mycobacterium avium
LTWAQLYQRTSNLAREV

SEQ ID NO: 20995 - protein, 23 aa, Mycobacterium avium
LVAAGACYLILTVPLTHLVNMID

SEQ ID NO: 20996 - protein, 34 aa, Mycobacterium avium
LVAGIPLAHWEFYMALAYFKLAIIAAGIDFRRRM

SEQ ID NO: 20997 - protein, 28 aa, Mycobacterium avium
LVALIALFPPYIMWAPNAIWKAFDLFVG

SEQ ID NO: 20998 - protein, 31 aa, Mycobacterium avium
LVARPVRPPRGWLLPLAGTAAALLMVTAVTL

SEQ ID NO: 20999 - protein, 19 aa, Mycobacterium avium
LVCFLLIITIPFGFASLRI

SEQ ID NO: 21000 - protein, 22 aa, Mycobacterium avium
LVGFVLALFLREIPLRDIHDST

SEQ ID NO: 21001 - protein, 49 aa, Mycobacterium avium
LVGGFFRMCVLTGKALFRWPFQWREFVLQCWFIMRVAFLPTIMVSIPLT

SEQ ID NO: 21002 - protein, 24 aa, Mycobacterium avium
LVGLVTCWLLLGVPFGIAAVVTGD

SEQ ID NO: 21003 - protein, 24 aa, Mycobacterium avium
LVLGATILVLLRAFANGGSSLTGV

SEQ ID NO: 21004 - protein, 18 aa, Mycobacterium avium
LVLGWRTARRWRRGAAVL

SEQ ID NO: 21005 - protein, 19 aa, Mycobacterium avium
LVSTRILGGLAVIVPLYAL

SEQ ID NO: 21006 - protein, 25 aa, Mycobacterium avium
LVTALQVTALLFALPLYARLAHQRI

SEQ ID NO: 21007 - protein, 27 aa, Mycobacterium avium
LVTRPSTFLWLIAAVGTLLVVAGRMDP

SEQ ID NO: 21008 - protein, 34 aa, Mycobacterium avium
LVVQPTFLYELLWNLLIFVALLYADRRLTLGHGR

SEQ ID NO: 21009 - protein, 18 aa, Mycobacterium avium
LVWTVLRNLPAFPLFPTV

SEQ ID NO: 21010 - protein, 27 aa, Mycobacterium avium
LVYAVLAVVWFFLLKRYTVEGPLEHDA

SEQ ID NO: 21011 - protein, 22 aa, Mycobacterium avium
LWSLFWEVMCYLVVAAIGVAGL

SEQ ID NO: 21012 - protein, 20 aa, Mycobacterium avium
LWTGVGLMLIAWLSLGRRVL

SEQ ID NO: 21013 - protein, 18 aa, Mycobacterium avium
LYMSFQRWDVFTPPKFVG

SEQ ID NO: 21014 - protein, 18 aa, Mycobacterium avium
MAFGMWAFFAALGSGPIS

SEQ ID NO: 21015 - protein, 21 aa, Mycobacterium avium
MAGLLVSLLVRRRRVWVRLTP

SEQ ID NO: 21016 - protein, 21 aa, Mycobacterium avium
MANYYRWFGTPEAPFGWYYDL

SEQ ID NO: 21017 - protein, 27 aa, Mycobacterium avium
MATMSQLLYLRVPALNALFPDYRGSVL

SEQ ID NO: 21018 - protein, 18 aa, Mycobacterium avium
MCALTTGYTYFHSDRRAL

SEQ ID NO: 21019 - protein, 25 aa, Mycobacterium avium
MFGSPYAIFLLREHFRMIPNDLVNA

SEQ ID NO: 21020 - protein, 37 aa, Mycobacterium avium
MFRMPIFTWNILVTSILILIAFPILTAALFGLAADRH

SEQ ID NO: 21021 - protein, 18 aa, Mycobacterium avium
MGLPCSVGMLISVFIALT

SEQ ID NO: 21022 - protein, 26 aa, Mycobacterium avium
MGRRKFLPPFATWYAANLFAIVPLRN

SEQ ID NO: 21023 - protein, 23 aa, Mycobacterium avium
MGVVTVLWVLYGYSVAFGDDVGN

SEQ ID NO: 21024 - protein, 20 aa, Mycobacterium avium
MIGLALAIALTGWRVIRAKI

SEQ ID NO: 21025 - protein, 30 aa, Mycobacterium avium
MIRALPHLGLIPLFILWFGIGELPKVLLVA

SEQ ID NO: 21026 - protein, 23 aa, Mycobacterium avium
MLEWAPECFGTPGDLKLAALAIS

SEQ ID NO: 21027 - protein, 25 aa, Mycobacterium avium
MLLCLFGMLVILLRRGHVPGVASGP

SEQ ID NO: 21028 - protein, 35 aa, Mycobacterium avium
MLVGTPAMWWLAVPVLVFALWRMLVRRDWRYAAVL

SEQ ID NO: 21029 - protein, 24 aa, Mycobacterium avium
MNATQLVIGTSRRSRWARLFEEGI

SEQ ID NO: 21030 - protein, 18 aa, Mycobacterium avium
MNLGSWILSAFSAGISVA

SEQ ID NO: 21031 - protein, 25 aa, Mycobacterium avium
MPAPMRPLLAARPDAYRKLIDLTLW

SEQ ID NO: 21032 - protein, 17 aa, Mycobacterium avium
MPLFERLGRRFPKHFGP

SEQ ID NO: 21033 - protein, 26 aa, Mycobacterium avium
MPWTQWLTWPFQAVPTFFLVAGYAGA

SEQ ID NO: 21034 - protein, 18 aa, Mycobacterium avium
MQSTILPDAARLYQATSK

SEQ ID NO: 21035 - protein, 17 aa, Mycobacterium avium
MSDLLIAAIAAFVLIFL

SEQ ID NO: 21036 - protein, 38 aa, Mycobacterium avium
MSEDQPWQPYFLGNPLYAFLLMVLFQYGVALHELETER

SEQ ID NO: 21037 - protein, 17 aa, Mycobacterium avium
MSEVHLARDVRLHRDVA

SEQ ID NO: 21038 - protein, 42 aa, Mycobacterium avium
MSLSGFEHSWFFLFLLVVAGLAALYILMQLARQRRMLRFANM

SEQ ID NO: 21039 - protein, 21 aa, Mycobacterium avium
MSRFWQRMFLTIGILVAVFGM

SEQ ID NO: 21040 - protein, 31 aa, Mycobacterium avium
MSTSAYDIGLFYRYAWQNPTFADIVATRTFD

SEQ ID NO: 21041 - protein, 25 aa, Mycobacterium avium
MTIPIAVFMGCYLRFLRPGRVAEVS

SEQ ID NO: 21042 - protein, 27 aa, Mycobacterium avium
MTTWYAAMLFAVVPLRNALPGSPPFGS

SEQ ID NO: 21043 - protein, 19 aa, Mycobacterium avium
MVEDLPHPWLDAVGIPDRV

SEQ ID NO: 21044 - protein, 35 aa, Mycobacterium avium
MVGALADWFAVTALFRHPLGIPIPHTAIIKRKKDQ

SEQ ID NO: 21045 - protein, 19 aa, Mycobacterium avium
MVQLLGRINAELAVYTGLI

SEQ ID NO: 21046 - protein, 43 aa, Mycobacterium avium
NADVLRMVIGGAALALLGVRRYVFARPPLLGPSGRLFATGVTV

SEQ ID NO: 21047 - protein, 24 aa, Mycobacterium avium
NALIGFVVLGFALFWAGRGQADEI

SEQ ID NO: 21048 - protein, 19 aa, Mycobacterium avium
NAQAAWTSPLLPTADELAD

SEQ ID NO: 21049 - protein, 21 aa, Mycobacterium avium
NCLDVTRWQRAGWRVYRLGAP

SEQ ID NO: 21050 - protein, 30 aa, Mycobacterium avium
NCTIKVMVGFLFLYPAFVAKAHQANGWAQL

SEQ ID NO: 21051 - protein, 17 aa, Mycobacterium avium
NEAWRSDQFVLDATRVT

SEQ ID NO: 21052 - protein, 23 aa, Mycobacterium avium
NEGRGDFFAVVRSLALFVNALHQ

SEQ ID NO: 21053 - protein, 20 aa, Mycobacterium avium
NETLVLCVIALFAVNVVLTT

SEQ ID NO: 21054 - protein, 28 aa, Mycobacterium avium
NFDYRVFALLIFLNALGGGLFAAPNTAV

SEQ ID NO: 21055 - protein, 23 aa, Mycobacterium avium
NFEKFAWLFMRFSGVALFVLAIG

SEQ ID NO: 21056 - protein, 19 aa, Mycobacterium avium
NFVVALLLRSHSSGSLAVK

SEQ ID NO: 21057 - protein, 29 aa, Mycobacterium avium
NGEQLLLTMFIPITLLVGLTLLPLGSFGQ

SEQ ID NO: 21058 - protein, 26 aa, Mycobacterium avium
NGFIGKWPAELGGQPALWIPGSSVSA

SEQ ID NO: 21059 - protein, 29 aa, Mycobacterium avium
NGINRILQFITYLLVPAGLLTIYTQLFTT

SEQ ID NO: 21060 - protein, 17 aa, Mycobacterium avium
NGLPFLARLIYGRRVVV

SEQ ID NO: 21061 - protein, 28 aa, Mycobacterium avium
NGLSAFYYALLLLLAGFTGSIVVSTLVD

SEQ ID NO: 21062 - protein, 24 aa, Mycobacterium avium
NIMALYLWHMIPVVIVAIVGYPAG

SEQ ID NO: 21063 - protein, 27 aa, Mycobacterium avium
NIRLTQWFLLMMAFGSLFMAAGKRYAE

SEQ ID NO: 21064 - protein, 20 aa, Mycobacterium avium
NIVGQRYLGLSLGKEGNPAQ

SEQ ID NO: 21065 - protein, 21 aa, Mycobacterium avium
NLFAIVPLRNILPGAPPPGSW

SEQ ID NO: 21066 - protein, 29 aa, Mycobacterium avium
NLPAGFAIGWAMWPLVACVVLQAIAAVVV

SEQ ID NO: 21067 - protein, 27 aa, Mycobacterium avium
NLRSQPVPFIMNQPPPPPGPVPGPGQP

SEQ ID NO: 21068 - protein, 25 aa, Mycobacterium avium
NNLPATLVLLPLVAPAGPVAVLAVL

SEQ ID NO: 21069 - protein, 32 aa, Mycobacterium avium
NNRFFPPMGSILYWMRFGTIRLPPWPDRVPFT

SEQ ID NO: 21070 - protein, 17 aa, Mycobacterium avium
NNTALRWAQNALSFVGF

SEQ ID NO: 21071 - protein, 22 aa, Mycobacterium avium
NNTILMVFGYLFAAATLAAATR

SEQ ID NO: 21072 - protein, 25 aa, Mycobacterium avium
NPLNWPPAFFSWFAAGMLLAEWVHG

SEQ ID NO: 21073 - protein, 33 aa, Mycobacterium avium
NQGSILGELLVYVLPLLLLVGLFVMFSRMQGGA

SEQ ID NO: 21074 - protein, 28 aa, Mycobacterium avium
NRGEGQLWNVWLPLVIAGFAVACALSAL

SEQ ID NO: 21075 - protein, 24 aa, Mycobacterium avium
NRKRVVAVSFPRDLAITPMQCEAW

SEQ ID NO: 21076 - protein, 19 aa, Mycobacterium avium
NRLVTFIAIFLAGGVMFTL

SEQ ID NO: 21077 - protein, 28 aa, Mycobacterium avium
NRRNLTLYVTALLFVLAWATSGINGWFY

SEQ ID NO: 21078 - protein, 26 aa, Mycobacterium avium
NSAITELVLLLIAVAVAVLVDFAAKR

SEQ ID NO: 21079 - protein, 25 aa, Mycobacterium avium
NSANILMLVLLLAGFGWMVSSRMVR

SEQ ID NO: 21080 - protein, 26 aa, Mycobacterium avium
NSVDAVWHQLMPRYTRPHVRLFTGRV

SEQ ID NO: 21081 - protein, 37 aa, Mycobacterium avium
NTFLNPIDLLWSFLQAILMALTILLIHTYYGYFASGG

SEQ ID NO: 21082 - protein, 28 aa, Mycobacterium avium
NTLATLSLVFAFLFAPAGAVLGHLGLAQ

SEQ ID NO: 21083 - protein, 26 aa, Mycobacterium avium
NTLTLLRLVLVPVFLLALFAGDGHET

SEQ ID NO: 21084 - protein, 20 aa, Mycobacterium avium
NTRLTALAAVLLSLVALVKD

SEQ ID NO: 21085 - protein, 28 aa, Mycobacterium avium
NVAAGNPWWANWFPTTKNPPEAPRYFWR

SEQ ID NO: 21086 - protein, 34 aa, Mycobacterium avium
NVPVSPVPLRNMVIGFIAGLLLAIAVALTREAGD

SEQ ID NO: 21087 - protein, 26 aa, Mycobacterium avium
NVTMLVFATAFFGAGLLLPSYFQQVL

SEQ ID NO: 21088 - protein, 18 aa, Mycobacterium avium
NWVAGLIVGTLLLLSGIL

SEQ ID NO: 21089 - protein, 26 aa, Mycobacterium avium
NYGMGLLWTLVLLIPVLYVNQEMVLR

SEQ ID NO: 21090 - protein, 23 aa, Mycobacterium avium
PAARLWDVGIAAVSLLGLGALLG

SEQ ID NO: 21091 - protein, 26 aa, Mycobacterium avium
PADLTSPVAFLQRPARWIQAMSRADP

SEQ ID NO: 21092 - protein, 25 aa, Mycobacterium avium
PAEFSKILLLIFFSAVLIAKRGLFT

SEQ ID NO: 21093 - protein, 22 aa, Mycobacterium avium
PAGDLSIWPPIGATAVDVTGGY

SEQ ID NO: 21094 - protein, 34 aa, Mycobacterium avium
PALRDMTYLGLPPFYPPGWFWIGGRAAALSGTPA

SEQ ID NO: 21095 - protein, 21 aa, Mycobacterium avium
PATCWWWQKTSGENRARVQVV

SEQ ID NO: 21096 - protein, 29 aa, Mycobacterium avium
PAVGRVLIMALLMLQLVSAGGMYPVETTS

SEQ ID NO: 21097 - protein, 26 aa, Mycobacterium avium
PDDPALRATLLYPRGTVVMATEGPNT

SEQ ID NO: 21098 - protein, 26 aa, Mycobacterium avium
PDEAAQILALLLPAAAFMGTALTIRD

SEQ ID NO: 21099 - protein, 21 aa, Mycobacterium avium
PDRGLRREALERGWPVMSFSR

SEQ ID NO: 21100 - protein, 25 aa, Mycobacterium avium
PDRRGDLAMTWLLAGLVAGVLSGAV

SEQ ID NO: 21101 - protein, 26 aa, Mycobacterium avium
PEAGFRFLLYGFLCCAAFLVVRIEER

SEQ ID NO: 21102 - protein, 24 aa, Mycobacterium avium
PEDKRLPTVLFQTTVSKLRDLLAA

SEQ ID NO: 21103 - protein, 32 aa, Mycobacterium avium
PEGKMAAVAKRRGWPILRFSSRGPVGLRRQLR

SEQ ID NO: 21104 - protein, 19 aa, Mycobacterium avium
PEKFWQSFFLVDHPGWSVL

SEQ ID NO: 21105 - protein, 24 aa, Mycobacterium avium
PFGEYLPMPWLFKHLSGYADRAGA

SEQ ID NO: 21106 - protein, 19 aa, Mycobacterium avium
PFLVQYLRYLGGVLRGDLG

SEQ ID NO: 21107 - protein, 29 aa, Mycobacterium avium
PFRRRNPRPAIVVVSLLAVATAVIWTVAL

SEQ ID NO: 21108 - protein, 22 aa, Mycobacterium avium
PGAMMAGRLLVPVTGAIGVYDP

SEQ ID NO: 21109 - protein, 30 aa, Mycobacterium avium
PGANFVICLVLLYAIALIWGLPNLHPPTKA

SEQ ID NO: 21110 - protein, 21 aa, Mycobacterium avium
PGAPLLWDLVVTLSASWQKIF

SEQ ID NO: 21111 - protein, 25 aa, Mycobacterium avium
PGARTALTVLLFTSLAIAITVQVLA

SEQ ID NO: 21112 - protein, 17 aa, Mycobacterium avium
PGNLERYGLRGSTLSVA

SEQ ID NO: 21113 - protein, 33 aa, Mycobacterium avium
PGNLNMVRLWWDKPWPMRIAALARLPLQIPMIT

SEQ ID NO: 21114 - protein, 23 aa, Mycobacterium avium
PGNPLQFPNALLHKVTASLTEQF

SEQ ID NO: 21115 - protein, 17 aa, Mycobacterium avium
PGPRFLDAPGQPAGMVA

SEQ ID NO: 21116 - protein, 22 aa, Mycobacterium avium
PGQTWVLVFAVTMMAGLLVSLL

SEQ ID NO: 21117 - protein, 19 aa, Mycobacterium avium
PGYPPPYPPPAPSPVPPPP

SEQ ID NO: 21118 - protein, 24 aa, Mycobacterium avium
PHVFLNAIFGLFGALALIMATIVL

SEQ ID NO: 21119 - protein, 19 aa, Mycobacterium avium
PIGDWMAALFFVAVAASSV

SEQ ID NO: 21120 - protein, 46 aa, Mycobacterium avium
PILGGWLIGAYGWKWIFLINLPIGLTAFALAALLFPKDRSAPSEAL

SEQ ID NO: 21121 - protein, 27 aa, Mycobacterium avium
PIRPVAPEAYALYGLSRVMPQGLRNAA

SEQ ID NO: 21122 - protein, 20 aa, Mycobacterium avium
PIRSYFYWEKHCYDIPVCWA

SEQ ID NO: 21123 - protein, 31 aa, Mycobacterium avium
PKFIGAGLLILVILAVALFPALFTAADPTYA

SEQ ID NO: 21124 - protein, 25 aa, Mycobacterium avium
PLANPAHYFIIIGLFGVFLGGMVSV

SEQ ID NO: 21125 - protein, 30 aa, Mycobacterium avium; identical to SEQ ID NO: 11909

SEQ ID NO: 21126 - protein, 20 aa, Mycobacterium avium
PLEHCYAYSDSITDLPMLEA

SEQ ID NO: 21127 - protein, 27 aa, Mycobacterium avium
PLEWNVFFIFSLFYLFGHYAGVTATGL

SEQ ID NO: 21128 - protein, 22 aa, Mycobacterium avium
PLFVGVLGLLLATGWVANHFVG

SEQ ID NO: 21129 - protein, 17 aa, Mycobacterium avium
PLIVVLAVIGVIYGAIV

SEQ ID NO: 21130 - protein, 26 aa, Mycobacterium avium
PLMDTALLHERWGFRPAWQCGECVED

SEQ ID NO: 21131 - protein, 18 aa, Mycobacterium avium
PLPSHRLILGAMLATTVF

SEQ ID NO: 21132 - protein, 26 aa, Mycobacterium avium
PLPVQRPIPVWFGAASDRAFERAGRL

SEQ ID NO: 21133 - protein, 20 aa, Mycobacterium avium
PLREILPAVQRLVVPAAANG

SEQ ID NO: 21134 - protein, 39 aa, Mycobacterium avium
PLSDGLTPWIAAPLLFIGFMFGLLLLTGTTIRELPVVMR

SEQ ID NO: 21135 - protein, 30 aa, Mycobacterium avium
PMNVLVTTARDFVYLIDFGLARAQADTALT

SEQ ID NO: 21136 - protein, 23 aa, Mycobacterium avium
PMTSFHLIIAIAGLLTTLGLIMV

SEQ ID NO: 21137 - protein, 29 aa, Mycobacterium avium
PNALAGLNLPAWGSLRLALPMTGNGDAAF

SEQ ID NO: 21138 - protein, 26 aa, Mycobacterium avium
PNTNVTVLLPRRTFARLLGRLLHDRT

SEQ ID NO: 21139 - protein, 37 aa, Mycobacterium avium
PPAGRNYLPPLLGLATILIIGLIFAVAVGLFQGSFTE

SEQ ID NO: 21140 - protein, 26 aa, Mycobacterium avium
PPLPAALLRVWPFIALGALGWLAAVG

SEQ ID NO: 21141 - protein, 20 aa, Mycobacterium avium
PPLPMLVVVIDEFYEWFRIM

SEQ ID NO: 21142 - protein, 18 aa, Mycobacterium avium
PPLPVLEDLPRRVRIGDA

SEQ ID NO: 21143 - protein, 18 aa, Mycobacterium avium
PPSPRAVLRLLREASRGG

SEQ ID NO: 21144 - protein, 26 aa, Mycobacterium avium
PPTAIPLRHDGLSYRFPFHTEKKTYP

SEQ ID NO: 21145 - protein, 24 aa, Mycobacterium avium
PPVDPASRREFGRPAGLRGSFVAE

SEQ ID NO: 21146 - protein, 24 aa, Mycobacterium avium
PQERRLVFERFYRSTSARAMPGSG

SEQ ID NO: 21147 - protein, 18 aa, Mycobacterium avium
PQFSLWLVPLAVLALPHR

SEQ ID NO: 21148 - protein, 20 aa, Mycobacterium avium
PQLRRVLFAPQTVGAPGGGI

SEQ ID NO: 21149 - protein, 21 aa, Mycobacterium avium
PQPAWRNLRFPLAWAPPEANV

SEQ ID NO: 21150 - protein, 34 aa, Mycobacterium avium
PQPQQPWVAPVAPKAPWIPQSSFRPSFGGNVGPV

SEQ ID NO: 21151 - protein, 24 aa, Mycobacterium avium
PQTEFNVSLPWSKVVVLEPGVQTE

SEQ ID NO: 21152 - protein, 19 aa, Mycobacterium avium
PRAFARALGQALRLSYMIL

SEQ ID NO: 21153 - protein, 31 aa, Mycobacterium avium
PRDRDTWMVIDEKPWFFALTDHLSVAEAEEF

SEQ ID NO: 21154 - protein, 20 aa, Mycobacterium avium
PRKVSFLPGMRYYAGNWDTT

SEQ ID NO: 21155 - protein, 32 aa, Mycobacterium avium
PRLARTIRVLALPIVLGWLVLAVGVNVFVPQL

SEQ ID NO: 21156 - protein, 26 aa, Mycobacterium avium
PRLIDAYVDWLWFGELGYRSVFSTVL

SEQ ID NO: 21157 - protein, 24 aa, Mycobacterium avium
PRMRGWIHFYSAWLAVITGATLVS

SEQ ID NO: 21158 - protein, 17 aa, Mycobacterium avium
PRYLCFTAPAMALILGV

SEQ ID NO: 21159 - protein, 38 aa, Mycobacterium avium
PSAISAMLIYRLISWLLIAAVGWVVFFFVFRTENIADS

SEQ ID NO: 21160 - protein, 26 aa, Mycobacterium avium
PSGMVPVFFVLWALSNFAGPLLLGHL

SEQ ID NO: 21161 - protein, 22 aa, Mycobacterium avium
PSHTRGYIATALRLLERKIAHL

SEQ ID NO: 21162 - protein, 28 aa, Mycobacterium avium
PSIAALLGKWFWWPQRVRQRPVPSPWPK

SEQ ID NO: 21163 - protein, 30 aa, Mycobacterium avium
PSLADPNPPLPWWPWQIGPAPRVPGTADPD

SEQ ID NO: 21164 - protein, 18 aa, Mycobacterium avium
PSRPLPAETFTTVTSPSA

SEQ ID NO: 21165 - protein, 24 aa, Mycobacterium avium
PSSLAFLGGWLLSLAALTALAVAA

SEQ ID NO: 21166 - protein, 28 aa, Mycobacterium avium
PSVAALLGRWFWWPQRVRPRPASTMLRP

SEQ ID NO: 21167 - protein, 22 aa, Mycobacterium avium
PSVICAVTVTWLDPYLDTGGES

SEQ ID NO: 21168 - protein, 33 aa, Mycobacterium avium
PTFFSQLRTADWWWALLGLLVSALTYVGAAAAL

SEQ ID NO: 21169 - protein, 20 aa, Mycobacterium avium
PTQPDYGAPAGWRAPGWPPQ

SEQ ID NO: 21170 - protein, 19 aa, Mycobacterium avium
PTRWRAQDLLILTLGTHKL

SEQ ID NO: 21171 - protein, 19 aa, Mycobacterium avium
PTWSPRFIDHLVGDRIHRE

SEQ ID NO: 21172 - protein, 31 aa, Mycobacterium avium
PVGLSVVALLLLLGVPFLGVKWGFPDERVLP

SEQ ID NO: 21173 - protein, 26 aa, Mycobacterium avium
PVGTVALFRRLLRDRRWWTGSLVAAG

SEQ ID NO: 21174 - protein, 25 aa, Mycobacterium avium
PVIGIALLALFEIWLRNLTETEFAV

SEQ ID NO: 21175 - protein, 25 aa, Mycobacterium avium
PVLGAPLNWFPLYLGPALAVELVAL

SEQ ID NO: 21176 - protein, 19 aa, Mycobacterium avium
PVLGPYSLAITVGVVLVIC

SEQ ID NO: 21177 - protein, 27 aa, Mycobacterium avium
PVLILKGAPEVILPRCRFADPEADQQR

SEQ ID NO: 21178 - protein, 25 aa, Mycobacterium avium
PVNYLKLMPATYVVLVFVVGYMLLT

SEQ ID NO: 21179 - protein, 24 aa, Mycobacterium avium
PVRKPVEQLFWYRSSKFVMRRWAP

SEQ ID NO: 21180 - protein, 27 aa, Mycobacterium avium
PVRQRFFALFLYVVMLVGVVATAPLVV

SEQ ID NO: 21181 - protein, 20 aa, Mycobacterium avium
PVVKPAPWGHEVGAYLFLGG

SEQ ID NO: 21182 - protein, 27 aa, Mycobacterium avium
PVVLAVRPELLPALSGQNWAALPGLQT

SEQ ID NO: 21183 - protein, 27 aa, Mycobacterium avium
PWALHRPFLGWLGWPMLAVVAASQGLR

SEQ ID NO: 21184 - protein, 21 aa, Mycobacterium avium
PWIVYWVLVGNVPFVAAVLVA

SEQ ID NO: 21185 - protein, 26 aa, Mycobacterium avium
PWSNAFPAWHYAFATALLGLTVLVLL

SEQ ID NO: 21186 - protein, 27 aa, Mycobacterium avium
PYVIYQGLTMYLLLAIGWHGGEELAQV

SEQ ID NO: 21187 - protein, 17 aa, Mycobacterium avium
QADCYAGIWAHYASTVK

SEQ ID NO: 21188 - protein, 33 aa, Mycobacterium avium
QAESQLRQLLAEYLLPLCPPPRATSPPGAQATR

SEQ ID NO: 21189 - protein, 18 aa, Mycobacterium avium
QAFIFSILTILYFSQAME

SEQ ID NO: 21190 - protein, 27 aa, Mycobacterium avium
QAGLFSVVLLLLFVIAVAVWGVFDGRA

SEQ ID NO: 21191 - protein, 25 aa, Mycobacterium avium
QAIPTLLRTGLPNTLILTFSASVIG

SEQ ID NO: 21192 - protein, 30 aa, Mycobacterium avium
QDLIGLGVQWIVLPLSIVILLAVGSDYNLL

SEQ ID NO: 21193 - protein, 26 aa, Mycobacterium avium
QEAAMKYFLLGAFSSAFFLYGVALLY

SEQ ID NO: 21194 - protein, 24 aa, Mycobacterium avium
QEALIQLLADRAFQWSLNAGEVIQ

SEQ ID NO: 21195 - protein, 27 aa, Mycobacterium avium
QEYIGGAFFVLYGLVVFSLGALPDLRR

SEQ ID NO: 21196 - protein, 27 aa, Mycobacterium avium
QFMGLGWKLLIPASLVWVLIAAVIRTL

SEQ ID NO: 21197 - protein, 25 aa, Mycobacterium avium
QGALLVGVFFWFAVVGGATVVMSGG

SEQ ID NO: 21198 - protein, 20 aa, Mycobacterium avium
QGGLLDPKMLWRSTPDALRK

SEQ ID NO: 21199 - protein, 17 aa, Mycobacterium avium
QGKNFYYFPDQLSIDRY

SEQ ID NO: 21200 - protein, 17 aa, Mycobacterium avium
QGPTQPDYGAPAGWRAP

SEQ ID NO: 21201 - protein, 18 aa, Mycobacterium avium
QGRAYWIHLMMASQTIES

SEQ ID NO: 21202 - protein, 22 aa, Mycobacterium avium
QGSLLGVPLQQPYLVGCLNARN

SEQ ID NO: 21203 - protein, 32 aa, Mycobacterium avium
QGVRRVLPALVNQFIALLKASALVYFLGLVAD

SEQ ID NO: 21204 - protein, 33 aa, Mycobacterium avium
QHARSLHFLVLVYFLFFILVHVTMVLTTSALRN

SEQ ID NO: 21205 - protein, 25 aa, Mycobacterium avium
QHTVSSLVWLQIGIGVAVLAVVGIA

SEQ ID NO: 21206 - protein, 22 aa, Mycobacterium avium
QIKPTLPVLLANLTTIGQIGIT

SEQ ID NO: 21207 - protein, 18 aa, Mycobacterium avium
QILTFRTTGRRVFRMAPF

SEQ ID NO: 21208 - protein, 19 aa, Mycobacterium avium
QIVVLALVCLGITAVTELA

SEQ ID NO: 21209 - protein, 33 aa, Mycobacterium avium
QKAGQPFWTALLLAVLCTWFLQTSMCMFFKARS

SEQ ID NO: 21210 - protein, 24 aa, Mycobacterium avium
QKYVQAYYTAAPRPTPDSLPVQDA

SEQ ID NO: 21211 - protein, 19 aa, Mycobacterium avium
QLAIFLIAGTIGVISMVLF

SEQ ID NO: 21212 - protein, 31 aa, Mycobacterium avium
QLGLAALGGLPLMLGALWASARLARRADSTA

SEQ ID NO: 21213 - protein, 30 aa, Mycobacterium avium
QLISTPLDRFLDWCQEALRRNGIGNSTLRG

SEQ ID NO: 21214 - protein, 19 aa, Mycobacterium avium
QLLSYFTTVFIAAPAALIT

SEQ ID NO: 21215 - protein, 25 aa, Mycobacterium avium
QLVTLVGLLVLLKAVAYWLDRYELL

SEQ ID NO: 21216 - protein, 20 aa, Mycobacterium avium
QMGYLPCTIWIVAGAVFAGA

SEQ ID NO: 21217 - protein, 20 aa, Mycobacterium avium
QMHLDAGQQVWLITATPYEL

SEQ ID NO: 21218 - protein, 31 aa, Mycobacterium avium
QNLGYALQWPLFAWFCVYAYRKFVRYEEEPP

SEQ ID NO: 21219 - protein, 27 aa, Mycobacterium avium
QNYGYSLLWVLLLLVPVLIVNQEMVVR

SEQ ID NO: 21220 - protein, 20 aa, Mycobacterium avium
QPALWAVMVSLAELWRSVGV

SEQ ID NO: 21221 - protein, 17 aa, Mycobacterium avium
QPALWIPGSSVSAARLA

SEQ ID NO: 21222 - protein, 18 aa, Mycobacterium avium
QPIYNFVMQTRAPHHLRG

SEQ ID NO: 21223 - protein, 20 aa, Mycobacterium avium
QPNPCVYKPSGPPTAVYSPQ

SEQ ID NO: 21224 - protein, 38 aa, Mycobacterium avium
QPTGRPAWMRWLRSHYRRWGLIGVGLFQVAIAAAQISG

SEQ ID NO: 21225 - protein, 23 aa, Mycobacterium avium
QQLIERPFAYLPQRQSRPGADGF

SEQ ID NO: 21226 - protein, 24 aa, Mycobacterium avium
QQPTPPPVLAPIDLPAASAIGPGA

SEQ ID NO: 21227 - protein, 19 aa, Mycobacterium avium
QQVWLITATPYELAATIAR

SEQ ID NO: 21228 - protein, 31 aa, Mycobacterium avium
QRARKKGFLGRFWLVLTIAAVVALSGFVVYR

SEQ ID NO: 21229 - protein, 26 aa, Mycobacterium avium
QREALLLTQLLGLPYADAAAVCGCPV

SEQ ID NO: 21230 - protein, 18 aa, Mycobacterium avium
QRLTIARAILADTEILIL

SEQ ID NO: 21231 - protein, 23 aa, Mycobacterium avium
QRRNLIFVAIVLGMLLAALDQTI

SEQ ID NO: 21232 - protein, 26 aa, Mycobacterium avium
QSATTFPWVFLFPAGVLVLILVCANL

SEQ ID NO: 21233 - protein, 26 aa, Mycobacterium avium
QSQQPNYWHPPAQPPYWQQPAHGYPG

SEQ ID NO: 21234 - protein, 22 aa, Mycobacterium avium
QSVLPFNGIDFRLSPGGVTLDG

SEQ ID NO: 21235 - protein, 24 aa, Mycobacterium avium
QSYAFWDIATFLLNGSLWVFVGVQ

SEQ ID NO: 21236 - protein, 21 aa, Mycobacterium avium
QTDTLRFVGGYWQGAPEQQRV

SEQ ID NO: 21237 - protein, 25 aa, Mycobacterium avium
QTRAVWRLVNFLLEGVVFLLIGHQV

SEQ ID NO: 21238 - protein, 37 aa, Mycobacterium avium
QTVSLGIILLALLWYAGLPLRVFITSLLAVFMAGAVL

SEQ ID NO: 21239 - protein, 27 aa, Mycobacterium avium
QVATPPSHILGLLNLLTALKTGACVRL

SEQ ID NO: 21240 - protein, 28 aa, Mycobacterium avium
QVGSWFGPYRLVRLLRQGGMGEVYEAED

SEQ ID NO: 21241 - protein, 23 aa, Mycobacterium avium
QVGTWRVALLACSLITLAGTAVF

SEQ ID NO: 21242 - protein, 26 aa, Mycobacterium avium
QVGYVHSLLLAWLVDKLGRSPGFEGR

SEQ ID NO: 21243 - protein, 20 aa, Mycobacterium avium
QWKTIVHIVFPIAMPGIVSG

SEQ ID NO: 21244 - protein, 21 aa, Mycobacterium avium
QWLDVAVLAVAFIAAISGWRS

SEQ ID NO: 21245 - protein, 27 aa, Mycobacterium avium
RAAAPGAALYILAFAAGALAPAHPDRP

SEQ ID NO: 21246 - protein, 25 aa, Mycobacterium avium
RAAVKFLLYNLFGGLIMLAAVIGLY

SEQ ID NO: 21247 - protein, 22 aa, Mycobacterium avium
RAAVVLIFSMLGFAIAVLQDPV

SEQ ID NO: 21248 - protein, 24 aa, Mycobacterium avium
RADADGYFYFAGRLGAMIKTAGAN

SEQ ID NO: 21249 - protein, 20 aa, Mycobacterium avium
RADLARDPSFYLRFRREAQN

SEQ ID NO: 21250 - protein, 43 aa, Mycobacterium avium
RAERGVALWLLLGGGFGLALLLIFLFWPWEYKPKEAAGSFLYD

SEQ ID NO: 21251 - protein, 20 aa, Mycobacterium avium
RAGDTVYLVGPYRELLETLR

SEQ ID NO: 21252 - protein, 20 aa, Mycobacterium avium
RAGRRFYWATSVIGIVCFAF

SEQ ID NO: 21253 - protein, 25 aa, Mycobacterium avium
RAIEYGGQWFSWAQLGATARQVAAR

SEQ ID NO: 21254 - protein, 28 aa, Mycobacterium avium
RAKAAFIWAKFPKFVLGFLVVSAIATAG

SEQ ID NO: 21255 - protein, 23 aa, Mycobacterium avium
RAKQARTRRILLIAAGSIVAVAV

SEQ ID NO: 21256 - protein, 31 aa, Mycobacterium avium
RALAPPPPTTPPPPLTPTLSRPVTGADGLGF

SEQ ID NO: 21257 - protein, 29 aa, Mycobacterium avium
RALPTLGVLLFGTLLFGLGLGPSLVALML

SEQ ID NO: 21258 - protein, 30 aa, Mycobacterium avium
RALTSMGTALVLLFLLALGAIPGALLPQRN

SEQ ID NO: 21259 - protein, 30 aa, Mycobacterium avium
RALVGVTLSYVFILLAVVALAGWATLGGST

SEQ ID NO: 21260 - protein, 17 aa, Mycobacterium avium
RALVYGAGSLGLCAVAI

SEQ ID NO: 21261 - protein, 25 aa, Mycobacterium avium
RANGIRRIVMLTGDHPDIAAVVADE

SEQ ID NO: 21262 - protein, 17 aa, Mycobacterium avium
RAPRWPTFGITVMPSPT

SEQ ID NO: 21263 - protein, 30 aa, Mycobacterium avium
RAPVGTRQLLLVNLLTDMFPALAVAVTSQY

SEQ ID NO: 21264 - protein, 25 aa, Mycobacterium avium
RAQIRVTTILGSRYLALEPNGPARL

SEQ ID NO: 21265 - protein, 25 aa, Mycobacterium avium
RARGSPLRVMILLVLVTALASALLD

SEQ ID NO: 21266 - protein, 24 aa, Mycobacterium avium
RARRALLRLTLIEAALFGLTFGIA

SEQ ID NO: 21267 - protein, 18 aa, Mycobacterium avium
RAVATVLLVPLVGALFSG

SEQ ID NO: 21268 - protein, 27 aa, Mycobacterium avium
RAVFLGRFIALLRILAGPLAGALKMHY

SEQ ID NO: 21269 - protein, 40 aa, Mycobacterium avium
RAVILAPQGLSYIVAFLAAIQAGLIAVPLSVPQPGSHDER

SEQ ID NO: 21270 - protein, 34 aa, Mycobacterium avium
RCIDADSRLYLPMPFFWVGGFGSGILSALLAGAT

SEQ ID NO: 21271 - protein, 31 aa, Mycobacterium avium
RDDVNPMLFPAILLALTLLLVSTVIVHFSYT

SEQ ID NO: 21272 - protein, 18 aa, Mycobacterium avium
RDPSFYLRFRREAQNAAA

SEQ ID NO: 21273 - protein, 19 aa, Mycobacterium avium
RDTLLYSWVAIGADWLGVL

SEQ ID NO: 21274 - protein, 23 aa, Mycobacterium avium
REAGYVIPVIPLLAGGQLTVWLT

SEQ ID NO: 21275 - protein, 24 aa, Mycobacterium avium
REILEQIWFVARVSIFPTIMLSIP

SEQ ID NO: 21276 - protein, 23 aa, Mycobacterium avium
RENDRLLLALMPESVLQRYREGE

SEQ ID NO: 21277 - protein, 26 aa, Mycobacterium avium
REPGFSKHLVGIEPQLAFTGDNLPLL

SEQ ID NO: 21278 - protein, 17 aa, Mycobacterium avium
RFAEFWRQQHEAAEWRI

SEQ ID NO: 21279 - protein, 19 aa, Mycobacterium avium
RFPGILLIIARDATGKVQA

SEQ ID NO: 21280 - protein, 20 aa, Mycobacterium avium
RFWLNSLLLLSMGFTLVLGT

SEQ ID NO: 21281 - protein, 18 aa, Mycobacterium avium
RFWRITMPMLRPTTFFVL

SEQ ID NO: 21282 - protein, 24 aa, Mycobacterium avium
RGLRRPWLYFVSSLFTSFAFAFAF

SEQ ID NO: 21283 - protein, 25 aa, Mycobacterium avium
RGLRYTTIIALVAVLVGGVYVLTSQ

SEQ ID NO: 21284 - protein, 22 aa, Mycobacterium avium
RGMVAFLGYYKIIGLSTFATNL

SEQ ID NO: 21285 - protein, 23 aa, Mycobacterium avium
RGPVLLITALHRDFASTDTLAAL

SEQ ID NO: 21286 - protein, 18 aa, Mycobacterium avium
RGTPTVALLSLIAGVLWG

SEQ ID NO: 21287 - protein, 22 aa, Mycobacterium avium
RGVLRELLRLSGQRDWQLTELD

SEQ ID NO: 21288 - protein, 20 aa, Mycobacterium avium
RGVNFFTSTFSQLSLAIAGV

SEQ ID NO: 21289 - protein, 24 aa, Mycobacterium avium
RHADTWIMSLLYIGTFGSFIGYSA

SEQ ID NO: 21290 - protein, 30 aa, Mycobacterium avium
RHDWPFADRAFAAALPWLAGALGTPGIPRT

SEQ ID NO: 21291 - protein, 26 aa, Mycobacterium avium
RHQVSGWRFVMRRIASGIALHDTRML

SEQ ID NO: 21292 - protein, 18 aa, Mycobacterium avium
RIANFLAAARQGVVNMTS

SEQ ID NO: 21293 - protein, 25 aa, Mycobacterium avium
RILGGLAVIVPLYALALDMAFTSGQ

SEQ ID NO: 21294 - protein, 24 aa, Mycobacterium avium
RILPGFYICLIVTAFVFAPLSVVI

SEQ ID NO: 21295 - protein, 20 aa, Mycobacterium avium
RIRIQIIMTVMVLGANLIGI

SEQ ID NO: 21296 - protein, 26 aa, Mycobacterium avium
RISRAHLILRFEQGRWLAIDNGSLNG

SEQ ID NO: 21297 - protein, 35 aa, Mycobacterium avium
RISVAMPMFHGLGLGMLMLTIALGGTVLTHRHFDA

SEQ ID NO: 21298 - protein, 20 aa, Mycobacterium avium
RITRHIMAVPGVRAVQSASR

SEQ ID NO: 21299 - protein, 28 aa, Mycobacterium avium
RKIPPGSGWRKFIYTISFHKINPGESPR

SEQ ID NO: 21300 - protein, 19 aa, Mycobacterium avium
RKISFLPGMRYYAGNWDTT

SEQ ID NO: 21301 - protein, 29 aa, Mycobacterium avium
RKPVDVALYALFLLLTLAALFADGTGPVP

SEQ ID NO: 21302 - protein, 18 aa, Mycobacterium avium
RLDHLAARLRRNSANLLV

SEQ ID NO: 21303 - protein, 19 aa, Mycobacterium avium
RLFMGSVLIFTLGSLLCAV

SEQ ID NO: 21304 - protein, 20 aa, Mycobacterium avium
RLLLRVTRWDVVLAMAVAGT

SEQ ID NO: 21305 - protein, 35 aa, Mycobacterium avium
RLLQDGRDMFWSLIPLVIGCVVLAGLLGMCSLQLH

SEQ ID NO: 21306 - protein, 20 aa, Mycobacterium avium
RLPSATLLVLVGIGQALLPG

SEQ ID NO: 21307 - protein, 18 aa, Mycobacterium avium
RLPWSRFHWRVVIGLGGV

SEQ ID NO: 21308 - protein, 37 aa, Mycobacterium avium
RLQAFNVFSSFWFTAIYVLLFVSLVGCLTPRMIEHVR

SEQ ID NO: 21309 - protein, 18 aa, Mycobacterium avium
RLQLALWVTRKDLSLRPG

SEQ ID NO: 21310 - protein, 23 aa, Mycobacterium avium
RLRAGSPILFYPAGALAATVLAF

SEQ ID NO: 21311 - protein, 20 aa, Mycobacterium avium
RLRRRPKFIGAGLLILVILA

SEQ ID NO: 21312 - protein, 25 aa, Mycobacterium avium
RLSIFSVVLLIFTVMIIVVFGQMRF

SEQ ID NO: 21313 - protein, 19 aa, Mycobacterium avium
RLSWVLAVLAGVLGATAFT

SEQ ID NO: 21314 - protein, 34 aa, Mycobacterium avium
RLVVADRAYFVFLALLPFILGSLSLTVPGHNGFR

SEQ ID NO: 21315 - protein, 18 aa, Mycobacterium avium
RMPTSLSARFDRACAQSS

SEQ ID NO: 21316 - protein, 30 aa, Mycobacterium avium
RNTFLAPWRIALVDLVLWGAGTLLLTVLYG

SEQ ID NO: 21317 - protein, 39 aa, Mycobacterium avium
RPAMRAIGRISYSWYLWHWPVLLLMPALLGEPAGLPARL

SEQ ID NO: 21318 - protein, 26 aa, Mycobacterium avium
RPARPMRTWTLIPALAGAGLVTGVCS

SEQ ID NO: 21319 - protein, 20 aa, Mycobacterium avium
RPDVPIVLRIYDRTLGDAVA

SEQ ID NO: 21320 - protein, 23 aa, Mycobacterium avium
RPERFLNMLRTVKLTSPMNLGSW

SEQ ID NO: 21321 - protein, 26 aa, Mycobacterium avium
RPGEEKLVFSRFWRADPSRVRRSGGT

SEQ ID NO: 21322 - protein, 34 aa, Mycobacterium avium
RPHNLPLLFVGVGLLWFGWFGFNAGSALAANGTA

SEQ ID NO: 21323 - protein, 17 aa, Mycobacterium avium
RPIMRAATLGAEPRLAV

SEQ ID NO: 21324 - protein, 28 aa, Mycobacterium avium
RPLESYNKTWLGFVAVAVVAAVIAVMLV

SEQ ID NO: 21325 - protein, 31 aa, Mycobacterium avium
RPQRIPVPSLLRALLSEHLDPGYAAAAAKRG

SEQ ID NO: 21326 - protein, 25 aa, Mycobacterium avium
RPRYINLVVLLRITCEITATVLLVV

SEQ ID NO: 21327 - protein, 20 aa, Mycobacterium avium
RPWAIWVNLGAQAILLAGFA

SEQ ID NO: 21328 - protein, 28 aa, Mycobacterium avium
RQCMDLIFTIGGYLLLALAVNTFGVQEE

SEQ ID NO: 21329 - protein, 33 aa, Mycobacterium avium
RQLFGITEGFFSPLFFVWLGASLQVRELGAHPQ

SEQ ID NO: 21330 - protein, 27 aa, Mycobacterium avium
RQVLAPLRDLFAAIFFLAIGYSVDPHE

SEQ ID NO: 21331 - protein, 24 aa, Mycobacterium avium
RRADGLAGLSLAWGLWEQASAMTA

SEQ ID NO: 21332 - protein, 20 aa, Mycobacterium avium
RRASQEAELLTLFAGSVLRG

SEQ ID NO: 21333 - protein, 24 aa, Mycobacterium avium
RRFSAIALWCWVAMALSGLVNAAV

SEQ ID NO: 21334 - protein, 19 aa, Mycobacterium avium
RRHYSCWPVPVGDIALMAA

SEQ ID NO: 21335 - protein, 24 aa, Mycobacterium avium
RRKRDRMYTALYGVGALFGGLASA

SEQ ID NO: 21336 - protein, 17 aa, Mycobacterium avium
RRLITLCPALLILAVGY

SEQ ID NO: 21337 - protein, 27 aa, Mycobacterium avium
RRLPGWPVWFALLWAAQEWLKSIFPFG

SEQ ID NO: 21338 - protein, 28 aa, Mycobacterium avium
RRLTRPVRIIAWLVAGLSALGLLNLSRA

SEQ ID NO: 21339 - protein, 32 aa, Mycobacterium avium
RRPQYRPLWVFLLLPVLILLTVSGRWLYTNAA

SEQ ID NO: 21340 - protein, 18 aa, Mycobacterium avium
RRQVRLVVADRAYFVFLA

SEQ ID NO: 21341 - protein, 20 aa, Mycobacterium avium
RRRRALRWGLIFTAGCAFWA

SEQ ID NO: 21342 - protein, 25 aa, Mycobacterium avium
RRRTLAWIAALSVAGVVLLVIVAAV

SEQ ID NO: 21343 - protein, 36 aa, Mycobacterium avium
RRTPLRSRFRFGIQSKILITMLLSSILGVAVIGLIG

SEQ ID NO: 21344 - protein, 20 aa, Mycobacterium avium
RRVASWLAALIVPSVICAVT

SEQ ID NO: 21345 - protein, 18 aa, Mycobacterium avium
RRWGSQWALVRLPEDRRD

SEQ ID NO: 21346 - protein, 21 aa, Mycobacterium avium
RSAGWGFIVFGLVAPNVFATL

SEQ ID NO: 21347 - protein, 21 aa, Mycobacterium avium
RSLRIYIGLFPILGATNLTVQ

SEQ ID NO: 21348 - protein, 18 aa, Mycobacterium avium
RSSKFVMRRWAPVGLIVV

SEQ ID NO: 21349 - protein, 19 aa, Mycobacterium avium
RTGQRWLPVLLAGFCAGFL

SEQ ID NO: 21350 - protein, 35 aa, Mycobacterium avium
RTQPALDLDALIGGFKPLFRALDPQKVNTIATALV

SEQ ID NO: 21351 - protein, 25 aa, Mycobacterium avium
RTRSWLLALALPYALYYVADPMNGV

SEQ ID NO: 21352 - protein, 23 aa, Mycobacterium avium
RTTHHLFQPLLYQVATGIVSEGD

SEQ ID NO: 21353 - protein, 17 aa, Mycobacterium avium
RTTIFAFPVFGFGVIFG

SEQ ID NO: 21354 - protein, 25 aa, Mycobacterium avium
RTTLLSFRLQPTLSVLLVAAGAFGL

SEQ ID NO: 21355 - protein, 44 aa, Mycobacterium avium
RVDQPLIPPFLPRMIHRLALPIVLVWLGIVFITNTVAPQLEVVA

SEQ ID NO: 21356 - protein, 18 aa, Mycobacterium avium
RVFQAAVLFFVAGSVLCG

SEQ ID NO: 21357 - protein, 17 aa, Mycobacterium avium
RVGDAIMAFLALLIVTS

SEQ ID NO: 21358 - protein, 22 aa, Mycobacterium avium
RVGWRQRFVTAWAGFRGAVSLA

SEQ ID NO: 21359 - protein, 17 aa, Mycobacterium avium
RVLGIRALAFLVTAVVA

SEQ ID NO: 21360 - protein, 26 aa, Mycobacterium avium
RVMLWGLVACLPWAFVVIPLIDTGRP

SEQ ID NO: 21361 - protein, 26 aa, Mycobacterium avium
RVPIEELLFFLIIPVCAVLTYNAVST

SEQ ID NO: 21362 - protein, 26 aa, Mycobacterium avium
RVVEGPYVLPSLSLLVAGDPPKKRSA

SEQ ID NO: 21363 - protein, 20 aa, Mycobacterium avium
RWARDAPRPAIRRWPSRATS

SEQ ID NO: 21364 - protein, 20 aa, Mycobacterium avium
RWLERFSWIGLVVAVVAGLT

SEQ ID NO: 21365 - protein, 19 aa, Mycobacterium avium
RYRVGPPVLLIVLGVLLGL

SEQ ID NO: 21366 - protein, 25 aa, Mycobacterium avium
SAALLLIPCLLLAWAVSHPGIPFGV

SEQ ID NO: 21367 - protein, 17 aa, Mycobacterium avium
SADWFGMAVLVAWGALG

SEQ ID NO: 21368 - protein, 29 aa, Mycobacterium avium
SAGAIALLALTMLIAVIVALWVSRTDGVV

SEQ ID NO: 21369 - protein, 19 aa, Mycobacterium avium
SALVYFLGLVADQRELFQV

SEQ ID NO: 21370 - protein, 24 aa, Mycobacterium avium
SAPDKPVIFWTADHGAFVVRGAMR

SEQ ID NO: 21371 - protein, 17 aa, Mycobacterium avium
SAQHFLHELDTPEFPWT

SEQ ID NO: 21372 - protein, 19 aa, Mycobacterium avium
SAWVIFGKQVLWTVIGLIA

SEQ ID NO: 21373 - protein, 24 aa, Mycobacterium avium
SDLDEWDWVKWLPHFGDPRRQDAA

SEQ ID NO: 21374 - protein, 31 aa, Mycobacterium avium
SDQPFMPLAMKQHVLGPYPLDPNLLAQGVPP

SEQ ID NO: 21375 - protein, 33 aa, Mycobacterium avium
SDTDALLSLLLLIFPHLALAPYMRGLDPVLGLD

SEQ ID NO: 21376 - protein, 27 aa, Mycobacterium avium
SEAGGPFLFLQALLRTSTIPTYLRGDW

SEQ ID NO: 21377 - protein, 22 aa, Mycobacterium avium
SFASMFPARRFGGGALAVYVDG

SEQ ID NO: 21378 - protein, 18 aa, Mycobacterium avium
SFYGRLSCSIFNAAGQRV

SEQ ID NO: 21379 - protein, 24 aa, Mycobacterium avium
SGAATVWLGFVASLPVFLVAAGVV

SEQ ID NO: 21380 - protein, 23 aa, Mycobacterium avium
SGAPRYYAVLPDGLQQISPVLAA

SEQ ID NO: 21381 - protein, 25 aa, Mycobacterium avium
SGAVSWLIALVYKGLYTGGLINEVT

SEQ ID NO: 21382 - protein, 24 aa, Mycobacterium avium
SGEFLKVMLRWLNAFVSKPGQTIP

SEQ ID NO: 21383 - protein, 24 aa, Mycobacterium avium
SGGTQFYVLLPDGVQKVTSFVADL

SEQ ID NO: 21384 - protein, 22 aa, Mycobacterium avium
SGHLFYNRRLRAATTRFSVRMK

SEQ ID NO: 21385 - protein, 17 aa, Mycobacterium avium
SGKFQTFVPLTLVSDRA

SEQ ID NO: 21386 - protein, 27 aa, Mycobacterium avium
SGLAYVVIFSLPLARKAFLLDPSNVVV

SEQ ID NO: 21387 - protein, 22 aa, Mycobacterium avium
SGPLPYIVMEYVDGVTLRDIVH

SEQ ID NO: 21388 - protein, 33 aa, Mycobacterium avium
SGPLTARFWPPFGGFLYWLRPNTIRLPPWPDKV

SEQ ID NO: 21389 - protein, 31 aa, Mycobacterium avium
SGPPQARPPYPPYPPYPPPGQPAPEGGSPDR

SEQ ID NO: 21390 - protein, 17 aa, Mycobacterium avium
SGRALVYGAGSLGLCAV

SEQ ID NO: 21391 - protein, 20 aa, Mycobacterium avium
SGVALIRWMIARRAAVFAHH

SEQ ID NO: 21392 - protein, 25 aa, Mycobacterium avium
SGVEWDTLLFFAGLFVMVGALVKTG

SEQ ID NO: 21393 - protein, 25 aa, Mycobacterium avium
SHHHRLPQLPPVITIPQVPTVITVP

SEQ ID NO: 21394 - protein, 27 aa, Mycobacterium avium
SHRRVVLLIYLWVGIVAFGAASTIFFR

SEQ ID NO: 21395 - protein, 32 aa, Mycobacterium avium
SHTGGAWLVLFMIFNVIWTYVLVRGSAVNNGT

SEQ ID NO: 21396 - protein, 32 aa, Mycobacterium avium
SIEPALRFYVVFFLGLLAVTWYCYLRKHNAIT

SEQ ID NO: 21397 - protein, 20 aa, Mycobacterium avium
SIGGLLLAGFIIGSLGVLND

SEQ ID NO: 21398 - protein, 23 aa, Mycobacterium avium
SIGLLVWFWPRLGPDKLTLPVTL

SEQ ID NO: 21399 - protein, 24 aa, Mycobacterium avium
SILRILGPWFWWPTLVRSRPLPQR

SEQ ID NO: 21400 - protein, 17 aa, Mycobacterium avium
SIWMRLPTLAMALTCWW

SEQ ID NO: 21401 - protein, 20 aa, Mycobacterium avium
SLAELWRSVGVVPDAVIGHS

SEQ ID NO: 21402 - protein, 22 aa, Mycobacterium avium
SLAKITLFTLGAIAIMLLLVYR

SEQ ID NO: 21403 - protein, 17 aa, Mycobacterium avium
SLGLCAVAILRALYPEV

SEQ ID NO: 21404 - protein, 20 aa, Mycobacterium avium
SLGQIVPIRGAAPAAPAVPA

SEQ ID NO: 21405 - protein, 31 aa, Mycobacterium avium
SLGVEEQFYLVWPLLIIAVAASVRRVRPLRA

SEQ ID NO: 21406 - protein, 23 aa, Mycobacterium avium
SLIAPIALHWSLNGLGALAAAFV

SEQ ID NO: 21407 - protein, 18 aa, Mycobacterium avium
SLIWELLCYLVVAAIGVV

SEQ ID NO: 21408 - protein, 17 aa, Mycobacterium avium
SLLSFVGVLLGAIAGVL

SEQ ID NO: 21409 - protein, 20 aa, Mycobacterium avium
SLVAWLGFPIPVIAIVLACI

SEQ ID NO: 21410 - protein, 25 aa, Mycobacterium avium
SLVPTLLVSIPFTVLVAFTLNILLR

SEQ ID NO: 21411 - protein, 20 aa, Mycobacterium avium
SLWRRLGLERQLLWAASRAL

SEQ ID NO: 21412 - protein, 23 aa, Mycobacterium avium
SMARRFAVLVMLLCLFGMLVILL

SEQ ID NO: 21413 - protein, 24 aa, Mycobacterium avium
SMDANYRWFHPAPTTLAAAVGSPR

SEQ ID NO: 21414 - protein, 26 aa, Mycobacterium avium
SMLGELPWWITVLILAREFGVTVLRL

SEQ ID NO: 21415 - protein, 30 aa, Mycobacterium avium
SMVLVAIASGWMMLLNVLKPTGIVGDSTII

SEQ ID NO: 21416 - protein, 21 aa, Mycobacterium avium
SNDVDFVWITDFQPYQPQLDA

SEQ ID NO: 21417 - protein, 21 aa, Mycobacterium avium
SNLDDFFRPIKSYFYWEKHCF

SEQ ID NO: 21418 - protein, 29 aa, Mycobacterium avium
SNRPEFLAVLLAIWRLAATAVLISPAWKR

SEQ ID NO: 21419 - protein, 40 aa, Mycobacterium avium
SPAEPAHPRWWFISTTPGRILTIGIVLAALGGLSAFATST

SEQ ID NO: 21420 - protein, 25 aa, Mycobacterium avium
SPPRWSSWLRVVLGAGLIGYGIFRW

SEQ ID NO: 21421 - protein, 23 aa, Mycobacterium avium
SPVPRSLIPWPYNGIPVCPGCTL

SEQ ID NO: 21422 - protein, 22 aa, Mycobacterium avium
SQDQLVDYIFSGLRAPWRPRAF

SEQ ID NO: 21423 - protein, 31 aa, Mycobacterium avium
SRAGGRYSVYIWALLAMAVARLGLGPLRTVR

SEQ ID NO: 21424 - protein, 21 aa, Mycobacterium avium
SRAGLFYVPLAVVAAVCAFLF

SEQ ID NO: 21425 - protein, 18 aa, Mycobacterium avium
SRQIILDRDLQLVVNSLW

SEQ ID NO: 21426 - protein, 24 aa, Mycobacterium avium
SRTAPALDLDLLLGGLKPVTQGLN

SEQ ID NO: 21427 - protein, 26 aa, Mycobacterium avium
SSLVGLFVFPNFANPIHFLCSAIQAG

SEQ ID NO: 21428 - protein, 21 aa, Mycobacterium avium
SSLVVFLVALPLSLGIAIASN

SEQ ID NO: 21429 - protein, 28 aa, Mycobacterium avium
SSQVANLELYLIFPLKNEQATIQLVRGT

SEQ ID NO: 21430 - protein, 21 aa, Mycobacterium avium
SSRMEPLLRDIRRGMAGAGLR

SEQ ID NO: 21431 - protein, 36 aa, Mycobacterium avium
SSTFVRFWTVSFPVVAYRSWRWWVATGAAFFAVVVI

SEQ ID NO: 21432 - protein, 26 aa, Mycobacterium avium
SSVSIIFLFVLQLVQGKLPLHLHDPA

SEQ ID NO: 21433 - protein, 32 aa, Mycobacterium avium
STAALIFGCLLMWILAWLTATPVRVVRAALKR

SEQ ID NO: 21434 - protein, 32 aa, Mycobacterium avium
STNGIYPLLIMAMLPVLLGLDVSSRRAAVVLI

SEQ ID NO: 21435 - protein, 24 aa, Mycobacterium avium
STPIAFLLFAFFGGFAIMLGAELN

SEQ ID NO: 21436 - protein, 25 aa, Mycobacterium avium
STPTFVIASLLILAALRVNWALGVQ

SEQ ID NO: 21437 - protein, 23 aa, Mycobacterium avium
STQPLPVWGTWKTLLRVQDGYTM

SEQ ID NO: 21438 - protein, 26 aa, Mycobacterium avium
STRATLHFLWLRLARVWPVYLVTLHL

SEQ ID NO: 21439 - protein, 25 aa, Mycobacterium avium
STTYSYWFEPNPGWSRLFAPGGEVK

SEQ ID NO: 21440 - protein, 23 aa, Mycobacterium avium
SVGWVRLGALVLALAALTALLIN

SEQ ID NO: 21441 - protein, 19 aa, Mycobacterium avium
SVLLIFTIGVTWSSVHYLL

SEQ ID NO: 21442 - protein, 26 aa, Mycobacterium avium
SVLLTFFPGWVTVGLMLALLVAAARL

SEQ ID NO: 21443 - protein, 26 aa, Mycobacterium avium
SVLLVQALLMFSVLFALPINARLSHR

SEQ ID NO: 21444 - protein, 20 aa, Mycobacterium avium
SVPLVARPLDHRPKSAVILC

SEQ ID NO: 21445 - protein, 31 aa, Mycobacterium avium
SVPTLWRETPAPYGPLFLWIGRGISAITGEN

SEQ ID NO: 21446 - protein, 19 aa, Mycobacterium avium
SVRLPEAGFRFLLYGFLCC

SEQ ID NO: 21447 - protein, 27 aa, Mycobacterium avium
SVVYNLPKMISLLVEPWYSLAGDREQV

SEQ ID NO: 21448 - protein, 23 aa, Mycobacterium avium
SWSHHWVWVLPTVLVTGVLGWRR

SEQ ID NO: 21449 - protein, 24 aa, Mycobacterium avium
SYATAMRLVVVPQGVRRVLPALVN

SEQ ID NO: 21450 - protein, 21 aa, Mycobacterium avium
SYLAFLAPGIIAQSALFISIF

SEQ ID NO: 21451 - protein, 26 aa, Mycobacterium avium
SYSPALAPLRAPLQNVLRLASATRTE

SEQ ID NO: 21452 - protein, 27 aa, Mycobacterium avium
SYTKPRLSWLDALYFTAETITTVGYGE

SEQ ID NO: 21453 - protein, 24 aa, Mycobacterium avium
TAAQLVRLPWDYRRLYGLDPDEQP

SEQ ID NO: 21454 - protein, 25 aa, Mycobacterium avium
TAATRYMLMTYIKPGSVVLFHNTYS

SEQ ID NO: 21455 - protein, 23 aa, Mycobacterium avium
TAAYLPFNAYLLTRSTLSPRIRE

SEQ ID NO: 21456 - protein, 22 aa, Mycobacterium avium
TAGAVFVAAWLPFNNGLRPEPL

SEQ ID NO: 21457 - protein, 19 aa, Mycobacterium avium
TAGEWVWAALLTAAVTVVV

SEQ ID NO: 21458 - protein, 29 aa, Mycobacterium avium
TAPRRRRSWRWVLATLLVLAVIAGVDAYL

SEQ ID NO: 21459 - protein, 17 aa, Mycobacterium avium
TAPTFFSQLRTADWWWA

SEQ ID NO: 21460 - protein, 25 aa, Mycobacterium avium
TAQPSGLLDVIWSPIALGGNDLGDE

SEQ ID NO: 21461 - protein, 34 aa, Mycobacterium avium
TASVVALLLIATYRSPVLWLVPLLVVAFADRVAA

SEQ ID NO: 21462 - protein, 35 aa, Mycobacterium avium
TATVLLVVFLYDNFGLRWGLFGAAAIMVVTSFVVM

SEQ ID NO: 21463 - protein, 19 aa, Mycobacterium avium
TAVPVVLARILELPPRVRA

SEQ ID NO: 21464 - protein, 21 aa, Mycobacterium avium
TAVVRWPAPVLAVTIAVALVG

SEQ ID NO: 21465 - protein, 22 aa, Mycobacterium avium
TAYFGFYLFYRARNPELFLHSQ

SEQ ID NO: 21466 - protein, 21 aa, Mycobacterium avium
TCILPPLLYHAALESSLVGIR

SEQ ID NO: 21467 - protein, 19 aa, Mycobacterium avium
TDDLRPIPVFGSDELARLT

SEQ ID NO: 21468 - protein, 24 aa, Mycobacterium avium
TDEAGIVFITFLAAYFPIMVSTRH

SEQ ID NO: 21469 - protein, 25 aa, Mycobacterium avium
TDLSYGMYIYAYPVQQLLAVLGLLS

SEQ ID NO: 21470 - protein, 22 aa, Mycobacterium avium
TDPLLLPIVALLNGLGLVMIHR

SEQ ID NO: 21471 - protein, 24 aa, Mycobacterium avium
TDRQIELTPPYRGGPVLGNHDTIG

SEQ ID NO: 21472 - protein, 32 aa, Mycobacterium avium
TETARLVHTLIFTALRIAFLAVLVGTTLEVLS

SEQ ID NO: 21473 - protein, 30 aa, Mycobacterium avium
TFEMSPATPIWRLVLPFFAMGVGMAFVWSP

SEQ ID NO: 21474 - protein, 28 aa, Mycobacterium avium
TFHIARPWRWGYLGVLFLIFGFPLLTMD

SEQ ID NO: 21475 - protein, 27 aa, Mycobacterium avium
TFNRGMPYFPNLVVPLIVCAIGIGAVF

SEQ ID NO: 21476 - protein, 29 aa, Mycobacterium avium
TFTVIIGMLLLVYRSVITVLLTLVMVVLE

SEQ ID NO: 21477 - protein, 25 aa, Mycobacterium avium
TGAFEVVGRRRLWFGISGAIVAVAI

SEQ ID NO: 21478 - protein, 25 aa, Mycobacterium avium
TGAGLLLLAIAVVGLHFVSALAFNA

SEQ ID NO: 21479 - protein, 21 aa, Mycobacterium avium
TGFRILAFLIFAFACITDRLD

SEQ ID NO: 21480 - protein, 31 aa, Mycobacterium avium
TGGVIVLLFLIAWWLLDALWHPVRGRLADVA

SEQ ID NO: 21481 - protein, 22 aa, Mycobacterium avium
TGKYGPIYDPKTKSWGPKMVYT

SEQ ID NO: 21482 - protein, 28 aa, Mycobacterium avium
THVGSSTWIAWAAWAAIALAVITLIFTN

SEQ ID NO: 21483 - protein, 35 aa, Mycobacterium avium
TIAMFLGSTLVLRRKFKPPLVLQDIEKYRPTAMVV

SEQ ID NO: 21484 - protein, 33 aa, Mycobacterium avium
TIFFLGSFVVALVPLIWVLSVVLERGWYAVTRS

SEQ ID NO: 21485 - protein, 32 aa, Mycobacterium avium
TKNVPSLKYLSYRLFMKRAKSRWLVTRMTTIT

SEQ ID NO: 21486 - protein, 30 aa, Mycobacterium avium
TKTPLSFLCYWIIPFALLGLAAVVSRLLPD

SEQ ID NO: 21487 - protein, 23 aa, Mycobacterium avium
TLAAGLLFGPLLGVAIAVAASTA

SEQ ID NO: 21488 - protein, 30 aa, Mycobacterium avium
TLFFALANAILIIPLGLVPSWLALASTSCD

SEQ ID NO: 21489 - protein, 38 aa, Mycobacterium avium
TLKSLKPPPRRQPHRTLVAWISFAAAVLAVGALAGGVA

SEQ ID NO: 21490 - protein, 17 aa, Mycobacterium avium
TLLATGLIFILVSAAQA

SEQ ID NO: 21491 - protein, 19 aa, Mycobacterium avium
TLLEDWRDNLRWPPASALV

SEQ ID NO: 21492 - protein, 25 aa, Mycobacterium avium
TLQTRGWRRMGTAVVRWPAPVLAVT

SEQ ID NO: 21493 - protein, 20 aa, Mycobacterium avium
TLRFIGSYLGGIAAGLLVGG

SEQ ID NO: 21494 - protein, 22 aa, Mycobacterium avium
TLRGYLVVAVVFVIIKLVQAGV

SEQ ID NO: 21495 - protein, 36 aa, Mycobacterium avium
TLVRMVLVPAFIHLLGRWTWWAPRPMVWLRERSATG

SEQ ID NO: 21496 - protein, 25 aa, Mycobacterium avium
TLVSRLTGFARVVLLAAILGAALSS

SEQ ID NO: 21497 - protein, 19 aa, Mycobacterium avium
TLYLWHMPVLLGVHLAFDY

SEQ ID NO: 21498 - protein, 27 aa, Mycobacterium avium
TMITGGAVLLVLLAGIALLVSRQVVVP

SEQ ID NO: 21499 - protein, 23 aa, Mycobacterium avium
TNGSQFFMVYKDSQLPPQYTVFG

SEQ ID NO: 21500 - protein, 19 aa, Mycobacterium avium
TNNNPYPLGIAALGMMAAA

SEQ ID NO: 21501 - protein, 21 aa, Mycobacterium avium
TPAVFLLYFLLRRDHRAVLTA

SEQ ID NO: 21502 - protein, 19 aa, Mycobacterium avium
TPELYACILVALGGVVWSQ

SEQ ID NO: 21503 - protein, 25 aa, Mycobacterium avium
TPIDPRFPTFLATNLSEALPGPFSP

SEQ ID NO: 21504 - protein, 26 aa, Mycobacterium avium
TPPKWASWVRLVFGVALLALAAYHWF

SEQ ID NO: 21505 - protein, 30 aa, Mycobacterium avium
TPSIAAALGHWFWWPINTIRMTRRTHHDEE

SEQ ID NO: 21506 - protein, 26 aa, Mycobacterium avium
TPSIMTAMGRWFWWPKRVRVRPASQM

SEQ ID NO: 21507 - protein, 31 aa, Mycobacterium avium
TPVALHLFYVVKILLYILGGWLFASATRGLG

SEQ ID NO: 21508 - protein, 26 aa, Mycobacterium avium
TQAAGLLLWFLIALPIGAVLGGWIAT

SEQ ID NO: 21509 - protein, 19 aa, Mycobacterium avium
TQFGVPPKAAVPQSIPPRL

SEQ ID NO: 21510 - protein, 24 aa, Mycobacterium avium
TRANPFVFVYNYLKQVVAEMRKVI

SEQ ID NO: 21511 - protein, 28 aa, Mycobacterium avium
TRIVRRSNALLDWAYGRSLRYSESMSLG

SEQ ID NO: 21512 - protein, 21 aa, Mycobacterium avium
TRLHPALFFLASVAATLPLAA

SEQ ID NO: 21513 - protein, 18 aa, Mycobacterium avium
TRLPAAPQTTRAAAALIN

SEQ ID NO: 21514 - protein, 32 aa, Mycobacterium avium
TRNRRPRVSGWLWQALAALLIATVFAAAVAQA

SEQ ID NO: 21515 - protein, 22 aa, Mycobacterium avium
TRPLDYLPGILLLIGVGVLGKY

SEQ ID NO: 21516 - protein, 22 aa, Mycobacterium avium
TSLLLYTSFLVVVYLATQRFSW

SEQ ID NO: 21517 - protein, 21 aa, Mycobacterium avium
TSMTMVWLSVLLYVKIGEPDD

SEQ ID NO: 21518 - protein, 18 aa, Mycobacterium avium
TSPLLPTADELADRYSLV

SEQ ID NO: 21519 - protein, 23 aa, Mycobacterium avium
TSSPYTILAIGPPHALRDAFDTS

SEQ ID NO: 21520 - protein, 17 aa, Mycobacterium avium
TSYVFIMAIAGPVLARY

SEQ ID NO: 21521 - protein, 22 aa, Mycobacterium avium
TTALAAVLLAPAATASPIGDAE

SEQ ID NO: 21522 - protein, 23 aa, Mycobacterium avium
TTAQIRYLDLIGNRYLELKRGQG

SEQ ID NO: 21523 - protein, 22 aa, Mycobacterium avium
TTASAWRWTAILAAAITLASLP

SEQ ID NO: 21524 - protein, 17 aa, Mycobacterium avium
TTGYTYFHSDRRALLDE

SEQ ID NO: 21525 - protein, 26 aa, Mycobacterium avium
TTLDGIFGIYALGLLPGLLVGGRTSD

SEQ ID NO: 21526 - protein, 18 aa, Mycobacterium avium
TTLFRPHNLPFVMLGAGL

SEQ ID NO: 21527 - protein, 20 aa, Mycobacterium avium
TTLTAILFAGDRIGLVHIGD

SEQ ID NO: 21528 - protein, 20 aa, Mycobacterium avium
TTVVTPSWFSDYVLTVGAVD

SEQ ID NO: 21529 - protein, 30 aa, Mycobacterium avium
TVATAFAFAPWYFFLTRFFTGAGIGGEYAA

SEQ ID NO: 21530 - protein, 20 aa, Mycobacterium avium
TVAVLIILRSAARPGHWSLF

SEQ ID NO: 21531 - protein, 27 aa, Mycobacterium avium
TVFSTLYLPLLAILFGMILRAVAIEWR

SEQ ID NO: 21532 - protein, 38 aa, Mycobacterium avium
TVGSVGRWIVAVAALAVLTIIVVIAFNTFGGGARDVQV

SEQ ID NO: 21533 - protein, 24 aa, Mycobacterium avium
TVIGVPWLLSFAQPNIWQIGRPWY

SEQ ID NO: 21534 - protein, 28 aa, Mycobacterium avium
TVIVAITLPLIPIFMVLIGLATRDRSAA

SEQ ID NO: 21535 - protein, 17 aa, Mycobacterium avium
TVLLIAPVTLLVCDRLA

SEQ ID NO: 21536 - protein, 25 aa, Mycobacterium avium
TVMATPAMFIEFSRQRALAADGRCK

SEQ ID NO: 21537 - protein, 22 aa, Mycobacterium avium
TVRTGLLWWTVAIHLLTSMTMV

SEQ ID NO: 21538 - protein, 24 aa, Mycobacterium avium
TVTSVIFLNLLHGVLIGLLLAVVV

SEQ ID NO: 21539 - protein, 21 aa, Mycobacterium avium
TVTWLDPYLDTGGESALFFVG

SEQ ID NO: 21540 - protein, 20 aa, Mycobacterium avium
TVVAYFPAANALYPGDKVQI

SEQ ID NO: 21541 - protein, 28 aa, Mycobacterium avium
TVVVRWPGPILVLTIGVALVGLLTLPGY

SEQ ID NO: 21542 - protein, 23 aa, Mycobacterium avium
TVVYAFICLFVINVVMTAIGVRI

SEQ ID NO: 21543 - protein, 20 aa, Mycobacterium avium
TVWNTANLVRKEGFGAAVRS

SEQ ID NO: 21544 - protein, 20 aa, Mycobacterium avium
TVYHFIFVPLTIGLAPLLAI

SEQ ID NO: 21545 - protein, 23 aa, Mycobacterium avium
TWTKGMLPGLMAVPLTIAGQIER

SEQ ID NO: 21546 - protein, 19 aa, Mycobacterium avium
TYFRPLIVVLAVIGVIYGA

SEQ ID NO: 21547 - protein, 19 aa, Mycobacterium avium
TYLGGWRIIRTLGKGLVEI

SEQ ID NO: 21548 - protein, 28 aa, Mycobacterium avium
TYTSVVLAFLAFMVALVGLADFGLTKLV

SEQ ID NO: 21549 - protein, 20 aa, Mycobacterium avium
TYWITRRTVLALRWAIEERK

SEQ ID NO: 21550 - protein, 19 aa, Mycobacterium avium
VAAAPVNYLKLMPATYVVL

SEQ ID NO: 21551 - protein, 41 aa, Mycobacterium avium
VAAAVVCVLISVALTFLVINIRGLLRDRALLDRWAGDATAS

SEQ ID NO: 21552 - protein, 24 aa, Mycobacterium avium
VAALLISLLIVALTVWYYKLNVNP

SEQ ID NO: 21553 - protein, 20 aa, Mycobacterium avium
VAALRAGLIALALLAVLALI

SEQ ID NO: 21554 - protein, 29 aa, Mycobacterium avium
VAAMLGGWLAVLAGAWFVVGGQLAPLLGI

SEQ ID NO: 21555 - protein, 17 aa, Mycobacterium avium
VACLFWRLFMQDNRKRP

SEQ ID NO: 21556 - protein, 19 aa, Mycobacterium avium
VAETPWGASWLSLSPVTVS

SEQ ID NO: 21557 - protein, 18 aa, Mycobacterium avium
VAFAWRRPRFDPLKPGRA

SEQ ID NO: 21558 - protein, 25 aa, Mycobacterium avium
VAFKLYPRRAVLGLALFIGQAFLYN

SEQ ID NO: 21559 - protein, 24 aa, Mycobacterium avium
VAGRILRIRDFGGVLFAQLRDWSG

SEQ ID NO: 21560 - protein, 29 aa, Mycobacterium avium
VAIAVVGLILVRAWFLDNALSQFYQAHLI

SEQ ID NO: 21561 - protein, 23 aa, Mycobacterium avium
VALGFAAYLLNFGPTFTIGADLG

SEQ ID NO: 21562 - protein, 20 aa, Mycobacterium avium
VALLKRMPTSLSARFDRACA

SEQ ID NO: 21563 - protein, 23 aa, Mycobacterium avium
VALTFVWLGMVLAISFLEAPLKF

SEQ ID NO: 21564 - protein, 23 aa, Mycobacterium avium
VASYSWYYAWTPGTGYLANLLPH

SEQ ID NO: 21565 - protein, 24 aa, Mycobacterium avium
VAVGLGLGALAWLAARPDKPAPAT

SEQ ID NO: 21566 - protein, 21 aa, Mycobacterium avium
VAVLAVLTRLRHLFFDVITAN

SEQ ID NO: 21567 - protein, 34 aa, Mycobacterium avium
VCWPTAPRWLGVPLYLLLGWVAIWYAPTILHQAG

SEQ ID NO: 21568 - protein, 23 aa, Mycobacterium avium
VDAWLGLCQTYGWAPGVMGASTQ

SEQ ID NO: 21569 - protein, 29 aa, Mycobacterium avium
VDLLTGGRFRLGIGLGWNAVEYEALGETF

SEQ ID NO: 21570 - protein, 24 aa, Mycobacterium avium
VDQRLLTAVPPGLSLVAAAGVPVV

SEQ ID NO: 21571 - protein, 22 aa, Mycobacterium avium
VDRNIDRLLRRVCPGDIVVLDV

SEQ ID NO: 21572 - protein, 22 aa, Mycobacterium avium
VDSFDGYEYLFWVGCAGAYDDK

SEQ ID NO: 21573 - protein, 37 aa, Mycobacterium avium
VDSRRNLLGLFMPSTLFLMFIMFGVPQLQLYISPAML

SEQ ID NO: 21574 - protein, 24 aa, Mycobacterium avium
VEARPLSVLLLSVGLAGFCVHATL

SEQ ID NO: 21575 - protein, 18 aa, Mycobacterium avium
VEGRSMWAGVRDAVTILV

SEQ ID NO: 21576 - protein, 21 aa, Mycobacterium avium
VEQFRLVLQPMMIAGAAALAA

SEQ ID NO: 21577 - protein, 20 aa, Mycobacterium avium
VFGAFAHRWLARRTRRRINP

SEQ ID NO: 21578 - protein, 26 aa, Mycobacterium avium
VFGYVTFYFGPYFPAVWILRRLQAKY

SEQ ID NO: 21579 - protein, 20 aa, Mycobacterium avium
VFPIGIIDRPFKHDQPPWTV

SEQ ID NO: 21580 - protein, 25 aa, Mycobacterium avium
VFVAFQLMFAIITVALISGAVSDRL

SEQ ID NO: 21581 - protein, 22 aa, Mycobacterium avium
VFVMEWLAILRDLVLGLLIAGA

SEQ ID NO: 21582 - protein, 29 aa, Mycobacterium avium
VGADFTAVPLLWLLAIDIGLTILGAMAFR

SEQ ID NO: 21583 - protein, 26 aa, Mycobacterium avium
VGALAILVMVVWVGTALTISTTASRS

SEQ ID NO: 21584 - protein, 28 aa, Mycobacterium avium
VGALCLIFIIMLILTRSFIAALVIVGTV

SEQ ID NO: 21585 - protein, 26 aa, Mycobacterium avium
VGASRWYTQLPFLVEAMLAAAIGVAI

SEQ ID NO: 21586 - protein, 24 aa, Mycobacterium avium
VGAVFVHWLIFQSLYRIGALCPYC

SEQ ID NO: 21587 - protein, 25 aa, Mycobacterium avium
VGERPVAVEALWKTALRSACCACDG

SEQ ID NO: 21588 - protein, 25 aa, Mycobacterium avium
VGGTGSIFLLLDEPEVYGLPPDPRV

SEQ ID NO: 21589 - protein, 25 aa, Mycobacterium avium
VGIALWLPWLIVAGVMFILSSVAGL

SEQ ID NO: 21590 - protein, 25 aa, Mycobacterium avium
VGLASYLLIGFWYHKPTAATAAKKA

SEQ ID NO: 21591 - protein, 19 aa, Mycobacterium avium
VGLIALVFVKVFGAAAPGG

SEQ ID NO: 21592 - protein, 26 aa, Mycobacterium avium
VGLVVLFLLRRVLLGSSYFTVPKVQL

SEQ ID NO: 21593 - protein, 27 aa, Mycobacterium avium
VGPTIAWYQDWLRYYFLTVESNPDGSM

SEQ ID NO: 21594 - protein, 19 aa, Mycobacterium avium
VGPYTRYGLPLVAACAAAG

SEQ ID NO: 21595 - protein, 26 aa, Mycobacterium avium
VGTLGLWLESLWISAVYHYPWPVSMW

SEQ ID NO: 21596 - protein, 48 aa, Mycobacterium avium
VGTTIALGLLFDTLIVRSFMTPSLATLLGRWFWWPQHVRPRPASTMLR

SEQ ID NO: 21597 - protein, 28 aa, Mycobacterium avium
VHGLYYLLMHGWFRLVPPTEFWSRAPSG

SEQ ID NO: 21598 - protein, 33 aa, Mycobacterium avium
VHLAPIVVIVVGVLIALLPRLFPGAFTVDPERV

SEQ ID NO: 21599 - protein, 18 aa, Mycobacterium avium
VHSIDYVRPQLFTNSFTP

SEQ ID NO: 21600 - protein, 21 aa, Mycobacterium avium
VIAAVLGLVWLAVEHRRIRRI

SEQ ID NO: 21601 - protein, 18 aa, Mycobacterium avium
VIDEFYEWFRIMPTAVDV

SEQ ID NO: 21602 - protein, 25 aa, Mycobacterium avium
VIGKARFIVWPPSRWGGVGSVNPQQ

SEQ ID NO: 21603 - protein, 20 aa, Mycobacterium avium
VILIVLAVLLRSVMAPPVLL

SEQ ID NO: 21604 - protein, 23 aa, Mycobacterium avium
VIPQFLIMRTLGWVDTPWAMIVP

SEQ ID NO: 21605 - protein, 27 aa, Mycobacterium avium
VIVVKKGLLKWAWIPGAPLLWDLVVTL

SEQ ID NO: 21606 - protein, 31 aa, Mycobacterium avium
VLAGAYPLYLDAYPLPQFAIYGAVSLRTIKQ

SEQ ID NO: 21607 - protein, 37 aa, Mycobacterium avium
VLAIVGPTWFAWLTVIWLWLTVLFANLAEAVAEGRGK

SEQ ID NO: 21608 - protein, 25 aa, Mycobacterium avium
VLALANLMWFVFAGLGALTVDSGVI

SEQ ID NO: 21609 - protein, 17 aa, Mycobacterium avium
VLAVVVLALIWGERLGP

SEQ ID NO: 21610 - protein, 18 aa, Mycobacterium avium
VLAYREFWAKVRKGALVK

SEQ ID NO: 21611 - protein, 22 aa, Mycobacterium avium
VLDHPQPFFAPIAAAVSLSTSN

SEQ ID NO: 21612 - protein, 29 aa, Mycobacterium avium
VLFHTPIVDLPFTYPPLAAIVFCPFAWMH

SEQ ID NO: 21613 - protein, 28 aa, Mycobacterium avium
VLIFTTSIICALFGFIWDVSWHIGNGRD

SEQ ID NO: 21614 - protein, 28 aa, Mycobacterium avium
VLLANPGLPLWLFVLCAALTGLGGGNYA

SEQ ID NO: 21615 - protein, 24 aa, Mycobacterium avium
VLRRRWQLFDFASVAVLLVLAVLA

SEQ ID NO: 21616 - protein, 29 aa, Mycobacterium avium
VLTAGSFLWLWWTTNLLSGLLALATIAFY

SEQ ID NO: 21617 - protein, 17 aa, Mycobacterium avium
VLTFHIARPWRWGYLGV

SEQ ID NO: 21618 - protein, 23 aa, Mycobacterium avium
VLTIVMGLVFVGLIPALQRQARF

SEQ ID NO: 21619 - protein, 25 aa, Mycobacterium avium
VLVGTLLSWYALVAALTTIPLVRWT

SEQ ID NO: 21620 - protein, 30 aa, Mycobacterium avium
VLVIAYCLGLGIPFVLLAFGSAGAVAGLGW

SEQ ID NO: 21621 - protein, 21 aa, Mycobacterium avium
VLVQALLVTSLLFALLISARV

SEQ ID NO: 21622 - protein, 28 aa, Mycobacterium avium
VMPALKPLRFLPQTALLESLLITMLAGH

SEQ ID NO: 21623 - protein, 18 aa, Mycobacterium avium
VNELDRFESLLNDLLEIS

SEQ ID NO: 21624 - protein, 20 aa, Mycobacterium avium
VNVWNDFLWPLLMIQRSSLA

SEQ ID NO: 21625 - protein, 21 aa, Mycobacterium avium
VPAVLLYRMLTCWLPVFVGWP

SEQ ID NO: 21626 - protein, 27 aa, Mycobacterium avium
VPLEATPPLFRWLAEFEPMHQVFLGTR

SEQ ID NO: 21627 - protein, 17 aa, Mycobacterium avium
VPPVRRLMAARQEAVRQ

SEQ ID NO: 21628 - protein, 26 aa, Mycobacterium avium
VPSIVAALFIFSLWIATLGFQQSSFA

SEQ ID NO: 21629 - protein, 24 aa, Mycobacterium avium
VPVEGRVGLLRKVLDSASITVNPI

SEQ ID NO: 21630 - protein, 32 aa, Mycobacterium avium
VQIGGTAFVVIFAVALVFYIVTSHHKKAGPTG

SEQ ID NO: 21631 - protein, 17 aa, Mycobacterium avium
VQSWFDRRRGRHGRGIL

SEQ ID NO: 21632 - protein, 23 aa, Mycobacterium avium
VQTPADIALALPAAVAAARTGGP

SEQ ID NO: 21633 - protein, 38 aa, Mycobacterium avium
VRDVLFGGKVSYLALLVLLLIALVIGLIGGVVGRKTAE

SEQ ID NO: 21634 - protein, 24 aa, Mycobacterium avium
VRGPTLAWVLAAYGLAGLLSVPLV

SEQ ID NO: 21635 - protein, 32 aa, Mycobacterium avium
VRIDGEIVLLLFLPAILYWEGLNISFREIRAN

SEQ ID NO: 21636 - protein, 23 aa, Mycobacterium avium
VRPRLYLALGPPALSISLLSFSR

SEQ ID NO: 21637 - protein, 19 aa, Mycobacterium avium
VRQVYDMALVFRHRVRKDR

SEQ ID NO: 21638 - protein, 25 aa, Mycobacterium avium
VRTIQYFFYDLITGRFQWQEFVRQG

SEQ ID NO: 21639 - protein, 33 aa, Mycobacterium avium
VRWHSGRRVHLDLDPLLPFPRWHEYAPAVEEPV

SEQ ID NO: 21640 - protein, 24 aa, Mycobacterium avium
VRWTAHLPRRRVLVASLTCLTASQ

SEQ ID NO: 21641 - protein, 24 aa, Mycobacterium avium
VSHAGSVMTWWTGDSLMVFDVNTL

SEQ ID NO: 21642 - protein, 22 aa, Mycobacterium avium
VSKEIVYFLAQLDVKEIHGYNP

SEQ ID NO: 21643 - protein, 43 aa, Mycobacterium avium
VSKGNQFIMPDLSGMFWTDAEPRLRALGWTGILDKGPDVDAGG

SEQ ID NO: 21644 - protein, 23 aa, Mycobacterium avium
VSLGLYSRIFRNNILASGVIPQI

SEQ ID NO: 21645 - protein, 20 aa, Mycobacterium avium
VSMQYSFLPSWLSFLVDKEN

SEQ ID NO: 21646 - protein, 18 aa, Mycobacterium avium
VSTTSIWMRLPTLAMALT

SEQ ID NO: 21647 - protein, 24 aa, Mycobacterium avium
VSVFVATISFLIYLACWLIGRRRE

SEQ ID NO: 21648 - protein, 24 aa, Mycobacterium avium
VTAAILVFIFAWNDLLLALTLTAT

SEQ ID NO: 21649 - protein, 23 aa, Mycobacterium avium
VTALIQLYIVGVFISFTLSQIGM

SEQ ID NO: 21650 - protein, 20 aa, Mycobacterium avium
VTFFYALGYPIGTLAVVAMT

SEQ ID NO: 21651 - protein, 30 aa, Mycobacterium avium
VTLITFVVIIVMLLVVYRSIITVAVMLGMV

SEQ ID NO: 21652 - protein, 22 aa, Mycobacterium avium
VTMGLVYLLSAYTTMSVFVTST

SEQ ID NO: 21653 - protein, 29 aa, Mycobacterium avium
VTRNPEVWSWIVWLPHNLHDELFDACGWR

SEQ ID NO: 21654 - protein, 25 aa, Mycobacterium avium
VTVAGIIFGLTMLALLTSSVLSIAQ

SEQ ID NO: 21655 - protein, 25 aa, Mycobacterium avium
VTVSWLIIGYGFVASVLPVWLLLAP

SEQ ID NO: 21656 - protein, 25 aa, Mycobacterium avium
VVAATAALIWWTSDARATVSRPAAV

SEQ ID NO: 21657 - protein, 24 aa, Mycobacterium avium
VVAIALIAVFLLLRAVPSLRVNHA

SEQ ID NO: 21658 - protein, 19 aa, Mycobacterium avium
VVAIAPRRWGLRDAVRAAD

SEQ ID NO: 21659 - protein, 24 aa, Mycobacterium avium
VVDVTAFQWNWKFGYQKVNFKDGT

SEQ ID NO: 21660 - protein, 23 aa, Mycobacterium avium
VVFAQAFHHLPPATAVRAIAEAT

SEQ ID NO: 21661 - protein, 26 aa, Mycobacterium avium
VVFTIPSLALFVVLPMIIGTRILDEA

SEQ ID NO: 21662 - protein, 25 aa, Mycobacterium avium
VVGAIVYGLIFWASAFHRKKATDTE

SEQ ID NO: 21663 - protein, 23 aa, Mycobacterium avium
VVGILFLLWERFARTRLIEPAGV

SEQ ID NO: 21664 - protein, 18 aa, Mycobacterium avium
VVHTFWVPEFLFKRDVIP

SEQ ID NO: 21665 - protein, 27 aa, Mycobacterium avium
VVKPTPISRLFILASRSARRESLPPSA

SEQ ID NO: 21666 - protein, 18 aa, Mycobacterium avium
VVLLVLLHRAKGGGLSTL

SEQ ID NO: 21667 - protein, 20 aa, Mycobacterium avium
VVLPALLPALLSGAGLAFSR

SEQ ID NO: 21668 - protein, 19 aa, Mycobacterium avium
VVLVLVAIVLFGAASLLFG

SEQ ID NO: 21669 - protein, 25 aa, Mycobacterium avium
VVNLTLLMPVFRWQRRDNLLAESDP

SEQ ID NO: 21670 - protein, 25 aa, Mycobacterium avium
VVPVSIALLLSWRFAPRALGPDDTW

SEQ ID NO: 21671 - protein, 25 aa, Mycobacterium avium
VVRANWVLRALLREYGRRLTHAGVF

SEQ ID NO: 21672 - protein, 23 aa, Mycobacterium avium
VVTNFAWLFPVLTGLPISQQTWN

SEQ ID NO: 21673 - protein, 18 aa, Mycobacterium avium
VVVALLAALLAGLGLLPK

SEQ ID NO: 21674 - protein, 27 aa, Mycobacterium avium
VVVVVGSVILWRFFGDALSKRSHTAAG

SEQ ID NO: 21675 - protein, 19 aa, Mycobacterium avium
VVYLFRPYIVYRSREVAAK

SEQ ID NO: 21676 - protein, 34 aa, Mycobacterium avium
VWDSAACKAWLLAQPYLAAGVLLVLYTATGRYAG

SEQ ID NO: 21677 - protein, 19 aa, Mycobacterium avium
VWFNLLQTSLAAGLSWYLA

SEQ ID NO: 21678 - protein, 30 aa, Mycobacterium avium
VWGVLTPGRPWAWLALVVAGLVVGIFITQG

SEQ ID NO: 21679 - protein, 26 aa, Mycobacterium avium
VWKTTPFMSLLLLAGLALVPEDLLKA

SEQ ID NO: 21680 - protein, 18 aa, Mycobacterium avium
VWSPQFSLWLVPLAVLAL

SEQ ID NO: 21681 - protein, 29 aa, Mycobacterium avium
VYIGIYFGLIIFFTYFYVSITFNPDERAD

SEQ ID NO: 21682 - protein, 17 aa, Mycobacterium avium
VYLLFVFTQTVRHRDFF

SEQ ID NO: 21683 - protein, 25 aa, Mycobacterium avium
VYVVRYLLLVINRDTLLYSWVAIGA

SEQ ID NO: 21684 - protein, 26 aa, Mycobacterium avium
VYYPVSWIMWVWYKLFAAMLGPSNFF

SEQ ID NO: 21685 - protein, 17 aa, Mycobacterium avium
WAAIALAVITLIFTNSQ

SEQ ID NO: 21686 - protein, 25 aa, Mycobacterium avium
WAAQEWLKSIFPFGGFPWGSVAFGQ

SEQ ID NO: 21687 - protein, 26 aa, Mycobacterium avium
WAETTVIIRFWLLTAIACGLGVALFY

SEQ ID NO: 21688 - protein, 26 aa, Mycobacterium avium
WAGGLTMITLIPFGVVLGALVAFIVF

SEQ ID NO: 21689 - protein, 21 aa, Mycobacterium avium
WAGLSLFLYLEVLDAAFSFDG

SEQ ID NO: 21690 - protein, 25 aa, Mycobacterium avium
WAPYHLRLDWLMWFAAISPGYAQPW

SEQ ID NO: 21691 - protein, 17 aa, Mycobacterium avium
WAQLYQRTSNLAREVAR

SEQ ID NO: 21692 - protein, 20 aa, Mycobacterium avium
WAVILARFAPFVRTFVPVIA

SEQ ID NO: 21693 - protein, 17 aa, Mycobacterium avium
WDGVVPLLAERFRILRY

SEQ ID NO: 21694 - protein, 23 aa, Mycobacterium avium
WGPRLGVRWWRFGAGVLLGLACG

SEQ ID NO: 21695 - protein, 19 aa, Mycobacterium avium
WIRRAHHRLSFQLSGAQLG

SEQ ID NO: 21696 - protein, 20 aa, Mycobacterium avium
WITDFQPYQPQLDAPTAWVV

SEQ ID NO: 21697 - protein, 27 aa, Mycobacterium avium
WLASIVGLFYLIWNYGYRQGTTGSSVG

SEQ ID NO: 21698 - protein, 17 aa, Mycobacterium avium
WLKTVPKRLSALLNTSG

SEQ ID NO: 21699 - protein, 17 aa, Mycobacterium avium
WLTLGLAAVWTVGALSS

SEQ ID NO: 21700 - protein, 17 aa, Mycobacterium avium
WLVFGGLWMAVGYLAAA

SEQ ID NO: 21701 - protein, 19 aa, Mycobacterium avium
WMRLPTLAMALTCWWVISR

SEQ ID NO: 21702 - protein, 20 aa, Mycobacterium avium
WNNFMWPLVITSGHKWRVLT

SEQ ID NO: 21703 - protein, 20 aa, Mycobacterium avium
WRNPLSYDPLGRVPPPEPEP

SEQ ID NO: 21704 - protein, 25 aa, Mycobacterium avium
WRRLATAIVRWPAPILATSVILAIV

SEQ ID NO: 21705 - protein, 21 aa, Mycobacterium avium
WSGLYFVLFFAAMSLAFDVAA

SEQ ID NO: 21706 - protein, 17 aa, Mycobacterium avium
WTGILDKGPDVDAGGAQ

SEQ ID NO: 21707 - protein, 17 aa, Mycobacterium avium
WVATEFALIVLLAVGSD

SEQ ID NO: 21708 - protein, 18 aa, Mycobacterium avium
WVSLHLFGFPALDYTTPL

SEQ ID NO: 21709 - protein, 18 aa, Mycobacterium avium
WWRMVRFEYALIVTTATA

SEQ ID NO: 21710 - protein, 25 aa, Mycobacterium avium
YAESLTEVFFWAAPVALVGFVLALF

SEQ ID NO: 21711 - protein, 24 aa, Mycobacterium avium
YAFGAFGVPLWQMAVGAFIGSAPR

SEQ ID NO: 21712 - protein, 25 aa, Mycobacterium avium
YAILLLAIWIGIGFIFRGVATTISA

SEQ ID NO: 21713 - protein, 22 aa, Mycobacterium avium
YALLPVLWIFSLSLKPTSTVKD

SEQ ID NO: 21714 - protein, 28 aa, Mycobacterium avium
YARDTDLCGLSWLYRYAVGVYRDDRGCG

SEQ ID NO: 21715 - protein, 18 aa, Mycobacterium avium
YARVPWVGAAALPDVGEP

SEQ ID NO: 21716 - protein, 20 aa, Mycobacterium avium
YCAGWLPWFADIDRQMYFFY

SEQ ID NO: 21717 - protein, 21 aa, Mycobacterium avium
YEFRLVSLAAQLVLWAGIGLV

SEQ ID NO: 21718 - protein, 27 aa, Mycobacterium avium
YFGTTDAPFDWYLGLLSRLASVSTAGV

SEQ ID NO: 21719 - protein, 28 aa, Mycobacterium avium
YGKGAFLSQLFGAILRPLGQPANEYIET

SEQ ID NO: 21720 - protein, 47 aa, Mycobacterium avium
YGPEQILIELLPHAGLAAFLLLLPITGVILLILVLVAASYRQVVMAY

SEQ ID NO: 21721 - protein, 29 aa, Mycobacterium avium
YGRIKRQQLFLSSLLRSLISADTLLDLNK

SEQ ID NO: 21722 - protein, 18 aa, Mycobacterium avium
YHPVLISTLLYTAATMAA

SEQ ID NO: 21723 - protein, 25 aa, Mycobacterium avium
YHSVFIRFLRYLSFGGMFIGLSVFQ

SEQ ID NO: 21724 - protein, 25 aa, Mycobacterium avium
YHTGVEQVLVFLPQGASIAQTVAAP

SEQ ID NO: 21725 - protein, 23 aa, Mycobacterium avium
YIIALPFFGIITEIIPVFARKPV

SEQ ID NO: 21726 - protein, 23 aa, Mycobacterium avium
YIQPYRRLVAVLMALQVISNLAS

SEQ ID NO: 21727 - protein, 24 aa, Mycobacterium avium
YIVSFALFIYGLMGLTGPKTAVRG

SEQ ID NO: 21728 - protein, 20 aa, Mycobacterium avium
YLALHPRLPRRDVIKVLAEA

SEQ ID NO: 21729 - protein, 20 aa, Mycobacterium avium
YLLLQTIVVAVWIVVNVFAV

SEQ ID NO: 21730 - protein, 35 aa, Mycobacterium avium
YLNADYNWTGWPADSRWRPATAIVGAVVALGAIAT

SEQ ID NO: 21731 - protein, 18 aa, Mycobacterium avium
YLPTLLAGLAITGLGMGC

SEQ ID NO: 21732 - protein, 18 aa, Mycobacterium avium
YMMWTEGLARIWPPWEFY

SEQ ID NO: 21733 - protein, 18 aa, Mycobacterium avium
YMTRVMLMTFFGEKRWAP

SEQ ID NO: 21734 - protein, 33 aa, Mycobacterium avium
YNMPLELVLTVTPFLIISVLFYFTVVVQEKMLH

SEQ ID NO: 21735 - protein, 23 aa, Mycobacterium avium
YPEGILLERIRATPIWIPQQSIS

SEQ ID NO: 21736 - protein, 18 aa, Mycobacterium avium
YRLTHVLDPLIALESLYR

SEQ ID NO: 21737 - protein, 26 aa, Mycobacterium avium
YTDVFRGLPEVVIILLIGLGIGPIVG

SEQ ID NO: 21738 - protein, 17 aa, Mycobacterium avium
YTELWVGFTAVTALLIL

SEQ ID NO: 21739 - protein, 17 aa, Mycobacterium avium
YTRPHVRLFTGRVNTGC

SEQ ID NO: 21740 - protein, 24 aa, Mycobacterium avium
YTSTYLRFVWTLSATALVVCYGLW

SEQ ID NO: 21741 - protein, 36 aa, Mycobacterium avium
YVADGLQHWPLLIFPYMILLVVVVSFISWSALSRLL

SEQ ID NO: 21742 - protein, 17 aa, Mycobacterium avium
YVALPPLHDQWRPVLWT

SEQ ID NO: 21743 - protein, 17 aa, Mycobacterium avium
YVLSRITLPGSIYLGAI

SEQ ID NO: 21744 - protein, 23 aa, Mycobacterium avium
YWVCAVYLVFLAAVAIAAAMFMD

SEQ ID NO: 21745 - protein, 17 aa, Mycobacterium avium
YYLCMLELRGTDLQGKT

SEQ ID NO: 21746 - protein, 21 aa, Mycobacterium avium
YYRYCTYVYIPFQYLSVILGA

SEQ ID NO: 21747 - protein, 25 aa, Mycobacterium avium
AAAGLPRHSFLSRLYTGTGAFEVVG

SEQ ID NO: 21748 - protein, 20 aa, Mycobacterium avium
AAAHIALGLLLKVGSTGVVF

SEQ ID NO: 21749 - protein, 18 aa, Mycobacterium avium
AAALAPRLPQMQSFTWTA

SEQ ID NO: 21750 - protein, 45 aa, Mycobacterium avium
AAALLVPAMRFRPFIRLTVEWVEVLAFIVLLPAAAALGGLFTWIR

SEQ ID NO: 21751 - protein, 29 aa, Mycobacterium avium
AAAYLLFLGAFLYLVAFLGNFWVPRTVDH

SEQ ID NO: 21752 - protein, 32 aa, Mycobacterium avium
AADLLRESLPLIGFLIVGLLYCRADGVILSLL

SEQ ID NO: 21753 - protein, 25 aa, Mycobacterium avium
AADNQTWPTTLWASNPTISAAIQFG

SEQ ID NO: 21754 - protein, 28 aa, Mycobacterium avium
AAEKWNLPVILIVLLAVFGSLAAAAIPL

SEQ ID NO: 21755 - protein, 25 aa, Mycobacterium avium
AAEVMLWHCWPITNRLPPAATLQLL

SEQ ID NO: 21756 - protein, 23 aa, Mycobacterium avium
AAFLNRHLGWFFLFKTGNVSLAG

SEQ ID NO: 21757 - protein, 26 aa, Mycobacterium avium
AAGLPWYAILCLPVLFAAGMCLLDTI

SEQ ID NO: 21758 - protein, 23 aa, Mycobacterium avium
AAGNALPLLAFALAGRRVAQRVA

SEQ ID NO: 21759 - protein, 28 aa, Mycobacterium avium
AAHCPAYFQLLVKSLLQPGLLELAQTAV

SEQ ID NO: 21760 - protein, 24 aa, Mycobacterium avium
AAHPWAFLMRSLVGGAMVAFGVLL

SEQ ID NO: 21761 - protein, 26 aa, Mycobacterium avium
AAIHWRARGWLKRVLPAALVAAVAVT

SEQ ID NO: 21762 - protein, 33 aa, Mycobacterium avium
AAILLGRITGLPLPAVLVPPMALSRMVLGVHYP

SEQ ID NO: 21763 - protein, 22 aa, Mycobacterium avium
AAKNMFAWIGPVLAALQGNPVC

SEQ ID NO: 21764 - protein, 18 aa, Mycobacterium avium
AALGEIPEWSRRARPIVL

SEQ ID NO: 21765 - protein, 19 aa, Mycobacterium avium
AAMFAWGISFLGRTRGQMA

SEQ ID NO: 21766 - protein, 25 aa, Mycobacterium avium
AANARFDFYVRDIATRFDYRDALLL

SEQ ID NO: 21767 - protein, 24 aa, Mycobacterium avium
AANARFNDYFREIATRFEYRDALL

SEQ ID NO: 21768 - protein, 24 aa, Mycobacterium avium
AANTALYIYATRAGKFVVWDRILS

SEQ ID NO: 21769 - protein, 17 aa, Mycobacterium avium
AAPLLAVLAICAAAAVL

SEQ ID NO: 21770 - protein, 36 aa, Mycobacterium avium
AAPPPPPPAVAPIPVPIPLPIPGLGGPGFGGPPGHG

SEQ ID NO: 21771 - protein, 23 aa, Mycobacterium avium
AAPRRIIALGVLVFLAAAVFGIP

SEQ ID NO: 21772 - protein, 27 aa, Mycobacterium avium
AAQATLLRWLWYGARREGLRLDGAEDD

SEQ ID NO: 21773 - protein, 20 aa, Mycobacterium avium
AARIGMGWPLTVLAALATYA

SEQ ID NO: 21774 - protein, 29 aa, Mycobacterium avium
AASGLLGWWRWHHNSWLPTVYAGVIGVLM

SEQ ID NO: 21775 - protein, 23 aa, Mycobacterium avium
AASYFLVTPLIVLTGTAIAMALP

SEQ ID NO: 21776 - protein, 24 aa, Mycobacterium avium
AATLGFPVRQPALPAGWQANSGHR

SEQ ID NO: 21777 - protein, 23 aa, Mycobacterium avium
AATLLGLLRPHVALDGARVVLAR

SEQ ID NO: 21778 - protein, 18 aa, Mycobacterium avium
AAVDAIRLSRRTLATIKT

SEQ ID NO: 21779 - protein, 19 aa, Mycobacterium avium
AAVLLSLVALVKDLGRPER

SEQ ID NO: 21780 - protein, 26 aa, Mycobacterium avium
AAWSVFRLFWLLYLGMTFGWLFGAMV

SEQ ID NO: 21781 - protein, 22 aa, Mycobacterium avium
ACAFSQAYWQLMLCRVFSGVGS

SEQ ID NO: 21782 - protein, 17 aa, Mycobacterium avium
ADAVKYLFRRPFQWREF

SEQ ID NO: 21783 - protein, 20 aa, Mycobacterium avium
ADAVPPWLRAASGVGALALF

SEQ ID NO: 21784 - protein, 32 aa, Mycobacterium avium
ADDTRLLVGAALVLIFLIVTAMLRSPVAGLVV

SEQ ID NO: 21785 - protein, 33 aa, Mycobacterium avium
ADMRITHPLISRAHLLLRYDQGKWLAIDNGSLN

SEQ ID NO: 21786 - protein, 35 aa, Mycobacterium avium
ADPRLVEVLGWLLYAVPVLVVFLRPARLAATPRAR

SEQ ID NO: 21787 - protein, 29 aa, Mycobacterium avium
ADRRRFFGYLNLFLASMLLLVIADNYVVL

SEQ ID NO: 21788 - protein, 37 aa, Mycobacterium avium
ADVPGMPRLLKWISPLIPLVAGPLPVAFFIGVLAGEE

SEQ ID NO: 21789 - protein, 23 aa, Mycobacterium avium
AELVDRLEQLLADPVLRDQLGAK

SEQ ID NO: 21790 - protein, 24 aa, Mycobacterium avium
AERDGGTWLLWNGRRSQINLADHA

SEQ ID NO: 21791 - protein, 38 aa, Mycobacterium avium
AFAIPTYAFIIGVLTMIGWGLFRIFVLGNPLRAESAGF

SEQ ID NO: 21792 - protein, 47 aa, Mycobacterium avium
AFARWVVRTPWPLFWLSMMQADIIGALFVLGFLRYALPPEDRIQLQD

SEQ ID NO: 21793 - protein, 20 aa, Mycobacterium avium
AFGLALAWLATVWASAGLAG

SEQ ID NO: 21794 - protein, 23 aa, Mycobacterium avium
AFGLAWRLDRAALLLWTAGLALY

SEQ ID NO: 21795 - protein, 39 aa, Mycobacterium avium
AFKISPTAWWVCGAATTVTLLYLGYLRRQTRIEEKVRRR

SEQ ID NO: 21796 - protein, 17 aa, Mycobacterium avium
AFLDSDVAPRRGWLEAL

SEQ ID NO: 21797 - protein, 18 aa, Mycobacterium avium
AFLGGWVLGLVGLTTAFV

SEQ ID NO: 21798 - protein, 18 aa, Mycobacterium avium
AFLHYRGWAIPVAFVIAQ

SEQ ID NO: 21799 - protein, 17 aa, Mycobacterium avium
AFRAIDRLGPELSVREI

SEQ ID NO: 21800 - protein, 20 aa, Mycobacterium avium
AFRFLGLHWSLPLGVAILLA

SEQ ID NO: 21801 - protein, 23 aa, Mycobacterium avium
AFRVPFLRNWKYSRAYLNWLADR

SEQ ID NO: 21802 - protein, 23 aa, Mycobacterium avium
AGAGLDAILYRSLLSGVDYAAAE

SEQ ID NO: 21803 - protein, 24 aa, Mycobacterium avium
AGDDFGVHPVLLDAALHALGVAGE

SEQ ID NO: 21804 - protein, 24 aa, Mycobacterium avium
AGDEYLVRCAAFWRQVAPAGAVLA

SEQ ID NO: 21805 - protein, 28 aa, Mycobacterium avium
AGFSHFTLLLVHALRQQFSRVRVFAFID

SEQ ID NO: 21806 - protein, 28 aa, Mycobacterium avium
AGGDIPFYEPGLRKLLNENLAAGRLRFT

SEQ ID NO: 21807 - protein, 24 aa, Mycobacterium avium
AGGVLPFVWIAWTALRNFRSGTTV

SEQ ID NO: 21808 - protein, 31 aa, Mycobacterium avium
AGHGPAAHRVWLPPLGRPPELRTLLGGAADL

SEQ ID NO: 21809 - protein, 22 aa, Mycobacterium avium
AGICLVLFALPAMALTIALLML

SEQ ID NO: 21810 - protein, 26 aa, Mycobacterium avium
AGIGMAVRRRKFGRRGHVVVIAGDGA

SEQ ID NO: 21811 - protein, 23 aa, Mycobacterium avium
AGIGVALVIWGSAVVAGFESVTK

SEQ ID NO: 21812 - protein, 19 aa, Mycobacterium avium
AGKAPWVGALLGVVLVFTC

SEQ ID NO: 21813 - protein, 20 aa, Mycobacterium avium
AGKTTLMLVLAGREPTSGTI

SEQ ID NO: 21814 - protein, 27 aa, Mycobacterium avium
AGLLALACWCLILATAALAGVLSGAPL

SEQ ID NO: 21815 - protein, 28 aa, Mycobacterium avium
AGLTYYTIFALFPLLMVGFAVFGFVLAR

SEQ ID NO: 21816 - protein, 17 aa, Mycobacterium avium
AGSWLPAVLWGVAFAVL

SEQ ID NO: 21817 - protein, 18 aa, Mycobacterium avium
AGTNWWAFRSACTSSGCA

SEQ ID NO: 21818 - protein, 19 aa, Mycobacterium avium
AGVLALPLPIAKVNRIMTA

SEQ ID NO: 21819 - protein, 20 aa, Mycobacterium avium
AGVLLLWSWLVLPLAQGYYS

SEQ ID NO: 21820 - protein, 25 aa, Mycobacterium avium
AGVTLFVLAGRYFERRSKRTAGAAL

SEQ ID NO: 21821 - protein, 29 aa, Mycobacterium avium
AGVTSLSIPSWWQPYVLSVASLTPDGQPS

SEQ ID NO: 21822 - protein, 17 aa, Mycobacterium avium
AHFNLLVAAALVPAAFV

SEQ ID NO: 21823 - protein, 30 aa, Mycobacterium avium
AHPGSGGVSLWWMIGLLAAAGVLGLMVVLP

SEQ ID NO: 21824 - protein, 18 aa, Mycobacterium avium
AHPKAVPAVIQALGDLLS

SEQ ID NO: 21825 - protein, 18 aa, Mycobacterium avium
AIAFAWIISVGPPGPPPP

SEQ ID NO: 21826 - protein, 25 aa, Mycobacterium avium
AIALTTIFGFFWYSHSIFGLESLGE

SEQ ID NO: 21827 - protein, 28 aa, Mycobacterium avium
AIALTVSILLTPALIRLFTRQGFGHHTR

SEQ ID NO: 21828 - protein, 27 aa, Mycobacterium avium
AIASGPFFKVVLHNLALYQISQPWVDA

SEQ ID NO: 21829 - protein, 42 aa, Mycobacterium avium
AILDTALVLAAIVIALAVVLLVARALVRPLRTLRDGALKVAH

SEQ ID NO: 21830 - protein, 20 aa, Mycobacterium avium
AILIMAFPHTGLGVERLYDA

SEQ ID NO: 21831 - protein, 19 aa, Mycobacterium avium
AILMLYTIVIVRGLRTAIA

SEQ ID NO: 21832 - protein, 25 aa, Mycobacterium avium
AIPLAALGMLNPMLAGAAMALSSVL

SEQ ID NO: 21833 - protein, 24 aa, Mycobacterium avium
AIRDPRLLVTCGVVLLAVFAAFIA

SEQ ID NO: 21834 - protein, 27 aa, Mycobacterium avium
AIRRRSGFPLLLLAVLAAAACADLSML

SEQ ID NO: 21835 - protein, 18 aa, Mycobacterium avium
AIVLFIASIVVLVVALRR

SEQ ID NO: 21836 - protein, 23 aa, Mycobacterium avium
AKRGRLWRRVGTAVVRWPAPVLA

SEQ ID NO: 21837 - protein, 25 aa, Mycobacterium avium
AKSATPVPQLTWIPAKGAQTPPAVQ

SEQ ID NO: 21838 - protein, 36 aa, Mycobacterium avium
ALAAGMLPILGWRNEIRWALLVAGLVLFAVADGAYL

SEQ ID NO: 21839 - protein, 19 aa, Mycobacterium avium
ALACTAGALGITLLGSVPP

SEQ ID NO: 21840 - protein, 17 aa, Mycobacterium avium
ALAFLLMSRMQPSTPAV

SEQ ID NO: 21841 - protein, 53 aa, Mycobacterium avium
ALAGIFVCLFCAFYFMTVTYSLMTFWITTMLALLYGLLGQFSFGVLMLRIEET

SEQ ID NO: 21842 - protein, 26 aa, Mycobacterium avium
ALAGLSGWLGYRAYQQHDAQARRNLF

SEQ ID NO: 21843 - protein, 24 aa, Mycobacterium avium
ALAGSLLFGLWHVATSFGLTSGNV

SEQ ID NO: 21844 - protein, 18 aa, Mycobacterium avium
ALAVRRLVAVLAAAFSPA

SEQ ID NO: 21845 - protein, 26 aa, Mycobacterium avium
ALDRGYTYGLLWLAGVVALLGGVTLL

SEQ ID NO: 21846 - protein, 26 aa, Mycobacterium avium
ALDYTTPLFAFLFLAALGVDYTIFLV

SEQ ID NO: 21847 - protein, 25 aa, Mycobacterium avium
ALESLAIRPIPFLVTTRLMASVIAV

SEQ ID NO: 21848 - protein, 18 aa, Mycobacterium avium
ALFVLLRAADRKGWRRRL

SEQ ID NO: 21849 - protein, 17 aa, Mycobacterium avium
ALGLLLKVGSTGVVFRT

SEQ ID NO: 21850 - protein, 19 aa, Mycobacterium avium
ALGRIIISHALPNGAMSLG

SEQ ID NO: 21851 - protein, 24 aa, Mycobacterium avium
ALILALRFHRSAALALLALFVVQF

SEQ ID NO: 21852 - protein, 17 aa, Mycobacterium avium
ALLALYLVVQARRRRRL

SEQ ID NO: 21853 - protein, 19 aa, Mycobacterium avium
ALLSFAIMLVGFSATALAL

SEQ ID NO: 21854 - protein, 24 aa, Mycobacterium avium
ALLVHFVLVLVPLTALLDIVCGLW

SEQ ID NO: 21855 - protein, 19 aa, Mycobacterium avium
ALPIVPLFAYSRTAAMLCL

SEQ ID NO: 21856 - protein, 24 aa, Mycobacterium avium
ALRLKGYLLMCRNSRRDYADFADM

SEQ ID NO: 21857 - protein, 18 aa, Mycobacterium avium
ALRWRTTVGAAAISVAQR

SEQ ID NO: 21858 - protein, 20 aa, Mycobacterium avium
ALSLPPLLLGLLGTLAYVAP

SEQ ID NO: 21859 - protein, 22 aa, Mycobacterium avium
ALTASALLLTAGLTVWVVGYTL

SEQ ID NO: 21860 - protein, 24 aa, Mycobacterium avium
ALTGFLSAFLNVRMIAPCTAGLAL

SEQ ID NO: 21861 - protein, 23 aa, Mycobacterium avium
ALTWVRFGIWLVVGTAIYAGYGY

SEQ ID NO: 21862 - protein, 25 aa, Mycobacterium avium
ALVFKPLFFPNISPSAGTLASFATY

SEQ ID NO: 21863 - protein, 24 aa, Mycobacterium avium
ALVGANFWRRGSLLLGIGVGVAAL

SEQ ID NO: 21864 - protein, 28 aa, Mycobacterium avium
ALVIEGAFTLPFMAVYYGYPTLSLTQIC

SEQ ID NO: 21865 - protein, 20 aa, Mycobacterium avium
ALVLGALAFLFLASTVLVVC

SEQ ID NO: 21866 - protein, 21 aa, Mycobacterium avium
ALVRSGLLNPPSPRAVLRLLR

SEQ ID NO: 21867 - protein, 22 aa, Mycobacterium avium
ALWVSRTDGVVLHWITDYWNHF

SEQ ID NO: 21868 - protein, 20 aa, Mycobacterium avium
AMALTCWWVISREVMPRLGH

SEQ ID NO: 21869 - protein, 26 aa, Mycobacterium avium
AMDYEVFLVSRIHEYWLASQSIRETP

SEQ ID NO: 21870 - protein, 21 aa, Mycobacterium avium
AMGAVLLVTGLAGCFVFSLIR

SEQ ID NO: 21871 - protein, 23 aa, Mycobacterium avium
AMHLWFLAVYLVVVSLTPIALVA

SEQ ID NO: 21872 - protein, 17 aa, Mycobacterium avium
AMLFAVIPAVAAVLSWI

SEQ ID NO: 21873 - protein, 29 aa, Mycobacterium avium
AMLVAAAWLALFALPLLFVAHRLTESAEG

SEQ ID NO: 21874 - protein, 29 aa, Mycobacterium avium
AMSPAALTALLPGLLDLLSGRMPPPDASQ

SEQ ID NO: 21875 - protein, 26 aa, Mycobacterium avium
AMVVVLMAFAVYAVISAALYSDIDNQ

SEQ ID NO: 21876 - protein, 21 aa, Mycobacterium avium
ANFDDFFRPVRSYFYWEKHCF

SEQ ID NO: 21877 - protein, 30 aa, Mycobacterium avium
ANIDATLIRMLVIFGIVTVIALAAATIAGV

SEQ ID NO: 21878 - protein, 31 aa, Mycobacterium avium
APAPYPPRRSKRRLIVGLALAVALVAVMTVA

SEQ ID NO: 21879 - protein, 18 aa, Mycobacterium avium
APEPAFKAAIAKASEAAA

SEQ ID NO: 21880 - protein, 44 aa, Mycobacterium avium
APGSSGRVILLATLAALLVAVMALLLVMRYRGRRRRAAALAAAR

SEQ ID NO: 21881 - protein, 32 aa, Mycobacterium avium
APKRPSTWRHLPAILLVASLVLFTIAMAGPTN

SEQ ID NO: 21882 - protein, 18 aa, Mycobacterium avium
APNTVFLFLLNSSGAIIL

SEQ ID NO: 21883 - protein, 30 aa, Mycobacterium avium
APPAHPLPPRRVAAPAIPPIPGLNEPIPGL

SEQ ID NO: 21884 - protein, 28 aa, Mycobacterium avium
APRDTVCVSWLPFYHDMGLVQGVIAPIL

SEQ ID NO: 21885 - protein, 20 aa, Mycobacterium avium
APRRPWSMLLAGGALAGIAA

SEQ ID NO: 21886 - protein, 24 aa, Mycobacterium avium
APSVVGLLFLLYLVGTGTSVVAGR

SEQ ID NO: 21887 - protein, 23 aa, Mycobacterium avium
APVAVLVYLFAVDWRVALVLFVP

SEQ ID NO: 21888 - protein, 17 aa, Mycobacterium avium
APVAWGVLIGFVALYLI

SEQ ID NO: 21889 - protein, 23 aa, Mycobacterium avium
AQARRNLFVATARQGAVNLTTIN

SEQ ID NO: 21890 - protein, 41 aa, Mycobacterium avium
AQHLGFRAAFLLLAGLSLGALIIWVTFAPMLRRAARLPAAP

SEQ ID NO: 21891 - protein, 43 aa, Mycobacterium avium
AQLLETIVMLALQFVIHRTLYLIWLILYNPAGLLSFFLSNPVY

SEQ ID NO: 21892 - protein, 43 aa, Mycobacterium avium
AQLSFTRFTLLMAAPWLAAVATLYAVFRGFFAKDLRVQPDPAA

SEQ ID NO: 21893 - protein, 30 aa, Mycobacterium avium
AQVPLWIGPILLYVLLPILDLRFGPDGQNP

SEQ ID NO: 21894 - protein, 24 aa, Mycobacterium avium
AQWGYRMVLPQLILMPVLYVVQEM

SEQ ID NO: 21895 - protein, 17 aa, Mycobacterium avium
ARALAEHVDWSLIDVIR

SEQ ID NO: 21896 - protein, 20 aa, Mycobacterium avium
ARALTAAPVPLAAGFMALVF

SEQ ID NO: 21897 - protein, 25 aa, Mycobacterium avium
ARDFLRIDIIIFGLTIYALLGIITD

SEQ ID NO: 21898 - protein, 35 aa, Mycobacterium avium
ARDVFALLSPFLLVAAVIFVPMLDLLLAIVRRTRA

SEQ ID NO: 21899 - protein, 30 aa, Mycobacterium avium
ARIMTPLRVMFLIALVFLALGWSTKAACLQ

SEQ ID NO: 21900 - protein, 26 aa, Mycobacterium avium
ARKYAFRKRVLMAMAVVLVGSATAAF

SEQ ID NO: 21901 - protein, 25 aa, Mycobacterium avium
ARPHAHTFSFFLPQGHEYQITLIVM

SEQ ID NO: 21902 - protein, 24 aa, Mycobacterium avium
ARRIDNVMLVSAFLAAAALAQNVG

SEQ ID NO: 21903 - protein, 34 aa, Mycobacterium avium
ARRNVKVVPIVLISLLLISGAGTAWLYFKEYLPD

SEQ ID NO: 21904 - protein, 20 aa, Mycobacterium avium
ARTLATRLAARRRRSRAGTI

SEQ ID NO: 21905 - protein, 26 aa, Mycobacterium avium
ARTWHLQLSLFWTAAAFLAGGIFLVP

SEQ ID NO: 21906 - protein, 18 aa, Mycobacterium avium
ARYTKMTAMPQLVAFFNG

SEQ ID NO: 21907 - protein, 22 aa, Mycobacterium avium
ASAAALAALLLASGALAGLPPA

SEQ ID NO: 21908 - protein, 23 aa, Mycobacterium avium
ASALYLFSYYLGGSVAGAFGGVL

SEQ ID NO: 21909 - protein, 25 aa, Mycobacterium avium
ASFGNKWMWSPIVVTPPVVVAGIGG

SEQ ID NO: 21910 - protein, 25 aa, Mycobacterium avium
ASGAMVFAILILLGRYINYTLDLAG

SEQ ID NO: 21911 - protein, 31 aa, Mycobacterium avium
ASGPAIYNYTWLVLMLPFGMIGVTVLTVVMP

SEQ ID NO: 21912 - protein, 20 aa, Mycobacterium avium
ASIYPPCPFKWLTGWNCPFC

SEQ ID NO: 21913 - protein, 24 aa, Mycobacterium avium
ASKLLSRNLYIYGLGGIVAPFIGI

SEQ ID NO: 21914 - protein, 19 aa, Mycobacterium avium
ASLVVFLVALPLSLGIAIA

SEQ ID NO: 21915 - protein, 26 aa, Mycobacterium avium
ASPAKRAWLPIAIAVIAVVVVVVVLL

SEQ ID NO: 21916 - protein, 17 aa, Mycobacterium avium
ASPIRRLRADAPPFFVL

SEQ ID NO: 21917 - protein, 31 aa, Mycobacterium avium
ASPIRVITRRLAIALVVLFAAAVIVYADRSG

SEQ ID NO: 21918 - protein, 28 aa, Mycobacterium avium
ASTAALITLLVTALWVLAVVARPYQWWR

SEQ ID NO: 21919 - protein, 23 aa, Mycobacterium avium
ASTPPVTLLPRRNPGSSGIADVA

SEQ ID NO: 21920 - protein, 33 aa, Mycobacterium avium
ASVISWVSVVIIGIWVMLQIASILQFSVGGLVA

SEQ ID NO: 21921 - protein, 22 aa, Mycobacterium avium
ASVLIRRPLVGYAWSWAGGRGD

SEQ ID NO: 21922 - protein, 31 aa, Mycobacterium avium
ASVSAALVICLGALLWSFISPAGQVGDSPII

SEQ ID NO: 21923 - protein, 22 aa, Mycobacterium avium
ATAFGFVVVVLLLSGLNATIFE

SEQ ID NO: 21924 - protein, 24 aa, Mycobacterium avium
ATARTLAILLATTAPVIVAVAAGA

SEQ ID NO: 21925 - protein, 36 aa, Mycobacterium avium
ATGPAAFLGFGWRIPFLLSIFLVAVGLFVRLRLTDA

SEQ ID NO: 21926 - protein, 18 aa, Mycobacterium avium
ATLVLTIPLAWLLHRFTR

SEQ ID NO: 21927 - protein, 35 aa, Mycobacterium avium
ATMRLLAMQVPGQLLFSLASQLALILLAGAATALT

SEQ ID NO: 21928 - protein, 17 aa, Mycobacterium avium
ATQLLLGPVARGTTVSL

SEQ ID NO: 21929 - protein, 23 aa, Mycobacterium avium
ATRWAPLLQWVMVAVAGAVILVA

SEQ ID NO: 21930 - protein, 25 aa, Mycobacterium avium
ATTDRAYAFLVPPTIRGVNQSRVEA

SEQ ID NO: 21931 - protein, 22 aa, Mycobacterium avium
ATVAFPMYFLKSFAYAGVATVA

SEQ ID NO: 21932 - protein, 58 aa, Mycobacterium avium
ATVAGCLPAVIWWACHRPNRLWWRYTGWWLVALVLATLWWVVGLVMLRAISPPFLDFI

SEQ ID NO: 21933 - protein, 18 aa, Mycobacterium avium
AVAAIVAGGLYGIEQGLA

SEQ ID NO: 21934 - protein, 21 aa, Mycobacterium avium
AVALVLWWRMVRFEYALIVTT

SEQ ID NO: 21935 - protein, 17 aa, Mycobacterium avium
AVARLRPRVPGLHLDIV

SEQ ID NO: 21936 - protein, 37 aa, Mycobacterium avium
AVARTLALALLLYLVSALLIWVQARLLNRTVQRTMVA

SEQ ID NO: 21937 - protein, 27 aa, Mycobacterium avium
AVATAVIWTVALTRPAKMHEAAVCNPP

SEQ ID NO: 21938 - protein, 40 aa, Mycobacterium avium
AVAVLVGVALVFVRWWGQPAWSWAVLWRRGRRPIDWSAPI

SEQ ID NO: 21939 - protein, 17 aa, Mycobacterium avium
AVDLLTPGKLRQLVFID

SEQ ID NO: 21940 - protein, 25 aa, Mycobacterium avium
AVGLAALLSITFLPACLGILGRHVD

SEQ ID NO: 21941 - protein, 36 aa, Mycobacterium avium
AVGTYAYLLFWVRALQVLLLLYVVPFFLAQATPVTM

SEQ ID NO: 21942 - protein, 22 aa, Mycobacterium avium
AVIFSYVWGVRVGGLFTALGVT

SEQ ID NO: 21943 - protein, 23 aa, Mycobacterium avium
AVLAIGLVRWYFGHGQRSTTAAG

SEQ ID NO: 21944 - protein, 20 aa, Mycobacterium avium
AVLAIGVFVGLEGWSSTPAR

SEQ ID NO: 21945 - protein, 29 aa, Mycobacterium avium
AVLGAALGLRYALGARRWARLGMAGSAGG

SEQ ID NO: 21946 - protein, 25 aa, Mycobacterium avium
AVLGLIGVALGWGWADAVAGIVVTG

SEQ ID NO: 21947 - protein, 20 aa, Mycobacterium avium
AVLTILTAGLLWATPVGAQP

SEQ ID NO: 21948 - protein, 22 aa, Mycobacterium avium
AVLVLAPFWLIPTTLDVHLSMT

SEQ ID NO: 21949 - protein, 20 aa, Mycobacterium avium
AVMFLVAVGFWNFLGAGIFG

SEQ ID NO: 21950 - protein, 52 aa, Mycobacterium avium
AVPAKRPPAWSLSNWPVRWKVLAIVLVPLMLATVFGVLRIHGAMANAAGLRL

SEQ ID NO: 21951 - protein, 24 aa, Mycobacterium avium
AVPMVAVVLFLVFGGAVAAGLPAI

SEQ ID NO: 21952 - protein, 24 aa, Mycobacterium avium
AVQRWLPYATVVVGVLLVALGGWL

SEQ ID NO: 21953 - protein, 17 aa, Mycobacterium avium
AVSARKYAFRKRVLMAM

SEQ ID NO: 21954 - protein, 23 aa, Mycobacterium avium
AVTLCAVVLRRLRAALVLALACA

SEQ ID NO: 21955 - protein, 22 aa, Mycobacterium avium
AVTMLLPLVTILLSLVIAQAAV

SEQ ID NO: 21956 - protein, 17 aa, Mycobacterium avium
AVVSVAVRPLGPAGTYT

SEQ ID NO: 21957 - protein, 24 aa, Mycobacterium avium
AVVWFGITSAWRERLDRRLDETAG

SEQ ID NO: 21958 - protein, 18 aa, Mycobacterium avium
AWATPARWGFAASASTAD

SEQ ID NO: 21959 - protein, 20 aa, Mycobacterium avium
AWIALFAMSLLFGIMKMINR

SEQ ID NO: 21960 - protein, 20 aa, Mycobacterium avium
AWLLTRWLIPGWTGRVLVWA

SEQ ID NO: 21961 - protein, 24 aa, Mycobacterium avium
AWSLTVLVAVAWIARGIFLGRPVT

SEQ ID NO: 21962 - protein, 21 aa, Mycobacterium avium
AWVVHLLPVLPIATVVLVLLP

SEQ ID NO: 21963 - protein, 22 aa, Mycobacterium avium
AYLLAKIVVFCVFAVAQAAVAT

SEQ ID NO: 21964 - protein, 38 aa, Mycobacterium avium
AYSAFVPNFLAPQLFQPFLDYLWGFRTFDTARGPGHPS

SEQ ID NO: 21965 - protein, 21 aa, Mycobacterium avium
CAALAVLPLPSVLAGAVVAAT

SEQ ID NO: 21966 - protein, 17 aa, Mycobacterium avium
CAIAMVVIVLAALTLAP

SEQ ID NO: 21967 - protein, 27 aa, Mycobacterium avium
CDGAVVVHPSWWPPARVRTVSAAAATL

SEQ ID NO: 21968 - protein, 17 aa, Mycobacterium avium
CFGLALVCSVLLDAYIA

SEQ ID NO: 21969 - protein, 46 aa, Mycobacterium avium
CGGLVGPIFLVVYFTLGLGSLLQWMFYVGLLITVADVLIALALANY

SEQ ID NO: 21970 - protein, 30 aa, Mycobacterium avium
CGIIGLGAALLIAALLLTTYTTSRITKVPL

SEQ ID NO: 21971 - protein, 24 aa, Mycobacterium avium
CGPRPHLRGLRRSRLPAELITEIG

SEQ ID NO: 21972 - protein, 45 aa, Mycobacterium avium
CIGLLLDTLIVRTLLMPSIATLLGRWFWWPMVVHPRGDNARRPVP

SEQ ID NO: 21973 - protein, 19 aa, Mycobacterium avium
CLAAALFLAAAPAVSGTAS

SEQ ID NO: 21974 - protein, 35 aa, Mycobacterium avium
CLFGVLLAFRFLTPWGRQFWRITRGYFVGAHSVRV

SEQ ID NO: 21975 - protein, 17 aa, Mycobacterium avium
CNYGLMLMGLPAAAVLA

SEQ ID NO: 21976 - protein, 26 aa, Mycobacterium avium
CVAALLVAQMFVRPIRRLQAGAREIS

SEQ ID NO: 21977 - protein, 18 aa, Mycobacterium avium
CVLGARLYPGPVAALLLG

SEQ ID NO: 21978 - protein, 28 aa, Mycobacterium avium
CVPAAIMLWLLLRLPESPRWLVKKDNRD

SEQ ID NO: 21979 - protein, 25 aa, Mycobacterium avium
CVPELLIPVLLLNFTPMFGHPSHAS

SEQ ID NO: 21980 - protein, 22 aa, Mycobacterium avium
CVVPLANLLWAPVFVIELALLE

SEQ ID NO: 21981 - protein, 29 aa, Mycobacterium avium
CWQKITRDLWPAPYLVMDTGASLAPYNHL

SEQ ID NO: 21982 - protein, 18 aa, Mycobacterium avium
CWRLIEAGVRLRYEPIAL

SEQ ID NO: 21983 - protein, 17 aa, Mycobacterium avium
CWWAPRWARRLQNKIGL

SEQ ID NO: 21984 - protein, 17 aa, Mycobacterium avium
CYDIPICFSLRSIFDAL

SEQ ID NO: 21985 - protein, 24 aa, Mycobacterium avium
DAAYRQAAPPPWSIGRPQPELERL

SEQ ID NO: 21986 - protein, 21 aa, Mycobacterium avium
DALFWVAFIVAITVAGMVIPD

SEQ ID NO: 21987 - protein, 21 aa, Mycobacterium avium
DAMTGLLWPVVAVTTFAAFGL

SEQ ID NO: 21988 - protein, 20 aa, Mycobacterium avium
DAPPTLLARQPLGGAVGGDV

SEQ ID NO: 21989 - protein, 22 aa, Mycobacterium avium
DARHPFLVMELIEGGTLRELLG

SEQ ID NO: 21990 - protein, 27 aa, Mycobacterium avium
DDDQNSLLPRWLPGAPEHRGWVARIRA

SEQ ID NO: 21991 - protein, 24 aa, Mycobacterium avium
DDEKFRAFLAEQPDLGPKQWPSYV

SEQ ID NO: 21992 - protein, 25 aa, Mycobacterium avium
DDLAYGLGLWWGVLRERNARALRPQ

SEQ ID NO: 21993 - protein, 23 aa, Mycobacterium avium
DDPPICTVGFMPPNTWRSPDDLS

SEQ ID NO: 21994 - protein, 25 aa, Mycobacterium avium
DDVVNLLHMIYSLIMVAMAVEIMHQ

SEQ ID NO: 21995 - protein, 17 aa, Mycobacterium avium
DDWRRWYRLARAYDYAG

SEQ ID NO: 21996 - protein, 32 aa, Mycobacterium avium
DENPILPPMGLNAPVPIPPPPPGPGVAPGPVA

SEQ ID NO: 21997 - protein, 24 aa, Mycobacterium avium
DERRRLLGQPPLGPALLTADARAA

SEQ ID NO: 21998 - protein, 24 aa, Mycobacterium avium
DHAAFVGIYALIRRAAEQVRKHGF

SEQ ID NO: 21999 - protein, 24 aa, Mycobacterium avium
DHANPAVLWWSLALGTDFGGNLTA

SEQ ID NO: 22000 - protein, 28 aa, Mycobacterium avium
DHRETYDAMFDLWFPAALGARAVVTDED

SEQ ID NO: 22001 - protein, 20 aa, Mycobacterium avium
DHWVNQAVVLFPSADKAKSF

SEQ ID NO: 22002 - protein, 29 aa, Mycobacterium avium
DIAKYFAIIPAMFVALFPGLDLINVMRLH

SEQ ID NO: 22003 - protein, 25 aa, Mycobacterium avium
DILALTIFQLLSTNGIYPLLIMAML

SEQ ID NO: 22004 - protein, 17 aa, Mycobacterium avium
DIPICFSLRSIFDALDG

SEQ ID NO: 22005 - protein, 24 aa, Mycobacterium avium
DKFVPIFTRLNRLSDKFFQEVWDP

SEQ ID NO: 22006 - protein, 18 aa, Mycobacterium avium
DKPVIFWTPEHGAHVVRG

SEQ ID NO: 22007 - protein, 24 aa, Mycobacterium avium
DLARGYLAIALPVGTLGLLASRSL

SEQ ID NO: 22008 - protein, 25 aa, Mycobacterium avium
DLEPRGWWAQLSWLPQRPVLVPGTV

SEQ ID NO: 22009 - protein, 21 aa, Mycobacterium avium
DLPGYPLPWALPVAMWALAAA

SEQ ID NO: 22010 - protein, 20 aa, Mycobacterium avium
DLPLLLGALFANGLARFVGS

SEQ ID NO: 22011 - protein, 19 aa, Mycobacterium avium
DLQRSLSPPGPPPTQGGAL

SEQ ID NO: 22012 - protein, 18 aa, Mycobacterium avium
DLSYGVYIYAWPMQQLLA

SEQ ID NO: 22013 - protein, 19 aa, Mycobacterium avium
DLTANPLRFLARATNLWNS

SEQ ID NO: 22014 - protein, 26 aa, Mycobacterium avium
DNAARWLGGAALVLAALGIAIALVRR

SEQ ID NO: 22015 - protein, 24 aa, Mycobacterium avium
DNEILGLCFMFVLAGLDTVTSAVG

SEQ ID NO: 22016 - protein, 31 aa, Mycobacterium avium
DNKRKQWIIVGAVALVALVAFVVAVVGYLST

SEQ ID NO: 22017 - protein, 29 aa, Mycobacterium avium
DPGSAVQAPWPLLRTFAAGPALSREAALL

SEQ ID NO: 22018 - protein, 29 aa, Mycobacterium avium
DPTGISLPMFMEELFWGCAGIGLAIVMPA

SEQ ID NO: 22019 - protein, 39 aa, Mycobacterium avium
DPWSTLKVSLLLSVALFFVWMIAVAFLYLVLGGMGVWSK

SEQ ID NO: 22020 - protein, 33 aa, Mycobacterium avium
DQEAEPTPWYRRPAMLIAWVVSVVVLIGLIVFG

SEQ ID NO: 22021 - protein, 17 aa, Mycobacterium avium
DQVLLMAPGGKTAFLGP

SEQ ID NO: 22022 - protein, 21 aa, Mycobacterium avium
DRAALLLWTAGLALYGLLIGS

SEQ ID NO: 22023 - protein, 19 aa, Mycobacterium avium
DRGWMLYSHKPPRGTPIDR

SEQ ID NO: 22024 - protein, 21 aa, Mycobacterium avium
DRHLRPMLARRYAIATGQRQA

SEQ ID NO: 22025 - protein, 25 aa, Mycobacterium avium
DRVLMWLVDLLLVVPSFILIAIVTP

SEQ ID NO: 22026 - protein, 21 aa, Mycobacterium avium
DSANRLAPRPISRPPVDPASR

SEQ ID NO: 22027 - protein, 26 aa, Mycobacterium avium
DSIGWTWMHYLPPTPGFAFLDHTVIG

SEQ ID NO: 22028 - protein, 17 aa, Mycobacterium avium
DSPPRTEILGRLGPYRV

SEQ ID NO: 22029 - protein, 25 aa, Mycobacterium avium
DSVVAWWVRLVMPALAVVAVVKPLV

SEQ ID NO: 22030 - protein, 34 aa, Mycobacterium avium
DTLISIGTLAAFLWSLYALVLGAADRPGMRHDFE

SEQ ID NO: 22031 - protein, 18 aa, Mycobacterium avium
DVALTCVASAMLGLALSA

SEQ ID NO: 22032 - protein, 24 aa, Mycobacterium avium
DVAPRRGWLEALLGHFCDPTVGLV

SEQ ID NO: 22033 - protein, 24 aa, Mycobacterium avium
DVFFVLSGFLITSLLLDELGRTGR

SEQ ID NO: 22034 - protein, 18 aa, Mycobacterium avium
DVMLLAIVLLAGLGKLSD

SEQ ID NO: 22035 - protein, 22 aa, Mycobacterium avium
DVPQPLAYCLPGVRSRVVVSEG

SEQ ID NO: 22036 - protein, 27 aa, Mycobacterium avium
DVVELRLPRQLPVLAPGQEWRTVWDSA

SEQ ID NO: 22037 - protein, 22 aa, Mycobacterium avium
DWCAMLDGLGGRRVDLPTYGFV

SEQ ID NO: 22038 - protein, 32 aa, Mycobacterium avium
DYLGALLGGLVWPFLLLPQLGMIRGAAATGMI

SEQ ID NO: 22039 - protein, 18 aa, Mycobacterium avium
DYVIFLLGRYHEARSFGQ

SEQ ID NO: 22040 - protein, 47 aa, Mycobacterium avium
DYYQHDIKFIIAVTLLVVLLTLMALLRAIVAPLYLVATVVISYLSAV

SEQ ID NO: 22041 - protein, 24 aa, Mycobacterium avium
EAAFYRLSSLRLWPDRRLSRRGVE

SEQ ID NO: 22042 - protein, 17 aa, Mycobacterium avium
EAAYFINLAFMALFVFA

SEQ ID NO: 22043 - protein, 19 aa, Mycobacterium avium
EAELLDWIHGAADANQPVI

SEQ ID NO: 22044 - protein, 25 aa, Mycobacterium avium
EFMVFDEPYRQAWASGYRGLTPASD

SEQ ID NO: 22045 - protein, 34 aa, Mycobacterium avium
EFVCLIAPMFLAMYLRAFYSPRRGAALVAVLAGL

SEQ ID NO: 22046 - protein, 28 aa, Mycobacterium avium
EGTDLDSVLKRFGPLPPPRAVAIITQIA

SEQ ID NO: 22047 - protein, 22 aa, Mycobacterium avium
EGVGLWLLKRWGEYFAVIATSV

SEQ ID NO: 22048 - protein, 19 aa, Mycobacterium avium
EHFFVAPTLLLGLLTVLAV

SEQ ID NO: 22049 - protein, 35 aa, Mycobacterium avium
EHSHRSGLVWLLVLPVLVLMFVAPPALRPSAAAPS

SEQ ID NO: 22050 - protein, 18 aa, Mycobacterium avium
EIIMIVGALHFKESRGRG

SEQ ID NO: 22051 - protein, 36 aa, Mycobacterium avium
EILIARNDRYWGPPAKPGLILFRRAGAPAALADSVR

SEQ ID NO: 22052 - protein, 27 aa, Mycobacterium avium
EINGWRDWVLGAMVLAILGTGLFLGLF

SEQ ID NO: 22053 - protein, 30 aa, Mycobacterium avium
EIPEWSRRARPIVLIPDAAAALLAVRTSPG

SEQ ID NO: 22054 - protein, 24 aa, Mycobacterium avium
ELAATIARRLGLTGALGTVAESVD

SEQ ID NO: 22055 - protein, 21 aa, Mycobacterium avium
ELQALLGAPHWNSDDKAVLRA

SEQ ID NO: 22056 - protein, 18 aa, Mycobacterium avium
ELRDWLARKAFYGGSAAP

SEQ ID NO: 22057 - protein, 20 aa, Mycobacterium avium
EPEHPAPTLALAAGPAAGHQ

SEQ ID NO: 22058 - protein, 22 aa, Mycobacterium avium
EPVLPHEDWVLTRPRLTGICGS

SEQ ID NO: 22059 - protein, 23 aa, Mycobacterium avium
EQIMPLLVVAVMSQLVFSGGMIP

SEQ ID NO: 22060 - protein, 40 aa, Mycobacterium avium
ERDRLPIELAIAVLVLVVLLVVYRSAVTMLLPLVTILLSL

SEQ ID NO: 22061 - protein, 25 aa, Mycobacterium avium
ERKRALLEVTYFSGLGALIIFVGGV

SEQ ID NO: 22062 - protein, 34 aa, Mycobacterium avium
ERLGPVLRRLTVNYPPLMFHPLNTITAYKGQIIY

SEQ ID NO: 22063 - protein, 45 aa, Mycobacterium avium
ERRKRPWRRYLRRSVLPLLLVASLAVSGFLGWRQWQEHQVKAAGE

SEQ ID NO: 22064 - protein, 23 aa, Mycobacterium avium
ESEARRMALLVDELLLLSRLGEG

SEQ ID NO: 22065 - protein, 21 aa, Mycobacterium avium
ESFLQRWILPLSNAGIFLAAL

SEQ ID NO: 22066 - protein, 17 aa, Mycobacterium avium
ESGLALAFDRDKLPQLY

SEQ ID NO: 22067 - protein, 45 aa, Mycobacterium avium
ESKARSRRRLRLPSWSVAWKAAVIALICAFVAASGYMMWERHQTS

SEQ ID NO: 22068 - protein, 52 aa, Mycobacterium avium
ESQPKTAARQWKRYGRAALVVAVYAGAFGLAGGLGWKLWDQRAVAQAGQAAQ

SEQ ID NO: 22069 - protein, 23 aa, Mycobacterium avium
ETGLRGYLIAADRQFLAPYYDGQ

SEQ ID NO: 22070 - protein, 28 aa, Mycobacterium avium
EVEEQLFRFSRILDVQPRLAILLGDYAV

SEQ ID NO: 22071 - protein, 23 aa, Mycobacterium avium
EVGRIFVGNTFPFAGYTGGGNKQ

SEQ ID NO: 22072 - protein, 18 aa, Mycobacterium avium
EVGRQLRVLVIRALARAG

SEQ ID NO: 22073 - protein, 21 aa, Mycobacterium avium
EVIRLVRRLVPALVVVLAGCA

SEQ ID NO: 22074 - protein, 29 aa, Mycobacterium avium
EVMADFAHLYPFQVFMDLYGLPLQDRDRL

SEQ ID NO: 22075 - protein, 28 aa, Mycobacterium avium
EWIEYLCLMPIFPLALWLMNVYAAIRYR

SEQ ID NO: 22076 - protein, 25 aa, Mycobacterium avium
FAALLFAVIPIRNFLPGSPPAGAWV

SEQ ID NO: 22077 - protein, 25 aa, Mycobacterium avium
FAINVAAVIYLLISKRLFGLRGGRA

SEQ ID NO: 22078 - protein, 27 aa, Mycobacterium avium
FALFGTKKLLWFGLAMVIVFGVVHALF

SEQ ID NO: 22079 - protein, 21 aa, Mycobacterium avium
FAMLLLVVPLATGCLRVRASL

SEQ ID NO: 22080 - protein, 26 aa, Mycobacterium avium
FARDLRSALLRKLSRLPLGWFTARGS

SEQ ID NO: 22081 - protein, 24 aa, Mycobacterium avium
FATGPPPPALPYLDVADPGPNDPA

SEQ ID NO: 22082 - protein, 27 aa, Mycobacterium avium
FATGVTVFTGYPFLRGALRSLRSGRAG

SEQ ID NO: 22083 - protein, 22 aa, Mycobacterium avium
FCAACWLIQILVHHHSNPSWHY

SEQ ID NO: 22084 - protein, 24 aa, Mycobacterium avium
FDKGALTAFLSWLESRPSPRSRRR

SEQ ID NO: 22085 - protein, 19 aa, Mycobacterium avium
FDMVFSLAALIAAAPVMLA

SEQ ID NO: 22086 - protein, 29 aa, Mycobacterium avium
FFFESTFIGLWIFGWGRLPKLIHLACIWI

SEQ ID NO: 22087 - protein, 25 aa, Mycobacterium avium
FGAVPTFWLGLVVLQVFSVQLGLIS

SEQ ID NO: 22088 - protein, 17 aa, Mycobacterium avium
FGFLITALCLFTAVFIM

SEQ ID NO: 22089 - protein, 18 aa, Mycobacterium avium
FGGLLAAALPMALGALAV

SEQ ID NO: 22090 - protein, 27 aa, Mycobacterium avium
FGLVLPRAMFWTVLVYVFIATVVAVWL

SEQ ID NO: 22091 - protein, 29 aa, Mycobacterium avium
FIERGTPTLALLFVAAALRFVGGTLGQGL

SEQ ID NO: 22092 - protein, 17 aa, Mycobacterium avium
FLGANFMLVPRFLFGAG

SEQ ID NO: 22093 - protein, 40 aa, Mycobacterium avium
FLIGHALGVPGWITQRLWWALLLTVGFWGLLRVAEALGIG

SEQ ID NO: 22094 - protein, 18 aa, Mycobacterium avium
FLVFTLRALLYKPFVRQI

SEQ ID NO: 22095 - protein, 32 aa, Mycobacterium avium
FMTPTIAALLGRWFWWPQLVRRRPASQLLRSE

SEQ ID NO: 22096 - protein, 25 aa, Mycobacterium avium
FPDRDLLLFCTLVVVLVTLIGQGVT

SEQ ID NO: 22097 - protein, 20 aa, Mycobacterium avium
FPLGFSLYMSFQRWDVFTPP

SEQ ID NO: 22098 - protein, 19 aa, Mycobacterium avium
FPLPVDIITPFLRNPELLQ

SEQ ID NO: 22099 - protein, 18 aa, Mycobacterium avium
FPRWVAHFNLLVAAALVP

SEQ ID NO: 22100 - protein, 19 aa, Mycobacterium avium
FQLPKLPCILPAPFCPPST

SEQ ID NO: 22101 - protein, 28 aa, Mycobacterium avium
FRRIAATLRRPVLRLGRPAPAELEPVLS

SEQ ID NO: 22102 - protein, 25 aa, Mycobacterium avium
FSEPYPAWKELFNNILPAHIVKDVP

SEQ ID NO: 22103 - protein, 21 aa, Mycobacterium avium
FSSDPLFLIAIRNTVIFTLGS

SEQ ID NO: 22104 - protein, 27 aa, Mycobacterium avium
FSTVLVTRFVVFLIAGLLVGGIVFAGL

SEQ ID NO: 22105 - protein, 18 aa, Mycobacterium avium
FTIESRALTFQPKRIHKQ

SEQ ID NO: 22106 - protein, 25 aa, Mycobacterium avium
FVFSDLVLMKYLAFGLMAALLLDAT

SEQ ID NO: 22107 - protein, 20 aa, Mycobacterium avium
FVISGFLITGLLFREASTTN

SEQ ID NO: 22108 - protein, 19 aa, Mycobacterium avium
FVSLPFLVISLEGAARTAG

SEQ ID NO: 22109 - protein, 25 aa, Mycobacterium avium
FVVGSGIDIPLIKPALEAATTLPLT

SEQ ID NO: 22110 - protein, 18 aa, Mycobacterium avium
FVWNLRVLRTLGLIDLAV

SEQ ID NO: 22111 - protein, 25 aa, Mycobacterium avium
GAAAKLYPLLFLGPMLVLGIRTGRL

SEQ ID NO: 22112 - protein, 27 aa, Mycobacterium avium
GAAAWLHAAVWWKALLALVVAVAMTVG

SEQ ID NO: 22113 - protein, 24 aa, Mycobacterium avium
GAAFVRRLVTLTTALLIVATALSV

SEQ ID NO: 22114 - protein, 25 aa, Mycobacterium avium
GAAGFVFSWLRRRSGSLIAPIALHW

SEQ ID NO: 22115 - protein, 32 aa, Mycobacterium avium
GAEGRLGWPLWTAYIGVFALTVLVGARLMVAV

SEQ ID NO: 22116 - protein, 24 aa, Mycobacterium avium
GAIAIMLLLVYRSIVTTLVQLFMT

SEQ ID NO: 22117 - protein, 33 aa, Mycobacterium avium
GAIGLLLVLLYSLLYYRVLGLLTALSLAASGAM

SEQ ID NO: 22118 - protein, 19 aa, Mycobacterium avium
GALGVGLGLTLWLSTDSAE

SEQ ID NO: 22119 - protein, 27 aa, Mycobacterium avium
GALIELAVWLAIPYLCIGFAWTVFHAD

SEQ ID NO: 22120 - protein, 17 aa, Mycobacterium avium
GALLLLVLGVAPPVWVL

SEQ ID NO: 22121 - protein, 18 aa, Mycobacterium avium
GALWLLYRYYRTRDPRFW

SEQ ID NO: 22122 - protein, 21 aa, Mycobacterium avium
GAPAFLGRPLAAADTAWSLCD

SEQ ID NO: 22123 - protein, 17 aa, Mycobacterium avium
GAPYDWLVGVAAGLMAV

SEQ ID NO: 22124 - protein, 26 aa, Mycobacterium avium
GASGLIFGWLAFLLVFGIFVRRVRDI

SEQ ID NO: 22125 - protein, 24 aa, Mycobacterium avium
GASPVSFRRWLNPVNAAAATALVA

SEQ ID NO: 22126 - protein, 20 aa, Mycobacterium avium
GATLMPDGRLTGRAVKLLGA

SEQ ID NO: 22127 - protein, 21 aa, Mycobacterium avium
GAVFGGLLWWVAFGLHDEPLA

SEQ ID NO: 22128 - protein, 25 aa, Mycobacterium avium
GAVLTLRRRLFGAAAPALVCCLALI

SEQ ID NO: 22129 - protein, 35 aa, Mycobacterium avium
GCAFWAVLTIVLAAWGWFALLLEITGAVAVVMAIP

SEQ ID NO: 22130 - protein, 25 aa, Mycobacterium avium
GCGKTTLLMTLAGLLPPLQGQVVLD

SEQ ID NO: 22131 - protein, 23 aa, Mycobacterium avium
GDAERLLRDLLAPDSRLLSPPRT

SEQ ID NO: 22132 - protein, 21 aa, Mycobacterium avium
GDGPFWRRLLSPAGFTAVSHV

SEQ ID NO: 22133 - protein, 18 aa, Mycobacterium avium
GDHLLFEAAPLTAAQHRA

SEQ ID NO: 22134 - protein, 43 aa, Mycobacterium avium
GDRSILKMTLIGALIIFIVLLFVYRSVTTVVLLLLTVGIEVFA

SEQ ID NO: 22135 - protein, 23 aa, Mycobacterium avium
GDRWWVLVLHLVTTAGLTVLAYR

SEQ ID NO: 22136 - protein, 18 aa, Mycobacterium avium
GEPIYYPRYLIFTAPAMA

SEQ ID NO: 22137 - protein, 26 aa, Mycobacterium avium
GEPRRRRRPMLMAGRSVAALAAVLAL

SEQ ID NO: 22138 - protein, 25 aa, Mycobacterium avium
GERLRDMLWTAIFPSIDLKTDSARE

SEQ ID NO: 22139 - protein, 20 aa, Mycobacterium avium
GERRIYIGGLLIVAVSTAAC

SEQ ID NO: 22140 - protein, 28 aa, Mycobacterium avium
GESKGYFLLGIWMSLLWAVVVAASVLIR

SEQ ID NO: 22141 - protein, 35 aa, Mycobacterium avium
GESKMNMPWLFFFSGLAIPAFYTVGLLAGSDAHYT

SEQ ID NO: 22142 - protein, 25 aa, Mycobacterium avium
GEVLPLLVPVILAAVLFNGSLVQLV

SEQ ID NO: 22143 - protein, 20 aa, Mycobacterium avium
GFLVAWQRPLAGKKTFMDLV

SEQ ID NO: 22144 - protein, 20 aa, Mycobacterium avium
GFNLYWRVRYALQSSGGAAQ

SEQ ID NO: 22145 - protein, 29 aa, Mycobacterium avium
GGAGSLLRLLVLALIMVPITAAVMLRAQV

SEQ ID NO: 22146 - protein, 23 aa, Mycobacterium avium
GGLIFTFFTALLGSVILLWIVGM

SEQ ID NO: 22147 - protein, 24 aa, Mycobacterium avium
GGRNVWPWVNWGLALATVPAAAIV

SEQ ID NO: 22148 - protein, 17 aa, Mycobacterium avium
GGRPPGGYPPAAPPPPP

SEQ ID NO: 22149 - protein, 22 aa, Mycobacterium avium
GHDPWWLVLGKALAIFVFLMLN

SEQ ID NO: 22150 - protein, 23 aa, Mycobacterium avium
GHFYTPWSWLPRIVTQFTAGALA

SEQ ID NO: 22151 - protein, 26 aa, Mycobacterium avium
GHLLMNLHFLLSGYLFYWVVIGVDPT

SEQ ID NO: 22152 - protein, 27 aa, Mycobacterium avium
GHRRDGIALLLLGFSVVVAASSWFHAA

SEQ ID NO: 22153 - protein, 25 aa, Mycobacterium avium
GIAAPLLLTVLRLLQGFAVGAEWAG

SEQ ID NO: 22154 - protein, 24 aa, Mycobacterium avium
GIALPFLVWVWARQLRDRRGYRPV

SEQ ID NO: 22155 - protein, 21 aa, Mycobacterium avium
GIFRTIVFLPLAISSVVMAVV

SEQ ID NO: 22156 - protein, 30 aa, Mycobacterium avium
GIVFIISSVFFVGAFIWKHSYYHCHHHHGV

SEQ ID NO: 22157 - protein, 22 aa, Mycobacterium avium
GIVFRVQQELGVPVKLVGLGEG

SEQ ID NO: 22158 - protein, 41 aa, Mycobacterium avium
GKRFLVIDLPRPRSVQLLLTPLILAPFAAALALVRPSLKHV

SEQ ID NO: 22159 - protein, 22 aa, Mycobacterium avium
GKSEFFLSLVYGIALTHSPETF

SEQ ID NO: 22160 - protein, 17 aa, Mycobacterium avium
GKSYCRCGGFLTGVGDF

SEQ ID NO: 22161 - protein, 26 aa, Mycobacterium avium
GLAAAVGALWWLSLQRDRLRADAHRR

SEQ ID NO: 22162 - protein, 24 aa, Mycobacterium avium
GLARLPVAVFFLTALAATLPLAAA

SEQ ID NO: 22163 - protein, 24 aa, Mycobacterium avium
GLASFFGQLGFSPALSTALGWAIF

SEQ ID NO: 22164 - protein, 31 aa, Mycobacterium avium
GLATRNYFTYRDVLGFIYAQAKFQVLGKENS

SEQ ID NO: 22165 - protein, 24 aa, Mycobacterium avium
GLATWLWDWSADPGSALAAGCTPA

SEQ ID NO: 22166 - protein, 30 aa, Mycobacterium avium
GLFAQLGIWRWAFVVMAVLTALMALLVPVA

SEQ ID NO: 22167 - protein, 17 aa, Mycobacterium avium
GLFTLRGYLVVAVVFVI

SEQ ID NO: 22168 - protein, 26 aa, Mycobacterium avium
GLGGLLDFLRATALTVVLLGLGALVS

SEQ ID NO: 22169 - protein, 25 aa, Mycobacterium avium
GLGGYFFNYLFSNPVPYARAGLDPK

SEQ ID NO: 22170 - protein, 29 aa, Mycobacterium avium
GLGQPSPAPWPLLTLLPAGPELSRPNASV

SEQ ID NO: 22171 - protein, 18 aa, Mycobacterium avium
GLGWWLLRRRTDVPPLAE

SEQ ID NO: 22172 - protein, 35 aa, Mycobacterium avium
GLLSFFLSNPVYTLALTTPLLIVPAGAAGGLAGLT

SEQ ID NO: 22173 - protein, 21 aa, Mycobacterium avium
GLNQLSWAMPARWGYAAASAT

SEQ ID NO: 22174 - protein, 31 aa, Mycobacterium avium
GLNRQILAGPWRWSSGPPIWVAAVAPAQSGV

SEQ ID NO: 22175 - protein, 28 aa, Mycobacterium avium
GLRDDAIAAFLWMANWRFVAQKTDYFTQ

SEQ ID NO: 22176 - protein, 22 aa, Mycobacterium avium
GLRERVTFYAPILLTAENVINA

SEQ ID NO: 22177 - protein, 19 aa, Mycobacterium avium
GLRRALYFALLGVFAVVAI

SEQ ID NO: 22178 - protein, 25 aa, Mycobacterium avium
GLSSPLLLVILIAALAVVPILGNLF

SEQ ID NO: 22179 - protein, 38 aa, Mycobacterium avium
GLTADDRLFCNSPFFWIGGFAFGLLATLVAGSTLICSN

SEQ ID NO: 22180 - protein, 25 aa, Mycobacterium avium
GLTGLFYVVTYIGFGLPLILASVRP

SEQ ID NO: 22181 - protein, 20 aa, Mycobacterium avium
GLVLAYWLVPVLPTQSHRFD

SEQ ID NO: 22182 - protein, 50 aa, Mycobacterium avium
GMGRHWHFFAVIGWVLVGLSYYVLLFATGQWHRYWPYSWSIFPEAFNDIV

SEQ ID NO: 22183 - protein, 25 aa, Mycobacterium avium
GMLVSMLVFVIFGLPSAGATVPLEA

SEQ ID NO: 22184 - protein, 22 aa, Mycobacterium avium
GMSTMFCSFLAGLLATMADFTL

SEQ ID NO: 22185 - protein, 20 aa, Mycobacterium avium
GNLIAVLRNGAVIGSAVFSE

SEQ ID NO: 22186 - protein, 24 aa, Mycobacterium avium
GPDGRPTIHLPLEDPYQAPEGYPI

SEQ ID NO: 22187 - protein, 26 aa, Mycobacterium avium
GPFLPLAIILYWFANNIWTFGQQHYV

SEQ ID NO: 22188 - protein, 19 aa, Mycobacterium avium
GPKCLVKEIQKLSGLSINH

SEQ ID NO: 22189 - protein, 26 aa, Mycobacterium avium
GPRDLEPFRCFYLSAPFVVPKTKEVA

SEQ ID NO: 22190 - protein, 32 aa, Mycobacterium avium
GPSMWLYALFNVAAWIFVFFRMPDLTGKTLEE

SEQ ID NO: 22191 - protein, 22 aa, Mycobacterium avium
GQALRDFILEQRKIRDIAKVVN

SEQ ID NO: 22192 - protein, 24 aa, Mycobacterium avium
GQLWRSFELYALVFCGVAGMIYHQ

SEQ ID NO: 22193 - protein, 29 aa, Mycobacterium avium
GQPPGTSFYVLLPGRPLPPAGHSTPAGES

SEQ ID NO: 22194 - protein, 25 aa, Mycobacterium avium
GQSFTSVPMLFATPTYYAQFTDAGG

SEQ ID NO: 22195 - protein, 28 aa, Mycobacterium avium
GRDRWFNLLWLIPIGFALLIAGVAVGKG

SEQ ID NO: 22196 - protein, 19 aa, Mycobacterium avium
GRISAFARWVVRTPWPLFW

SEQ ID NO: 22197 - protein, 17 aa, Mycobacterium avium
GRISWAAAGLIAAGSLV

SEQ ID NO: 22198 - protein, 17 aa, Mycobacterium avium
GRLLGPMERLLILSLGV

SEQ ID NO: 22199 - protein, 20 aa, Mycobacterium avium
GRPAPLLRVRNKFFAHADQL

SEQ ID NO: 22200 - protein, 19 aa, Mycobacterium avium
GRRLPLMVDVMFYSVVGFL

SEQ ID NO: 22201 - protein, 18 aa, Mycobacterium avium
GRRVGVTLRLLVIGSLIG

SEQ ID NO: 22202 - protein, 21 aa, Mycobacterium avium
GRTVFRVRLPLIDGPGTLGAA

SEQ ID NO: 22203 - protein, 17 aa, Mycobacterium avium
GSQSRLLGACRRAKEQL

SEQ ID NO: 22204 - protein, 23 aa, Mycobacterium avium
GSTPSQLVAWLNDAIYRMLQKIS

SEQ ID NO: 22205 - protein, 22 aa, Mycobacterium avium
GSVSPLIRYLIKVPREFINDYL

SEQ ID NO: 22206 - protein, 19 aa, Mycobacterium avium
GSVVLPIKAVLMSALTLGS

SEQ ID NO: 22207 - protein, 20 aa, Mycobacterium avium
GTAIVRWPAPILTATIAVAL

SEQ ID NO: 22208 - protein, 18 aa, Mycobacterium avium
GTAIVRWPGPILVVATGV

SEQ ID NO: 22209 - protein, 18 aa, Mycobacterium avium
GTAWLYFKEYLPDKRTDA

SEQ ID NO: 22210 - protein, 25 aa, Mycobacterium avium
GTAWRRSLQLRVVALTLGLSLAVIL

SEQ ID NO: 22211 - protein, 19 aa, Mycobacterium avium
GTHLANWRRVGLATWIADA

SEQ ID NO: 22212 - protein, 27 aa, Mycobacterium avium
GTISYGVYLWHWPIFLALNGERTGWAG

SEQ ID NO: 22213 - protein, 27 aa, Mycobacterium avium
GTLAAAFVVSVLLGIGIGWGLYGNTSS

SEQ ID NO: 22214 - protein, 17 aa, Mycobacterium avium
GTRLCWTDHPRADQLRR

SEQ ID NO: 22215 - protein, 28 aa, Mycobacterium avium
GTTIGLGLLFDTLIVRAFMTPSVAALLG

SEQ ID NO: 22216 - protein, 27 aa, Mycobacterium avium
GTWSTALLPLALLLLAAAVAAIAVRGW

SEQ ID NO: 22217 - protein, 19 aa, Mycobacterium avium
GVDALLKDIRDFTGLVSAH

SEQ ID NO: 22218 - protein, 22 aa, Mycobacterium avium
GVDLLYYAYHRIAHRVRLIWAT

SEQ ID NO: 22219 - protein, 29 aa, Mycobacterium avium
GVFTRYVKPGLWPWLVTSAVVLIGLALAA

SEQ ID NO: 22220 - protein, 17 aa, Mycobacterium avium
GVKFIGLVGAIVALMDA

SEQ ID NO: 22221 - protein, 28 aa, Mycobacterium avium
GVLLGVLVIVILVAWRWVPAKVRRVPGP

SEQ ID NO: 22222 - protein, 24 aa, Mycobacterium avium
GVPIFFVLSGYLLFRPWVKSAATG

SEQ ID NO: 22223 - protein, 27 aa, Mycobacterium avium
GVSAWLITRAWQMPPVLDLSVAAVAVR

SEQ ID NO: 22224 - protein, 32 aa, Mycobacterium avium
GVTVAVVLLVRPLWLLLTQALPRSLHTRLGNV

SEQ ID NO: 22225 - protein, 17 aa, Mycobacterium avium
GVVSVRLFGFTPGQLVL

SEQ ID NO: 22226 - protein, 20 aa, Mycobacterium avium
GVVTLILALILKYTMGLRLN

SEQ ID NO: 22227 - protein, 27 aa, Mycobacterium avium
GVVVKTLLLLGLWLAGWGAARLVALVL

SEQ ID NO: 22228 - protein, 20 aa, Mycobacterium avium
GWADRKPRKGFFTDTSICIG

SEQ ID NO: 22229 - protein, 21 aa, Mycobacterium avium
GWLIATLALAVAVPAGWVQLH

SEQ ID NO: 22230 - protein, 21 aa, Mycobacterium avium
GWRFMSVFMTVLVTVTPTLRP

SEQ ID NO: 22231 - protein, 22 aa, Mycobacterium avium
GWTRRIFYRLTHVLDPLIALES

SEQ ID NO: 22232 - protein, 27 aa, Mycobacterium avium
GWVFAVRALLLMAFPHAFMAAADAAVR

SEQ ID NO: 22233 - protein, 23 aa, Mycobacterium avium
GWWIGVLVYFLPRRSWLRAASED

SEQ ID NO: 22234 - protein, 34 aa, Mycobacterium avium
GYAFVFGLAFYLPLLPWVGLLVGAVPWLVLAAVS

SEQ ID NO: 22235 - protein, 25 aa, Mycobacterium avium
GYDRPLWVQYFAQLNQVLHGHFGFS

SEQ ID NO: 22236 - protein, 26 aa, Mycobacterium avium
GYFTTRLLERLPTSSYRRPLLGTGFC

SEQ ID NO: 22237 - protein, 19 aa, Mycobacterium avium
GYGHIGMLFVEPRSATLAV

SEQ ID NO: 22238 - protein, 18 aa, Mycobacterium avium
GYLAIIGVPPFAGFFSKD

SEQ ID NO: 22239 - protein, 21 aa, Mycobacterium avium
GYLYFLLCLLVFRPSAPDRSG

SEQ ID NO: 22240 - protein, 24 aa, Mycobacterium avium
GYTAVFIAFVVFIAVKMLGTLKMV

SEQ ID NO: 22241 - protein, 23 aa, Mycobacterium avium
HAGYVQLLALISLAALTASVVAV

SEQ ID NO: 22242 - protein, 27 aa, Mycobacterium avium
HAPGRWEDSPLYFKEIALVGSNAFGVE

SEQ ID NO: 22243 - protein, 28 aa, Mycobacterium avium
HATPEKLFTPILLLAVAALGIGLVSTLL

SEQ ID NO: 22244 - protein, 25 aa, Mycobacterium avium
HAVALGMLLWTTPVAMMIAEMFAAR

SEQ ID NO: 22245 - protein, 24 aa, Mycobacterium avium
HDELFDACGWRRLVFATPEELEAT

SEQ ID NO: 22246 - protein, 19 aa, Mycobacterium avium
HDFWRGELGEWIITRGLRI

SEQ ID NO: 22247 - protein, 28 aa, Mycobacterium avium
HDWPFAAQAFATALPWLAWTIGTPNTEP

SEQ ID NO: 22248 - protein, 25 aa, Mycobacterium avium
HFVEVTLGAFFQIAKAVEPITVCLA

SEQ ID NO: 22249 - protein, 19 aa, Mycobacterium avium
HLLVFFVRALVAVPLALRQ

SEQ ID NO: 22250 - protein, 31 aa, Mycobacterium avium
HLPLLCCLVAFILTFFVTRSFVRFIRHRAET

SEQ ID NO: 22251 - protein, 17 aa, Mycobacterium avium
HLVGFVEALRGAGISVG

SEQ ID NO: 22252 - protein, 27 aa, Mycobacterium avium
HMDDRKIHLVIARRPLAALGAGVAALA

SEQ ID NO: 22253 - protein, 32 aa, Mycobacterium avium
HPARYLSVFLLLLVGVYLLVFLTGDKRAAPKL

SEQ ID NO: 22254 - protein, 19 aa, Mycobacterium avium
HRRELVYLPPAWFNSNPPP

SEQ ID NO: 22255 - protein, 20 aa, Mycobacterium avium
HRSEILLADALRALAYAATG

SEQ ID NO: 22256 - protein, 20 aa, Mycobacterium avium
HRTLVWPVLAGVAVLAGCTA

SEQ ID NO: 22257 - protein, 22 aa, Mycobacterium avium
HSAAPLFHNIAGWLMQRENVPL

SEQ ID NO: 22258 - protein, 40 aa, Mycobacterium avium
HSLFDKAPLMLVLLLGATLLLMFLAFGSVVLPIKAVLMSA

SEQ ID NO: 22259 - protein, 18 aa, Mycobacterium avium
HSWRWMLGLACVPAVLLL

SEQ ID NO: 22260 - protein, 21 aa, Mycobacterium avium
HWKRLIGPVLVLILGTGLAAF

SEQ ID NO: 22261 - protein, 19 aa, Mycobacterium avium
HYFARDPLKPELTLADYKV

SEQ ID NO: 22262 - protein, 24 aa, Mycobacterium avium
IAADDFWYLWHQMVSQPGVVDPAG

SEQ ID NO: 22263 - protein, 36 aa, Mycobacterium avium
IAALLAIGVVLGWPLWWVSACSVLVLLIVEGVLINF

SEQ ID NO: 22264 - protein, 28 aa, Mycobacterium avium
IAALSLILLIMVLITRSLVAAIVIVGTV

SEQ ID NO: 22265 - protein, 37 aa, Mycobacterium avium
IAAVAVIFVGGIVALAWALAFIRPHADKRPEVGTQVV

SEQ ID NO: 22266 - protein, 28 aa, Mycobacterium avium
IAFGYAGLPFWPQGKIYDAYFTDAGGIN

SEQ ID NO: 22267 - protein, 25 aa, Mycobacterium avium
IAGGVGVWLVIRPKPEPPQAAPLTS

SEQ ID NO: 22268 - protein, 29 aa, Mycobacterium avium
IAGVSALCLIFIIMLIMTRSFIAAMVIVG

SEQ ID NO: 22269 - protein, 19 aa, Mycobacterium avium
IAILAVPNLPPPPLPFAQT

SEQ ID NO: 22270 - protein, 20 aa, Mycobacterium avium
IAIRPIPYLVTTRLIASVVA

SEQ ID NO: 22271 - protein, 17 aa, Mycobacterium avium
IALVVSVSLLFARTDTT

SEQ ID NO: 22272 - protein, 37 aa, Mycobacterium avium
IARRQVRLVIADRAYFLFLAVLPFVMGALSLTVPGSA

SEQ ID NO: 22273 - protein, 38 aa, Mycobacterium avium
IAVLVVIAALVLGLARYRRRRISFSTRPEPGAIDRSGG

SEQ ID NO: 22274 - protein, 25 aa, Mycobacterium avium
IAVTWMVYATLRRDVAGPTTPYAAM

SEQ ID NO: 22275 - protein, 22 aa, Mycobacterium avium
ICAAIALWLSRSAPLGPSERQL

SEQ ID NO: 22276 - protein, 39 aa, Mycobacterium avium
ICALSIGAAAVFAWLLAAFAVRPFKRLAQQARSIDADER

SEQ ID NO: 22277 - protein, 38 aa, Mycobacterium avium
IDAALSNYFRRGNLTALRELALLWLADQVDTALAKYRA

SEQ ID NO: 22278 - protein, 31 aa, Mycobacterium avium
IDAVHGAYYLLMHGWFALFPPTEFFSRLPSA

SEQ ID NO: 22279 - protein, 18 aa, Mycobacterium avium
IDELTLSAPLPLPASGGV

SEQ ID NO: 22280 - protein, 21 aa, Mycobacterium avium
IDGQMFLEMRLVEGTDLDSVL

SEQ ID NO: 22281 - protein, 21 aa, Mycobacterium avium
IDKIVYLSQYQAQALFSMRVS

SEQ ID NO: 22282 - protein, 17 aa, Mycobacterium avium
IDNALRYSPPTTSARVS

SEQ ID NO: 22283 - protein, 19 aa, Mycobacterium avium
IDNAQALRWRTTVGAAAIS

SEQ ID NO: 22284 - protein, 30 aa, Mycobacterium avium
IDPENFWRSAGLPAFRWPDPNGTRLPNGAP

SEQ ID NO: 22285 - protein, 22 aa, Mycobacterium avium
IFAFLQIVLGPARFLSYGWRIG

SEQ ID NO: 22286 - protein, 25 aa, Mycobacterium avium
IFEHLEYAMPMRTFGWPRDLPRAVG

SEQ ID NO: 22287 - protein, 18 aa, Mycobacterium avium
IFLAVLVAALVVVHVPLG

SEQ ID NO: 22288 - protein, 24 aa, Mycobacterium avium
IFRPGVLTYEFWLKAGIVALGSRF

SEQ ID NO: 22289 - protein, 36 aa, Mycobacterium avium
IGAAPQGILPMPRPMPATPAFPPPAGPPPAVGAPPP

SEQ ID NO: 22290 - protein, 33 aa, Mycobacterium avium
IGAIVLLVKKIWWPLAVWLLLVVVNVDAGNPLG

SEQ ID NO: 22291 - protein, 21 aa, Mycobacterium avium
IGQAITMPLFFASNALYPVEL

SEQ ID NO: 22292 - protein, 17 aa, Mycobacterium avium
IGRSVAAALAPRLPQMQ

SEQ ID NO: 22293 - protein, 18 aa, Mycobacterium avium
IGVAVVAVLFAWGGWQRR

SEQ ID NO: 22294 - protein, 45 aa, Mycobacterium avium
IGYGLGVFAVWLYRYLWAKPSSPPPPRWAWKILIPVGAVGMVLMA

SEQ ID NO: 22295 - protein, 18 aa, Mycobacterium avium
IIAWRMWLTANLTDDWLA

SEQ ID NO: 22296 - protein, 19 aa, Mycobacterium avium
IIDVPEEPLMPPRPQQPAP

SEQ ID NO: 22297 - protein, 24 aa, Mycobacterium avium
IIIRVLAVERLFRALVIALAAYAV

SEQ ID NO: 22298 - protein, 29 aa, Mycobacterium avium
IILIVVMLLLVYRTPSTLLVPLLGVLIEM

SEQ ID NO: 22299 - protein, 29 aa, Mycobacterium avium
IKAVTFLVTVFSLSRLCFAPISGLLTERL

SEQ ID NO: 22300 - protein, 28 aa, Mycobacterium avium
IKTNLVWAFGYNLAAIPLAALGMLNPML

SEQ ID NO: 22301 - protein, 22 aa, Mycobacterium avium
ILALWAAVAGAFVSVLYRRQSD

SEQ ID NO: 22302 - protein, 17 aa, Mycobacterium avium
ILRDLVLGLLIAGAVAA

SEQ ID NO: 22303 - protein, 19 aa, Mycobacterium avium
ILSVFGFIVMFGGVVFAIT

SEQ ID NO: 22304 - protein, 27 aa, Mycobacterium avium
ILVAFVVLVTFLLPALRDGAPAVPVAL

SEQ ID NO: 22305 - protein, 20 aa, Mycobacterium avium
INALNVWRLVLASGVILQHS

SEQ ID NO: 22306 - protein, 25 aa, Mycobacterium avium
INLVDLPAIRRIVNERFMSDAPAAL

SEQ ID NO: 22307 - protein, 19 aa, Mycobacterium avium
INQPPPCLTGFIPASEWRS

SEQ ID NO: 22308 - protein, 19 aa, Mycobacterium avium
IPAHVSFMRMLGLGLTLGV

SEQ ID NO: 22309 - protein, 30 aa, Mycobacterium avium
IPAPLLATMFDFFYQPGKMPASLADYLRGL

SEQ ID NO: 22310 - protein, 19 aa, Mycobacterium avium
IPLPWMAVLIANDRPPRSP

SEQ ID NO: 22311 - protein, 17 aa, Mycobacterium avium
IPVLKANGYRLVTVSEL

SEQ ID NO: 22312 - protein, 29 aa, Mycobacterium avium
IPVPDPVSPPQLLAPPRLSVPQPVQPPVR

SEQ ID NO: 22313 - protein, 20 aa, Mycobacterium avium
IRARFPALTARQVMQRIEAT

SEQ ID NO: 22314 - protein, 18 aa, Mycobacterium avium
IRDLIGERAIFLREQAVG

SEQ ID NO: 22315 - protein, 19 aa, Mycobacterium avium
IRTYFYWEKHCYDIPVCIG

SEQ ID NO: 22316 - protein, 29 aa, Mycobacterium avium
ISDFEDFWRPLRSYFYWEKHCYDIPICFS

SEQ ID NO: 22317 - protein, 27 aa, Mycobacterium avium
ISGDMMNFPVAFRLSPLALACTAGALG

SEQ ID NO: 22318 - protein, 21 aa, Mycobacterium avium
ISVMTLVVLLGTWVWVGVTND

SEQ ID NO: 22319 - protein, 27 aa, Mycobacterium avium
ISVPRRVRRVFMVLGGLVSVVGLVLSA

SEQ ID NO: 22320 - protein, 25 aa, Mycobacterium avium
ITALAQQILLPRLPPKGLSQEELRA

SEQ ID NO: 22321 - protein, 26 aa, Mycobacterium avium
ITALCLFTAVFIMLRRKRIPGVARGP

SEQ ID NO: 22322 - protein, 26 aa, Mycobacterium avium
ITGISPCILPVLPVILLSGMDGDRRG

SEQ ID NO: 22323 - protein, 27 aa, Mycobacterium avium
ITLTVMAVFYLRLPATFGIGTYGVSAD

SEQ ID NO: 22324 - protein, 19 aa, Mycobacterium avium
ITLVLLCEINPLVLSTILA

SEQ ID NO: 22325 - protein, 23 aa, Mycobacterium avium
IVGALLVMSLLITPAAAAARVVA

SEQ ID NO: 22326 - protein, 31 aa, Mycobacterium avium
IVGTKPRIPPLLWAGLIFGAVVLVAFTGFLR

SEQ ID NO: 22327 - protein, 28 aa, Mycobacterium avium
IVLLAHPGLPLWPYLVCAALTGLGGGNY

SEQ ID NO: 22328 - protein, 17 aa, Mycobacterium avium
IVSFWLLGFDTAGSPVW

SEQ ID NO: 22329 - protein, 19 aa, Mycobacterium avium
IVTPRVMQLTLRATQPKLA

SEQ ID NO: 22330 - protein, 22 aa, Mycobacterium avium
IVTVLVLIYLVTNLVVDLLYAV

SEQ ID NO: 22331 - protein, 24 aa, Mycobacterium avium
IVVGYLLGLMLWAATLTQFDTALS

SEQ ID NO: 22332 - protein, 17 aa, Mycobacterium avium
IVVVIAGAVVWFGITSA

SEQ ID NO: 22333 - protein, 18 aa, Mycobacterium avium
IVWLVLSALTLAYLGIDH

SEQ ID NO: 22334 - protein, 17 aa, Mycobacterium avium
IYGAWGLYVLAPQLRPV

SEQ ID NO: 22335 - protein, 20 aa, Mycobacterium avium
KAILGLLDVDLLAAVGAGSD

SEQ ID NO: 22336 - protein, 34 aa, Mycobacterium avium
KALKADPLLYPFQPIHVTVAAWFTIGIPSFILSL

SEQ ID NO: 22337 - protein, 28 aa, Mycobacterium avium
KAWAVAAMVAALLFVGSAGFAGAMVQPY

SEQ ID NO: 22338 - protein, 17 aa, Mycobacterium avium
KCMGLPTLPFNTNPPQF

SEQ ID NO: 22339 - protein, 33 aa, Mycobacterium avium
KFAAWLVFAGLWATFVYFPVAHWVFAFDGFASE

SEQ ID NO: 22340 - protein, 35 aa, Mycobacterium avium
KFAIFAVVMAMLTAFLFFIFGQYRTGATNGYSAVF

SEQ ID NO: 22341 - protein, 17 aa, Mycobacterium avium
KFGLGQRTNVGLPGESA

SEQ ID NO: 22342 - protein, 18 aa, Mycobacterium avium
KGRLLFMPGVMVTSVPWQ

SEQ ID NO: 22343 - protein, 23 aa, Mycobacterium avium
KGRSFRIHILFASQTLDVGKIKD

SEQ ID NO: 22344 - protein, 21 aa, Mycobacterium avium
KGVMRTWYLIGRKPAEAPTDL

SEQ ID NO: 22345 - protein, 20 aa, Mycobacterium avium
KIDGRLYPALNLTSARLATG

SEQ ID NO: 22346 - protein, 25 aa, Mycobacterium avium
KLDLNDPPPCAVGFLPPPLMRTPAD

SEQ ID NO: 22347 - protein, 21 aa, Mycobacterium avium
KLVIMDLRDHWMAKAPYILGD

SEQ ID NO: 22348 - protein, 40 aa, Mycobacterium avium
KLVNWVMRKPLAFAIPIAVGMILLVIPLGNLSFGGMSEKY

SEQ ID NO: 22349 - protein, 19 aa, Mycobacterium avium
KLVVFWSVLAMFTVMIIVV

SEQ ID NO: 22350 - protein, 26 aa, Mycobacterium avium
KNNPFSLLFTLGGFVALLLLAQAVAS

SEQ ID NO: 22351 - protein, 24 aa, Mycobacterium avium
KPLVEQFWYRSTKYVLRRAVPVGL

SEQ ID NO: 22352 - protein, 24 aa, Mycobacterium avium
KPTKLTLDPVLRFASLQTVFHHGR

SEQ ID NO: 22353 - protein, 28 aa, Mycobacterium avium
KQPRPAIGPLRRTGLSGMLRGGRSRFGF

SEQ ID NO: 22354 - protein, 19 aa, Mycobacterium avium
KRGLKLFLSPDGKAARMII

SEQ ID NO: 22355 - protein, 19 aa, Mycobacterium avium
KRRLWLMGLIAPTALFVML

SEQ ID NO: 22356 - protein, 18 aa, Mycobacterium avium
KSRWLVTRMTTITSLDLT

SEQ ID NO: 22357 - protein, 24 aa, Mycobacterium avium
KVFAEIVPVLLVAALVLVVTGPRI

SEQ ID NO: 22358 - protein, 25 aa, Mycobacterium avium
KVLNYWFHAPLWVLSLGLMLLMTAT

SEQ ID NO: 22359 - protein, 17 aa, Mycobacterium avium
KYDLLIAGIAALSLILL

SEQ ID NO: 22360 - protein, 18 aa, Mycobacterium avium
LAALAVAGSWRAGGARFD

SEQ ID NO: 22361 - protein, 17 aa, Mycobacterium avium
LAAPWFIGAAMGLQVLG

SEQ ID NO: 22362 - protein, 22 aa, Mycobacterium avium
LAARFHPVLYWATIVASTTFGT

SEQ ID NO: 22363 - protein, 21 aa, Mycobacterium avium
LAAVLSFGFNLYWRVRYALQS

SEQ ID NO: 22364 - protein, 27 aa, Mycobacterium avium
LAAVPRPPLGPVWVALLIIGASSGVAV

SEQ ID NO: 22365 - protein, 19 aa, Mycobacterium avium
LACLLIGVNAFFVGAEFSL

SEQ ID NO: 22366 - protein, 24 aa, Mycobacterium avium
LACPVWFYQLWAFITPGLYQKERR

SEQ ID NO: 22367 - protein, 21 aa, Mycobacterium avium
LADVAVIFGFVLWHVIGANSS

SEQ ID NO: 22368 - protein, 25 aa, Mycobacterium avium
LAFTGDNLPLLLKGFARAVSEGSYG

SEQ ID NO: 22369 - protein, 19 aa, Mycobacterium avium
LAGGRPRLVWYAPHFVEGE

SEQ ID NO: 22370 - protein, 23 aa, Mycobacterium avium
LAKGIVYALITLGLLVAVNQIEA

SEQ ID NO: 22371 - protein, 18 aa, Mycobacterium avium
LAKTAVFCGFAVLQSAIV

SEQ ID NO: 22372 - protein, 28 aa, Mycobacterium avium
LALAAGAITLWLGLVANVGQVLNGDAPS

SEQ ID NO: 22373 - protein, 23 aa, Mycobacterium avium
LALPLASLVFLGAFIPLVGAVVA

SEQ ID NO: 22374 - protein, 25 aa, Mycobacterium avium
LAMAFGRFLPIVLVLALAGSLARQG

SEQ ID NO: 22375 - protein, 17 aa, Mycobacterium avium
LAMAFNTFGIQLEHAEQ

SEQ ID NO: 22376 - protein, 17 aa, Mycobacterium avium
LAPAMLTVASFFKLMDP

SEQ ID NO: 22377 - protein, 18 aa, Mycobacterium avium
LAPDVYWPLRRIGVEFHA

SEQ ID NO: 22378 - protein, 20 aa, Mycobacterium avium
LARFVWATVIIWIVGGFGTW

SEQ ID NO: 22379 - protein, 25 aa, Mycobacterium avium
LARIRALRMPFYRTVTSMVIWCIGG

SEQ ID NO: 22380 - protein, 24 aa, Mycobacterium avium
LARLTTAMLTLYFVLAVGAHVRVR

SEQ ID NO: 22381 - protein, 17 aa, Mycobacterium avium
LARVLVADGRRVVLGAA

SEQ ID NO: 22382 - protein, 28 aa, Mycobacterium avium
LASALAILLLKPVLTALFLRAGGAGGLL

SEQ ID NO: 22383 - protein, 23 aa, Mycobacterium avium
LASLPVLRWSWAPVLLAASLTTL

SEQ ID NO: 22384 - protein, 18 aa, Mycobacterium avium
LAVGWRSRRWRTVWVPVA

SEQ ID NO: 22385 - protein, 19 aa, Mycobacterium avium
LAVLAVLGFLPGRAERRRK

SEQ ID NO: 22386 - protein, 28 aa, Mycobacterium avium
LAVVARPYQWWRVALVIASGLAYVVIFS

SEQ ID NO: 22387 - protein, 18 aa, Mycobacterium avium
LAVVLLCTAALAAAVATG

SEQ ID NO: 22388 - protein, 17 aa, Mycobacterium avium
LCAAFNVLLRAVCGRDT

SEQ ID NO: 22389 - protein, 23 aa, Mycobacterium avium
LCLRFTRLNYFQSLGIPAAIGIG

SEQ ID NO: 22390 - protein, 29 aa, Mycobacterium avium
LDEEHGTARWPWVVGVAAIVAAIALVVSV

SEQ ID NO: 22391 - protein, 20 aa, Mycobacterium avium
LDNAGRLFIVGREDDMIISG

SEQ ID NO: 22392 - protein, 17 aa, Mycobacterium avium
LDNISLTALPGTLTAII

SEQ ID NO: 22393 - protein, 19 aa, Mycobacterium avium
LDPRTLWRNPVMFIVEIGA

SEQ ID NO: 22394 - protein, 27 aa, Mycobacterium avium
LDRIAAYERYWLYPGAENLAIFRAHLE

SEQ ID NO: 22395 - protein, 26 aa, Mycobacterium avium
LEARVEYWLPGYAVPLALAATALTAV

SEQ ID NO: 22396 - protein, 18 aa, Mycobacterium avium
LEPVLSAPLMDTALLHER

SEQ ID NO: 22397 - protein, 21 aa, Mycobacterium avium
LFLTKTVYSVLLALLVGLECL

SEQ ID NO: 22398 - protein, 19 aa, Mycobacterium avium
LGAALTLWLHVVDARFARD

SEQ ID NO: 22399 - protein, 24 aa, Mycobacterium avium
LGAFYVLLWVGLVAVSLAIGPVWR

SEQ ID NO: 22400 - protein, 40 aa, Mycobacterium avium
LGASFGLSVLLWQYILGLKLHWMVLAMAVILLLAVGSDYN

SEQ ID NO: 22401 - protein, 18 aa, Mycobacterium avium
LGAWVIVSTWILPGVVLT

SEQ ID NO: 22402 - protein, 27 aa, Mycobacterium avium
LGAYGSFFNIYFCSVTIKINGPAGSDI

SEQ ID NO: 22403 - protein, 19 aa, Mycobacterium avium
LGEDYLRLAALGAYGSFFN

SEQ ID NO: 22404 - protein, 26 aa, Mycobacterium avium
LGLCFLPAFVCLGIVPVVAGLAGDVL

SEQ ID NO: 22405 - protein, 31 aa, Mycobacterium avium
LGLSGSPLPIPWSVLSLFAKGPTLSRADALL

SEQ ID NO: 22406 - protein, 27 aa, Mycobacterium avium
LGLTRIHPALLHSLSLAIALAIVVTLH

SEQ ID NO: 22407 - protein, 26 aa, Mycobacterium avium
LGMLATPWLLYLTPWYTAALHNEWVG

SEQ ID NO: 22408 - protein, 41 aa, Mycobacterium avium
LGQALRLSYMILLSIPVLAPLALRLTLSIPALRRNAVDNIP

SEQ ID NO: 22409 - protein, 23 aa, Mycobacterium avium
LGTVMPFWYAMTLLLLGSLAVQE

SEQ ID NO: 22410 - protein, 25 aa, Mycobacterium avium
LGVAALVLLWRLVRRDSPQPAISGF

SEQ ID NO: 22411 - protein, 24 aa, Mycobacterium avium
LGVAQLLGRIPLPGSAPKSLWLSA

SEQ ID NO: 22412 - protein, 28 aa, Mycobacterium avium
LGVEEQYYFVWPLLLIAVALALAARARR

SEQ ID NO: 22413 - protein, 25 aa, Mycobacterium avium
LGVNRFLLVQWLAPLASEAPEFIIA

SEQ ID NO: 22414 - protein, 35 aa, Mycobacterium avium
LGVTVLLFPVVQPWYLLWAIIPLAAWATRTGFRVA

SEQ ID NO: 22415 - protein, 23 aa, Mycobacterium avium
LHARLPSRRLLPALAVLAVAGMS

SEQ ID NO: 22416 - protein, 31 aa, Mycobacterium avium
LHRLDAIVLYLGFIVVAWLLGYLMRTQRLLV

SEQ ID NO: 22417 - protein, 21 aa, Mycobacterium avium
LIAVAVGALITLGPLALSLQS

SEQ ID NO: 22418 - protein, 25 aa, Mycobacterium avium
LIAVVTFMLLFLLTGSAVLPVQALV

SEQ ID NO: 22419 - protein, 31 aa, Mycobacterium avium
LIPRMVRAFAIPIIFFWGLLAVTTNTFMPQV

SEQ ID NO: 22420 - protein, 26 aa, Mycobacterium avium
LIPVRPDLPDVLLPQNYQPPKDLAPP

SEQ ID NO: 22421 - protein, 19 aa, Mycobacterium avium
LIRGLMNYTFWVPNGSPEY

SEQ ID NO: 22422 - protein, 21 aa, Mycobacterium avium
LIVFMRILFTLIAIGALWLLY

SEQ ID NO: 22423 - protein, 17 aa, Mycobacterium avium
LIVPMPPGGPGGPGGPV

SEQ ID NO: 22424 - protein, 24 aa, Mycobacterium avium
LKARVIGFVQKPVVLASLAGVGAL

SEQ ID NO: 22425 - protein, 22 aa, Mycobacterium avium
LKAWRRGLIFAMFVFAAIFTPG

SEQ ID NO: 22426 - protein, 22 aa, Mycobacterium avium
LKDYVAFPLLAGPFAPFVFTGN

SEQ ID NO: 22427 - protein, 23 aa, Mycobacterium avium
LKHFNGFVTSLWLSPSDITTDKL

SEQ ID NO: 22428 - protein, 36 aa, Mycobacterium avium
LKWLGIPQFVVFDWLFWIFSILIATLVSWLLFTWMI

SEQ ID NO: 22429 - protein, 25 aa, Mycobacterium avium
LLDATVVRMFLVPSVMKLLGDDCWW

SEQ ID NO: 22430 - protein, 19 aa, Mycobacterium avium
LLDLIAGIPTLRALGRSSG

SEQ ID NO: 22431 - protein, 17 aa, Mycobacterium avium
LLDTYSPELFCMIRNFH

SEQ ID NO: 22432 - protein, 20 aa, Mycobacterium avium
LLDVCWPASSVLIAMASWAP

SEQ ID NO: 22433 - protein, 36 aa, Mycobacterium avium
LLERQLDLLLDGRKLLWWTLSRFTTLRNLPFRYEED

SEQ ID NO: 22434 - protein, 18 aa, Mycobacterium avium
LLGLVIWQGSLIGASYYA

SEQ ID NO: 22435 - protein, 27 aa, Mycobacterium avium
LLIMGLHPLMFFLPMWHGADSMMLRAL

SEQ ID NO: 22436 - protein, 19 aa, Mycobacterium avium
LLKGWYMSFWPVLSLALVM

SEQ ID NO: 22437 - protein, 43 aa, Mycobacterium avium
LLLDTLVVRAFIVPSIVALLGRWFWWPSPLPRRGVARVVKTVE

SEQ ID NO: 22438 - protein, 19 aa, Mycobacterium avium
LLLGLGVPWYFTQHTTGSL

SEQ ID NO: 22439 - protein, 21 aa, Mycobacterium avium
LLLLAAMVGVLYWFGAHPISG

SEQ ID NO: 22440 - protein, 17 aa, Mycobacterium avium
LLLPLYIGTVPFPISGL

SEQ ID NO: 22441 - protein, 17 aa, Mycobacterium avium
LLLSLRTAAASTALCVA

SEQ ID NO: 22442 - protein, 21 aa, Mycobacterium avium
LLLVSSTLAVIFIAAVVALEI

SEQ ID NO: 22443 - protein, 17 aa, Mycobacterium avium
LLNLAFSTQAAYAAPLI

SEQ ID NO: 22444 - protein, 22 aa, Mycobacterium avium
LLNYLVLLALASFLTFCLTSVA

SEQ ID NO: 22445 - protein, 33 aa, Mycobacterium avium
LLPEAHRMRALIDDLLLLARADERNLLRRKEPV

SEQ ID NO: 22446 - protein, 25 aa, Mycobacterium avium
LLVAFLCVALLVYFALLGRVAIAMI

SEQ ID NO: 22447 - protein, 19 aa, Mycobacterium avium
LLVGFYAVDLLTPGKLRQL

SEQ ID NO: 22448 - protein, 17 aa, Mycobacterium avium
LLVLLALADKWLDRRGK

SEQ ID NO: 22449 - protein, 19 aa, Mycobacterium avium
LLVLPQGFVHSLTYAIFAA

SEQ ID NO: 22450 - protein, 22 aa, Mycobacterium avium
LLVVVMLTRRLLPDAADSVAAP

SEQ ID NO: 22451 - protein, 32 aa, Mycobacterium avium
LMLLPLVYGALYLWAFWDPFGHTNKMPVALVN

SEQ ID NO: 22452 - protein, 18 aa, Mycobacterium avium
LMTTMHEHGLWATADIYP

SEQ ID NO: 22453 - protein, 17 aa, Mycobacterium avium
LNENLAAGRLRFTTDYD

SEQ ID NO: 22454 - protein, 26 aa, Mycobacterium avium
LNVTLRAYLVPLDGYCLYPESPLRLV

SEQ ID NO: 22455 - protein, 36 aa, Mycobacterium avium
LNVVAALIFAIVPWLHRFGDLVAPLTFLGAAYVTVF

SEQ ID NO: 22456 - protein, 17 aa, Mycobacterium avium
LPAMALTIALLMLTGKR

SEQ ID NO: 22457 - protein, 26 aa, Mycobacterium avium
LPAVAPTLFFLLAGAWFVFLAVRASA

SEQ ID NO: 22458 - protein, 26 aa, Mycobacterium avium
LPDAKGALASWLPPGAAAVADYPTVL

SEQ ID NO: 22459 - protein, 33 aa, Mycobacterium avium
LPLYGFQRPGMLLFGLVPLALLALYLVVQARRR

SEQ ID NO: 22460 - protein, 18 aa, Mycobacterium avium
LPLYIGTVPFPISGLISG

SEQ ID NO: 22461 - protein, 19 aa, Mycobacterium avium
LPRTVTFKVLKRQLAAQGV

SEQ ID NO: 22462 - protein, 29 aa, Mycobacterium avium
LQLASALCRHYWPLALLAATMSRHFRRVV

SEQ ID NO: 22463 - protein, 17 aa, Mycobacterium avium
LQMTGMYQTIANDGVRI

SEQ ID NO: 22464 - protein, 18 aa, Mycobacterium avium
LQRKLRVGFAKAGRLMDL

SEQ ID NO: 22465 - protein, 20 aa, Mycobacterium avium
LQVLLGFSRIARAALAISPV

SEQ ID NO: 22466 - protein, 19 aa, Mycobacterium avium
LQVSAYRYLSRRLECALLG

SEQ ID NO: 22467 - protein, 20 aa, Mycobacterium avium
LRARIHGLLGALPAGDGPDS

SEQ ID NO: 22468 - protein, 17 aa, Mycobacterium avium
LRDFYDAFFPRLEEAID

SEQ ID NO: 22469 - protein, 26 aa, Mycobacterium avium
LREFGNLVFHFSLLGLLVAVAVGKLF

SEQ ID NO: 22470 - protein, 20 aa, Mycobacterium avium
LRELGWRNVRRRNLGWRMWY

SEQ ID NO: 22471 - protein, 24 aa, Mycobacterium avium
LRPGSLQALLPPEQRARPGARATL

SEQ ID NO: 22472 - protein, 28 aa, Mycobacterium avium
LSAAAVLVLLAGRRLWHRFRGQPDRADL

SEQ ID NO: 22473 - protein, 18 aa, Mycobacterium avium
LSAPLPLPASGGVRLQLV

SEQ ID NO: 22474 - protein, 30 aa, Mycobacterium avium
LSDEPAPAALWLWVMLTGTAVAVLVLGWRT

SEQ ID NO: 22475 - protein, 18 aa, Mycobacterium avium
LSGLLIGLGVLMVVSLTA

SEQ ID NO: 22476 - protein, 35 aa, Mycobacterium avium
LSLVAAAGVPVVFLTALYGLSVLAGLRPGERVLVH

SEQ ID NO: 22477 - protein, 18 aa, Mycobacterium avium
LSTSAYLLAKVCVYTVFA

SEQ ID NO: 22478 - protein, 22 aa, Mycobacterium avium
LSVKMWFFPVLSVLTLAGITAV

SEQ ID NO: 22479 - protein, 25 aa, Mycobacterium avium
LTCPRWRSLAFVPLGVAAFVVGGAK

SEQ ID NO: 22480 - protein, 20 aa, Mycobacterium avium
LTCVASAMLGLALSAVAKSN

SEQ ID NO: 22481 - protein, 18 aa, Mycobacterium avium
LTERLGERRIYIGGLLIV

SEQ ID NO: 22482 - protein, 22 aa, Mycobacterium avium
LTFTFALVAFAWRRPRFDPLKP

SEQ ID NO: 22483 - protein, 27 aa, Mycobacterium avium
LTKRQRFWVSLYYPLTMRLLCNAITVP

SEQ ID NO: 22484 - protein, 20 aa, Mycobacterium avium
LTLSVLGVALLMLGAARLYA

SEQ ID NO: 22485 - protein, 18 aa, Mycobacterium avium
LTMLALVCLLVIAVLATC

SEQ ID NO: 22486 - protein, 19 aa, Mycobacterium avium
LTMLPVFETPPAHAVSPPA

SEQ ID NO: 22487 - protein, 18 aa, Mycobacterium avium
LTQERLLRRDMGVGELLG

SEQ ID NO: 22488 - protein, 20 aa, Mycobacterium avium
LTVLLLAPDVYWPLRRIGVE

SEQ ID NO: 22489 - protein, 33 aa, Mycobacterium avium
LVATSFPLQLPWLPLLAPLGALAIYLLAIRPFL

SEQ ID NO: 22490 - protein, 27 aa, Mycobacterium avium
LVDGLGWQWIFFVNVPIGVLGLVLAYW

SEQ ID NO: 22491 - protein, 19 aa, Mycobacterium avium
LVGALITLAPFTLGLLTAF

SEQ ID NO: 22492 - protein, 31 aa, Mycobacterium avium
LVGALVPRIRWPMWLRTLLATVALGAVLSCG

SEQ ID NO: 22493 - protein, 18 aa, Mycobacterium avium
LVGSGVDVPLIKPALEAA

SEQ ID NO: 22494 - protein, 18 aa, Mycobacterium avium
LVIVFIETGLLFPLLPGE

SEQ ID NO: 22495 - protein, 32 aa, Mycobacterium avium
LVLFFQILGFALFIFWLLLIARVVVEFIRSFS

SEQ ID NO: 22496 - protein, 24 aa, Mycobacterium avium
LVPSPTCIIVGLPAGLRLAVDNAI

SEQ ID NO: 22497 - protein, 25 aa, Mycobacterium avium
LVPSPTVLMIGLPTGLRLVIDNAIA

SEQ ID NO: 22498 - protein, 18 aa, Mycobacterium avium
LVRDGLLAATLPLLWSRG

SEQ ID NO: 22499 - protein, 31 aa, Mycobacterium avium
LVVMDWLELSWRWLFGLSIVPALISLIIRYR

SEQ ID NO: 22500 - protein, 21 aa, Mycobacterium avium
LVVVFGDFRFGPESTYHATFV

SEQ ID NO: 22501 - protein, 28 aa, Mycobacterium avium
LWACFREPFWRFWLNAPAEDIFFILGAA

SEQ ID NO: 22502 - protein, 18 aa, Mycobacterium avium
MAALLKWLGIPQFVVFDW

SEQ ID NO: 22503 - protein, 29 aa, Mycobacterium avium
MALRRKFSASGFLPDVRRYGATYANYVGK

SEQ ID NO: 22504 - protein, 19 aa, Mycobacterium avium
MASVIAVIPLYIACLAVTY

SEQ ID NO: 22505 - protein, 19 aa, Mycobacterium avium
MCSAATMYSPARVTFFCIG

SEQ ID NO: 22506 - protein, 22 aa, Mycobacterium avium
MDGKVHRHWGFGGGPHRCLGSH

SEQ ID NO: 22507 - protein, 25 aa, Mycobacterium avium
MFVLTWAVALLIWRYGRIEERWAGA

SEQ ID NO: 22508 - protein, 26 aa, Mycobacterium avium
MGSRPVMRRPGWPVFPYTTMVRSSLW

SEQ ID NO: 22509 - protein, 25 aa, Mycobacterium avium
MIMMSFISIPLVTVAWLLVGYTMAF

SEQ ID NO: 22510 - protein, 30 aa, Mycobacterium avium
MIPALQFQHWHWAALALTAPVVGWCGRPFH

SEQ ID NO: 22511 - protein, 25 aa, Mycobacterium avium
MISRPRPGPSLLAYWIGGLTVCVPE

SEQ ID NO: 22512 - protein, 18 aa, Mycobacterium avium
MLAILLNLNMVLMVPVYG

SEQ ID NO: 22513 - protein, 17 aa, Mycobacterium avium
MLPLFRRMQALIDGVNR

SEQ ID NO: 22514 - protein, 34 aa, Mycobacterium avium
MLRGGRSRFGFGTLAVLLCLLLGIAIVTQVRQTE

SEQ ID NO: 22515 - protein, 19 aa, Mycobacterium avium
MPSWWPLNMTWGGLPLFVP

SEQ ID NO: 22516 - protein, 18 aa, Mycobacterium avium
MRALFDAIINDDPLPEEN

SEQ ID NO: 22517 - protein, 29 aa, Mycobacterium avium
MSDFEDFWRPLRSYFYWEKHCYDIPICWS

SEQ ID NO: 22518 - protein, 20 aa, Mycobacterium avium
MSLVAGPRPWHGPVAVLLGL

SEQ ID NO: 22519 - protein, 20 aa, Mycobacterium avium
MTLDRWLLFNWMRYGRALEY

SEQ ID NO: 22520 - protein, 23 aa, Mycobacterium avium
MVAVAVFMLFPLGFSLYMSFQRW

SEQ ID NO: 22521 - protein, 17 aa, Mycobacterium avium
MVFAYITAYLVLFCTAW

SEQ ID NO: 22522 - protein, 17 aa, Mycobacterium avium
MVILGAAPLLLMALYVL

SEQ ID NO: 22523 - protein, 29 aa, Mycobacterium avium
MVLAILGTGLFLGLFSRAAITRPIAQLAA

SEQ ID NO: 22524 - protein, 34 aa, Mycobacterium avium
MVPALMAMFAQWNWWLPPWLSRVLPSVDFDRPLP

SEQ ID NO: 22525 - protein, 27 aa, Mycobacterium avium
MWIGYRHGWGWLARMDWSLLNGTRDLA

SEQ ID NO: 22526 - protein, 19 aa, Mycobacterium avium
MWVARATGMKVRRYFVGFG

SEQ ID NO: 22527 - protein, 37 aa, Mycobacterium avium
NDAETALLRYLLYGLLPAWFIPALLDWNQHRRSRIEI

SEQ ID NO: 22528 - protein, 19 aa, Mycobacterium avium
NDNGPPPPFTSWQPPGVPP

SEQ ID NO: 22529 - protein, 30 aa, Mycobacterium avium
NEIALNILLAALTIIFVFAVATLQPLAIYS

SEQ ID NO: 22530 - protein, 24 aa, Mycobacterium avium
NELHLRVLLICASVIGGTVVVGWV

SEQ ID NO: 22531 - protein, 19 aa, Mycobacterium avium
NFLNRRIGPALAASGAPPG

SEQ ID NO: 22532 - protein, 21 aa, Mycobacterium avium
NFSRRFVPTSFIVSAITLAVT

SEQ ID NO: 22533 - protein, 19 aa, Mycobacterium avium
NFYYFPDQLSIDRYLDRNG

SEQ ID NO: 22534 - protein, 24 aa, Mycobacterium avium
NGTVFLVVSVLLLVVVRPPLRRRL

SEQ ID NO: 22535 - protein, 20 aa, Mycobacterium avium
NILTGPYRQSNLRGAYEKAM

SEQ ID NO: 22536 - protein, 17 aa, Mycobacterium avium
NLAAAGVLVFFFLAAIL

SEQ ID NO: 22537 - protein, 29 aa, Mycobacterium avium
NLQEWLEALFPFNPFSPQGWSMHPSLSMF

SEQ ID NO: 22538 - protein, 25 aa, Mycobacterium avium
NMAVSTWWLRRHCGYRTPVAFVLRL

SEQ ID NO: 22539 - protein, 25 aa, Mycobacterium avium
NMTGNVIFLGFWLAPRTSIDLTAVV

SEQ ID NO: 22540 - protein, 25 aa, Mycobacterium avium
NPADLQALLVPTAPQSGPAPAGGAP

SEQ ID NO: 22541 - protein, 23 aa, Mycobacterium avium
NPDGSIDILVALRVKVASDQSQN

SEQ ID NO: 22542 - protein, 32 aa, Mycobacterium avium
NPTAWTNWLEIFLILVIGFSLPRTFGRMVGNP

SEQ ID NO: 22543 - protein, 27 aa, Mycobacterium avium
NQAPYWVCAVYLVLLALVGAGAALFMD

SEQ ID NO: 22544 - protein, 22 aa, Mycobacterium avium
NQSIPEYILIRSPHDLRTPQAL

SEQ ID NO: 22545 - protein, 21 aa, Mycobacterium avium
NRGTWLVRRFRVAAEGIADDE

SEQ ID NO: 22546 - protein, 35 aa, Mycobacterium avium
NRRVVGVWVVFVLALASWLLGGYIAAAVAVLVGVA

SEQ ID NO: 22547 - protein, 25 aa, Mycobacterium avium
NSELPAPRPIALGLFNAIPEAPSLS

SEQ ID NO: 22548 - protein, 22 aa, Mycobacterium avium
NSLLVLLLVHHLPGLEGGGFGT

SEQ ID NO: 22549 - protein, 26 aa, Mycobacterium avium
NSSGAIILFVYWLIALSQIVLRRRTP

SEQ ID NO: 22550 - protein, 29 aa, Mycobacterium avium
NVFAVRLRWDPYPFILLNLAFSTQAAYAA

SEQ ID NO: 22551 - protein, 26 aa, Mycobacterium avium
NVRRRNLGWRMWYGGPWFSTRIVTAT

SEQ ID NO: 22552 - protein, 19 aa, Mycobacterium avium
NVYGVIPAPLLATMFDFFY

SEQ ID NO: 22553 - protein, 27 aa, Mycobacterium avium
NWAVLSSLVLLIPTLAAIVLLAHPGLP

SEQ ID NO: 22554 - protein, 27 aa, Mycobacterium avium
PAAAIALFQAVVLYCVVRFALGMHAVH

SEQ ID NO: 22555 - protein, 24 aa, Mycobacterium avium
PAAKIPTRLFAGAALPMAPGSSAG

SEQ ID NO: 22556 - protein, 18 aa, Mycobacterium avium
PADLVRFLNRLYIAFDEL

SEQ ID NO: 22557 - protein, 28 aa, Mycobacterium avium
PAGRLVLWTLFWLGWVIALAATFMVSHF

SEQ ID NO: 22558 - protein, 22 aa, Mycobacterium avium
PAIASFLTVVGFVYGALLGFTV

SEQ ID NO: 22559 - protein, 40 aa, Mycobacterium avium
PAKKKRRFLRDPVSVLLIFIIVFALIIAGFIGAELYVRHV

SEQ ID NO: 22560 - protein, 22 aa, Mycobacterium avium
PALVCCLALILALPDLVWGVGG

SEQ ID NO: 22561 - protein, 20 aa, Mycobacterium avium
PAMLPALFPTNVRYGALAIS

SEQ ID NO: 22562 - protein, 19 aa, Mycobacterium avium
PAMLTVASFFKLMDPKRTL

SEQ ID NO: 22563 - protein, 28 aa, Mycobacterium avium
PANIGYLLWMLMGYLVVTAVLVVFVGRL

SEQ ID NO: 22564 - protein, 28 aa, Mycobacterium avium
PAPPPPQPPPPPPSPPPAPPPPVVVTTA

SEQ ID NO: 22565 - protein, 20 aa, Mycobacterium avium
PASSVLIAMASWAPPPATAT

SEQ ID NO: 22566 - protein, 22 aa, Mycobacterium avium
PASWPWPTFTVNIVGAFLVGYF

SEQ ID NO: 22567 - protein, 22 aa, Mycobacterium avium
PATLRRFCKRFAPYNFREHMMQ

SEQ ID NO: 22568 - protein, 27 aa, Mycobacterium avium
PAVDDKWLPKPARPAPPWPTAQREVCA

SEQ ID NO: 22569 - protein, 28 aa, Mycobacterium avium
PAVNTPQFSWVLSRLPRHPQPVPPIYQP

SEQ ID NO: 22570 - protein, 32 aa, Mycobacterium avium
PAYEPPPIPVPVQSPLVLPPPNAGQGAVPVLE

SEQ ID NO: 22571 - protein, 17 aa, Mycobacterium avium
PDAVGKSYCRCGGFLTG

SEQ ID NO: 22572 - protein, 19 aa, Mycobacterium avium
PDNPPPPSAAPPPPPAAPV

SEQ ID NO: 22573 - protein, 20 aa, Mycobacterium avium
PDQFALFRLSVKLPDADTVS

SEQ ID NO: 22574 - protein, 29 aa, Mycobacterium avium
PDTRLRKDLTWWDLVVFGVAVVIGAGIFT

SEQ ID NO: 22575 - protein, 26 aa, Mycobacterium avium
PDVVAQRYRGARYRAFDLMEAGPDRT

SEQ ID NO: 22576 - protein, 24 aa, Mycobacterium avium
PELVNGLRLGLANAWLFVVAAELI

SEQ ID NO: 22577 - protein, 20 aa, Mycobacterium avium
PEVLASRHHATLIPTPAGTE

SEQ ID NO: 22578 - protein, 21 aa, Mycobacterium avium
PFLLIMGGFMYFASRRQRRAM

SEQ ID NO: 22579 - protein, 21 aa, Mycobacterium avium
PFLPLVQLGGVALLSFAIMLV

SEQ ID NO: 22580 - protein, 26 aa, Mycobacterium avium
PFLSYGIQWIAFGILAPIGVGYFAYS

SEQ ID NO: 22581 - protein, 18 aa, Mycobacterium avium
PGALVLTATFAAGNALPL

SEQ ID NO: 22582 - protein, 28 aa, Mycobacterium avium
PGGLSWLSPLGWSLLVKPYAGDRWWVLV

SEQ ID NO: 22583 - protein, 18 aa, Mycobacterium avium
PGGPGLIVPMPPGGPGGP

SEQ ID NO: 22584 - protein, 18 aa, Mycobacterium avium
PGPLWATWTASTALTLFG

SEQ ID NO: 22585 - protein, 23 aa, Mycobacterium avium
PGPPPMWAAPPMPPPPLHGPPGP

SEQ ID NO: 22586 - protein, 23 aa, Mycobacterium avium
PGVILRQILTWMLSTAVPVLAIV

SEQ ID NO: 22587 - protein, 25 aa, Mycobacterium avium
PGWGLIVAWITVLVLIYQWARVVWS

SEQ ID NO: 22588 - protein, 20 aa, Mycobacterium avium
PHVLPLHDFGEIDGVPFIDM

SEQ ID NO: 22589 - protein, 21 aa, Mycobacterium avium
PIAFIALIAVGADYNLLLALR

SEQ ID NO: 22590 - protein, 17 aa, Mycobacterium avium
PIALPEREPRNIWVMIG

SEQ ID NO: 22591 - protein, 31 aa, Mycobacterium avium
PIAPLDVPTPTELPPPPPPPPAPAAPDQVDG

SEQ ID NO: 22592 - protein, 17 aa, Mycobacterium avium
PIAVPRIPGLGGAAPGL

SEQ ID NO: 22593 - protein, 25 aa, Mycobacterium avium
PKRFHRYIINALPLAFQRGSMLWVA

SEQ ID NO: 22594 - protein, 33 aa, Mycobacterium avium
PLAGRYFPPMGSILYWLRPGTIRLPPWPNRIPL

SEQ ID NO: 22595 - protein, 17 aa, Mycobacterium avium
PLGGTRLLLRLAGDGRG

SEQ ID NO: 22596 - protein, 21 aa, Mycobacterium avium
PLLAYLLLVLICRRQWQPKLV

SEQ ID NO: 22597 - protein, 23 aa, Mycobacterium avium
PLWAAMLMWLTLWVLYLSIVNVG

SEQ ID NO: 22598 - protein, 18 aa, Mycobacterium avium
PMERLLILSLGVGGQLAA

SEQ ID NO: 22599 - protein, 28 aa, Mycobacterium avium
PMMARFHGMWSLGTLAGALIGAACVGAG

SEQ ID NO: 22600 - protein, 28 aa, Mycobacterium avium
PMTTEWIHVPLLPVPIPVPVPQKQAPAT

SEQ ID NO: 22601 - protein, 42 aa, Mycobacterium avium
PNFGTGMAPFFLTLALFFGALVLWMVLRPLQYRAIAAEVIAI

SEQ ID NO: 22602 - protein, 22 aa, Mycobacterium avium
PNFTVLVILRLLYGIGMGGEWG

SEQ ID NO: 22603 - protein, 26 aa, Mycobacterium avium
PNLVAARFIQLTPAYTGGPVLADGAS

SEQ ID NO: 22604 - protein, 48 aa, Mycobacterium avium
PNPNPGWAPNPNPLVPVPIPIPVPIPGWNPPYNPPYTPPYNPTTPYTP

SEQ ID NO: 22605 - protein, 23 aa, Mycobacterium avium
PPARPWRPGVWAAVPALAAGAVI

SEQ ID NO: 22606 - protein, 17 aa, Mycobacterium avium
PPCLTGFIPASEWRSPA

SEQ ID NO: 22607 - protein, 21 aa, Mycobacterium avium
PPGGYPPAAPPPPPVAPAPAA

SEQ ID NO: 22608 - protein, 34 aa, Mycobacterium avium
PPGLPAWIGWTHFFNLFMMMFIIRTGIQILCDHP

SEQ ID NO: 22609 - protein, 23 aa, Mycobacterium avium
PPGSWIDQAIVQWVLIALVAAMT

SEQ ID NO: 22610 - protein, 17 aa, Mycobacterium avium
PPLTLLEPVTWSPGTRL

SEQ ID NO: 22611 - protein, 17 aa, Mycobacterium avium
PPPLVMALGWLALAGVL

SEQ ID NO: 22612 - protein, 25 aa, Mycobacterium avium
PPPQHPRIPLQAKPIAALAARQLRD

SEQ ID NO: 22613 - protein, 21 aa, Mycobacterium avium
PPTGELPPPGFPPDRPEGFEQ

SEQ ID NO: 22614 - protein, 17 aa, Mycobacterium avium
PPVFVLVVVALTLAGFA

SEQ ID NO: 22615 - protein, 23 aa, Mycobacterium avium
PPVTTKLPPFATRTDSVLLVATS

SEQ ID NO: 22616 - protein, 24 aa, Mycobacterium avium
PREVTFYCLDYGGGKLRALEDLAH

SEQ ID NO: 22617 - protein, 25 aa, Mycobacterium avium
PRGRRRALPILLRTGAAALGSTVAG

SEQ ID NO: 22618 - protein, 19 aa, Mycobacterium avium
PRLLVAVAALCLGSVAWSP

SEQ ID NO: 22619 - protein, 28 aa, Mycobacterium avium
PRRLGRLMSILSIPMLLAPIGGPILGGW

SEQ ID NO: 22620 - protein, 22 aa, Mycobacterium avium
PRRWVLLKGRLVASVASAFVMA

SEQ ID NO: 22621 - protein, 24 aa, Mycobacterium avium
PSAAPPPPPAAPVPAAPPPQAPVS

SEQ ID NO: 22622 - protein, 18 aa, Mycobacterium avium
PSAFSLAGPWVDVAAPGE

SEQ ID NO: 22623 - protein, 17 aa, Mycobacterium avium
PSTLLVPLLGVLIEMLV

SEQ ID NO: 22624 - protein, 29 aa, Mycobacterium avium
PSVAALLGRWFWWPQLVRPRPASTMLRPT

SEQ ID NO: 22625 - protein, 23 aa, Mycobacterium avium
PSVAFRPVRLFAISVAITAVAVL

SEQ ID NO: 22626 - protein, 19 aa, Mycobacterium avium
PTAPPAMTTPAALALLEGA

SEQ ID NO: 22627 - protein, 25 aa, Mycobacterium avium
PTMRLGHMLVFFVRAVLAVPTVLRQ

SEQ ID NO: 22628 - protein, 25 aa, Mycobacterium avium
PTQPQYIMVLLNIGAVFMGTALTIR

SEQ ID NO: 22629 - protein, 18 aa, Mycobacterium avium
PTTTRVRPIPPIFQPPFG

SEQ ID NO: 22630 - protein, 39 aa, Mycobacterium avium
PVAAVPRGPSRLGRGWLAAIAAVLVLCAAGIGAGGYLAL

SEQ ID NO: 22631 - protein, 20 aa, Mycobacterium avium
PVAGTALMALAFLLMSRMQP

SEQ ID NO: 22632 - protein, 18 aa, Mycobacterium avium
PVLRDTGLAMVVWAVAVA

SEQ ID NO: 22633 - protein, 30 aa, Mycobacterium avium
PVSKDLNPGGWPFPPVPFVNGLASFFGQLG

SEQ ID NO: 22634 - protein, 24 aa, Mycobacterium avium
PVTAAAIVAWRQTNGRFTSVDQLA

SEQ ID NO: 22635 - protein, 20 aa, Mycobacterium avium
PWKWNVIGLLAIALAGAVVL

SEQ ID NO: 22636 - protein, 31 aa, Mycobacterium avium
PWLPARWRHWWWALLLAFVPIHLVVSAIVPA

SEQ ID NO: 22637 - protein, 18 aa, Mycobacterium avium
PWVGALLGVVLVFTCTLG

SEQ ID NO: 22638 - protein, 26 aa, Mycobacterium avium
PYAAVSLPFLLLFRLTCYYYRGAYYR

SEQ ID NO: 22639 - protein, 17 aa, Mycobacterium avium
PYQVLQPWVDAAFKKRG

SEQ ID NO: 22640 - protein, 37 aa, Mycobacterium avium
QADLLVMEMIALPLSFLVLIWVFGGLLAAALPMALGA

SEQ ID NO: 22641 - protein, 18 aa, Mycobacterium avium
QAYGLAYQQSLNAQAAGN

SEQ ID NO: 22642 - protein, 22 aa, Mycobacterium avium
QDAIRWTALVVLTAIGLGLIFP

SEQ ID NO: 22643 - protein, 30 aa, Mycobacterium avium
QDMLSYGWRIPLLLGLPFGLVALYLRLRLE

SEQ ID NO: 22644 - protein, 23 aa, Mycobacterium avium
QESRALLAGWPVASLLLTTVVGA

SEQ ID NO: 22645 - protein, 24 aa, Mycobacterium avium
QEVGFTLSAPLRALTKQSLGVEKP

SEQ ID NO: 22646 - protein, 23 aa, Mycobacterium avium
QFLPDVWWLPYAAVSLPFLLLFR

SEQ ID NO: 22647 - protein, 25 aa, Mycobacterium avium
QGFVHSLTYAIFAAVGLAALLSITF

SEQ ID NO: 22648 - protein, 31 aa, Mycobacterium avium
QGVSMPYFPNYLSLASPFAFSGLSFFHTIEY

SEQ ID NO: 22649 - protein, 28 aa, Mycobacterium avium
QHTATAWLFDMAMLAVLSVGYAALVRWR

SEQ ID NO: 22650 - protein, 21 aa, Mycobacterium avium
QIDAARLLTWRASWMAANNVP

SEQ ID NO: 22651 - protein, 28 aa, Mycobacterium avium
QITDKALIALVVFLALVGLYITVRYERY

SEQ ID NO: 22652 - protein, 17 aa, Mycobacterium avium
QIVSLNVVAALIFAIVP

SEQ ID NO: 22653 - protein, 69 aa, Mycobacterium avium
QKMLQDFWANLPAFLAANGPLLFFVAYQVFFNAVGWPTWGAILTAPFLLPLLLGIGLSSLLAAPAEIAP

SEQ ID NO: 22654 - protein, 25 aa, Mycobacterium avium
QLARYGYICGLVGLVFLVIPALLPA

SEQ ID NO: 22655 - protein, 17 aa, Mycobacterium avium
QLLQWFGAGYVAHVVKR

SEQ ID NO: 22656 - protein, 23 aa, Mycobacterium avium
QLQPLAIDFARESHLLILGANGC

SEQ ID NO: 22657 - protein, 17 aa, Mycobacterium avium
QLRPVATWLNHSMGWCF

SEQ ID NO: 22658 - protein, 41 aa, Mycobacterium avium
QLVAFGILTVISLLVLGIYYLQIPSLVGIGRYTLKAELPAS

SEQ ID NO: 22659 - protein, 22 aa, Mycobacterium avium
QLVARYKLVVGRRIRSATMVAD

SEQ ID NO: 22660 - protein, 20 aa, Mycobacterium avium
QLWFVPFFDDSSWDGPAWSI

SEQ ID NO: 22661 - protein, 25 aa, Mycobacterium avium
QMATRGWRRIGTAIVRWPGPILVVA

SEQ ID NO: 22662 - protein, 22 aa, Mycobacterium avium
QNTGPVLALIALGIIGVAVAGA

SEQ ID NO: 22663 - protein, 21 aa, Mycobacterium avium
QPIHWTPARYLMLAASSGFGF

SEQ ID NO: 22664 - protein, 22 aa, Mycobacterium avium
QPRQSGWGLALRFGGFAVVVGV

SEQ ID NO: 22665 - protein, 24 aa, Mycobacterium avium
QQALNVPLPWSKVLSSTKPGIPAN

SEQ ID NO: 22666 - protein, 33 aa, Mycobacterium avium
QQINPACGCYFDNVYWITFAGMATVDNPRYVIG

SEQ ID NO: 22667 - protein, 18 aa, Mycobacterium avium
QQISFLPAMRYYAGNWAT

SEQ ID NO: 22668 - protein, 23 aa, Mycobacterium avium
QRALGAALWYAATVKDAVVVAAA

SEQ ID NO: 22669 - protein, 18 aa, Mycobacterium avium
QRVSIARALLKPAPILLV

SEQ ID NO: 22670 - protein, 18 aa, Mycobacterium avium
QSVISAILIMAFPHTGLG

SEQ ID NO: 22671 - protein, 28 aa, Mycobacterium avium
QTIRRLSVPILLVWVAVAAISNIAVPNL

SEQ ID NO: 22672 - protein, 26 aa, Mycobacterium avium
QTNNLHRRVILICALSIGAAAVFAWL

SEQ ID NO: 22673 - protein, 22 aa, Mycobacterium avium
QTPDFPLPFTYPPFAAIVFYPL

SEQ ID NO: 22674 - protein, 19 aa, Mycobacterium avium
QVCLPFYGALVTNCGLDRS

SEQ ID NO: 22675 - protein, 33 aa, Mycobacterium avium
QVGSLTAFLAYFTQILMAVLMATMTLVVLPRAS

SEQ ID NO: 22676 - protein, 19 aa, Mycobacterium avium
QVVDRVQWFAVRPDPQSAG

SEQ ID NO: 22677 - protein, 30 aa, Mycobacterium avium
RAAEPILPVRLFASPVFTVCCVLSFVVGFA

SEQ ID NO: 22678 - protein, 17 aa, Mycobacterium avium
RAAFTERGWLDLTHTRR

SEQ ID NO: 22679 - protein, 21 aa, Mycobacterium avium
RAGLRLWVPSLALTAAWVGLY

SEQ ID NO: 22680 - protein, 21 aa, Mycobacterium avium
RAHLVASVLVLIILASCAGLV

SEQ ID NO: 22681 - protein, 19 aa, Mycobacterium avium
RAIFWVGVPVGVLGTVWGM

SEQ ID NO: 22682 - protein, 25 aa, Mycobacterium avium
RALAHRTCVAPLPYAQADLDALQRV

SEQ ID NO: 22683 - protein, 24 aa, Mycobacterium avium
RAPLHIWVIVALVMVPVLVACVVA

SEQ ID NO: 22684 - protein, 21 aa, Mycobacterium avium
RAPQLRSAVGVWVTILDRTRL

SEQ ID NO: 22685 - protein, 17 aa, Mycobacterium avium
RAQALPPGRGLLLSADG

SEQ ID NO: 22686 - protein, 29 aa, Mycobacterium avium
RASAIMHGVWILLFTIPFAGLVDEIPTAA

SEQ ID NO: 22687 - protein, 28 aa, Mycobacterium avium
RASQLAGRPLSLYTLPISGFGKDPNGSD

SEQ ID NO: 22688 - protein, 17 aa, Mycobacterium avium
RAVAMGAVLLVTGLAGC

SEQ ID NO: 22689 - protein, 32 aa, Mycobacterium avium
RDPLRTGIFGVVLVVCVVLIAFGYAGLPFWPQ

SEQ ID NO: 22690 - protein, 18 aa, Mycobacterium avium
RDRTSFIIAHRLSTIRDA

SEQ ID NO: 22691 - protein, 26 aa, Mycobacterium avium
RDVAVRGAAFCLVALTLAAAAGAVRA

SEQ ID NO: 22692 - protein, 23 aa, Mycobacterium avium
REITMPVLSPGSTPLRVLHISDL

SEQ ID NO: 22693 - protein, 36 aa, Mycobacterium avium
REKIPRFIRTFAVPIIIGWIALIAVLNVVVPQLDEV

SEQ ID NO: 22694 - protein, 23 aa, Mycobacterium avium
RELTTGLWRRSGIRIVRRPRAHL

SEQ ID NO: 22695 - protein, 26 aa, Mycobacterium avium
REPIPPLKFAQLVGLIFAVLGAAGFA

SEQ ID NO: 22696 - protein, 18 aa, Mycobacterium avium
RFEFPYVIYQGLTMYLLL

SEQ ID NO: 22697 - protein, 20 aa, Mycobacterium avium
RGAPIVFRSASPADLFMLIF

SEQ ID NO: 22698 - protein, 27 aa, Mycobacterium avium
RGELVYLPPEWFATTPPPALPTVMMIG

SEQ ID NO: 22699 - protein, 19 aa, Mycobacterium avium
RGFVVSILVFVLLGSFILP

SEQ ID NO: 22700 - protein, 21 aa, Mycobacterium avium
RGQWDRLRWQLPASLAGAGLG

SEQ ID NO: 22701 - protein, 42 aa, Mycobacterium avium
RGVVRGLKMLMVTILLVIVGIGLALVLYFTPAMSARNIVVVG

SEQ ID NO: 22702 - protein, 19 aa, Mycobacterium avium
RGWMVLVVVVVVGVAGFCV

SEQ ID NO: 22703 - protein, 19 aa, Mycobacterium avium
RGWYRTQVLPRPDIKIIRI

SEQ ID NO: 22704 - protein, 18 aa, Mycobacterium avium
RHWREALRLTRRDRIQVA

SEQ ID NO: 22705 - protein, 17 aa, Mycobacterium avium
RIFSHYGVASTVLGVLS

SEQ ID NO: 22706 - protein, 21 aa, Mycobacterium avium
RIITPAPPPPPPDHRARNIAI

SEQ ID NO: 22707 - protein, 31 aa, Mycobacterium avium
RIMAGLVVIIPLYALAMIMSFLSPQITTTVL

SEQ ID NO: 22708 - protein, 36 aa, Mycobacterium avium
RIVGDPMLLTMLWQNLIGNAIKFRHKDRRPRVVIEC

SEQ ID NO: 22709 - protein, 22 aa, Mycobacterium avium
RKMAAWAGILAVPTMIAAIYGM

SEQ ID NO: 22710 - protein, 28 aa, Mycobacterium avium
RKRFGSTLGYRLVIYPTYAALDRPDPSD

SEQ ID NO: 22711 - protein, 31 aa, Mycobacterium avium
RKYRWLVFAGWLLALVPAVYLALTQSGNLTG

SEQ ID NO: 22712 - protein, 31 aa, Mycobacterium avium
RLAHQRIKPREWAWALILAAALAVVIIVGDP

SEQ ID NO: 22713 - protein, 22 aa, Mycobacterium avium
RLDNARFLLPVVGVPPDRADDL

SEQ ID NO: 22714 - protein, 21 aa, Mycobacterium avium
RLEAIWRGSVVVLQSILAVAF

SEQ ID NO: 22715 - protein, 17 aa, Mycobacterium avium
RLFIVGREDDMIISGGE

SEQ ID NO: 22716 - protein, 19 aa, Mycobacterium avium
RLFTPFFITVGLVEAAYFI

SEQ ID NO: 22717 - protein, 39 aa, Mycobacterium avium
RLGGKLRTSRQINWGWILALVVIVLALAAIAILGTVLLT

SEQ ID NO: 22718 - protein, 21 aa, Mycobacterium avium
RLIFERFGRFWGAFSVGDLLI

SEQ ID NO: 22719 - protein, 32 aa, Mycobacterium avium
RLIVSDRGYFVFLALLPFIMGSLSMSVPGDVG

SEQ ID NO: 22720 - protein, 17 aa, Mycobacterium avium
RLKGGRLLGPMERLLIL

SEQ ID NO: 22721 - protein, 23 aa, Mycobacterium avium
RLPARIVVGLLIAIGVAVAVGAI

SEQ ID NO: 22722 - protein, 21 aa, Mycobacterium avium
RLPKLIHLACIWIVAIGVNAS

SEQ ID NO: 22723 - protein, 18 aa, Mycobacterium avium
RLRDFLAARALRILPGYY

SEQ ID NO: 22724 - protein, 17 aa, Mycobacterium avium
RLRLVSVGVPVAIGLLA

SEQ ID NO: 22725 - protein, 25 aa, Mycobacterium avium
RLRPPAPWPAPGYPPAWPGSGPAPQ

SEQ ID NO: 22726 - protein, 27 aa, Mycobacterium avium
RLSGLTRWGPWLSLGSAALCGVGALLT

SEQ ID NO: 22727 - protein, 19 aa, Mycobacterium avium
RMEVLAVPMVAVVLFLVFG

SEQ ID NO: 22728 - protein, 17 aa, Mycobacterium avium
RMFAISRGVLHYCERLV

SEQ ID NO: 22729 - protein, 32 aa, Mycobacterium avium
RMGHVRPLYGPGLRFLIPLLDKMIRVDQRLVT

SEQ ID NO: 22730 - protein, 21 aa, Mycobacterium avium
RNANRAFGAPPARWPRALHLV

SEQ ID NO: 22731 - protein, 17 aa, Mycobacterium avium
RNRLAVTSLTLLVLLFV

SEQ ID NO: 22732 - protein, 26 aa, Mycobacterium avium
RNVDNWVRRVLALPAFPGGTVDRPIQ

SEQ ID NO: 22733 - protein, 27 aa, Mycobacterium avium
RPDLSTLRRIPWLPGTALVIADVVGAD

SEQ ID NO: 22734 - protein, 20 aa, Mycobacterium avium
RPDNPLPCAGAVTGPFGGPG

SEQ ID NO: 22735 - protein, 45 aa, Mycobacterium avium
RPPPEPPTPWYRRPAALVAFGALGVLLLGAVVFAAVKLATSSPAH

SEQ ID NO: 22736 - protein, 18 aa, Mycobacterium avium
RPRSWLLARASRAAPEDT

SEQ ID NO: 22737 - protein, 23 aa, Mycobacterium avium
RPVATWLNHSMGWCFLFADGNTS

SEQ ID NO: 22738 - protein, 18 aa, Mycobacterium avium
RPVRSYFYWEKHCFDIPA

SEQ ID NO: 22739 - protein, 17 aa, Mycobacterium avium
RPYGYDHTPRFVPRLWR

SEQ ID NO: 22740 - protein, 30 aa, Mycobacterium avium
RQEDKRLLPYMIGAFLLVVGVSVAVGVWAG

SEQ ID NO: 22741 - protein, 17 aa, Mycobacterium avium
RQFAPRRTAVCAGAVFA

SEQ ID NO: 22742 - protein, 26 aa, Mycobacterium avium
RQHVDLRPLWGIDQRLKRFGTMAAAM

SEQ ID NO: 22743 - protein, 25 aa, Mycobacterium avium
RQLITIARAFLARPQLLILDEATSS

SEQ ID NO: 22744 - protein, 21 aa, Mycobacterium avium
RQRWMSWFALLTIPTPFLANI

SEQ ID NO: 22745 - protein, 25 aa, Mycobacterium avium
RQSAILVTAWAVSGGIFLLLNLAGG

SEQ ID NO: 22746 - protein, 18 aa, Mycobacterium avium
RRAAGFIGFAIGGPLSDG

SEQ ID NO: 22747 - protein, 24 aa, Mycobacterium avium
RRDRNLVYFLFASALFRDGLAAIF

SEQ ID NO: 22748 - protein, 18 aa, Mycobacterium avium
RRGANVALLARGAAGLQG

SEQ ID NO: 22749 - protein, 44 aa, Mycobacterium avium
RRHGGALHRAGLLAALPLSLIAVAAAAVMIFFVHQRDSTAPATE

SEQ ID NO: 22750 - protein, 22 aa, Mycobacterium avium
RRIGKPAQLRWLGMIAPSDDEA

SEQ ID NO: 22751 - protein, 35 aa, Mycobacterium avium
RRMKAVALSFLIGATGLFLACRWAQAQPGVGAWVG

SEQ ID NO: 22752 - protein, 20 aa, Mycobacterium avium
RRRRMRARTVRLNETALMVQ

SEQ ID NO: 22753 - protein, 34 aa, Mycobacterium avium
RRSGPGWLLFQWRWSIVALWFTAVFLLIMVRFWD

SEQ ID NO: 22754 - protein, 25 aa, Mycobacterium avium
RRTQHNVYIPWSMTVTPISQSDVGS

SEQ ID NO: 22755 - protein, 25 aa, Mycobacterium avium
RSAMATLRIAFLSALVLELLATLGV

SEQ ID NO: 22756 - protein, 18 aa, Mycobacterium avium
RSASCLAAALFLAAAPAV

SEQ ID NO: 22757 - protein, 26 aa, Mycobacterium avium
RSASPADLFMLIFTSGTSGEPKAVKC

SEQ ID NO: 22758 - protein, 22 aa, Mycobacterium avium
RSLLIFIVTVVILVTVLVQGST

SEQ ID NO: 22759 - protein, 18 aa, Mycobacterium avium
RSMVIKVSIFAAAMLLVS

SEQ ID NO: 22760 - protein, 28 aa, Mycobacterium avium
RSPLSRIPRRWVIAALGVLVVAAGLAVA

SEQ ID NO: 22761 - protein, 25 aa, Mycobacterium avium
RSPRLVALPLWTWLLTVAVISMGGP

SEQ ID NO: 22762 - protein, 23 aa, Mycobacterium avium
RSQLWLSLLSWAVVVALYFVARS

SEQ ID NO: 22763 - protein, 25 aa, Mycobacterium avium
RSRVRSLLLLLVLGSAAIAATLLAA

SEQ ID NO: 22764 - protein, 17 aa, Mycobacterium avium
RSTVDLAAPWFIGAAMG

SEQ ID NO: 22765 - protein, 27 aa, Mycobacterium avium
RSTVLRHALLSYLLGAVILAVTINLIA

SEQ ID NO: 22766 - protein, 19 aa, Mycobacterium avium
RTLWPIAQTTVAAGLAWYL

SEQ ID NO: 22767 - protein, 20 aa, Mycobacterium avium
RTQLLVPPATWNLQADDAQV

SEQ ID NO: 22768 - protein, 17 aa, Mycobacterium avium
RTQVTGYQFLARRTAMA

SEQ ID NO: 22769 - protein, 26 aa, Mycobacterium avium
RTVALPLGALVLAVLAVLGFLPGRAE

SEQ ID NO: 22770 - protein, 24 aa, Mycobacterium avium
RTVGVLFAIILLDASLIGANAVGL

SEQ ID NO: 22771 - protein, 25 aa, Mycobacterium avium
RTVRFWAAPLVITLALMSALCALYL

SEQ ID NO: 22772 - protein, 22 aa, Mycobacterium avium
RVALFWVAFILTRPLGATVGDF

SEQ ID NO: 22773 - protein, 19 aa, Mycobacterium avium
RVALRRMKAVALSFLIGAT

SEQ ID NO: 22774 - protein, 27 aa, Mycobacterium avium
RVAPPHPSRWRHVPTILLATSLVLLTT

SEQ ID NO: 22775 - protein, 27 aa, Mycobacterium avium
RVDGELILFWTLPVALVLWIASFFLFP

SEQ ID NO: 22776 - protein, 20 aa, Mycobacterium avium
RVGDRLYPALNLASARLITG

SEQ ID NO: 22777 - protein, 19 aa, Mycobacterium avium
RVLAIAAWLAVLVCADFIL

SEQ ID NO: 22778 - protein, 17 aa, Mycobacterium avium
RVQFYCLDFGGGALSSL

SEQ ID NO: 22779 - protein, 28 aa, Mycobacterium avium
RVRKYLTLMAFRIPALILAAVAYGAWHN

SEQ ID NO: 22780 - protein, 20 aa, Mycobacterium avium
RWELPVLRWVDGGRGNRRVI

SEQ ID NO: 22781 - protein, 25 aa, Mycobacterium avium
RWERAMFIFIAITLLQIPMLLMSHP

SEQ ID NO: 22782 - protein, 19 aa, Mycobacterium avium
RYFGFLINLLIVFGVSFEF

SEQ ID NO: 22783 - protein, 18 aa, Mycobacterium avium
RYLPDLVVVLALLAAVAL

SEQ ID NO: 22784 - protein, 17 aa, Mycobacterium avium
RYRKILQPYFSPHALGK

SEQ ID NO: 22785 - protein, 24 aa, Mycobacterium avium
SAAFVDSLRWLAIAWVISAVCLFG

SEQ ID NO: 22786 - protein, 22 aa, Mycobacterium avium
SAAMILMVWRVGLGLPAVAPTL

SEQ ID NO: 22787 - protein, 18 aa, Mycobacterium avium
SAGLVPPIDQWSGSTFSN

SEQ ID NO: 22788 - protein, 27 aa, Mycobacterium avium
SAIVLLAVFSLVFWGVSILPADPAAIF

SEQ ID NO: 22789 - protein, 17 aa, Mycobacterium avium
SALLAWLTAAAVAIAML

SEQ ID NO: 22790 - protein, 19 aa, Mycobacterium avium
SALPAALARAALAGGIAAV

SEQ ID NO: 22791 - protein, 27 aa, Mycobacterium avium
SALTLIFMIMLLLTRSVVAALVIVGTA

SEQ ID NO: 22792 - protein, 20 aa, Mycobacterium avium
SARQLALALCALAAALALLA

SEQ ID NO: 22793 - protein, 28 aa, Mycobacterium avium
SARVLVIAALAAVFVFIAAVAGVQLYRK

SEQ ID NO: 22794 - protein, 17 aa, Mycobacterium avium
SAVCLFGVLLAFRFLTP

SEQ ID NO: 22795 - protein, 28 aa, Mycobacterium avium
SAVIFNAIIIVLLIPLSLRGVRYTPSSA

SEQ ID NO: 22796 - protein, 24 aa, Mycobacterium avium
SAYHALTFGWLMSGLGRAVTGKGM

SEQ ID NO: 22797 - protein, 35 aa, Mycobacterium avium
SDASLWMRLPDLFAGIVCWLLLSREVLPRLGPAVA

SEQ ID NO: 22798 - protein, 30 aa, Mycobacterium avium
SDPVMTLFSVLFALLWLSALAVFQTRSTRI

SEQ ID NO: 22799 - protein, 23 aa, Mycobacterium avium
SDRLSHTLLPKRIALPVFASDAL

SEQ ID NO: 22800 - protein, 17 aa, Mycobacterium avium
SERTFLGVIPMLTSTNL

SEQ ID NO: 22801 - protein, 24 aa, Mycobacterium avium
SFEQKFPNVLSPRTSLLVLGDGRT

SEQ ID NO: 22802 - protein, 34 aa, Mycobacterium avium
SFGLSVLIWQDLFGIRIHWIVAALSVIILLAVGS

SEQ ID NO: 22803 - protein, 27 aa, Mycobacterium avium
SFWTFGIIAMVTLLAKVDLARGYLAIA

SEQ ID NO: 22804 - protein, 19 aa, Mycobacterium avium
SGALYAKIDGRLYPALNLT

SEQ ID NO: 22805 - protein, 35 aa, Mycobacterium avium
SGGFPRWFPSSLRRQLLFGVLAVVSVVLVTVGFVS

SEQ ID NO: 22806 - protein, 26 aa, Mycobacterium avium
SGLALAYLGLLWWMMVCWAQPVRNRP

SEQ ID NO: 22807 - protein, 28 aa, Mycobacterium avium
SGPFFKAIVANLLPYQVLQPWVDAAFKK

SEQ ID NO: 22808 - protein, 25 aa, Mycobacterium avium
SGPVAFWACGLLLCMFIGPSQSSSR

SEQ ID NO: 22809 - protein, 28 aa, Mycobacterium avium
SGTPHRALVWLGWLTAATAIGWAIDTAT

SEQ ID NO: 22810 - protein, 27 aa, Mycobacterium avium
SGVAAPFIWLAWLLRIPAVFVESVTRI

SEQ ID NO: 22811 - protein, 31 aa, Mycobacterium avium
SGVRSLSTGFFPLMGIGAFSMLAFSGRFGRA

SEQ ID NO: 22812 - protein, 34 aa, Mycobacterium avium
SIALTTVLPLQVISWLLMPISRLLVVLGNAVTPG

SEQ ID NO: 22813 - protein, 31 aa, Mycobacterium avium
SIATMHVAFSIWYLWSVMVLFMPQARYGFTT

SEQ ID NO: 22814 - protein, 20 aa, Mycobacterium avium
SIDYAIFVIAIIGAAESFGL

SEQ ID NO: 22815 - protein, 19 aa, Mycobacterium avium
SIGLARWWHLGVDVLWLLN

SEQ ID NO: 22816 - protein, 20 aa, Mycobacterium avium
SIPLLTARLSGRFGVPVHST

SEQ ID NO: 22817 - protein, 20 aa, Mycobacterium avium
SITVAVAVALVLWWRMVRFE

SEQ ID NO: 22818 - protein, 24 aa, Mycobacterium avium
SKYYPAWLPSRRFIAAVIAIGGMQ

SEQ ID NO: 22819 - protein, 29 aa, Mycobacterium avium
SLAAGWRSWRWRLLWLPSAAVLGVTTAVG

SEQ ID NO: 22820 - protein, 18 aa, Mycobacterium avium
SLFKAVVFVWIASTIQCY

SEQ ID NO: 22821 - protein, 21 aa, Mycobacterium avium
SLFMAIAIAVTWMVYATLRRD

SEQ ID NO: 22822 - protein, 21 aa, Mycobacterium avium
SLGILRLVAVFGPVHYFAQPV

SEQ ID NO: 22823 - protein, 17 aa, Mycobacterium avium
SLIALARDQVVHGWVLA

SEQ ID NO: 22824 - protein, 20 aa, Mycobacterium avium
SLIVVVVITLFISLAVYGAS

SEQ ID NO: 22825 - protein, 21 aa, Mycobacterium avium
SLLHGWLPPTVQGLALLMLVA

SEQ ID NO: 22826 - protein, 23 aa, Mycobacterium avium
SLRLRLLVGQIVVLALVCLGITA

SEQ ID NO: 22827 - protein, 25 aa, Mycobacterium avium
SLTYYPLLLAIHRPLGALILAFAVV

SEQ ID NO: 22828 - protein, 24 aa, Mycobacterium avium
SLVMVFQWGWLRDLGFAQISSIDS

SEQ ID NO: 22829 - protein, 24 aa, Mycobacterium avium
SMAVIAPAAWYGLGALLGAAVMIP

SEQ ID NO: 22830 - protein, 25 aa, Mycobacterium avium
SMDYEIFLLTRIRERFLHSGNTRDA

SEQ ID NO: 22831 - protein, 24 aa, Mycobacterium avium
SMDYEVFLLSRIREYWLASGAARP

SEQ ID NO: 22832 - protein, 19 aa, Mycobacterium avium
SMFGPYHLKRLLGRGGMGE

SEQ ID NO: 22833 - protein, 40 aa, Mycobacterium avium
SMMAAVWLSALLVFAARRQSRWPWLCFGLALVCSVLLDAY

SEQ ID NO: 22834 - protein, 23 aa, Mycobacterium avium
SMVLYIGCWWRHLNPPPAAAPAQ

SEQ ID NO: 22835 - protein, 25 aa, Mycobacterium avium
SNAILLIFTVLVIVGYPLILETATR

SEQ ID NO: 22836 - protein, 24 aa, Mycobacterium avium
SNLYSQWVPRTLPPGWKPGSQAVA

SEQ ID NO: 22837 - protein, 24 aa, Mycobacterium avium
SNRLLMGLGWPVVVLVSIVVARRS

SEQ ID NO: 22838 - protein, 37 aa, Mycobacterium avium
SPALSTALGWAIFHTLMIFWPFMQAAIQMAVVLAPVV

SEQ ID NO: 22839 - protein, 20 aa, Mycobacterium avium
SPEFVPWLLVALTGMIFQQS

SEQ ID NO: 22840 - protein, 23 aa, Mycobacterium avium
SPHSSWLVIRWVVASALGGPLLM

SEQ ID NO: 22841 - protein, 27 aa, Mycobacterium avium
SPHTTWVLYAVIIVSALIIAGAIPILL

SEQ ID NO: 22842 - protein, 29 aa, Mycobacterium avium
SPVNAAISALVLPSAFRPVPDPNTPTGSR

SEQ ID NO: 22843 - protein, 41 aa, Mycobacterium avium
SQQWEYLDLPRLWQILLIAGMFMWIAIIWRGIRGRLKGESK

SEQ ID NO: 22844 - protein, 27 aa, Mycobacterium avium
SRALFDALPATEPLGVPPVPLAGTPST

SEQ ID NO: 22845 - protein, 18 aa, Mycobacterium avium
SRAQLLIASGSLAADPGK

SEQ ID NO: 22846 - protein, 27 aa, Mycobacterium avium
SRHDIVIVRRAIRRLLLRGDSPETASL

SEQ ID NO: 22847 - protein, 17 aa, Mycobacterium avium
SRHHATLIPTPAGTEIH

SEQ ID NO: 22848 - protein, 19 aa, Mycobacterium avium
SRLYAWVTTLYLVGSVVAA

SEQ ID NO: 22849 - protein, 31 aa, Mycobacterium avium
SRWKRWLYSIAAIPGYLLLGDGRFLWACFRE

SEQ ID NO: 22850 - protein, 38 aa, Mycobacterium avium
SSALSFAIGALLPLIAILLPPPTWRIPVTVVAVLIALV

SEQ ID NO: 22851 - protein, 22 aa, Mycobacterium avium
SSEFQMLLAGRKLSARDRRVLS

SEQ ID NO: 22852 - protein, 32 aa, Mycobacterium avium
SSETLPMMLAPWVLLPTILALRATGPRSVRAL

SEQ ID NO: 22853 - protein, 25 aa, Mycobacterium avium
SSFKVPSVWLVLRSDDDLPRGVTGK

SEQ ID NO: 22854 - protein, 20 aa, Mycobacterium avium
SSVHYLLDVLRRVATDFDRI

SEQ ID NO: 22855 - protein, 17 aa, Mycobacterium avium
SSVPAWLSLLGDVLVAT

SEQ ID NO: 22856 - protein, 19 aa, Mycobacterium avium
SSWLLGCLVLLFVTSSGVG

SEQ ID NO: 22857 - protein, 26 aa, Mycobacterium avium
STFLRPNDLLWSFFSALAMATGVMVV

SEQ ID NO: 22858 - protein, 23 aa, Mycobacterium avium
STGLPARLLPVALSVAGIGVMTV

SEQ ID NO: 22859 - protein, 26 aa, Mycobacterium avium
STIGWGWTLLVLLATFLLGWGVVAPM

SEQ ID NO: 22860 - protein, 24 aa, Mycobacterium avium
STIMHGFWVLVFAVPFAGLVEKIP

SEQ ID NO: 22861 - protein, 26 aa, Mycobacterium avium
STVGITFLLIGFARMGVFKTVGISSA

SEQ ID NO: 22862 - protein, 20 aa, Mycobacterium avium
STVLPILQDTTIVAAGPSVQ

SEQ ID NO: 22863 - protein, 38 aa, Mycobacterium avium
SVADPEYLAYYPFVYAGLLLLMRARLKRLPIAVQLDSV

SEQ ID NO: 22864 - protein, 22 aa, Mycobacterium avium
SVIGLLLPFSPSLGVLVFGRAV

SEQ ID NO: 22865 - protein, 23 aa, Mycobacterium avium
SVISFTAILWKLSGDLNLFGLVL

SEQ ID NO: 22866 - protein, 21 aa, Mycobacterium avium
SVPSDLSVYALYRAARDDGAG

SEQ ID NO: 22867 - protein, 23 aa, Mycobacterium avium
SVQLGLISLFPDGSVTSLLVAAL

SEQ ID NO: 22868 - protein, 24 aa, Mycobacterium avium
SVRVWLMLGVLLLSVLLSVRLSVL

SEQ ID NO: 22869 - protein, 19 aa, Mycobacterium avium
SVVFQHPYLFHGSIRDNVL

SEQ ID NO: 22870 - protein, 19 aa, Mycobacterium avium
SWFHAAGPVGAWVDTALRT

SEQ ID NO: 22871 - protein, 25 aa, Mycobacterium avium
SWLEVPLAMRDGLGLRLELKLHDPR

SEQ ID NO: 22872 - protein, 29 aa, Mycobacterium avium
SWPAPLSILLALWAVRAVAHWLQARLGQR

SEQ ID NO: 22873 - protein, 26 aa, Mycobacterium avium
SWQDQLTAWLKQYTQNFAWPVSKDLN

SEQ ID NO: 22874 - protein, 32 aa, Mycobacterium avium
SWVRRYTLRRGALLFGKLLPVGIGVVVGAVGN

SEQ ID NO: 22875 - protein, 25 aa, Mycobacterium avium
TADYSFLSFYPYWGFQGLTSHYANP

SEQ ID NO: 22876 - protein, 18 aa, Mycobacterium avium
TAGAALRALLALGAKDVA

SEQ ID NO: 22877 - protein, 28 aa, Mycobacterium avium
TAGLTVWVVGYTLRPLRRLAAIAAHVAA

SEQ ID NO: 22878 - protein, 26 aa, Mycobacterium avium
TAIGLGLIFPPLQQLIERPFAYLPQR

SEQ ID NO: 22879 - protein, 23 aa, Mycobacterium avium
TALIVLIAVLFLGSPISVTKVVG

SEQ ID NO: 22880 - protein, 23 aa, Mycobacterium avium
TALLGYRIMAWTTGLWLIALCYE

SEQ ID NO: 22881 - protein, 17 aa, Mycobacterium avium
TALLLSLRTAAASTALC

SEQ ID NO: 22882 - protein, 34 aa, Mycobacterium avium
TAPVVISGWALMTWILMAFGSTLSRLASLLLAVL

SEQ ID NO: 22883 - protein, 30 aa, Mycobacterium avium
TAVALLLAAVLLPWNLYFGVGIPDSNPIVF

SEQ ID NO: 22884 - protein, 17 aa, Mycobacterium avium
TAVAVLVLGWRTARRWR

SEQ ID NO: 22885 - protein, 18 aa, Mycobacterium avium
TAVRRRRRRGRVATWVAS

SEQ ID NO: 22886 - protein, 23 aa, Mycobacterium avium
TAWLLALGLAMIAAGVWPASASG

SEQ ID NO: 22887 - protein, 20 aa, Mycobacterium avium
TAWTYLMYAGSWVGGPLRME

SEQ ID NO: 22888 - protein, 20 aa, Mycobacterium avium
TDIELLGMSHLLILAGLDTV

SEQ ID NO: 22889 - protein, 25 aa, Mycobacterium avium
TDLDALAALPLPTLDDLSRALVVDV

SEQ ID NO: 22890 - protein, 36 aa, Mycobacterium avium
TDRSRRRLRRRLSGGLLLLIALTIAGGLAAILTPRP

SEQ ID NO: 22891 - protein, 30 aa, Mycobacterium avium
TDVGVIELPPGYLPLRIPIEVNFTQRVAVD

SEQ ID NO: 22892 - protein, 19 aa, Mycobacterium avium
TDVLPPRPRTHTTVLTLAA

SEQ ID NO: 22893 - protein, 21 aa, Mycobacterium avium
TDYAVFLISRYHDFLRRGDDF

SEQ ID NO: 22894 - protein, 25 aa, Mycobacterium avium
TEPGLPRYFAAYVLGLSAACALAAG

SEQ ID NO: 22895 - protein, 30 aa, Mycobacterium avium
TEPLVLGFVALIAFVMLLVSIHSVFLALKG

SEQ ID NO: 22896 - protein, 23 aa, Mycobacterium avium
TEVSWRLAFLVNVPIGLVMMYLA

SEQ ID NO: 22897 - protein, 26 aa, Mycobacterium avium
TFAHQSAWLRIFAVGLMFAGVTTTAL

SEQ ID NO: 22898 - protein, 30 aa, Mycobacterium avium
TFGLGSRYFRFLPRRLVERIVPKPGTGPSP

SEQ ID NO: 22899 - protein, 19 aa, Mycobacterium avium
TFLTVEAWAFLQLGARQQS

SEQ ID NO: 22900 - protein, 23 aa, Mycobacterium avium
TFLYAYGVVFTLFPIRAGLTLSN

SEQ ID NO: 22901 - protein, 20 aa, Mycobacterium avium
TFVLGSFYIIPSILAVRGTG

SEQ ID NO: 22902 - protein, 26 aa, Mycobacterium avium
TGAAPGPWRLLLRDLAHLLDTASIVG

SEQ ID NO: 22903 - protein, 25 aa, Mycobacterium avium
TGAVVWLGIASFAAAGVVGLLAWVS

SEQ ID NO: 22904 - protein, 27 aa, Mycobacterium avium
TGGAGFFGLAFFIALAGLTPTGLLLAA

SEQ ID NO: 22905 - protein, 27 aa, Mycobacterium avium
TGKRGFLPPFVTWFAALLFAVIPIRNF

SEQ ID NO: 22906 - protein, 24 aa, Mycobacterium avium
TGREWAWALLLAVALAVLIAVGDP

SEQ ID NO: 22907 - protein, 34 aa, Mycobacterium avium
TIAGGYLLVLAMLYGWWCMHRGVPYFPNLVLPIV

SEQ ID NO: 22908 - protein, 17 aa, Mycobacterium avium
TIALLMLTGKRGFLPPF

SEQ ID NO: 22909 - protein, 17 aa, Mycobacterium avium
TIFAFPVFGFGVIFGAI

SEQ ID NO: 22910 - protein, 31 aa, Mycobacterium avium
TILDLVVVFLVTWPLVYLASKSPTLAKPAYN

SEQ ID NO: 22911 - protein, 20 aa, Mycobacterium avium
TINVSSVALIWFGGLRIDHG

SEQ ID NO: 22912 - protein, 23 aa, Mycobacterium avium
TITAYLINRRWTFQAAPSTARFV

SEQ ID NO: 22913 - protein, 25 aa, Mycobacterium avium
TKTAPPLSQLRPGGFPPALDRVIAK

SEQ ID NO: 22914 - protein, 26 aa, Mycobacterium avium
TLDAMIGHRSPRYLRFGWAAAKLDDI

SEQ ID NO: 22915 - protein, 18 aa, Mycobacterium avium
TLFLVLKTVNYVPHESVV

SEQ ID NO: 22916 - protein, 26 aa, Mycobacterium avium
TLGSTMGILTWIFVDGHLSGVLNFTP

SEQ ID NO: 22917 - protein, 21 aa, Mycobacterium avium
TLLVAIPFTVLVSFTLNILLR

SEQ ID NO: 22918 - protein, 31 aa, Mycobacterium avium
TLNALPPRPEVRLLWALIAAAAMIEGALPIP

SEQ ID NO: 22919 - protein, 17 aa, Mycobacterium avium
TLRHQARWRGDHPLLIC

SEQ ID NO: 22920 - protein, 19 aa, Mycobacterium avium
TLTLTLPRPTQVAGVRLVP

SEQ ID NO: 22921 - protein, 30 aa, Mycobacterium avium
TMVTLLAQKFAAPLLDRYLGRTGYDSQQTE

SEQ ID NO: 22922 - protein, 24 aa, Mycobacterium avium
TPAVIQSLYLFILGAGIGLSMQVL

SEQ ID NO: 22923 - protein, 21 aa, Mycobacterium avium
TPEAPFGWYYDLLALWAHVST

SEQ ID NO: 22924 - protein, 24 aa, Mycobacterium avium
TPGLPMPGLPMPAGPAVAPAPAEV

SEQ ID NO: 22925 - protein, 19 aa, Mycobacterium avium
TPHPRFPHLIPGGDYIMSG

SEQ ID NO: 22926 - protein, 52 aa, Mycobacterium avium
TPPRPLAAPHPIAPPPPAPPPIAVPVPVLPPPVFVPPPRVPLARPPAPGHGP

SEQ ID NO: 22927 - protein, 44 aa, Mycobacterium avium
TPSRPRWSRRRLFVVIALAVMLVLAGLTVGWWVIQRNYYVAEYN

SEQ ID NO: 22928 - protein, 25 aa, Mycobacterium avium
TQDYAPWLTRALAFVIDILPYVVVH

SEQ ID NO: 22929 - protein, 24 aa, Mycobacterium avium
TQPALDLDALLGGLRPVLKGLDAD

SEQ ID NO: 22930 - protein, 18 aa, Mycobacterium avium
TQRFSWVAIGLVLFVAGS

SEQ ID NO: 22931 - protein, 36 aa, Mycobacterium avium
TQSKFWNRWIGWVMRRPWMSALAASLVLLVMAAPAA

SEQ ID NO: 22932 - protein, 29 aa, Mycobacterium avium
TRLVRSLRPLILLPLVLPPVVGGIALLYA

SEQ ID NO: 22933 - protein, 21 aa, Mycobacterium avium
TRPPRRPVPPRRPARPPSTPP

SEQ ID NO: 22934 - protein, 31 aa, Mycobacterium avium
TRRSRILILIALGVIALLLAGPRLIDAYVDW

SEQ ID NO: 22935 - protein, 26 aa, Mycobacterium avium
TRSFRLVRRGFWRVLGIRALAFLVTA

SEQ ID NO: 22936 - protein, 23 aa, Mycobacterium avium
TSAALIMIAVFVGFAFAGMPLVA

SEQ ID NO: 22937 - protein, 22 aa, Mycobacterium avium
TSGTVLPFTALNTPLAVAVDRD

SEQ ID NO: 22938 - protein, 33 aa, Mycobacterium avium
TSKPVGITMLWPLADRPRLAPGVPGGTIPVRLV

SEQ ID NO: 22939 - protein, 22 aa, Mycobacterium avium
TSPAGWVAILLYAVCVVLRLAR

SEQ ID NO: 22940 - protein, 18 aa, Mycobacterium avium
TSRVPLLALVGQPPSTMD

SEQ ID NO: 22941 - protein, 30 aa, Mycobacterium avium
TSTFVLIVAFLLVWWVYDTYRPEPAPKPPA

SEQ ID NO: 22942 - protein, 28 aa, Mycobacterium avium
TSVWGILSWILILLLPAGTLHYWQAWVF

SEQ ID NO: 22943 - protein, 29 aa, Mycobacterium avium
TTAALGLSLLALWLLTRATGQPLTVALLG

SEQ ID NO: 22944 - protein, 24 aa, Mycobacterium avium
TTASIRYLNLIGDRYLELKRGTSG

SEQ ID NO: 22945 - protein, 27 aa, Mycobacterium avium
TVADFWRFWVVHLWVEDFLELFTTVMV

SEQ ID NO: 22946 - protein, 26 aa, Mycobacterium avium
TVAILIAWYLLLRLFGYTLSSVAAPA

SEQ ID NO: 22947 - protein, 22 aa, Mycobacterium avium
TVGCYTLLAMAFNTFGIQLEHA

SEQ ID NO: 22948 - protein, 25 aa, Mycobacterium avium
TVKDRLVALKLLRGELDAGFRQRLW

SEQ ID NO: 22949 - protein, 19 aa, Mycobacterium avium
TVLLVPLVGALFSGTPHRA

SEQ ID NO: 22950 - protein, 29 aa, Mycobacterium avium
TVPGGWLTATVLFLLLAIAAVVAVHILRR

SEQ ID NO: 22951 - protein, 25 aa, Mycobacterium avium
TVVFSFMALFFINILTTALGVKVTA

SEQ ID NO: 22952 - protein, 20 aa, Mycobacterium avium
TVVRLVMVPALMAMFAQWNW

SEQ ID NO: 22953 - protein, 33 aa, Mycobacterium avium
TVVVGWVISLIMVNPFLLLAQQARAINAQSSPD

SEQ ID NO: 22954 - protein, 17 aa, Mycobacterium avium
TVVVPVLAVVVLALIWG

SEQ ID NO: 22955 - protein, 24 aa, Mycobacterium avium
TYPANYFRSFAIRKQGVAVIDVPV

SEQ ID NO: 22956 - protein, 26 aa, Mycobacterium avium
VAAGGLPWYKRTALVLSVAGAGAAVL

SEQ ID NO: 22957 - protein, 26 aa, Mycobacterium avium
VAALAVLVTVFTLIRDRPAPVMSAKL

SEQ ID NO: 22958 - protein, 19 aa, Mycobacterium avium
VAARLPWVVIRSFDGLGPP

SEQ ID NO: 22959 - protein, 26 aa, Mycobacterium avium
VAASLTMVPLLPRLVFLVVGPAVDVK

SEQ ID NO: 22960 - protein, 25 aa, Mycobacterium avium
VAATGWLGYLLGPPLIGHLSEWVGL

SEQ ID NO: 22961 - protein, 23 aa, Mycobacterium avium
VAAVIFVLIYVVAGVFVVSHLPS

SEQ ID NO: 22962 - protein, 18 aa, Mycobacterium avium
VAGLYFWTGVSRVALFWV

SEQ ID NO: 22963 - protein, 28 aa, Mycobacterium avium
VAGRMDPVNLLPFLLLGTTFGARLLGIA

SEQ ID NO: 22964 - protein, 34 aa, Mycobacterium avium
VALAYIFVLLVIPVSLILWRTFRPGFGQFYAWVS

SEQ ID NO: 22965 - protein, 31 aa, Mycobacterium avium
VALLSLIAGVLWGAGWVAVLAVLTRLRHLFF

SEQ ID NO: 22966 - protein, 25 aa, Mycobacterium avium
VAMLGVALVLFLGLRNSALAAPPPP

SEQ ID NO: 22967 - protein, 18 aa, Mycobacterium avium
VAPLTFLGAAYVTVFVSC

SEQ ID NO: 22968 - protein, 26 aa, Mycobacterium avium
VAPTTLAVLMLLPLSAFEAMTPLPAA

SEQ ID NO: 22969 - protein, 34 aa, Mycobacterium avium
VAQSPWRHLPIAVSLLSLVLLTIALATPTHDMRI

SEQ ID NO: 22970 - protein, 40 aa, Mycobacterium avium
VARREIRLLLANRLYFAFLALLPFVLAGLTLLIPGDSGLA

SEQ ID NO: 22971 - protein, 28 aa, Mycobacterium avium
VASVLPVWLLLAPRDYLSTFMKVGAIAL

SEQ ID NO: 22972 - protein, 18 aa, Mycobacterium avium
VAVHRPVRFPALTAAGAG

SEQ ID NO: 22973 - protein, 17 aa, Mycobacterium avium
VAVLVVIAVLVVIAALV

SEQ ID NO: 22974 - protein, 33 aa, Mycobacterium avium
VAVPGRYFYVKWWKLVLVLLAVWAASAVVGLGL

SEQ ID NO: 22975 - protein, 19 aa, Mycobacterium avium
VAWVLVSGLLQALYWIRQG

SEQ ID NO: 22976 - protein, 19 aa, Mycobacterium avium
VDPTPRPIPPLAKLAVVFA

SEQ ID NO: 22977 - protein, 22 aa, Mycobacterium avium
VDQVLKFYAPLVAGDKLYCDVY

SEQ ID NO: 22978 - protein, 24 aa, Mycobacterium avium
VDYSLFILMRFREELRSGRQPREA

SEQ ID NO: 22979 - protein, 23 aa, Mycobacterium avium
VEASSLFRVSRLNCSITTSDGTV

SEQ ID NO: 22980 - protein, 25 aa, Mycobacterium avium
VEIMNALLLPIVLGLLLALEARALP

SEQ ID NO: 22981 - protein, 36 aa, Mycobacterium avium
VELGAIAYSLYLWHWPLLIFWLSYSGHKHAGFVEGT

SEQ ID NO: 22982 - protein, 19 aa, Mycobacterium avium
VENVMLVSAFLAAAALAQA

SEQ ID NO: 22983 - protein, 23 aa, Mycobacterium avium
VFAIGLFVLPWAGTPGPFRVGAA

SEQ ID NO: 22984 - protein, 48 aa, Mycobacterium avium
VFFIAALVVLFYSTFFFFFFVAELLDTWLWRWVAFLIVFGVQVVVGAV

SEQ ID NO: 22985 - protein, 17 aa, Mycobacterium avium
VFHGGTLARRDQTAAAT

SEQ ID NO: 22986 - protein, 27 aa, Mycobacterium avium
VFIETGLLFPLLPGESLLFTGGLLAAH

SEQ ID NO: 22987 - protein, 32 aa, Mycobacterium avium
VFLVGWRGVRWWRRGLAVLSIPLCVLCAGLAL

SEQ ID NO: 22988 - protein, 20 aa, Mycobacterium avium
VFVGFRASRKLPTERYPYGY

SEQ ID NO: 22989 - protein, 23 aa, Mycobacterium avium
VGADYNLLLALRIKQEAAAGLRT

SEQ ID NO: 22990 - protein, 22 aa, Mycobacterium avium
VGAVSAGWLLRTHRKVRDAELR

SEQ ID NO: 22991 - protein, 28 aa, Mycobacterium avium
VGFAAIVFLVVRYVVPPVRRLMAARQEA

SEQ ID NO: 22992 - protein, 22 aa, Mycobacterium avium
VGFCWALFFNGFLGAKLGVFYY

SEQ ID NO: 22993 - protein, 24 aa, Mycobacterium avium
VGLPLLLNLFHPIAARGDIGWGFG

SEQ ID NO: 22994 - protein, 18 aa, Mycobacterium avium
VGMLISVFIALTLVPAVL

SEQ ID NO: 22995 - protein, 27 aa, Mycobacterium avium
VGPFKKGPFRIAMAAGIPIVPIVIRNA

SEQ ID NO: 22996 - protein, 18 aa, Mycobacterium avium
VGSLLDVCWPASSVLIAM

SEQ ID NO: 22997 - protein, 19 aa, Mycobacterium avium
VGTLLLLSGILMATTLFPD

SEQ ID NO: 22998 - protein, 35 aa, Mycobacterium avium
VGVGVLVFQFLLGQQLHWSVPPLAFVVLVAVGADY

SEQ ID NO: 22999 - protein, 25 aa, Mycobacterium avium
VGVTQLTLLRYLIGQLRLSAPDRMR

SEQ ID NO: 23000 - protein, 24 aa, Mycobacterium avium
VGVVLLILDALRERQQRDLGGDEA

SEQ ID NO: 23001 - protein, 35 aa, Mycobacterium avium
VHAPKTVWVGLAYPWCDLMLLALAAGMLPILGWRN

SEQ ID NO: 23002 - protein, 25 aa, Mycobacterium avium
VHNTQPWRWRIDPAGLHLYADPARQ

SEQ ID NO: 23003 - protein, 25 aa, Mycobacterium avium
VHPVAMLGFMVLISAAFVAATQAIN

SEQ ID NO: 23004 - protein, 17 aa, Mycobacterium avium
VIDTLVLATGFDLWEAN

SEQ ID NO: 23005 - protein, 17 aa, Mycobacterium avium
VIEKLFLPEDSEPRRRP

SEQ ID NO: 23006 - protein, 17 aa, Mycobacterium avium
VIGKFIGGMPLLLLARL

SEQ ID NO: 23007 - protein, 26 aa, Mycobacterium avium
VIKVSIFAAAMLLVSAGLVVVFGDFR

SEQ ID NO: 23008 - protein, 20 aa, Mycobacterium avium
VIRIPIVLGVAQLLGRIPLP

SEQ ID NO: 23009 - protein, 18 aa, Mycobacterium avium
VIVALWVSRTDGVVLHWI

SEQ ID NO: 23010 - protein, 28 aa, Mycobacterium avium
VIVAVAAGATYWLVRRSLKSVDAIRARV

SEQ ID NO: 23011 - protein, 25 aa, Mycobacterium avium
VKDLLSGFFILAERQYGFGDLVTLT

SEQ ID NO: 23012 - protein, 23 aa, Mycobacterium avium
VLAALLTVGLSAGLLAPPAGAQP

SEQ ID NO: 23013 - protein, 19 aa, Mycobacterium avium
VLARWYITSLGVAGDPAPT

SEQ ID NO: 23014 - protein, 23 aa, Mycobacterium avium
VLDQHLYFTLNAPAAQTGGTAAT

SEQ ID NO: 23015 - protein, 21 aa, Mycobacterium avium
VLLAALIWLRVYPVSMIGVPG

SEQ ID NO: 23016 - protein, 28 aa, Mycobacterium avium
VLLIVEGVLINFWLLRRDSVSLGTDDDA

SEQ ID NO: 23017 - protein, 20 aa, Mycobacterium avium
VLLLLVIYTGFIAGSGSGPD

SEQ ID NO: 23018 - protein, 18 aa, Mycobacterium avium
VLLMTPGLAFFYGGMVRA

SEQ ID NO: 23019 - protein, 17 aa, Mycobacterium avium
VLLNVIPAPVGHGVAAP

SEQ ID NO: 23020 - protein, 18 aa, Mycobacterium avium
VLLPLVIDIRRAPTAALG

SEQ ID NO: 23021 - protein, 24 aa, Mycobacterium avium
VLQGAWVHLLPSRKEGWGLAVVEA

SEQ ID NO: 23022 - protein, 26 aa, Mycobacterium avium
VLQPPGHPLPVLPLAFDPPQHTRYRK

SEQ ID NO: 23023 - protein, 31 aa, Mycobacterium avium
VLRENVVALTVLWLLNIGEYLQDLTLRRTRR

SEQ ID NO: 23024 - protein, 24 aa, Mycobacterium avium
VLSVAAVVLAALIWSDHRDQVAER

SEQ ID NO: 23025 - protein, 25 aa, Mycobacterium avium
VLTTTAMVFVICVAALLVAQMFVRP

SEQ ID NO: 23026 - protein, 23 aa, Mycobacterium avium
VLVALLLSALLVPVVDWLDRHGL

SEQ ID NO: 23027 - protein, 22 aa, Mycobacterium avium
VLVGLGMRTWADGRTLLLGSPS

SEQ ID NO: 23028 - protein, 18 aa, Mycobacterium avium
VLVLIILASCAGLVRYNY

SEQ ID NO: 23029 - protein, 18 aa, Mycobacterium avium
VMLVNIPANRKRVVAVSF

SEQ ID NO: 23030 - protein, 18 aa, Mycobacterium avium
VMSLQVTALLFALPIYAR

SEQ ID NO: 23031 - protein, 22 aa, Mycobacterium avium
VMVSLLVCLIPTTIGALLSAIG

SEQ ID NO: 23032 - protein, 18 aa, Mycobacterium avium
VNIVIWFATVIYLLIVEP

SEQ ID NO: 23033 - protein, 17 aa, Mycobacterium avium
VNLLMRFYDVDAGRISI

SEQ ID NO: 23034 - protein, 24 aa, Mycobacterium avium
VNNDPWYTSLWHTIADAPHLPPAN

SEQ ID NO: 23035 - protein, 19 aa, Mycobacterium avium
VNPYLAVAAIVAGGLYGIE

SEQ ID NO: 23036 - protein, 18 aa, Mycobacterium avium
VNSPDLDWQSVWDRGWTL

SEQ ID NO: 23037 - protein, 21 aa, Mycobacterium avium
VPAFLLIRFGGVYPVIFIGVL

SEQ ID NO: 23038 - protein, 22 aa, Mycobacterium avium
VPLEWNVFMIFGVLSLFVAHTG

SEQ ID NO: 23039 - protein, 26 aa, Mycobacterium avium
VPSYALAYVVLLWTIAFTAKALDGGA

SEQ ID NO: 23040 - protein, 23 aa, Mycobacterium avium
VPVKWLLAIPHVLVCWSMEPLLQ

SEQ ID NO: 23041 - protein, 28 aa, Mycobacterium avium
VPVTHRVFLDQLSWLVPSRWGYAAQAAT

SEQ ID NO: 23042 - protein, 17 aa, Mycobacterium avium
VQLPAVWLLSAVTVCVF

SEQ ID NO: 23043 - protein, 21 aa, Mycobacterium avium
VQPALWLLIFGTTFSHLHMID

SEQ ID NO: 23044 - protein, 28 aa, Mycobacterium avium
VQPRQVLNAALPWSLTMVTTQPGAFSNL

SEQ ID NO: 23045 - protein, 21 aa, Mycobacterium avium
VRGTLRILLPISIVGAVLLVA

SEQ ID NO: 23046 - protein, 18 aa, Mycobacterium avium
VRGWGTLAAAFVVSVLLG

SEQ ID NO: 23047 - protein, 17 aa, Mycobacterium avium
VRLGANGATIPYYLCML

SEQ ID NO: 23048 - protein, 19 aa, Mycobacterium avium
VRRHRVVGTWPLVAPMLAA

SEQ ID NO: 23049 - protein, 19 aa, Mycobacterium avium
VRRTIIFNGWNWSVTQIIV

SEQ ID NO: 23050 - protein, 22 aa, Mycobacterium avium
VRVGDTWHPVLNLASARLIAAS

SEQ ID NO: 23051 - protein, 30 aa, Mycobacterium avium
VSDRGYTIFLAVLPFLIGALSLTVKGPHPG

SEQ ID NO: 23052 - protein, 33 aa, Mycobacterium avium
VSGGIFLLLNLAGGARLLLPIALGALLGGSAAA

SEQ ID NO: 23053 - protein, 18 aa, Mycobacterium avium
VSVLVVLPPLLAVCGRRL

SEQ ID NO: 23054 - protein, 23 aa, Mycobacterium avium
VTAAYVLITFWQYRNACVTAPGL

SEQ ID NO: 23055 - protein, 24 aa, Mycobacterium avium
VTASRHAHWLNPEPKHLWGSGDSA

SEQ ID NO: 23056 - protein, 36 aa, Mycobacterium avium
VTDRLPLVLGLMAAITFVLLFLLTGSVLLPAKALAC

SEQ ID NO: 23057 - protein, 17 aa, Mycobacterium avium
VTQIIVPLPLAIQAPRL

SEQ ID NO: 23058 - protein, 31 aa, Mycobacterium avium
VTVITVLVILAMLLWVYRSVTAVFVLVTVIV

SEQ ID NO: 23059 - protein, 26 aa, Mycobacterium avium
VTWSIRVMIAILWFSAGMAIVSSLYS

SEQ ID NO: 23060 - protein, 23 aa, Mycobacterium avium
VVAALYLLVFLTGGPGHIVALGV

SEQ ID NO: 23061 - protein, 25 aa, Mycobacterium avium
VVARVLALPPLVWLGTISYGVYLWH

SEQ ID NO: 23062 - protein, 30 aa, Mycobacterium avium
VVDAGPLYFWLPFLTCLLALAELHLRTIRL

SEQ ID NO: 23063 - protein, 26 aa, Mycobacterium avium
VVGAAIGSYLWWRSRRTYLLTVAGDS

SEQ ID NO: 23064 - protein, 22 aa, Mycobacterium avium
VVGLGLFSWWYHSIDKTPALFA

SEQ ID NO: 23065 - protein, 24 aa, Mycobacterium avium
VVHGWVYFVYVLTAFNLAVKVRWP

SEQ ID NO: 23066 - protein, 17 aa, Mycobacterium avium
VVLARILELPPRVRARN

SEQ ID NO: 23067 - protein, 50 aa, Mycobacterium avium
VVLQSILAVAFGAGLFVAFDQLWRWNSIVALVLSVLVILGLVVGVRVVRK

SEQ ID NO: 23068 - protein, 17 aa, Mycobacterium avium
VVLVVVLAAAVIALSYR

SEQ ID NO: 23069 - protein, 27 aa, Mycobacterium avium
VVNLLTPLISAVLLPAAIAVALVPVSW

SEQ ID NO: 23070 - protein, 17 aa, Mycobacterium avium
VVPTVALAVPWLTELER

SEQ ID NO: 23071 - protein, 31 aa, Mycobacterium avium
VVTLLALVNRLLLPVITGWSLGRALAGIAVT

SEQ ID NO: 23072 - protein, 25 aa, Mycobacterium avium
VVVAFAYLCFTVLAPWQLGKHSRTS

SEQ ID NO: 23073 - protein, 19 aa, Mycobacterium avium
VVVRPPLRRRLTPAAVPQL

SEQ ID NO: 23074 - protein, 27 aa, Mycobacterium avium
VVVVVVLLLVLYRARRRRRAARGVGPG

SEQ ID NO: 23075 - protein, 28 aa, Mycobacterium avium
VVYTGAVMMLFLFVLMLIGVDSAESLKE

SEQ ID NO: 23076 - protein, 17 aa, Mycobacterium avium
VYALYRAARDDGAGELV

SEQ ID NO: 23077 - protein, 19 aa, Mycobacterium avium
VYGSLLIPPSFSSKLRDFA

SEQ ID NO: 23078 - protein, 18 aa, Mycobacterium avium
VYIYAWPMQQLLAICGLS

SEQ ID NO: 23079 - protein, 29 aa, Mycobacterium avium
VYQRIGLEQLAWLTPARWGYAAGASSIDF

SEQ ID NO: 23080 - protein, 42 aa, Mycobacterium avium
WAAAPAQFAGPPPWGRPPPKRRVWPIVAAVVAVLVVIAGGVG

SEQ ID NO: 23081 - protein, 29 aa, Mycobacterium avium
WAGFSVAWLYWYFWVIVVGFEAVAGGKVL

SEQ ID NO: 23082 - protein, 27 aa, Mycobacterium avium
WASPFWQFWDLALLWLAQLHGGNGLRT

SEQ ID NO: 23083 - protein, 19 aa, Mycobacterium avium
WAVVVALYFVARSRGRVAA

SEQ ID NO: 23084 - protein, 26 aa, Mycobacterium avium
WEVVRLVSPLALLALWQLGSAIGVIA

SEQ ID NO: 23085 - protein, 18 aa, Mycobacterium avium
WFFAIVSVLFLAQTLLGA

SEQ ID NO: 23086 - protein, 17 aa, Mycobacterium avium
WFTIGIPSFILSLAPNN

SEQ ID NO: 23087 - protein, 32 aa, Mycobacterium avium
WGLLVAEGRRYLATAWWLSTLPGAVVLSVILA

SEQ ID NO: 23088 - protein, 18 aa, Mycobacterium avium
WGWFSVGDLFLLNFLTIV

SEQ ID NO: 23089 - protein, 25 aa, Mycobacterium avium
WIITRGLRIVMVLIAAVLAARFVNW

SEQ ID NO: 23090 - protein, 19 aa, Mycobacterium avium
WKTRLLTLLAIVGPGIIVM

SEQ ID NO: 23091 - protein, 19 aa, Mycobacterium avium
WLGAAVLLVLLALADKWLD

SEQ ID NO: 23092 - protein, 20 aa, Mycobacterium avium
WLGRPLIWLSFNNEKLNAAF

SEQ ID NO: 23093 - protein, 25 aa, Mycobacterium avium
WLIAGYSLALLVLGWGFDVMARRAS

SEQ ID NO: 23094 - protein, 30 aa, Mycobacterium avium
WLIDTSSWRWIFLINVPIGLLTVALAAVVF

SEQ ID NO: 23095 - protein, 26 aa, Mycobacterium avium
WLLEQPIRRWRPARVPLLPLAAATVA

SEQ ID NO: 23096 - protein, 18 aa, Mycobacterium avium
WLLLVCAVAAAIAVAVGA

SEQ ID NO: 23097 - protein, 26 aa, Mycobacterium avium
WLLVNLPVLVFFPRGWSEFFRLNTRR

SEQ ID NO: 23098 - protein, 19 aa, Mycobacterium avium
WLLVQPLTLGRHHDWVILV

SEQ ID NO: 23099 - protein, 21 aa, Mycobacterium avium
WLMQRENVPLSPDPGPPLTLQ

SEQ ID NO: 23100 - protein, 25 aa, Mycobacterium avium
WLPVLLAGFCAGFLLLRGRSYVDRW

SEQ ID NO: 23101 - protein, 26 aa, Mycobacterium avium
WPALVMFAIIFFWTPPHTWALAMRYK

SEQ ID NO: 23102 - protein, 23 aa, Mycobacterium avium
WRGDHPLLICDAERISYAEADVR

SEQ ID NO: 23103 - protein, 17 aa, Mycobacterium avium
WRRVGLATWIADAAVLA

SEQ ID NO: 23104 - protein, 22 aa, Mycobacterium avium
WSLLVGYGCLPWVATAMLGLRT

SEQ ID NO: 23105 - protein, 27 aa, Mycobacterium avium
WSRNRMAFLAALLFMMALCFATTNGWW

SEQ ID NO: 23106 - protein, 19 aa, Mycobacterium avium
WTAALWAVALLVAGTGIGM

SEQ ID NO: 23107 - protein, 21 aa, Mycobacterium avium
WTLIFEIFCYIAIAVAGVAGL

SEQ ID NO: 23108 - protein, 27 aa, Mycobacterium avium
WTRTSPSWAFFSLPTRAWELAAGGLVA

SEQ ID NO: 23109 - protein, 17 aa, Mycobacterium avium
WTVLLDGPVRISIGCQS

SEQ ID NO: 23110 - protein, 17 aa, Mycobacterium avium
WVAHFNLLVAAALVPAA

SEQ ID NO: 23111 - protein, 20 aa, Mycobacterium avium
WVGYFPTVLAAWNQLTQAPL

SEQ ID NO: 23112 - protein, 25 aa, Mycobacterium avium
YAAAHLPYLAWLQQASADSAGAAAQ

SEQ ID NO: 23113 - protein, 20 aa, Mycobacterium avium
YAGPPPAPAPYPPRRSKRRL

SEQ ID NO: 23114 - protein, 26 aa, Mycobacterium avium
YAGRRETWLIMRLAVIDNAQALRWRT

SEQ ID NO: 23115 - protein, 17 aa, Mycobacterium avium
YALCGLLIVLVMRMLGE

SEQ ID NO: 23116 - protein, 17 aa, Mycobacterium avium
YALTPWIGLAVAAVMLV

SEQ ID NO: 23117 - protein, 18 aa, Mycobacterium avium
YAPILLTAENVINASVRV

SEQ ID NO: 23118 - protein, 20 aa, Mycobacterium avium
YARTAMLFVEPYSATMAVVD

SEQ ID NO: 23119 - protein, 29 aa, Mycobacterium avium
YAVINSALPRWLWTRGSALVSAMWGVATV

SEQ ID NO: 23120 - protein, 18 aa, Mycobacterium avium
YDMVRKFGLGQRTNVGLP

SEQ ID NO: 23121 - protein, 21 aa, Mycobacterium avium
YEHYFRTFLRPEDVGWSVFEV

SEQ ID NO: 23122 - protein, 47 aa, Mycobacterium avium
YFGGGYHNGIFFQPGFYPYPFWGPGWGWALGDVLLMDALLDDHWGGG

SEQ ID NO: 23123 - protein, 36 aa, Mycobacterium avium
YFGGLRLNLGRFFRVTGVFLVLIAAGLVLGALRTAH

SEQ ID NO: 23124 - protein, 19 aa, Mycobacterium avium
YGAPARLDNARFLLPVVGV

SEQ ID NO: 23125 - protein, 24 aa, Mycobacterium avium
YGYDHTPRFVPRLWRRDIRAGHFS

SEQ ID NO: 23126 - protein, 18 aa, Mycobacterium avium
YLLAKVCVYTVFAIVQSA

SEQ ID NO: 23127 - protein, 17 aa, Mycobacterium avium
YLLFRPWVKSAATGGPP

SEQ ID NO: 23128 - protein, 19 aa, Mycobacterium avium
YLRFGWAAAKLDDIANYPA

SEQ ID NO: 23129 - protein, 19 aa, Mycobacterium avium
YMRYPVFLGFDIVGGIAWG

SEQ ID NO: 23130 - protein, 25 aa, Mycobacterium avium
YRIAFWVGVGLAVLVTLLSLVTYHG

SEQ ID NO: 23131 - protein, 26 aa, Mycobacterium avium
YSHGAFVFLGPGFFPGSPSGGAGGTP

SEQ ID NO: 23132 - protein, 17 aa, Mycobacterium avium
YSPARVTFFCIGGATLA

SEQ ID NO: 23133 - protein, 24 aa, Mycobacterium avium
YTDRHIRLWVVYVDTFSGQTATRW

SEQ ID NO: 23134 - protein, 25 aa, Mycobacterium avium
YTENLRYYYLILPTVDGSLSRRFGF

SEQ ID NO: 23135 - protein, 25 aa, Mycobacterium avium
YVGAHAPYLAWLTKASADSAAVAAQ

SEQ ID NO: 23136 - protein, 21 aa, Mycobacterium avium
YVLSLFGVHLLAKTAGPLKPP

SEQ ID NO: 23137 - protein, 24 aa, Mycobacterium avium
YVSMPLFHSNAVLVGWAVAAACQG

SEQ ID NO: 23138 - protein, 19 aa, Mycobacterium avium
AAAAGWADAALLRVDSRNQ

SEQ ID NO: 23139 - protein, 24 aa, Mycobacterium avium
AAAAVWLTVLFVAAVRRGAPRGWV

SEQ ID NO: 23140 - protein, 24 aa, Mycobacterium avium
AAAAVWLTVLFVAAVRRGAPRPWI

SEQ ID NO: 23141 - protein, 24 aa, Mycobacterium avium
AAAAVWLTVLFVAAVRRGAPRRWV

SEQ ID NO: 23142 - protein, 24 aa, Mycobacterium avium
AAAHLPYLAWLQQASADSAGAAAQ

SEQ ID NO: 23143 - protein, 21 aa, Mycobacterium avium
AAALLPVGTALMIGLTAQNKS

SEQ ID NO: 23144 - protein, 45 aa, Mycobacterium avium
AAALLVPTMRFRPFIRLTVEWVEVLAFIVLLPAAAALGGLFTWIR

SEQ ID NO: 23145 - protein, 17 aa, Mycobacterium avium
AAAMVLYVLISQLGLVV

SEQ ID NO: 23146 - protein, 18 aa, Mycobacterium avium
AAAMVLYVLISQLGLVVG

SEQ ID NO: 23147 - protein, 25 aa, Mycobacterium avium
AAARQPAFLAFPATMLVSTVAAALI

SEQ ID NO: 23148 - protein, 26 aa, Mycobacterium avium
AAARQPAFLAFPATMLVSTVAAALIG

SEQ ID NO: 23149 - protein, 24 aa, Mycobacterium avium
AAAVGALWWLSLQRDRLRADAHRR

SEQ ID NO: 23150 - protein, 23 aa, Mycobacterium avium
AAAVLVLLAGRRLWHRFRGQPDR

SEQ ID NO: 23151 - protein, 17 aa, Mycobacterium avium
AADAAEPVLLWGDARVG

SEQ ID NO: 23152 - protein, 25 aa, Mycobacterium avium
AADEIPPFAPFLTTSAVKDAAVKQN

SEQ ID NO: 23153 - protein, 29 aa, Mycobacterium avium
AAEKWNLPVILIVLLAVFGSLAAAAIPLA

SEQ ID NO: 23154 - protein, 26 aa, Mycobacterium avium
AAEVMLWHCWPITNRLPPAATLQLLF

SEQ ID NO: 23155 - protein, 17 aa, Mycobacterium avium
AAFLNRHLGWFFLFKTG

SEQ ID NO: 23156 - protein, 25 aa, Mycobacterium avium
AAGGLPWYKRTALVLSVAGAGAAVL

SEQ ID NO: 23157 - protein, 23 aa, Mycobacterium avium
AAGIVAYELLTGRTPFTGDSMLA

SEQ ID NO: 23158 - protein, 18 aa, Mycobacterium avium
AAGLAWYLAHDVLDHREP

SEQ ID NO: 23159 - protein, 24 aa, Mycobacterium avium
AAGLPRHSFLSRLYTGTGAFEVVG

SEQ ID NO: 23160 - protein, 27 aa, Mycobacterium avium
AAGWRSRRWRLLWLPSAAVLGVTTAVG

SEQ ID NO: 23161 - protein, 19 aa, Mycobacterium avium
AAHAPYQAWLLESAAKSST

SEQ ID NO: 23162 - protein, 21 aa, Mycobacterium avium
AAIFVIGVVALVVSLAIAIRP

SEQ ID NO: 23163 - protein, 32 aa, Mycobacterium avium
AAILPPSVFSPGPLKWIYLTMGVLMAAAMVNT

SEQ ID NO: 23164 - protein, 24 aa, Mycobacterium avium
AAKATFLRWAWYAARREELHLDGA

SEQ ID NO: 23165 - protein, 24 aa, Mycobacterium avium
AAKSPVMCAYWSKPAKAASSSVNL

SEQ ID NO: 23166 - protein, 17 aa, Mycobacterium avium
AALAWLVEEMEQRYQDM

SEQ ID NO: 23167 - protein, 35 aa, Mycobacterium avium
AALGEIPEWSRRARPIVLIPDAAAALLAVRTSPGL

SEQ ID NO: 23168 - protein, 18 aa, Mycobacterium avium
AALGGWFGYQTYQSHQAQ

SEQ ID NO: 23169 - protein, 24 aa, Mycobacterium avium
AALLFAVIPIRNFLPGSPPAGAWV

SEQ ID NO: 23170 - protein, 29 aa, Mycobacterium avium
AALNPCGFAMLPAYLLLVVRGAGARAPGV

SEQ ID NO: 23171 - protein, 27 aa, Mycobacterium avium
AALSLILLIMVLITRSLVAAIVIVGTV

SEQ ID NO: 23172 - protein, 43 aa, Mycobacterium avium
AAMAYPWHSPRDYWLLGIAAAVLIVLFGWWGGLYFTTLLRRRL

SEQ ID NO: 23173 - protein, 28 aa, Mycobacterium avium
AAMLAEIVGLLRAGVLTPLPLKTFDVRC

SEQ ID NO: 23174 - protein, 25 aa, Mycobacterium avium
AANTALYMYATRAGKFVVWDRILSD

SEQ ID NO: 23175 - protein, 25 aa, Mycobacterium avium
AANVRFDFYVRDIATRFDYRDALLL

SEQ ID NO: 23176 - protein, 28 aa, Mycobacterium avium
AAPPPVPPPPPPVPPPAPPAPAPEPPKG

SEQ ID NO: 23177 - protein, 24 aa, Mycobacterium avium
AAPPSPGRWRVLLLAAVAACAACG

SEQ ID NO: 23178 - protein, 17 aa, Mycobacterium avium
AAQPVPVPVAPPTKRPA

SEQ ID NO: 23179 - protein, 35 aa, Mycobacterium avium
AAQSPEDLKRFGAFGWAVPWIPGTAFGNLVTRDGS

SEQ ID NO: 23180 - protein, 32 aa, Mycobacterium avium
AAQVPLWIGPILLYILLPILDLRFGPDGQNPP

SEQ ID NO: 23181 - protein, 22 aa, Mycobacterium avium
AARGIIALLSYKNIIGLSTFAV

SEQ ID NO: 23182 - protein, 36 aa, Mycobacterium avium
AARLRELCWRNVRRRNLGWRMWYGGPWFSTRIVTAT

SEQ ID NO: 23183 - protein, 21 aa, Mycobacterium avium
AASAFLWPRSLQARATRRALL

SEQ ID NO: 23184 - protein, 30 aa, Mycobacterium avium
AASGLLGWWRWHHNSWLPTVYAGVIGVLML

SEQ ID NO: 23185 - protein, 31 aa, Mycobacterium avium
AASVWLFPTSAALLTWRLLRPSWGEWRTAGA

SEQ ID NO: 23186 - protein, 24 aa, Mycobacterium avium
AASYFLVTPLIVLTGTAIAMALPG

SEQ ID NO: 23187 - protein, 17 aa, Mycobacterium avium
AATAFHLLTGAPPFQHS

SEQ ID NO: 23188 - protein, 23 aa, Mycobacterium avium
AATLGFPVRQPALPAGWQANSGH

SEQ ID NO: 23189 - protein, 17 aa, Mycobacterium avium
AATLQLLFSVGVDGFFA

SEQ ID NO: 23190 - protein, 18 aa, Mycobacterium avium
AATLQLLFSVGVDGFFAI

SEQ ID NO: 23191 - protein, 19 aa, Mycobacterium avium
AATLRRPVLRLGRPAPDEL

SEQ ID NO: 23192 - protein, 25 aa, Mycobacterium avium
AATVFFALLALYLVGVDQGAVSLFG

SEQ ID NO: 23193 - protein, 24 aa, Mycobacterium avium
AATVFFALLALYLVGVEQGAVSLF

SEQ ID NO: 23194 - protein, 19 aa, Mycobacterium avium
AAVTLLPAIMVLAGPRGWI

SEQ ID NO: 23195 - protein, 39 aa, Mycobacterium avium
AAVWLSVLLVFAARRQSRWPWLCFGLALVCSVLLDAYIA

SEQ ID NO: 23196 - protein, 25 aa, Mycobacterium avium
AAYAAALLVVYLVLAALGPHARQVA

SEQ ID NO: 23197 - protein, 22 aa, Mycobacterium avium
ACPVWFYQLWAFITPGLYQKER

SEQ ID NO: 23198 - protein, 17 aa, Mycobacterium avium
ACRALLDALPQRLGDYQ

SEQ ID NO: 23199 - protein, 24 aa, Mycobacterium avium
ACRIPADRWAWALIAAGMACSAVG

SEQ ID NO: 23200 - protein, 25 aa, Mycobacterium avium
ACRIPADRWAWALIAAGMACSAVGD

SEQ ID NO: 23201 - protein, 18 aa, Mycobacterium avium
ACTDGMVNFWMLSIAQVA

SEQ ID NO: 23202 - protein, 17 aa, Mycobacterium avium
ADAALLRVDSRNQVLVA

SEQ ID NO: 23203 - protein, 22 aa, Mycobacterium avium
ADEIPPFAPFLTTSAVKDAAVK

SEQ ID NO: 23204 - protein, 17 aa, Mycobacterium avium
ADELALPGFRVPAPRNS

SEQ ID NO: 23205 - protein, 25 aa, Mycobacterium avium
ADPPACTVGFLPPSQWRSPADTSEA

SEQ ID NO: 23206 - protein, 34 aa, Mycobacterium avium
ADPRLVEVLGWLLYAVPVLVVFLRPARLAATPRA

SEQ ID NO: 23207 - protein, 26 aa, Mycobacterium avium
ADRLRRMLPFVDRISGAVLVLVGLYV

SEQ ID NO: 23208 - protein, 30 aa, Mycobacterium avium
ADRRRFFGYLNLFLASMLLLVIADNYVVLY

SEQ ID NO: 23209 - protein, 23 aa, Mycobacterium avium
ADTKYPEFMQWLARLNSAAVEFV

SEQ ID NO: 23210 - protein, 29 aa, Mycobacterium avium
AEARQLFDRLSPTLPIVLANLVSVGQVGV

SEQ ID NO: 23211 - protein, 31 aa, Mycobacterium avium
AEFFAAALQHWQWLVLGYALVAIVGASLVGW

SEQ ID NO: 23212 - protein, 42 aa, Mycobacterium avium
AEGPVEPPPPYPPPLPPPAYPPPYPPPYPPPPGPPPDTTATA

SEQ ID NO: 23213 - protein, 23 aa, Mycobacterium avium
AEHDLVFISIATAGLIALILLIV

SEQ ID NO: 23214 - protein, 24 aa, Mycobacterium avium
AELVDRLEQLLADPVLRDQLGAKA

SEQ ID NO: 23215 - protein, 22 aa, Mycobacterium avium
AEMVLLLFPVGAMTSLVLLSQL

SEQ ID NO: 23216 - protein, 24 aa, Mycobacterium avium
AEQGTHFELLESKGLYARLWEHDR

SEQ ID NO: 23217 - protein, 17 aa, Mycobacterium avium
AEQLRRRYREGRLARDL

SEQ ID NO: 23218 - protein, 17 aa, Mycobacterium avium
AERLGLIVSAAMGYEPE

SEQ ID NO: 23219 - protein, 19 aa, Mycobacterium avium
AERVTFATWAIVTGKSAGG

SEQ ID NO: 23220 - protein, 18 aa, Mycobacterium avium
AFGIFATGLSLSATGQTM

SEQ ID NO: 23221 - protein, 30 aa, Mycobacterium avium
AFGLAWRLDRAALLLWTAGLALYGLLIGSV

SEQ ID NO: 23222 - protein, 18 aa, Mycobacterium avium
AFGLRMALVPLFISDVMG

SEQ ID NO: 23223 - protein, 21 aa, Mycobacterium avium
AFLCVALVVYFALLGRVAIAM

SEQ ID NO: 23224 - protein, 18 aa, Mycobacterium avium
AFLGANFMLVPRFLFGAG

SEQ ID NO: 23225 - protein, 19 aa, Mycobacterium avium
AFLGGWVLGLVGLTAAFVG

SEQ ID NO: 23226 - protein, 24 aa, Mycobacterium avium
AGAGLDAILYRSLLSGVDYAAAER

SEQ ID NO: 23227 - protein, 22 aa, Mycobacterium avium
AGALLCALTLRLLMVVIHRNDD

SEQ ID NO: 23228 - protein, 18 aa, Mycobacterium avium
AGALRWRAARRHRRPRLS

SEQ ID NO: 23229 - protein, 23 aa, Mycobacterium avium
AGAMYCLSFTRLPYFQTLGVPCA

SEQ ID NO: 23230 - protein, 24 aa, Mycobacterium avium
AGAYLAAHAPYLAWLVRASTDSAA

SEQ ID NO: 23231 - protein, 22 aa, Mycobacterium avium
AGCLPAVIWWACHRPNRLWWRY

SEQ ID NO: 23232 - protein, 25 aa, Mycobacterium avium
AGDDFGVHPVLLDAALHVLGVAGEK

SEQ ID NO: 23233 - protein, 24 aa, Mycobacterium avium
AGDRWWVLVLHLVTTAGLTVLAYR

SEQ ID NO: 23234 - protein, 18 aa, Mycobacterium avium
AGEPIFWVVRALELLEDF

SEQ ID NO: 23235 - protein, 20 aa, Mycobacterium avium
AGFVFSWPRRRSGSLIAPIA

SEQ ID NO: 23236 - protein, 22 aa, Mycobacterium avium
AGGARLLLPIALGALLGGSAAA

SEQ ID NO: 23237 - protein, 27 aa, Mycobacterium avium
AGGDIPFYEPGLRKLLNENLSAGRLRF

SEQ ID NO: 23238 - protein, 25 aa, Mycobacterium avium
AGGGRPWLIVGYFAVLAAITVGAAC

SEQ ID NO: 23239 - protein, 33 aa, Mycobacterium avium
AGHRQRTWLSGLALLVALVVGAAYLALGALRVN

SEQ ID NO: 23240 - protein, 25 aa, Mycobacterium avium
AGIALPFLVWVWARQLRDQRGYRPV

SEQ ID NO: 23241 - protein, 30 aa, Mycobacterium avium
AGIGGVFSRRWAKVWLPITAAVYTANGLMG

SEQ ID NO: 23242 - protein, 18 aa, Mycobacterium avium
AGILLASASLGASGYMVW

SEQ ID NO: 23243 - protein, 24 aa, Mycobacterium avium
AGIVFIVAVIFFTGFILGHRGGHH

SEQ ID NO: 23244 - protein, 25 aa, Mycobacterium avium
AGIVFIVAVIFFTGFILGHRGGHHG

SEQ ID NO: 23245 - protein, 27 aa, Mycobacterium avium
AGIVTLLIAALLLIAVSRAALRPLDRL

SEQ ID NO: 23246 - protein, 29 aa, Mycobacterium avium
AGIVTLLIAALLLIAVSRAALRPLDRLTA

SEQ ID NO: 23247 - protein, 23 aa, Mycobacterium avium
AGKAPWVGALLGVVLVLTCTLGD

SEQ ID NO: 23248 - protein, 43 aa, Mycobacterium avium
AGKRFLVIDLPRPRSVQLLLTPLILAPFAAVLALVRPSLKHVM

SEQ ID NO: 23249 - protein, 21 aa, Mycobacterium avium
AGKTTLMLVLAGREPTSGTIE

SEQ ID NO: 23250 - protein, 19 aa, Mycobacterium avium
AGLALALSSAPWLIAVGAA

SEQ ID NO: 23251 - protein, 18 aa, Mycobacterium avium
AGLLALAGLLGWTLSRPA

SEQ ID NO: 23252 - protein, 19 aa, Mycobacterium avium
AGLLALAGLLGWTLSRPAV

SEQ ID NO: 23253 - protein, 26 aa, Mycobacterium avium
AGMLVSMLVFVIFGLPSAGATVPLEA

SEQ ID NO: 23254 - protein, 29 aa, Mycobacterium avium
AGPLGLCFLPAFVCLGIVPVVAGLAGDVL

SEQ ID NO: 23255 - protein, 23 aa, Mycobacterium avium
AGPVPPPSTFAPGLPPGPPAPPG

SEQ ID NO: 23256 - protein, 21 aa, Mycobacterium avium
AGRRRRIFAGLIAAALPGAAV

SEQ ID NO: 23257 - protein, 18 aa, Mycobacterium avium
AGRRRWVWAAAAIGAAAV

SEQ ID NO: 23258 - protein, 23 aa, Mycobacterium avium
AGTKLLVVFAMSLLLTVFPGWVA

SEQ ID NO: 23259 - protein, 20 aa, Mycobacterium avium
AGVNLSLRRNGNLVLLEGRA

SEQ ID NO: 23260 - protein, 19 aa, Mycobacterium avium
AGVQLYRKLTTTTVVAYFS

SEQ ID NO: 23261 - protein, 33 aa, Mycobacterium avium
AGVVFPVIGWWLYDIFYITPFLAIPYLHTVNRE

SEQ ID NO: 23262 - protein, 32 aa, Mycobacterium avium
AGVVFPVIGWWLYDIFYITPFPGNPLPAHRQP

SEQ ID NO: 23263 - protein, 31 aa, Mycobacterium avium
AGWVHRHGLWPWALALLALAAVRFGRARRRG

SEQ ID NO: 23264 - protein, 21 aa, Mycobacterium avium
AGYMGWAWLDPGSFCSWVTEP

SEQ ID NO: 23265 - protein, 34 aa, Mycobacterium avium
AHIPRGVLPSVPRWLWIFLGVVGVTAALAGGAPT

SEQ ID NO: 23266 - protein, 27 aa, Mycobacterium avium
AHKVENVMLVSAFLAAAALAQAVGHRT

SEQ ID NO: 23267 - protein, 18 aa, Mycobacterium avium
AHPGLRLDWPDDGTIGAS

SEQ ID NO: 23268 - protein, 22 aa, Mycobacterium avium
AHRRELVYLPPAWFNSNPPPRL

SEQ ID NO: 23269 - protein, 17 aa, Mycobacterium avium
AHYFGAWVFVIGFLMHV

SEQ ID NO: 23270 - protein, 44 aa, Mycobacterium avium
AIAILLLGWRGARWWRRGLSILAVPLCLLCSLLVLNQWVGYFQT

SEQ ID NO: 23271 - protein, 25 aa, Mycobacterium avium
AIALTTIFGFFWYSHAIFGLESLGE

SEQ ID NO: 23272 - protein, 20 aa, Mycobacterium avium
AIATLLRQASWWPHMNRHPA

SEQ ID NO: 23273 - protein, 30 aa, Mycobacterium avium
AIAWWHDPLINWFQPVLFYNAGLVNFSNWM

SEQ ID NO: 23274 - protein, 22 aa, Mycobacterium avium
AIDQLVLDHLLASDVSTAMLGG

SEQ ID NO: 23275 - protein, 17 aa, Mycobacterium avium
AIFWVGVPVGVLGTVWG

SEQ ID NO: 23276 - protein, 24 aa, Mycobacterium avium
AIGADYNLLLALRIKQEAAAGLRT

SEQ ID NO: 23277 - protein, 17 aa, Mycobacterium avium
AIGVGTVALLRTPAPAP

SEQ ID NO: 23278 - protein, 28 aa, Mycobacterium avium
AIHQEAALTWLLLISVPVMALTNYWVMS

SEQ ID NO: 23279 - protein, 28 aa, Mycobacterium avium
AIHQEAALTWLLLISVPVMAVTNYWVMS

SEQ ID NO: 23280 - protein, 24 aa, Mycobacterium avium
AIHWRARGWLKRVLPAALVAAVAV

SEQ ID NO: 23281 - protein, 20 aa, Mycobacterium avium
AIILFVYWLIALSQIVLRRR

SEQ ID NO: 23282 - protein, 28 aa, Mycobacterium avium
AILALHLIGWLTLVLLVAPAQYSLGGKA

SEQ ID NO: 23283 - protein, 18 aa, Mycobacterium avium
AILMLYTIVIVRGLRTAI

SEQ ID NO: 23284 - protein, 18 aa, Mycobacterium avium
AILRDLVLGLLIAGAVAA

SEQ ID NO: 23285 - protein, 32 aa, Mycobacterium avium
AINPDLLRPVLGWVLFAGLIGWRAASALAYLR

SEQ ID NO: 23286 - protein, 32 aa, Mycobacterium avium
AINPDLLRPVLGWVLFAGLIGWSAACALAYLR

SEQ ID NO: 23287 - protein, 21 aa, Mycobacterium avium
AIPFFLLLLTLEWTAARKLEH

SEQ ID NO: 23288 - protein, 25 aa, Mycobacterium avium
AIPRMKVPVWSLLIIGVASLAVSVA

SEQ ID NO: 23289 - protein, 17 aa, Mycobacterium avium
AISVMFPLFLIARELRM

SEQ ID NO: 23290 - protein, 19 aa, Mycobacterium avium
AIVLFIASIVVLVVALRRP

SEQ ID NO: 23291 - protein, 25 aa, Mycobacterium avium
AIVLLAVFSLVFWGVSILPADPAAI

SEQ ID NO: 23292 - protein, 31 aa, Mycobacterium avium
AIVLLVKKIWWPLAVWLLLVVVNVDAGNPLG

SEQ ID NO: 23293 - protein, 25 aa, Mycobacterium avium
AIYAYLAPWHLPATRWYTWAIAILG

SEQ ID NO: 23294 - protein, 26 aa, Mycobacterium avium
AIYAYLAPWHLPATRWYTWAIAILGV

SEQ ID NO: 23295 - protein, 26 aa, Mycobacterium avium
AIYAYLAPWHLPATRWYTWAIPILGV

SEQ ID NO: 23296 - protein, 25 aa, Mycobacterium avium
AKFAAWMVFVPVWTVAVYSVVAHWV

SEQ ID NO: 23297 - protein, 24 aa, Mycobacterium avium
AKFAAWMVFVPVWTVAVYSVVAQW

SEQ ID NO: 23298 - protein, 25 aa, Mycobacterium avium
AKGRRTVWIPWALGPAATVLRMLPQ

SEQ ID NO: 23299 - protein, 31 aa, Mycobacterium avium
AKLRLFRVPELLAGSFLLALLAVTAANFFTA

SEQ ID NO: 23300 - protein, 28 aa, Mycobacterium avium
AKNNPFSLLFTLGGFVALLLLAQAVASR

SEQ ID NO: 23301 - protein, 24 aa, Mycobacterium avium
AKRGRLWRRVGTAVVRWPAPVLAV

SEQ ID NO: 23302 - protein, 25 aa, Mycobacterium avium
AKSATPVPQLTWIPAKGAQTPPAAQ

SEQ ID NO: 23303 - protein, 25 aa, Mycobacterium avium
AKSMRVVEFPVFAPLALAGLAGKMP

SEQ ID NO: 23304 - protein, 20 aa, Mycobacterium avium
AKYDLLIAGIAALSLILLIM

SEQ ID NO: 23305 - protein, 24 aa, Mycobacterium avium
ALAAEVIFWHTFPIRGHLPSVRAV

SEQ ID NO: 23306 - protein, 25 aa, Mycobacterium avium
ALAAEVIFWHTFPIRGHLPSVRAVL

SEQ ID NO: 23307 - protein, 21 aa, Mycobacterium avium
ALAFAPFRRWIGTGRLAGVGR

SEQ ID NO: 23308 - protein, 52 aa, Mycobacterium avium
ALAGIFVCLFCAFYFMTVTYSLMTFWITTMLALLYGLLGQFSFGVLMLRIEE

SEQ ID NO: 23309 - protein, 26 aa, Mycobacterium avium
ALALALRTFPMLIDEFRVLYAARRLR

SEQ ID NO: 23310 - protein, 17 aa, Mycobacterium avium
ALALLAGLLLRSADVET

SEQ ID NO: 23311 - protein, 18 aa, Mycobacterium avium
ALALLAGLLLRSADVETT

SEQ ID NO: 23312 - protein, 23 aa, Mycobacterium avium
ALALRTFPMLIDEFRVLYAARRL

SEQ ID NO: 23313 - protein, 27 aa, Mycobacterium avium
ALAPVAIALAMLFAPFAGADDYTDQLV

SEQ ID NO: 23314 - protein, 23 aa, Mycobacterium avium
ALASLVEIWMLFGSPAVICSILS

SEQ ID NO: 23315 - protein, 25 aa, Mycobacterium avium
ALASLVEIWMLFGSPAVICSILSPK

SEQ ID NO: 23316 - protein, 19 aa, Mycobacterium avium
ALAVRRLVAVLAAAFSPAP

SEQ ID NO: 23317 - protein, 26 aa, Mycobacterium avium
ALDEGLLPVLPQLSAKHHLLVAAVAD

SEQ ID NO: 23318 - protein, 27 aa, Mycobacterium avium
ALDRGYTYGLLWLAGVVALLGGVALLI

SEQ ID NO: 23319 - protein, 27 aa, Mycobacterium avium
ALDYTTPLFAFLFLAALGVDYTIFLVA

SEQ ID NO: 23320 - protein, 26 aa, Mycobacterium avium
ALFGTKKLLWFGLAMVIVFGVVHALF

SEQ ID NO: 23321 - protein, 19 aa, Mycobacterium avium
ALFWVSFIVAITVAGMVIP

SEQ ID NO: 23322 - protein, 23 aa, Mycobacterium avium
ALGLRFSYGWIAALAFVLVPVAI

SEQ ID NO: 23323 - protein, 26 aa, Mycobacterium avium
ALGVAALVLLWRLVRRDSPQPAISGF

SEQ ID NO: 23324 - protein, 17 aa, Mycobacterium avium
ALIAALGGAPWLACGYL

SEQ ID NO: 23325 - protein, 26 aa, Mycobacterium avium
ALLGALWAWIVPPVRAVVALTRSGER

SEQ ID NO: 23326 - protein, 17 aa, Mycobacterium avium
ALLGYRIMAWTTGLWLI

SEQ ID NO: 23327 - protein, 17 aa, Mycobacterium avium
ALLLGLMSGSLWGLFAV

SEQ ID NO: 23328 - protein, 18 aa, Mycobacterium avium
ALMIDWLISYGLAALAMR

SEQ ID NO: 23329 - protein, 19 aa, Mycobacterium avium
ALMIDWLISYGLAALAMRL

SEQ ID NO: 23330 - protein, 24 aa, Mycobacterium avium
ALPIVPLFAYSRTAAMLGLGSFLM

SEQ ID NO: 23331 - protein, 27 aa, Mycobacterium avium
ALRITRLTMMRLWLLRPGMRLWDLPLF

SEQ ID NO: 23332 - protein, 22 aa, Mycobacterium avium
ALSPYPLWCGFATVLSTHIWRL

SEQ ID NO: 23333 - protein, 43 aa, Mycobacterium avium
ALSRDFFGFVPADFRSRPSARRLPFILARYPRTFAGIGRRIAR

SEQ ID NO: 23334 - protein, 27 aa, Mycobacterium avium
ALSTMVGLLIITLRMIDPISQLGDLAG

SEQ ID NO: 23335 - protein, 19 aa, Mycobacterium avium
ALTPRPVGPLWAPTARLGS

SEQ ID NO: 23336 - protein, 21 aa, Mycobacterium avium
ALTRAPLGLHPPRLWAGLRCG

SEQ ID NO: 23337 - protein, 22 aa, Mycobacterium avium
ALTWVRFGIWLVVGTAIYAGYG

SEQ ID NO: 23338 - protein, 24 aa, Mycobacterium avium
ALVALTRAPLGLHPPRLWAGLRCG

SEQ ID NO: 23339 - protein, 25 aa, Mycobacterium avium
ALVLALLVVGPLLRPGYLLLRDAVS

SEQ ID NO: 23340 - protein, 20 aa, Mycobacterium avium
ALVLSRLRLVSVGVPVAIGL

SEQ ID NO: 23341 - protein, 43 aa, Mycobacterium avium
ALVVLFYSTFFFFFFVAELLDTWLWRWVAFLIVFGVQVVVGAV

SEQ ID NO: 23342 - protein, 17 aa, Mycobacterium avium
ALVVSLAIAIRPTANVR

SEQ ID NO: 23343 - protein, 25 aa, Mycobacterium avium
AMDYEVFLVSRIHEYWLASQSIRET

SEQ ID NO: 23344 - protein, 19 aa, Mycobacterium avium
AMFEPLLAGLRDLGCMSLT

SEQ ID NO: 23345 - protein, 22 aa, Mycobacterium avium
AMGAVLLVTGLAGCFVFSLIRP

SEQ ID NO: 23346 - protein, 29 aa, Mycobacterium avium
AMGYEPEDLPWEVPLIELGLDSLMAVRIK

SEQ ID NO: 23347 - protein, 23 aa, Mycobacterium avium
AMITVLLPPVLVLTWSGLRAREC

SEQ ID NO: 23348 - protein, 30 aa, Mycobacterium avium
AMLVAAAWLALFALPLLFVAHRFTESAEGY

SEQ ID NO: 23349 - protein, 24 aa, Mycobacterium avium
AMNLAGGRPRLIWYAPHFVEGESS

SEQ ID NO: 23350 - protein, 27 aa, Mycobacterium avium
AMPVRWRGVWAGWWLGTAVVATVGADF

SEQ ID NO: 23351 - protein, 26 aa, Mycobacterium avium
AMRILRLTMMRLWLLRPGMRLWELPL

SEQ ID NO: 23352 - protein, 25 aa, Mycobacterium avium
AMTALPVVGLALGALAAAVAWGGTV

SEQ ID NO: 23353 - protein, 18 aa, Mycobacterium avium
ANARFNDYFREIATRFEY

SEQ ID NO: 23354 - protein, 22 aa, Mycobacterium avium
ANFDDFFRPVRSYFYWEKHCFD

SEQ ID NO: 23355 - protein, 27 aa, Mycobacterium avium
ANIGYLLWMLMGYLVVTAVLVVFVGRL

SEQ ID NO: 23356 - protein, 24 aa, Mycobacterium avium
ANWTQLFQFWNVTFANLAGTPAKL

SEQ ID NO: 23357 - protein, 28 aa, Mycobacterium avium
APAKKLRSPALLATVFGLVTVVGLAALG

SEQ ID NO: 23358 - protein, 28 aa, Mycobacterium avium
APAKQWGFFILLFLLLAPGLNRWFFGIV

SEQ ID NO: 23359 - protein, 24 aa, Mycobacterium avium
APDAPFAVFITLMGTMSMTALTDW

SEQ ID NO: 23360 - protein, 17 aa, Mycobacterium avium
APDVYWPLRRIGVEFHA

SEQ ID NO: 23361 - protein, 17 aa, Mycobacterium avium
APFRRWIGIGRLAGVGR

SEQ ID NO: 23362 - protein, 18 aa, Mycobacterium avium
APGIIAQSALFISIFYGI

SEQ ID NO: 23363 - protein, 26 aa, Mycobacterium avium
APGLMTWPMILLAIGSLFSGGLFAVG

SEQ ID NO: 23364 - protein, 44 aa, Mycobacterium avium
APGSSGRVILLATLAALLVAVMGLLLVMRYRGRRRRAAALAAAR

SEQ ID NO: 23365 - protein, 18 aa, Mycobacterium avium
APILLVIARIFQGLSTGG

SEQ ID NO: 23366 - protein, 26 aa, Mycobacterium avium
APLHQSMFIANAVWIIVVAVAAVALL

SEQ ID NO: 23367 - protein, 21 aa, Mycobacterium avium
APNPYIYPENLPRVNARGGPG

SEQ ID NO: 23368 - protein, 27 aa, Mycobacterium avium
APPAPVPPPAAPPPPPPPAPEAPPGGP

SEQ ID NO: 23369 - protein, 31 aa, Mycobacterium avium
APPPGEPKSPRWLWIAAGAAVLLVVALVIAL

SEQ ID NO: 23370 - protein, 32 aa, Mycobacterium avium
APPPGEPKSPRWLWIAAGAAVLLVVALVIALV

SEQ ID NO: 23371 - protein, 33 aa, Mycobacterium avium
APPPRRKRLFTRSRLFPAAAVVIPAAAVLLVGT

SEQ ID NO: 23372 - protein, 23 aa, Mycobacterium avium
APSKPLPVWIVAGFIASAIVVVA

SEQ ID NO: 23373 - protein, 25 aa, Mycobacterium avium
APSVVGLLFLLYLVGTGTSVVAGRL

SEQ ID NO: 23374 - protein, 18 aa, Mycobacterium avium
APVAWGVLIGFVALYLIG

SEQ ID NO: 23375 - protein, 32 aa, Mycobacterium avium
APVVISGWALMTWILMAFGSTLSRLASLLLAV

SEQ ID NO: 23376 - protein, 17 aa, Mycobacterium avium
APWEQAAHLLDYGFATP

SEQ ID NO: 23377 - protein, 23 aa, Mycobacterium avium
AQGRLFTPFFITVGLVEAAYFIN

SEQ ID NO: 23378 - protein, 44 aa, Mycobacterium avium
AQHLGFRAAFLLLAGLSLGALIIWVAFAPMLRRAARLPAAPSDR

SEQ ID NO: 23379 - protein, 18 aa, Mycobacterium avium
AQLLLVIAAVGLWVAARL

SEQ ID NO: 23380 - protein, 42 aa, Mycobacterium avium
AQLSFTRFTLLMAAPWLAAVATLYAVFRGFFAKDLRVQPDPA

SEQ ID NO: 23381 - protein, 25 aa, Mycobacterium avium
AQNQAYGYLFPHGTFFLIGHALGVP

SEQ ID NO: 23382 - protein, 24 aa, Mycobacterium avium
AQVFRLLSCLYATGFQIAINPDLL

SEQ ID NO: 23383 - protein, 21 aa, Mycobacterium avium
AQWPILLVGLIFAVALALVGA

SEQ ID NO: 23384 - protein, 20 aa, Mycobacterium avium
AQYGIAFAVGLPTALAYNVI

SEQ ID NO: 23385 - protein, 20 aa, Mycobacterium avium
AQYVPKLLELNEDNPFVLVG

SEQ ID NO: 23386 - protein, 32 aa, Mycobacterium avium
ARAARLRLALNVPYLLLVLAFVGFDAVQTVRF

SEQ ID NO: 23387 - protein, 33 aa, Mycobacterium avium
ARAARLRLALNVPYLLLVLAFVGFDAVQTVRFG

SEQ ID NO: 23388 - protein, 27 aa, Mycobacterium avium
ARAARPPTRARSRPLRRPRPVRWGPRS

SEQ ID NO: 23389 - protein, 34 aa, Mycobacterium avium
ARALAKGRRTVWIPWALGPAAAVLRMLPQFIWRR

SEQ ID NO: 23390 - protein, 26 aa, Mycobacterium avium
ARATRRALLLTALGGLLIAGLVTAIP

SEQ ID NO: 23391 - protein, 25 aa, Mycobacterium avium
ARATRRALLLTALGGLLIAGLVTAL

SEQ ID NO: 23392 - protein, 28 aa, Mycobacterium avium
ARGRLVTMLLIGVVLMAAGYSGGLGSPA

SEQ ID NO: 23393 - protein, 29 aa, Mycobacterium avium
ARIMTPLRVMFLIALVFLALGWSTKAACL

SEQ ID NO: 23394 - protein, 21 aa, Mycobacterium avium
ARLIRRHHLPRLAWTRPCGAA

SEQ ID NO: 23395 - protein, 18 aa, Mycobacterium avium
ARPEHWQRLALCWRLAGD

SEQ ID NO: 23396 - protein, 25 aa, Mycobacterium avium
ARPEHWQRLALCWRLAGDHGLGIAT

SEQ ID NO: 23397 - protein, 23 aa, Mycobacterium avium
ARPFVLLERFELNAWTAAVRRHR

SEQ ID NO: 23398 - protein, 24 aa, Mycobacterium avium
ARPPHVGVLLENTPFFSAVLVAAG

SEQ ID NO: 23399 - protein, 17 aa, Mycobacterium avium
ARPRLHPVDIPAGQHQH

SEQ ID NO: 23400 - protein, 33 aa, Mycobacterium avium
ARQPNEMLAGLPLIPFTPRWLVRRAEGIAMSSG

SEQ ID NO: 23401 - protein, 35 aa, Mycobacterium avium
ARQVGLLRNYLLPLGALLLFLVQASGIPAGHIPVR

SEQ ID NO: 23402 - protein, 27 aa, Mycobacterium avium
ARRDGKRVARVRAGAVCWLAIAVCCVA

SEQ ID NO: 23403 - protein, 37 aa, Mycobacterium avium
ARRQMRLIVFDRGYFVFLALLPFIMGSLSMSVPGDVG

SEQ ID NO: 23404 - protein, 25 aa, Mycobacterium avium
ARSGPALFAALALWGMFQGALDVAM

SEQ ID NO: 23405 - protein, 24 aa, Mycobacterium avium
ARSGPALFAALALWGMFQGTLDVA

SEQ ID NO: 23406 - protein, 29 aa, Mycobacterium avium
ARWPGPILVAALGLTLLVALPLAGMRIGF

SEQ ID NO: 23407 - protein, 28 aa, Mycobacterium avium
ARYGPRAPQLWLPPLDEPIPLSAMLARA

SEQ ID NO: 23408 - protein, 19 aa, Mycobacterium avium
ARYTKMTAMPQLVAFFNGV

SEQ ID NO: 23409 - protein, 28 aa, Mycobacterium avium
ASAAPSGLALDRFADRPLAPIDPSAMVG

SEQ ID NO: 23410 - protein, 35 aa, Mycobacterium avium
ASALRDHPDPDTLWTLIGGPRMWRRRPTDPDFCVV

SEQ ID NO: 23411 - protein, 35 aa, Mycobacterium avium
ASALRDHPDPDTLWTLIGGPRMWRRRPTGPDFCVV

SEQ ID NO: 23412 - protein, 22 aa, Mycobacterium avium
ASALYLFSYYLGGSVAGAFGGV

SEQ ID NO: 23413 - protein, 26 aa, Mycobacterium avium
ASFGNKWMWSPIVVTPPVVVAGIGGV

SEQ ID NO: 23414 - protein, 30 aa, Mycobacterium avium
ASGMRLTVLLALLANLFLPWGIAGGHPSAV

SEQ ID NO: 23415 - protein, 32 aa, Mycobacterium avium
ASGPAIYNYTWLVLMLPFGMIGVTVLTVVMPR

SEQ ID NO: 23416 - protein, 26 aa, Mycobacterium avium
ASHLLFVPQLLLFMLSTGLAPEQTFP

SEQ ID NO: 23417 - protein, 21 aa, Mycobacterium avium
ASIYPPCPFKWLTGWNCPFCG

SEQ ID NO: 23418 - protein, 18 aa, Mycobacterium avium
ASLMPEPVARRYREGEQT

SEQ ID NO: 23419 - protein, 27 aa, Mycobacterium avium
ASPAKRAWLPIAIAVIAVVVVVVLLLV

SEQ ID NO: 23420 - protein, 22 aa, Mycobacterium avium
ASPIRRLRADAPPFFVLHGRDD

SEQ ID NO: 23421 - protein, 20 aa, Mycobacterium avium
ASPRWRTTVALLTAVVLVTT

SEQ ID NO: 23422 - protein, 22 aa, Mycobacterium avium
ASSRRPLLAAAGLLSPRLPRLA

SEQ ID NO: 23423 - protein, 23 aa, Mycobacterium avium
ASSRRPLLAAAGLLSPRLPRLAA

SEQ ID NO: 23424 - protein, 18 aa, Mycobacterium avium
ASSVLIAMASWAPPPATA

SEQ ID NO: 23425 - protein, 29 aa, Mycobacterium avium
ASTAALITLLVTALWVLAVVARPYQWWRV

SEQ ID NO: 23426 - protein, 30 aa, Mycobacterium avium
ASVSAALVICLGALLWSFISPAGQVGDSPI

SEQ ID NO: 23427 - protein, 29 aa, Mycobacterium avium
ASVWLFPTSAALLTWRLLRPSWGEWRTAG

SEQ ID NO: 23428 - protein, 24 aa, Mycobacterium avium
ASYNVPMGPPIAAPGLMCMVGGMG

SEQ ID NO: 23429 - protein, 20 aa, Mycobacterium avium
ATAFGFVVVVLLLSGLNATV

SEQ ID NO: 23430 - protein, 17 aa, Mycobacterium avium
ATAPIPRVAPLSVSPLT

SEQ ID NO: 23431 - protein, 24 aa, Mycobacterium avium
ATARNGLLLIAVWALGSMAMRITD

SEQ ID NO: 23432 - protein, 24 aa, Mycobacterium avium
ATARSGLLLIAVWALGSMAMRITD

SEQ ID NO: 23433 - protein, 24 aa, Mycobacterium avium
ATARTLGILLATTAPVIVAVAAGA

SEQ ID NO: 23434 - protein, 21 aa, Mycobacterium avium
ATDVLPPRPRTHTTLLTLAAV

SEQ ID NO: 23435 - protein, 18 aa, Mycobacterium avium
ATEPLGVPPVPLAGTPST

SEQ ID NO: 23436 - protein, 37 aa, Mycobacterium avium
ATGPAAFLGFGWRIPFLLSIFLVAVGLFVRLRLTDAE

SEQ ID NO: 23437 - protein, 20 aa, Mycobacterium avium
ATIPFQRPYPNPTNFSQVWA

SEQ ID NO: 23438 - protein, 24 aa, Mycobacterium avium
ATIRRRLHFLSHVQKVTGVSMRSH

SEQ ID NO: 23439 - protein, 28 aa, Mycobacterium avium
ATKAAARWIRPLVPPLVARMMDTTTHRL

SEQ ID NO: 23440 - protein, 21 aa, Mycobacterium avium
ATLRRFCKRFAPYNFHEHMMQ

SEQ ID NO: 23441 - protein, 34 aa, Mycobacterium avium
ATMRLLAMQVPGQLLFSLASQLALILLAGTATAL

SEQ ID NO: 23442 - protein, 23 aa, Mycobacterium avium
ATRWAPLLQWVMVAVAGAVILVG

SEQ ID NO: 23443 - protein, 23 aa, Mycobacterium avium
ATSVLVIWFLLGVVSVRLFGFTP

SEQ ID NO: 23444 - protein, 25 aa, Mycobacterium avium
ATTDRAYAFLVPPTIRGVNQSRVDA

SEQ ID NO: 23445 - protein, 21 aa, Mycobacterium avium
ATVLLVPLVGALFSGAPHRAL

SEQ ID NO: 23446 - protein, 21 aa, Mycobacterium avium
ATVTLLPPVLALAATRGIGEP

SEQ ID NO: 23447 - protein, 41 aa, Mycobacterium avium
ATVVRLVMVPALMAMFAQWNWWLPPWLSRVLPSVDFDRPLP

SEQ ID NO: 23448 - protein, 17 aa, Mycobacterium avium
ATWAIVTGKSAGGIFNP

SEQ ID NO: 23449 - protein, 26 aa, Mycobacterium avium
ATWSEYLLYALLLAQPLIGWAMLSAA

SEQ ID NO: 23450 - protein, 29 aa, Mycobacterium avium
ATWSEYLLYALLLAQPLIGWAMLSAARFP

SEQ ID NO: 23451 - protein, 17 aa, Mycobacterium avium
AVAAIVAGGLYGIEQGL

SEQ ID NO: 23452 - protein, 23 aa, Mycobacterium avium
AVALTFVWLGMVLAISFLEAPLK

SEQ ID NO: 23453 - protein, 28 aa, Mycobacterium avium
AVALTVSILLTPALIRLFTRQGFGHHTR

SEQ ID NO: 23454 - protein, 20 aa, Mycobacterium avium
AVALVLWWRMVRFEYALIVT

SEQ ID NO: 23455 - protein, 18 aa, Mycobacterium avium
AVAPIAFIALIAVGADYN

SEQ ID NO: 23456 - protein, 37 aa, Mycobacterium avium
AVARTLALALLLYLVSALFIWMQARLLNRTVQRTMVA

SEQ ID NO: 23457 - protein, 27 aa, Mycobacterium avium
AVATAVIWTVALTRPAKVHEAAVCNPP

SEQ ID NO: 23458 - protein, 28 aa, Mycobacterium avium
AVAVFMLFPLGFSLYMSFQRWDVFTPPK

SEQ ID NO: 23459 - protein, 17 aa, Mycobacterium avium
AVDAIRLSRRTLATIKT

SEQ ID NO: 23460 - protein, 18 aa, Mycobacterium avium
AVDLLLDTLVVRAFIVPS

SEQ ID NO: 23461 - protein, 24 aa, Mycobacterium avium
AVDQYSLPDYLYVPVGPEPGDDEL

SEQ ID NO: 23462 - protein, 31 aa, Mycobacterium avium
AVDWRVALVLFVPVLVYLVLTASLTIQSGPR

SEQ ID NO: 23463 - protein, 28 aa, Mycobacterium avium
AVDWRVALVLFVPVLVYLVLTSSLTIQS

SEQ ID NO: 23464 - protein, 29 aa, Mycobacterium avium
AVDWRVALVLFVPVLVYLVLTSSLTIQSG

SEQ ID NO: 23465 - protein, 25 aa, Mycobacterium avium
AVDYSLFILMRFREELRSGRQPREA

SEQ ID NO: 23466 - protein, 26 aa, Mycobacterium avium
AVFAGFLAVVFYLVAVARVIDVGAIR

SEQ ID NO: 23467 - protein, 25 aa, Mycobacterium avium
AVFAGFLAVVFYLVAVARVIDVGEI

SEQ ID NO: 23468 - protein, 33 aa, Mycobacterium avium
AVFLVGWRGVRWWRRGLAVLSIPLCVLCAGLAL

SEQ ID NO: 23469 - protein, 21 aa, Mycobacterium avium
AVGAVMVAALAGLSGWLGYRA

SEQ ID NO: 23470 - protein, 36 aa, Mycobacterium avium
AVGAYAYLLFWVRALQVLLLLYVVPFFLAQATPVTM

SEQ ID NO: 23471 - protein, 25 aa, Mycobacterium avium
AVGDWVLALPWWTLSFLVGLAAFLF

SEQ ID NO: 23472 - protein, 26 aa, Mycobacterium avium
AVGDWVLALPWWTLSFLVGLAAFLFA

SEQ ID NO: 23473 - protein, 27 aa, Mycobacterium avium
AVGDWVLALPWWTLSFLVGLAAFLFAH

SEQ ID NO: 23474 - protein, 24 aa, Mycobacterium avium
AVGGWFFGWLTDRCGSLAAPLLAH

SEQ ID NO: 23475 - protein, 24 aa, Mycobacterium avium
AVGGWFFGWLTDRCGSLAAPMLAH

SEQ ID NO: 23476 - protein, 46 aa, Mycobacterium avium
AVGLLLDTLVVRAFIVPSIVALLGRWFWWPSPLPRRGVARVVKTVE

SEQ ID NO: 23477 - protein, 26 aa, Mycobacterium avium
AVIFNAIIIVLLIPLSLRGVRYTPSS

SEQ ID NO: 23478 - protein, 18 aa, Mycobacterium avium
AVIFSYVWGVRVGGLFTA

SEQ ID NO: 23479 - protein, 27 aa, Mycobacterium avium
AVINSALPRWLWTRGSALVSAMWGVAT

SEQ ID NO: 23480 - protein, 17 aa, Mycobacterium avium
AVIRRPAIYLFDDSFAA

SEQ ID NO: 23481 - protein, 25 aa, Mycobacterium avium
AVIVVALLVWWWFSGEGASRWRRKA

SEQ ID NO: 23482 - protein, 23 aa, Mycobacterium avium
AVLLPFFSFMTYLIAVPTGIKFF

SEQ ID NO: 23483 - protein, 24 aa, Mycobacterium avium
AVLLPFFSFMTYLIAVPTGIKFFN

SEQ ID NO: 23484 - protein, 18 aa, Mycobacterium avium
AVLLSLVALVKDLGRPER

SEQ ID NO: 23485 - protein, 21 aa, Mycobacterium avium
AVLTILTAGLLWATPAGAQPP

SEQ ID NO: 23486 - protein, 25 aa, Mycobacterium avium
AVLWAVYSTRWWLSGLLVGLAAGIK

SEQ ID NO: 23487 - protein, 19 aa, Mycobacterium avium
AVQLPAVWLLSAVTVCVFG

SEQ ID NO: 23488 - protein, 23 aa, Mycobacterium avium
AVTNYWVMSHMLPLFRRMQALID

SEQ ID NO: 23489 - protein, 27 aa, Mycobacterium avium
AVTNYWVMSHMLPLFRRMQALIDGVNR

SEQ ID NO: 23490 - protein, 20 aa, Mycobacterium avium
AVTSLTLLVLLFVGCYTLPA

SEQ ID NO: 23491 - protein, 27 aa, Mycobacterium avium
AVVIAAAALLLVGTALMIGLTAQNKSD

SEQ ID NO: 23492 - protein, 20 aa, Mycobacterium avium
AVVLALLFPQLETVVRQQSV

SEQ ID NO: 23493 - protein, 54 aa, Mycobacterium avium
AVVLLGSALAWLLAGLAAAGRWPLPALVPATLVFGLLLGAIVRGTAAPAAGANH

SEQ ID NO: 23494 - protein, 52 aa, Mycobacterium avium
AVVLLGSALAWLVAGLAAAGRWPLPALVPATLVFGLLVGAIVRGTAAPAAGA

SEQ ID NO: 23495 - protein, 31 aa, Mycobacterium avium
AVVMAIPATLLLLRYRWLRAEPLPAPRPATV

SEQ ID NO: 23496 - protein, 32 aa, Mycobacterium avium
AVVMAIPATLLLLRYRWLRAEPLPAPRPATVR

SEQ ID NO: 23497 - protein, 31 aa, Mycobacterium avium
AVVMAIPATLLLLRYRWLRAEPLPAPRTTNV

SEQ ID NO: 23498 - protein, 28 aa, Mycobacterium avium
AVVRRPVPLLVISLTILVALSAAAATMT

SEQ ID NO: 23499 - protein, 25 aa, Mycobacterium avium
AVVWFGITSAWRERLDRRLDETAGF

SEQ ID NO: 23500 - protein, 17 aa, Mycobacterium avium
AVYLWSLLSMLTTLART

SEQ ID NO: 23501 - protein, 23 aa, Mycobacterium avium
AWAFAVMLVGTWWDNTRPARERQ

SEQ ID NO: 23502 - protein, 24 aa, Mycobacterium avium
AWAFAVMLVGTWWDNTRPARERQR

SEQ ID NO: 23503 - protein, 18 aa, Mycobacterium avium
AWCLGLLALFGVLAVRMQ

SEQ ID NO: 23504 - protein, 18 aa, Mycobacterium avium
AWCRFQGFDRDHCAAKLV

SEQ ID NO: 23505 - protein, 17 aa, Mycobacterium avium
AWDKLRAPAGKLGAPVG

SEQ ID NO: 23506 - protein, 18 aa, Mycobacterium avium
AWDPSTGKYGPIYDPKTK

SEQ ID NO: 23507 - protein, 19 aa, Mycobacterium avium
AWDPSTGKYGPIYDPKTKS

SEQ ID NO: 23508 - protein, 19 aa, Mycobacterium avium
AWLVAPIGAPGRAAGVLAL

SEQ ID NO: 23509 - protein, 22 aa, Mycobacterium avium
AWPWRLVFLVGVSALFAQQAVI

SEQ ID NO: 23510 - protein, 20 aa, Mycobacterium avium
AWRRGLIFAMFVFAAIFTPG

SEQ ID NO: 23511 - protein, 26 aa, Mycobacterium avium
AWSVFRLFWLVYLGMTFGWLFGAMVF

SEQ ID NO: 23512 - protein, 19 aa, Mycobacterium avium
AWTYLMYAGSWVGGPLRME

SEQ ID NO: 23513 - protein, 20 aa, Mycobacterium avium
AWVLLPVELLNNPPVNAGLM

SEQ ID NO: 23514 - protein, 22 aa, Mycobacterium avium
AYGLGLWWGVLRERNARALKPQ

SEQ ID NO: 23515 - protein, 17 aa, Mycobacterium avium
AYGVVFTLFPIRPGLTL

SEQ ID NO: 23516 - protein, 19 aa, Mycobacterium avium
CARALALIAPPDQILPALT

SEQ ID NO: 23517 - protein, 27 aa, Mycobacterium avium
CDGAVVVYPSWWPPARVRTVSAAAATL

SEQ ID NO: 23518 - protein, 22 aa, Mycobacterium avium
CGCLALGWWQWTRFQSVSGSFQ

SEQ ID NO: 23519 - protein, 24 aa, Mycobacterium avium
CGKTTLLMTLAGLLPPLQGQVVLD

SEQ ID NO: 23520 - protein, 24 aa, Mycobacterium avium
CGYPLIERFPLMLGTAGAVLAIGL

SEQ ID NO: 23521 - protein, 20 aa, Mycobacterium avium
CHVVHPVRAACAAGVRAVVL

SEQ ID NO: 23522 - protein, 17 aa, Mycobacterium avium
CIVTLARRPWPIAGAVL

SEQ ID NO: 23523 - protein, 19 aa, Mycobacterium avium
CLVLLNVIPAPVGHGVAAP

SEQ ID NO: 23524 - protein, 23 aa, Mycobacterium avium
CRIPADRWAWALIAAGMACSAVG

SEQ ID NO: 23525 - protein, 18 aa, Mycobacterium avium
CRMHAAVLWLIFALVLAG

SEQ ID NO: 23526 - protein, 23 aa, Mycobacterium avium
CTADLMTMFKRAGLAAAGMVGAA

SEQ ID NO: 23527 - protein, 32 aa, Mycobacterium avium
CTSRLARFKAPKEFLFVAAVQRLGNGKADYRW

SEQ ID NO: 23528 - protein, 24 aa, Mycobacterium avium
CVGALVLIAGLTAPAAWAHAARVA

SEQ ID NO: 23529 - protein, 22 aa, Mycobacterium avium
CVKAELLAASSWRVAVNAGADS

SEQ ID NO: 23530 - protein, 23 aa, Mycobacterium avium
CVKAELLAASSWRVAVNAGADST

SEQ ID NO: 23531 - protein, 22 aa, Mycobacterium avium
CVKAELLAASSWRVAVNAGTDS

SEQ ID NO: 23532 - protein, 19 aa, Mycobacterium avium
CVLGARLYPGPVAALLLGL

SEQ ID NO: 23533 - protein, 27 aa, Mycobacterium avium
CVPAAIMLWLLLRLPESPRWLVKKDNR

SEQ ID NO: 23534 - protein, 18 aa, Mycobacterium avium
CVPVAGAGRRRWVWAAAA

SEQ ID NO: 23535 - protein, 19 aa, Mycobacterium avium
CVVDLFTGRFQWAEFVRQG

SEQ ID NO: 23536 - protein, 23 aa, Mycobacterium avium
CWQKITRDLWPAPELIMDTGNSI

SEQ ID NO: 23537 - protein, 17 aa, Mycobacterium avium
CYDIPICFSLRSIFDAI

SEQ ID NO: 23538 - protein, 26 aa, Mycobacterium avium
CYPYREPLPAPPPGGPPPGPPAQPGQ

SEQ ID NO: 23539 - protein, 36 aa, Mycobacterium avium
DAETALLRYLLYGLLPAWFIPALLDWNQHRRSRIEI

SEQ ID NO: 23540 - protein, 24 aa, Mycobacterium avium
DALKKLSHRFSWTAGSPPQERFLM

SEQ ID NO: 23541 - protein, 24 aa, Mycobacterium avium
DAPPPPPPSPPPSPAPPGPVAPAA

SEQ ID NO: 23542 - protein, 24 aa, Mycobacterium avium
DAQRMPFVVLSIAFGIFATGLSFS

SEQ ID NO: 23543 - protein, 23 aa, Mycobacterium avium
DAQVAPLLWAAAGGVPAVLAYRG

SEQ ID NO: 23544 - protein, 26 aa, Mycobacterium avium
DAQVAPLLWAAAGGVPAVLAYRGINT

SEQ ID NO: 23545 - protein, 21 aa, Mycobacterium avium
DASLWMRLPDLFAGIVCWLLL

SEQ ID NO: 23546 - protein, 29 aa, Mycobacterium avium
DATKAAARWIRPLVPPLVARMMDTTTHRL

SEQ ID NO: 23547 - protein, 26 aa, Mycobacterium avium
DAVHGAYYLLMHGWFALFPPTEFFSR

SEQ ID NO: 23548 - protein, 23 aa, Mycobacterium avium
DDFPLAVPFTMVAAAPIRAMVRR

SEQ ID NO: 23549 - protein, 22 aa, Mycobacterium avium
DDPPICTVGFMPPNTWRSPDDL

SEQ ID NO: 23550 - protein, 23 aa, Mycobacterium avium
DDPRLRDFLAARALRILPGYYVC

SEQ ID NO: 23551 - protein, 32 aa, Mycobacterium avium
DDTRLLVGAALVLNFLIVTAMLRSPVAGLVVV

SEQ ID NO: 23552 - protein, 25 aa, Mycobacterium avium
DESFTLVYDALVSRAGQNVAALPTA

SEQ ID NO: 23553 - protein, 27 aa, Mycobacterium avium
DEVLQSYLNIIYFGRGAYGISAAAKAY

SEQ ID NO: 23554 - protein, 17 aa, Mycobacterium avium
DFLVLRAGRHHVPLATA

SEQ ID NO: 23555 - protein, 17 aa, Mycobacterium avium
DFPGTITITFAYIGLTC

SEQ ID NO: 23556 - protein, 22 aa, Mycobacterium avium
DFPGTITITFAYIGLTCPRWRS

SEQ ID NO: 23557 - protein, 23 aa, Mycobacterium avium
DFPGTITITFAYIGLTCPRWRSL

SEQ ID NO: 23558 - protein, 17 aa, Mycobacterium avium
DFYLPQRALTDPRYTAV

SEQ ID NO: 23559 - protein, 17 aa, Mycobacterium avium
DGKPPHPSWLPRQRRGT

SEQ ID NO: 23560 - protein, 23 aa, Mycobacterium avium
DGLIVATSLFVISWVFVVEAQLR

SEQ ID NO: 23561 - protein, 22 aa, Mycobacterium avium
DGLLAPALIIAAAVLVLYALRW

SEQ ID NO: 23562 - protein, 32 aa, Mycobacterium avium
DGLNRQILAGPWRWSSGPPIWVAAVAPAQSGV

SEQ ID NO: 23563 - protein, 18 aa, Mycobacterium avium
DGRKTVIDTLVLATGFDL

SEQ ID NO: 23564 - protein, 22 aa, Mycobacterium avium
DGRPAPLLRVRNKFFAHADQLS

SEQ ID NO: 23565 - protein, 23 aa, Mycobacterium avium
DGVRLMNYMALLGAAVALVVGAF

SEQ ID NO: 23566 - protein, 23 aa, Mycobacterium avium
DHAAFVGIYALIRRAAEQVRKHG

SEQ ID NO: 23567 - protein, 25 aa, Mycobacterium avium
DHANPAVLWWSLALGTDFGGNLTAI

SEQ ID NO: 23568 - protein, 19 aa, Mycobacterium avium
DHPRFTPDHLRYIKHIGLG

SEQ ID NO: 23569 - protein, 25 aa, Mycobacterium avium
DHRFGWSSVPAWLSLLGDVLVATGL

SEQ ID NO: 23570 - protein, 25 aa, Mycobacterium avium
DHTMPSLDLDLLLGGLKPVIQGLNP

SEQ ID NO: 23571 - protein, 23 aa, Mycobacterium avium
DHYFNTYLQPTDLIWSLLQVMAT

SEQ ID NO: 23572 - protein, 20 aa, Mycobacterium avium
DIAILAVPNLPPPPLPFAQT

SEQ ID NO: 23573 - protein, 25 aa, Mycobacterium avium
DIMALTIFQLLSTNGIYPLLIMAML

SEQ ID NO: 23574 - protein, 17 aa, Mycobacterium avium
DIPICFSLRSIFDAIDG

SEQ ID NO: 23575 - protein, 29 aa, Mycobacterium avium
DISDRRRWAAVYLLLGGLVLGFVGNVVSL

SEQ ID NO: 23576 - protein, 25 aa, Mycobacterium avium
DKFVPIFTRLNRLSDKFFQEVWDPE

SEQ ID NO: 23577 - protein, 18 aa, Mycobacterium avium
DLAAPWFIGTAMGLQVLG

SEQ ID NO: 23578 - protein, 19 aa, Mycobacterium avium
DLAPIPTLFVVADEFTLML

SEQ ID NO: 23579 - protein, 24 aa, Mycobacterium avium
DLAQLRAWFDRPAATTLQITAAPG

SEQ ID NO: 23580 - protein, 23 aa, Mycobacterium avium
DLAQLRAWFDRPAATTLQVTAAP

SEQ ID NO: 23581 - protein, 23 aa, Mycobacterium avium
DLDALAALPLPTLDDLSRALVVD

SEQ ID NO: 23582 - protein, 20 aa, Mycobacterium avium
DLDWQSVWDRGWTLAAAAED

SEQ ID NO: 23583 - protein, 27 aa, Mycobacterium avium
DLEGPDWSWLKWLPHIDIPGELDGVGP

SEQ ID NO: 23584 - protein, 24 aa, Mycobacterium avium
DLERLVRINSGLALLYCVPLAALA

SEQ ID NO: 23585 - protein, 25 aa, Mycobacterium avium
DLERLVRINSGLALLYCVPLAALAA

SEQ ID NO: 23586 - protein, 17 aa, Mycobacterium avium
DLLIAGIAALSLILLIM

SEQ ID NO: 23587 - protein, 20 aa, Mycobacterium avium
DLPGYPLPWALPVAMWALAA

SEQ ID NO: 23588 - protein, 18 aa, Mycobacterium avium
DLPPIPTLFVVADEFTLM

SEQ ID NO: 23589 - protein, 17 aa, Mycobacterium avium
DLSAVWQLSRGAGQRIA

SEQ ID NO: 23590 - protein, 17 aa, Mycobacterium avium
DLSLLLGALFANGLARF

SEQ ID NO: 23591 - protein, 27 aa, Mycobacterium avium
DNKRKQWIIVGAVALVALVAFVVAFVG

SEQ ID NO: 23592 - protein, 26 aa, Mycobacterium avium
DPAGWPRLDWSMDAALLLAALASRAG

SEQ ID NO: 23593 - protein, 19 aa, Mycobacterium avium
DPALPRDRGAFARLLRACG

SEQ ID NO: 23594 - protein, 28 aa, Mycobacterium avium
DPAPTALWLWIALSGLAAAVFLVGWRGV

SEQ ID NO: 23595 - protein, 23 aa, Mycobacterium avium
DPASWPWPTFTVNIVGAFLVGYF

SEQ ID NO: 23596 - protein, 18 aa, Mycobacterium avium
DPEDFWRSAGLPAYRFPD

SEQ ID NO: 23597 - protein, 25 aa, Mycobacterium avium
DPGRRLFCTAAPQLRRVLFAPQTVG

SEQ ID NO: 23598 - protein, 21 aa, Mycobacterium avium
DPITHFALLVIGAVVATALVT

SEQ ID NO: 23599 - protein, 26 aa, Mycobacterium avium
DPPKPRRPWRRLRFSQLIIGMSAAVA

SEQ ID NO: 23600 - protein, 22 aa, Mycobacterium avium
DPQQRMALELTWEALEHARIPA

SEQ ID NO: 23601 - protein, 24 aa, Mycobacterium avium
DPRHEAYYRYAALSSIIGLSHLYF

SEQ ID NO: 23602 - protein, 17 aa, Mycobacterium avium
DPRLRDFLAARALRILP

SEQ ID NO: 23603 - protein, 18 aa, Mycobacterium avium
DPRRGHPVALFGRAVAGL

SEQ ID NO: 23604 - protein, 17 aa, Mycobacterium avium
DPSLWDAPLRFDPDRFD

SEQ ID NO: 23605 - protein, 28 aa, Mycobacterium avium
DPTGISLPMFMEELFWGCAGIGLAIVMP

SEQ ID NO: 23606 - protein, 18 aa, Mycobacterium avium
DPTPRPIPPLAKLAVVFA

SEQ ID NO: 23607 - protein, 18 aa, Mycobacterium avium
DPVLPQTVSMLKTSRVVL

SEQ ID NO: 23608 - protein, 23 aa, Mycobacterium avium
DQALAALYATALGVLLAGLVNDG

SEQ ID NO: 23609 - protein, 24 aa, Mycobacterium avium
DQLKPTLPVFLANLSTIGQIGVTY

SEQ ID NO: 23610 - protein, 24 aa, Mycobacterium avium
DQRALGAALWYAATVKDAVVVAAA

SEQ ID NO: 23611 - protein, 25 aa, Mycobacterium avium
DRISLPLWVLLLSVPLSTVYVGSIE

SEQ ID NO: 23612 - protein, 18 aa, Mycobacterium avium
DRLKGGRLLGPMERLLIL

SEQ ID NO: 23613 - protein, 19 aa, Mycobacterium avium
DRLLASLMPEPVARRYREG

SEQ ID NO: 23614 - protein, 23 aa, Mycobacterium avium
DRLRRMLPFVDRISGAVLVLVGL

SEQ ID NO: 23615 - protein, 25 aa, Mycobacterium avium
DRLTGFIYAFDDLLVRYRKSWSDLA

SEQ ID NO: 23616 - protein, 27 aa, Mycobacterium avium
DRLTGFIYAFDDLLVRYRKSWSDLAAV

SEQ ID NO: 23617 - protein, 21 aa, Mycobacterium avium
DRPVYTLTHDIMFSTPAGDLL

SEQ ID NO: 23618 - protein, 18 aa, Mycobacterium avium
DRTTAPGPAAHRRPRSRP

SEQ ID NO: 23619 - protein, 23 aa, Mycobacterium avium
DRVQALIFVLAVAVSLAAVPVAA

SEQ ID NO: 23620 - protein, 17 aa, Mycobacterium avium
DRYAMWDAAYVLGSLSA

SEQ ID NO: 23621 - protein, 22 aa, Mycobacterium avium
DSANRLAPRPISRPPVDPASRR

SEQ ID NO: 23622 - protein, 18 aa, Mycobacterium avium
DSPPRTEILGRLGPYRVN

SEQ ID NO: 23623 - protein, 24 aa, Mycobacterium avium
DTALRRHFNWVRSWYDFAVPDIGR

SEQ ID NO: 23624 - protein, 20 aa, Mycobacterium avium
DTAPRRVFPQVVAAPFDPAV

SEQ ID NO: 23625 - protein, 17 aa, Mycobacterium avium
DTRWWLGGLGDIGSYVL

SEQ ID NO: 23626 - protein, 20 aa, Mycobacterium avium
DTWRLVLRGLDETASRRYGA

SEQ ID NO: 23627 - protein, 24 aa, Mycobacterium avium
DVALTCVASAMLGLALSAVAKSNE

SEQ ID NO: 23628 - protein, 27 aa, Mycobacterium avium
DVGGFAYAGGWLRPDSPLTPPRFADRF

SEQ ID NO: 23629 - protein, 28 aa, Mycobacterium avium
DVVELRLPRQLPVLAPGQEWRTVWDSAL

SEQ ID NO: 23630 - protein, 21 aa, Mycobacterium avium
DVVFVLIVFAAAYIRRFGARG

SEQ ID NO: 23631 - protein, 22 aa, Mycobacterium avium
DVVFVLIVFAAAYIRRFGARGR

SEQ ID NO: 23632 - protein, 24 aa, Mycobacterium avium
DVVNLLHMIYSLIMVAMAVEIMHQ

SEQ ID NO: 23633 - protein, 23 aa, Mycobacterium avium
DWHQVKVVSAPSWFSDYVLSVGA

SEQ ID NO: 23634 - protein, 24 aa, Mycobacterium avium
DWHQVKVVSAPSWFSDYVLSVGAV

SEQ ID NO: 23635 - protein, 20 aa, Mycobacterium avium
DWHVTRLSMIPAAVQQYAAA

SEQ ID NO: 23636 - protein, 17 aa, Mycobacterium avium
DWPRYGGYALAGVSSFG

SEQ ID NO: 23637 - protein, 32 aa, Mycobacterium avium
DYLGALLGGLVWPFLLLPHLGMIRGAAATGMI

SEQ ID NO: 23638 - protein, 33 aa, Mycobacterium avium
DYNGAFLSFNLNLNWPPPCTTGFLPIQQQRAAS

SEQ ID NO: 23639 - protein, 20 aa, Mycobacterium avium
EAELLDWIHGAADANQPVIL

SEQ ID NO: 23640 - protein, 25 aa, Mycobacterium avium
EAIRDPRLLVTCGVVLLAVFAAFIA

SEQ ID NO: 23641 - protein, 18 aa, Mycobacterium avium
EAVARLRPRVPGLHLDIV

SEQ ID NO: 23642 - protein, 18 aa, Mycobacterium avium
EDRFDRCRAFAAAVSREC

SEQ ID NO: 23643 - protein, 18 aa, Mycobacterium avium
EDRYAMWDAAYVLGSLSA

SEQ ID NO: 23644 - protein, 30 aa, Mycobacterium avium
EFFAAALQHWQWLVLGYALVAIVGASLVGW

SEQ ID NO: 23645 - protein, 35 aa, Mycobacterium avium
EFVCLIAPMFLAMYLRAFYSPRRGAALVAVLAGLS

SEQ ID NO: 23646 - protein, 24 aa, Mycobacterium avium
EGALLAALIRRPSTLDPAVDPKGA

SEQ ID NO: 23647 - protein, 23 aa, Mycobacterium avium
EGIPHLITPIITQPKKAAAALAW

SEQ ID NO: 23648 - protein, 23 aa, Mycobacterium avium
EGPEWSWLKWLPHIDIPGELDGV

SEQ ID NO: 23649 - protein, 24 aa, Mycobacterium avium
EHGPTFHLGVLPLDDGGAAVTLVA

SEQ ID NO: 23650 - protein, 22 aa, Mycobacterium avium
EHWQRLALCWRLAGDHGLGIAT

SEQ ID NO: 23651 - protein, 19 aa, Mycobacterium avium
EIDGRLYVDMRLIEGRDLA

SEQ ID NO: 23652 - protein, 27 aa, Mycobacterium avium
EIEFRTRLWLPYLPLILAAAVGWGHAA

SEQ ID NO: 23653 - protein, 19 aa, Mycobacterium avium
EIIMIVGALHFKESRGRGN

SEQ ID NO: 23654 - protein, 23 aa, Mycobacterium avium
EIMNALLLPIVLGLLLALEARAL

SEQ ID NO: 23655 - protein, 41 aa, Mycobacterium avium
EINGWRDWVLGAMVLAILGTGLFLGLFSRAAITRPIAQLAA

SEQ ID NO: 23656 - protein, 17 aa, Mycobacterium avium
EIRDEMIIFLFAGHDTT

SEQ ID NO: 23657 - protein, 19 aa, Mycobacterium avium
EIVGLLQEGVLTPLPLKTF

SEQ ID NO: 23658 - protein, 25 aa, Mycobacterium avium
EKDQTVLPFAWQGVALHASGAARAR

SEQ ID NO: 23659 - protein, 24 aa, Mycobacterium avium
EKDQTVLPFSWQGVALHASGASRA

SEQ ID NO: 23660 - protein, 23 aa, Mycobacterium avium
ELAATIARRLGLTGALGTVAESV

SEQ ID NO: 23661 - protein, 26 aa, Mycobacterium avium
ELARIRALRMPFYRTVTSMVIWCIGG

SEQ ID NO: 23662 - protein, 17 aa, Mycobacterium avium
ELARRLAPGTTVVLAAR

SEQ ID NO: 23663 - protein, 29 aa, Mycobacterium avium
ELETVHIPLPRILLAHLFGRNPLVRVSDR

SEQ ID NO: 23664 - protein, 22 aa, Mycobacterium avium
ELHLRVLLICASVIGGTVVVGW

SEQ ID NO: 23665 - protein, 27 aa, Mycobacterium avium
ELNEDNPFVLVGWSLGGALAYACAIGL

SEQ ID NO: 23666 - protein, 23 aa, Mycobacterium avium
ELTERLMGVIRPVIKGWHRAEVH

SEQ ID NO: 23667 - protein, 23 aa, Mycobacterium avium
ELVNGLRLGLANAWLFVVAAELI

SEQ ID NO: 23668 - protein, 28 aa, Mycobacterium avium
ENFDDFFRPIRSYFYWEKHCFDIPACWS

SEQ ID NO: 23669 - protein, 23 aa, Mycobacterium avium
EPDVGPQPDLPWRRGRQIAPELA

SEQ ID NO: 23670 - protein, 23 aa, Mycobacterium avium
EPGQILVLLNVGAVFMGTALTIR

SEQ ID NO: 23671 - protein, 17 aa, Mycobacterium avium
EPKRQALLAYILLGAVA

SEQ ID NO: 23672 - protein, 18 aa, Mycobacterium avium
EPKRQALLAYILLGAVAV

SEQ ID NO: 23673 - protein, 24 aa, Mycobacterium avium
EPQTFPRWFGYLNAWYALLALPGG

SEQ ID NO: 23674 - protein, 22 aa, Mycobacterium avium
EPTKPLIPLAVSAFLTSRKKAA

SEQ ID NO: 23675 - protein, 72 aa, Mycobacterium avium
EPVAAPKPLSLPVAAPLPAAPPPAAPPLPEAPPIPAAPPVVPVPVVVPPVPVPVPVRIPVPDPVSPPQLLAP

SEQ ID NO: 23676 - protein, 17 aa, Mycobacterium avium
EQLRRRYREGRLARDLA

SEQ ID NO: 23677 - protein, 26 aa, Mycobacterium avium
ERQHALGPYPLDPNLLSQGLPPDDRA

SEQ ID NO: 23678 - protein, 33 aa, Mycobacterium avium
ERRKRPWRRYLRRSVLPLLLAASLAVSGFLGWR

SEQ ID NO: 23679 - protein, 44 aa, Mycobacterium avium
ESKARSRRLRLPSWSVAWKAAVIALICAFVAASGYMMWERHQTS

SEQ ID NO: 23680 - protein, 30 aa, Mycobacterium avium
ESKMNLPWMFFFTGLAIPAFYAVGLLAGHD

SEQ ID NO: 23681 - protein, 30 aa, Mycobacterium avium
ESKMNMPWLFFFSGLAIPAFYTVGLLAGSD

SEQ ID NO: 23682 - protein, 17 aa, Mycobacterium avium
ESNPPSPPWFSRPTPPG

SEQ ID NO: 23683 - protein, 23 aa, Mycobacterium avium
ESNPPSPPWFSRPTPPGRAGDAP

SEQ ID NO: 23684 - protein, 52 aa, Mycobacterium avium
ESQPKTAARQWKRYGRAALVVAVYAGAFGLAAGLGWKLWDQRAVAQAGQAAQ

SEQ ID NO: 23685 - protein, 24 aa, Mycobacterium avium
ESVLILLYGIIALGAVALAFAPFR

SEQ ID NO: 23686 - protein, 28 aa, Mycobacterium avium
ETAALLAHIAVMLAFLIIVLHSKHMHIF

SEQ ID NO: 23687 - protein, 45 aa, Mycobacterium avium
ETPSRPRWSRRRLFIVIALAVMLVLAGLTVGWWVIQRNYYVAEYN

SEQ ID NO: 23688 - protein, 29 aa, Mycobacterium avium
EVEEQLFRFSRILDVQPRLAILLGDYAVP

SEQ ID NO: 23689 - protein, 24 aa, Mycobacterium avium
EVIVQAWTLLKVTALPAVLMAIPF

SEQ ID NO: 23690 - protein, 17 aa, Mycobacterium avium
EVLERVAPPHPSRWRHV

SEQ ID NO: 23691 - protein, 23 aa, Mycobacterium avium
EVLVGLGMRTWADGRTLLLGSPS

SEQ ID NO: 23692 - protein, 23 aa, Mycobacterium avium
EVVRIFVGNTFPFAGYTGGGNKQ

SEQ ID NO: 23693 - protein, 17 aa, Mycobacterium avium
EVYRASFGAQFFSGLVA

SEQ ID NO: 23694 - protein, 18 aa, Mycobacterium avium
EVYRASFGAQFFSGLVAP

SEQ ID NO: 23695 - protein, 17 aa, Mycobacterium avium
EWNVLMIFGVLSLFVAH

SEQ ID NO: 23696 - protein, 24 aa, Mycobacterium avium
FAAGNALPLLAFALAGRRVAQRVA

SEQ ID NO: 23697 - protein, 32 aa, Mycobacterium avium
FAAWLVFAGLWATFVYFPVAHWVFAFDGFASE

SEQ ID NO: 23698 - protein, 18 aa, Mycobacterium avium
FADTTFYGLNAFLFTNSA

SEQ ID NO: 23699 - protein, 37 aa, Mycobacterium avium
FAEQVRISRFQTLLLKWAMMLLLGLLTSAVYLAIADG

SEQ ID NO: 23700 - protein, 21 aa, Mycobacterium avium
FAFLQIVLGPARFLSYGWRIG

SEQ ID NO: 23701 - protein, 25 aa, Mycobacterium avium
FAHQSAWLRIFAVGLMFAGVTTTAL

SEQ ID NO: 23702 - protein, 31 aa, Mycobacterium avium
FALASVVAMAFMFFQYMQVPTLLGIGKLTVT

SEQ ID NO: 23703 - protein, 23 aa, Mycobacterium avium
FALFIFWLLLIARFVVEFIRSFS

SEQ ID NO: 23704 - protein, 17 aa, Mycobacterium avium
FALIFHDSEMDPQSTVL

SEQ ID NO: 23705 - protein, 25 aa, Mycobacterium avium
FARDLRSALLRKLSRLPLGWFTARG

SEQ ID NO: 23706 - protein, 22 aa, Mycobacterium avium
FATDFYARFGYDRPVYTLTHDI

SEQ ID NO: 23707 - protein, 23 aa, Mycobacterium avium
FATGPPPPALPYLDVADPGPNDP

SEQ ID NO: 23708 - protein, 25 aa, Mycobacterium avium
FATGQWHRYWPYSWSIFPEAFNDIV

SEQ ID NO: 23709 - protein, 25 aa, Mycobacterium avium
FAVGLIVLLGLPPFAMFASELALAH

SEQ ID NO: 23710 - protein, 28 aa, Mycobacterium avium
FAVQVGLNHLWLAFLHYRGWAIPVAFVI

SEQ ID NO: 23711 - protein, 18 aa, Mycobacterium avium
FCNYGLMLMGLPAAAVLA

SEQ ID NO: 23712 - protein, 34 aa, Mycobacterium avium
FDQQAEPTPWYRRPAMLIAWVVSVVVLIGLIVFG

SEQ ID NO: 23713 - protein, 17 aa, Mycobacterium avium
FDRLGSPVPLIPIAIDP

SEQ ID NO: 23714 - protein, 17 aa, Mycobacterium avium
FDVASLCWVLVFAARFV

SEQ ID NO: 23715 - protein, 26 aa, Mycobacterium avium
FDWTRWLTIVAFDVAIVFLLFAARRP

SEQ ID NO: 23716 - protein, 17 aa, Mycobacterium avium
FEFPYVIYQGLTMYLLL

SEQ ID NO: 23717 - protein, 24 aa, Mycobacterium avium
FEHLEYAMPMRTFGWPRDLPRAVG

SEQ ID NO: 23718 - protein, 19 aa, Mycobacterium avium
FETRQLLANYPQGLGRQLT

SEQ ID NO: 23719 - protein, 24 aa, Mycobacterium avium
FEVGRQLRVLVIRALARAGIVTAA

SEQ ID NO: 23720 - protein, 28 aa, Mycobacterium avium
FFAAALQHWQWMVLGYALVAIVGASLVG

SEQ ID NO: 23721 - protein, 17 aa, Mycobacterium avium
FFATAVFLGIATFAVIR

SEQ ID NO: 23722 - protein, 30 aa, Mycobacterium avium
FFFESTFIGLWIFGWGRLPKLIHLACIWIV

SEQ ID NO: 23723 - protein, 21 aa, Mycobacterium avium
FFVISGFLITGLLFREASTTN

SEQ ID NO: 23724 - protein, 21 aa, Mycobacterium avium
FGAPPARWPRALHLVPPIHEA

SEQ ID NO: 23725 - protein, 17 aa, Mycobacterium avium
FGFSFYTAHYFGAWVFV

SEQ ID NO: 23726 - protein, 45 aa, Mycobacterium avium
FGGGYHNGIFFQPGFYPYPFWGPGWGWALGDVLLMDALLDDHWGG

SEQ ID NO: 23727 - protein, 18 aa, Mycobacterium avium
FGGLLWWVVFGLHDEPLA

SEQ ID NO: 23728 - protein, 35 aa, Mycobacterium avium
FGGLRLNLGRFFRVTGVFLVLIAAGLVLGALRTAH

SEQ ID NO: 23729 - protein, 19 aa, Mycobacterium avium
FGIVTVYHFIFVPLTIGLA

SEQ ID NO: 23730 - protein, 19 aa, Mycobacterium avium
FGLALAWLATVWASAGLAG

SEQ ID NO: 23731 - protein, 19 aa, Mycobacterium avium
FGMLPSLNARRTPGRAAVI

SEQ ID NO: 23732 - protein, 17 aa, Mycobacterium avium
FHAAGPVGAWVDTALRT

SEQ ID NO: 23733 - protein, 26 aa, Mycobacterium avium
FIETGLLFPLLPGESLLFTGGLLAAH

SEQ ID NO: 23734 - protein, 30 aa, Mycobacterium avium
FKHREELVYLPPAWFASYPPPQLPTVLMIG

SEQ ID NO: 23735 - protein, 20 aa, Mycobacterium avium
FKRGLKLFLSPDGKAARMII

SEQ ID NO: 23736 - protein, 21 aa, Mycobacterium avium
FLCAYLVTRWIQLPGLIAVTA

SEQ ID NO: 23737 - protein, 20 aa, Mycobacterium avium
FLGTVLLYFAARHAGASAAL

SEQ ID NO: 23738 - protein, 17 aa, Mycobacterium avium
FLIGYGVLVFGLAALPS

SEQ ID NO: 23739 - protein, 21 aa, Mycobacterium avium
FLNRHLGWFFLFKTGNVSLAG

SEQ ID NO: 23740 - protein, 23 aa, Mycobacterium avium
FLPFLLIMGGFMYFASRRQRRAM

SEQ ID NO: 23741 - protein, 17 aa, Mycobacterium avium
FLPPPLMRTPADETVRE

SEQ ID NO: 23742 - protein, 17 aa, Mycobacterium avium
FLSYGWRIGFLLSVLLV

SEQ ID NO: 23743 - protein, 26 aa, Mycobacterium avium
FLTYALCGLLIVLVMRMLGEMAAANP

SEQ ID NO: 23744 - protein, 27 aa, Mycobacterium avium
FMSQPELLAPALLLAAAPFAAVGGFAG

SEQ ID NO: 23745 - protein, 17 aa, Mycobacterium avium
FNYPPAGLNPFNSAATL

SEQ ID NO: 23746 - protein, 19 aa, Mycobacterium avium
FPERLWRSPLRGPWLTSVF

SEQ ID NO: 23747 - protein, 17 aa, Mycobacterium avium
FPGLTLTVSVLAGMVGL

SEQ ID NO: 23748 - protein, 22 aa, Mycobacterium avium
FPRWVAHFNLLVAAALVPAAFV

SEQ ID NO: 23749 - protein, 20 aa, Mycobacterium avium
FRDNLGAGLLGRRIERSPLP

SEQ ID NO: 23750 - protein, 17 aa, Mycobacterium avium
FRQPIHWTPARYLMLAA

SEQ ID NO: 23751 - protein, 30 aa, Mycobacterium avium
FRTVPSLAWVPLLLLWFGIDETPKILMVAV

SEQ ID NO: 23752 - protein, 19 aa, Mycobacterium avium
FSGFDPWLPSLGNPLSFLN

SEQ ID NO: 23753 - protein, 20 aa, Mycobacterium avium
FSGFDPWLPSLGNPLSFLNP

SEQ ID NO: 23754 - protein, 18 aa, Mycobacterium avium
FSMLAFSGRFGRARKITW

SEQ ID NO: 23755 - protein, 19 aa, Mycobacterium avium
FSMLAFSGRFGRARKITWG

SEQ ID NO: 23756 - protein, 34 aa, Mycobacterium avium
FSNPSVLFSWPTLLWVLDFIAGRIFDILVTLKFL

SEQ ID NO: 23757 - protein, 20 aa, Mycobacterium avium
FSRRFVPTSFIVSAITLAVT

SEQ ID NO: 23758 - protein, 22 aa, Mycobacterium avium
FSSDPLFLIAIRNTVIFTLGSV

SEQ ID NO: 23759 - protein, 32 aa, Mycobacterium avium
FSTLALVTRRWALAWIALAGTAIAGAAGMLAI

SEQ ID NO: 23760 - protein, 27 aa, Mycobacterium avium
FSTVLVTRFVVFFIAGLLVGGIVFAGL

SEQ ID NO: 23761 - protein, 25 aa, Mycobacterium avium
FTRINAILGVLLLIVLATGSVINGM

SEQ ID NO: 23762 - protein, 26 aa, Mycobacterium avium
FTRINAILGVLLLIVLATGSVINGMF

SEQ ID NO: 23763 - protein, 20 aa, Mycobacterium avium
FTVGYAALLLAISCAILVLG

SEQ ID NO: 23764 - protein, 38 aa, Mycobacterium avium
FVDDGGELFFWLPGLVCLLALGELLWRGKGLLVTFAVG

SEQ ID NO: 23765 - protein, 25 aa, Mycobacterium avium
FVGLPLLLNLFHPIAARGDIGWGIG

SEQ ID NO: 23766 - protein, 17 aa, Mycobacterium avium
FVGPRLPAGARMVLQAG

SEQ ID NO: 23767 - protein, 24 aa, Mycobacterium avium
FVPAPTLVPVALAPSPPPAPAPAP

SEQ ID NO: 23768 - protein, 26 aa, Mycobacterium avium
FVVGSGIDIPLIKPALEAATTLPLTA

SEQ ID NO: 23769 - protein, 32 aa, Mycobacterium avium
FVWITDFQPYQPQLGQPTAWLVAPIGAPGRAA

SEQ ID NO: 23770 - protein, 33 aa, Mycobacterium avium
FVWITDFQPYQPQLGQPTAWLVAPIGAPGRAAG

SEQ ID NO: 23771 - protein, 17 aa, Mycobacterium avium
FWGTSFSAAYVSGVAAL

SEQ ID NO: 23772 - protein, 20 aa, Mycobacterium avium
FYGDRYSYNRFRPSRLGAGL

SEQ ID NO: 23773 - protein, 21 aa, Mycobacterium avium
FYWAIGIAIGLPIGMIALTEI

SEQ ID NO: 23774 - protein, 25 aa, Mycobacterium avium
GAAAKLYPLLFLGPMLLLGIRTGRL

SEQ ID NO: 23775 - protein, 24 aa, Mycobacterium avium
GAAFVRRLVTLTTALLIGATALSV

SEQ ID NO: 23776 - protein, 18 aa, Mycobacterium avium
GAALTLWLHVVDARFARD

SEQ ID NO: 23777 - protein, 23 aa, Mycobacterium avium
GAFYVLLWVGLVAVSLAIGPVWR

SEQ ID NO: 23778 - protein, 18 aa, Mycobacterium avium
GAFYVTPRLIIDSPEPGS

SEQ ID NO: 23779 - protein, 20 aa, Mycobacterium avium
GAGILLASASLGASGYMVWQ

SEQ ID NO: 23780 - protein, 17 aa, Mycobacterium avium
GAGVLLGAWWRRGVSRA

SEQ ID NO: 23781 - protein, 20 aa, Mycobacterium avium
GAHKLWLLLAAPFGMMVAYF

SEQ ID NO: 23782 - protein, 32 aa, Mycobacterium avium
GAIGLLLVLLYSLLYYRVLGLLTALSLAASGA

SEQ ID NO: 23783 - protein, 20 aa, Mycobacterium avium
GALAFLINGLLATVSARPHA

SEQ ID NO: 23784 - protein, 18 aa, Mycobacterium avium
GALGFAALAVYWLYRFVG

SEQ ID NO: 23785 - protein, 26 aa, Mycobacterium avium
GALIELAVWLAIPYLCIGFAWTVFHA

SEQ ID NO: 23786 - protein, 19 aa, Mycobacterium avium
GALTVAMKHIKEPPPPLPA

SEQ ID NO: 23787 - protein, 18 aa, Mycobacterium avium
GALYAKIDGRLYPALNLT

SEQ ID NO: 23788 - protein, 22 aa, Mycobacterium avium
GAMVFAILILLGRYINYTLDLA

SEQ ID NO: 23789 - protein, 23 aa, Mycobacterium avium
GANLPAVTTTLARLFRVPVATTP

SEQ ID NO: 23790 - protein, 25 aa, Mycobacterium avium
GASGLIFGWLAFLLVFGIFVRRVRD

SEQ ID NO: 23791 - protein, 27 aa, Mycobacterium avium
GASHLLFVPQLLLFMLSTGIAPEQTFP

SEQ ID NO: 23792 - protein, 19 aa, Mycobacterium avium
GAVCWLAIAVCCVAAAGLA

SEQ ID NO: 23793 - protein, 26 aa, Mycobacterium avium
GAVQRWLPYATVVVGVLLVALGGWLL

SEQ ID NO: 23794 - protein, 20 aa, Mycobacterium avium
GAVSAGWLLRTHRKVREAEL

SEQ ID NO: 23795 - protein, 21 aa, Mycobacterium avium
GAWIALFAMSLLFGIMKMINR

SEQ ID NO: 23796 - protein, 21 aa, Mycobacterium avium
GAYWLFHDAKVGRLKDLLINC

SEQ ID NO: 23797 - protein, 35 aa, Mycobacterium avium
GCAFWAVLTIMLAAWGWFALLLEITGAVAVVMAIP

SEQ ID NO: 23798 - protein, 18 aa, Mycobacterium avium
GCFLGFTLVLGGLIRTGS

SEQ ID NO: 23799 - protein, 23 aa, Mycobacterium avium
GDAERLLRDLLAPDSRLLPSPRT

SEQ ID NO: 23800 - protein, 24 aa, Mycobacterium avium
GDGVRLMNYMALLGAAVALVVGAF

SEQ ID NO: 23801 - protein, 21 aa, Mycobacterium avium
GDHPLLICDAERISYAEADVR

SEQ ID NO: 23802 - protein, 26 aa, Mycobacterium avium
GDLRGSLRLLIRALRGHRRPVAPAGQ

SEQ ID NO: 23803 - protein, 17 aa, Mycobacterium avium
GDLVCLPHQGGARFRLT

SEQ ID NO: 23804 - protein, 29 aa, Mycobacterium avium
GDPAPTALWFWIALSGLAAAVFLVGWRGV

SEQ ID NO: 23805 - protein, 29 aa, Mycobacterium avium
GDPAPTALWLWIALSGLAAAVFLVGWRGV

SEQ ID NO: 23806 - protein, 22 aa, Mycobacterium avium
GDQYLVRCAAFWRQVAPAGAVL

SEQ ID NO: 23807 - protein, 23 aa, Mycobacterium avium
GDRAHWDWLKWLPHNRHPTHDDA

SEQ ID NO: 23808 - protein, 24 aa, Mycobacterium avium
GDRAHWDWLKWLPHNRHPTHDDAL

SEQ ID NO: 23809 - protein, 23 aa, Mycobacterium avium
GDRDRWQYLPFGGGPRSCIGDHF

SEQ ID NO: 23810 - protein, 42 aa, Mycobacterium avium
GDRSILKMTLIGALIIFIVLLFVYRSVTTVVLLLLTVGIEVF

SEQ ID NO: 23811 - protein, 26 aa, Mycobacterium avium
GDSVVAWWVRLVMPALAVVAVVKPLV

SEQ ID NO: 23812 - protein, 35 aa, Mycobacterium avium
GEILMWIPLPLLGIPPWMVFFSFSLNLIYQFWIHT

SEQ ID NO: 23813 - protein, 24 aa, Mycobacterium avium
GEILMWLPLPLLGIPPWMVFFSFS

SEQ ID NO: 23814 - protein, 28 aa, Mycobacterium avium
GELVSPARWYWAVIAAFVIFAGTNSWGE

SEQ ID NO: 23815 - protein, 29 aa, Mycobacterium avium
GELVSPARWYWAVIAAFVIFAGTNSWGET

SEQ ID NO: 23816 - protein, 27 aa, Mycobacterium avium
GEPRRRRRPMLMAGRSVAALAAVLALA

SEQ ID NO: 23817 - protein, 51 aa, Mycobacterium avium
GERDRLPIELAIAVLVLVVLLVVYRSAVTMLLPLVTILLSLVIAQAAVAGY

SEQ ID NO: 23818 - protein, 29 aa, Mycobacterium avium
GESKGYFLLGIWMSLLWAVVVAASVLIRR

SEQ ID NO: 23819 - protein, 24 aa, Mycobacterium avium
GEVLPLLVPVILAAVLFNGSLVQL

SEQ ID NO: 23820 - protein, 21 aa, Mycobacterium avium
GFCWALFFNGFLGAKLGVFYY

SEQ ID NO: 23821 - protein, 18 aa, Mycobacterium avium
GFLPPPLMRTPADETVRE

SEQ ID NO: 23822 - protein, 23 aa, Mycobacterium avium
GFPFGLSAVLPVNLPLPTKIVTQ

SEQ ID NO: 23823 - protein, 26 aa, Mycobacterium avium
GFQSLPGMPIGQLFRRIPPVDSRPHP

SEQ ID NO: 23824 - protein, 27 aa, Mycobacterium avium
GFQSLPGMPIGQLFRRIPPVDSRPHPE

SEQ ID NO: 23825 - protein, 18 aa, Mycobacterium avium
GFWIRRARRLLPALVLMV

SEQ ID NO: 23826 - protein, 27 aa, Mycobacterium avium
GFWIRRARRLLPALVLMVLTVAAARQL

SEQ ID NO: 23827 - protein, 29 aa, Mycobacterium avium
GGASSLLRLLVLALIMVPITAAVMLRAQV

SEQ ID NO: 23828 - protein, 20 aa, Mycobacterium avium
GGGALFLALITAGQTLGGRT

SEQ ID NO: 23829 - protein, 25 aa, Mycobacterium avium
GGGASIPLLTPRLSGRFGVPVHSTA

SEQ ID NO: 23830 - protein, 25 aa, Mycobacterium avium
GGGPPYFVTSLLDHPRFTPDHLRYI

SEQ ID NO: 23831 - protein, 28 aa, Mycobacterium avium
GGIYGDFYNFYLCDISIKVNGLQPGGPV

SEQ ID NO: 23832 - protein, 28 aa, Mycobacterium avium
GGLGYAMAFLFIALLLCLAVTLGADAVG

SEQ ID NO: 23833 - protein, 21 aa, Mycobacterium avium
GGLIFTFFTALLGSVILLWIV

SEQ ID NO: 23834 - protein, 30 aa, Mycobacterium avium
GGPPRPRKRRRLKLVRAIAAGILAAVLATA

SEQ ID NO: 23835 - protein, 29 aa, Mycobacterium avium
GGQPPGTSFYVLLPGRSLPPAGHSTPAGE

SEQ ID NO: 23836 - protein, 19 aa, Mycobacterium avium
GGRPWLIVGYFAVLAAITV

SEQ ID NO: 23837 - protein, 24 aa, Mycobacterium avium
GGSKKLMVLTIVGVAVALLVGGTG

SEQ ID NO: 23838 - protein, 25 aa, Mycobacterium avium
GGSPDTFPGLAGLGDLIVTCTSQRS

SEQ ID NO: 23839 - protein, 29 aa, Mycobacterium avium
GGSTVVYEPLLKRLPPDTPMYGFERVEGS

SEQ ID NO: 23840 - protein, 24 aa, Mycobacterium avium
GGVFSRRWAKVWLPITAAVYTANG

SEQ ID NO: 23841 - protein, 26 aa, Mycobacterium avium
GGVFSRRWAKVWLPITAAVYTANGLM

SEQ ID NO: 23842 - protein, 22 aa, Mycobacterium avium
GGVLPFVWIAWTALRNFRSGTT

SEQ ID NO: 23843 - protein, 26 aa, Mycobacterium avium
GGVTLLAVVAWRWRRFRAAAAAALLI

SEQ ID NO: 23844 - protein, 26 aa, Mycobacterium avium
GGVTLLAVVAWRWRRFRAAAAAALLV

SEQ ID NO: 23845 - protein, 17 aa, Mycobacterium avium
GGVVFIIASWSVARFAA

SEQ ID NO: 23846 - protein, 21 aa, Mycobacterium avium
GGWLLLVGATLACAGLLWADR

SEQ ID NO: 23847 - protein, 25 aa, Mycobacterium avium
GHAGYVQLLALISLAALTASVVAVP

SEQ ID NO: 23848 - protein, 23 aa, Mycobacterium avium
GHARACGWAIRDGVVGPSSTPGH

SEQ ID NO: 23849 - protein, 22 aa, Mycobacterium avium
GHFYTPWSWLPRIVTQFTAGAL

SEQ ID NO: 23850 - protein, 20 aa, Mycobacterium avium
GHLLVFFVRALVAVPLALRQ

SEQ ID NO: 23851 - protein, 32 aa, Mycobacterium avium
GHRQRTWLSGLALLVTLVVGGAYLALGALRVN

SEQ ID NO: 23852 - protein, 25 aa, Mycobacterium avium
GHRSPSYLRFGWAAAKLDDIANYPA

SEQ ID NO: 23853 - protein, 25 aa, Mycobacterium avium
GIAAPLLLTVLRLLQGFAVGGEWAG

SEQ ID NO: 23854 - protein, 21 aa, Mycobacterium avium
GIAATAFLLTAGVPLIVELGA

SEQ ID NO: 23855 - protein, 18 aa, Mycobacterium avium
GIATGLWGAVRPAMRRPA

SEQ ID NO: 23856 - protein, 21 aa, Mycobacterium avium
GICLVLFALPAMALTIALLML

SEQ ID NO: 23857 - protein, 22 aa, Mycobacterium avium
GIFRTIVFLPLAISSVVMAVVW

SEQ ID NO: 23858 - protein, 25 aa, Mycobacterium avium
GIGMAVRRRKFGRRGHVVVIAGDGA

SEQ ID NO: 23859 - protein, 17 aa, Mycobacterium avium
GIILFTAAITAAIAVAD

SEQ ID NO: 23860 - protein, 28 aa, Mycobacterium avium
GILVAFVVLVTFLLPALRDGAPAVPVAL

SEQ ID NO: 23861 - protein, 22 aa, Mycobacterium avium
GINTLLAPQYVSAPSSYPPFAA

SEQ ID NO: 23862 - protein, 35 aa, Mycobacterium avium
GIPSVIGLALILFSGRRWVTTLGAFVLAVAPGWFG

SEQ ID NO: 23863 - protein, 23 aa, Mycobacterium avium
GIVFRVQQELGVPVKLVGLGEGP

SEQ ID NO: 23864 - protein, 17 aa, Mycobacterium avium
GIVTVYHFIFVPLTIGL

SEQ ID NO: 23865 - protein, 18 aa, Mycobacterium avium
GIVTVYHFIFVPLTIGLA

SEQ ID NO: 23866 - protein, 27 aa, Mycobacterium avium
GIYGDFYNFYLCDISIKVNGLQPGGPV

SEQ ID NO: 23867 - protein, 29 aa, Mycobacterium avium
GKAWAVAAMVAALLFVGSAGFAGAMVQPY

SEQ ID NO: 23868 - protein, 18 aa, Mycobacterium avium
GKAWYLPVGVAGTLGDPT

SEQ ID NO: 23869 - protein, 18 aa, Mycobacterium avium
GKNWTWLVLAVAVVAQVA

SEQ ID NO: 23870 - protein, 40 aa, Mycobacterium avium
GKPSIAWPRVFGYGILPGLALILALGAGYLRWSAGSADDL

SEQ ID NO: 23871 - protein, 23 aa, Mycobacterium avium
GKSEFFLSLVYGIALTHSPETFN

SEQ ID NO: 23872 - protein, 27 aa, Mycobacterium avium
GKVLNYWFHAPLWVLSLGLMLLMTATN

SEQ ID NO: 23873 - protein, 25 aa, Mycobacterium avium
GKVWTGLLGMFLVVLLVIGAVRLSR

SEQ ID NO: 23874 - protein, 23 aa, Mycobacterium avium
GLAALAMRLGWFSASALATAVLV

SEQ ID NO: 23875 - protein, 23 aa, Mycobacterium avium
GLAALAMRLGWFSASALATSVLV

SEQ ID NO: 23876 - protein, 20 aa, Mycobacterium avium
GLALAYWLVPVLPTQSHRFD

SEQ ID NO: 23877 - protein, 26 aa, Mycobacterium avium
GLAMAFGRFLPIVLVLALAGSLARQG

SEQ ID NO: 23878 - protein, 23 aa, Mycobacterium avium
GLAQAWQRYVPTASIRDVRDDRD

SEQ ID NO: 23879 - protein, 23 aa, Mycobacterium avium
GLATWLWDWSADPGSALAAGCTP

SEQ ID NO: 23880 - protein, 29 aa, Mycobacterium avium
GLFAQLGIWRWAFVVMAVLTALMALLVPV

SEQ ID NO: 23881 - protein, 28 aa, Mycobacterium avium
GLGGRPPVGPPPPPPRRGWSGGPGGPGG

SEQ ID NO: 23882 - protein, 25 aa, Mycobacterium avium
GLGGYFFNYLFSKPVPYARAGLDPK

SEQ ID NO: 23883 - protein, 17 aa, Mycobacterium avium
GLILGRKVSRMVDAKFP

SEQ ID NO: 23884 - protein, 29 aa, Mycobacterium avium
GLLAVRAARPILLRLGVLLVLLCAQAAVG

SEQ ID NO: 23885 - protein, 25 aa, Mycobacterium avium
GLLCASFPAVNWWWAAVPAAALLAW

SEQ ID NO: 23886 - protein, 26 aa, Mycobacterium avium
GLLCASFPAVNWWWAAVPAAAVLAWV

SEQ ID NO: 23887 - protein, 31 aa, Mycobacterium avium
GLLVAEGRRYLATAWWLSTLPGAVVLSVILA

SEQ ID NO: 23888 - protein, 19 aa, Mycobacterium avium
GLLVDTLIVRSFMTPSIAA

SEQ ID NO: 23889 - protein, 17 aa, Mycobacterium avium
GLMALWLAGLRWRRHGI

SEQ ID NO: 23890 - protein, 18 aa, Mycobacterium avium
GLMALWLAGLRWRRHGVR

SEQ ID NO: 23891 - protein, 22 aa, Mycobacterium avium
GLNQLSWAMPARWGYAAASATV

SEQ ID NO: 23892 - protein, 23 aa, Mycobacterium avium
GLNRWFFGIVYWLFDFSGVPHWL

SEQ ID NO: 23893 - protein, 24 aa, Mycobacterium avium
GLNRWFFGIVYWLFDFSGVPHWLA

SEQ ID NO: 23894 - protein, 25 aa, Mycobacterium avium
GLRDDAIAAFLWVANWRFVAQKTDY

SEQ ID NO: 23895 - protein, 23 aa, Mycobacterium avium
GLRERVTFYAPILLTAENVINAS

SEQ ID NO: 23896 - protein, 17 aa, Mycobacterium avium
GLRLDWPDDGTIGASGF

SEQ ID NO: 23897 - protein, 19 aa, Mycobacterium avium
GLRRALYFALLAVFAVVAI

SEQ ID NO: 23898 - protein, 20 aa, Mycobacterium avium
GLSINHFIAVDFAGFAKMVD

SEQ ID NO: 23899 - protein, 22 aa, Mycobacterium avium
GLSLFMAIAIAVTWMVYATLRR

SEQ ID NO: 23900 - protein, 39 aa, Mycobacterium avium
GLTADDRLFCNSPFFWIGGFAFGLLATLVAGSTLICSNA

SEQ ID NO: 23901 - protein, 30 aa, Mycobacterium avium
GLTGSPVPIPWSVLSLFASGPTLSRADALL

SEQ ID NO: 23902 - protein, 19 aa, Mycobacterium avium
GLTLFVLTFVVDALARGAV

SEQ ID NO: 23903 - protein, 25 aa, Mycobacterium avium
GLVLAAVLIVWRRDLRAIVGLLAWQ

SEQ ID NO: 23904 - protein, 25 aa, Mycobacterium avium
GLVYSAAFVFISLLLCLAVTLGADA

SEQ ID NO: 23905 - protein, 26 aa, Mycobacterium avium
GLYGDFFSFYLCDIVLKLNGKGGQPV

SEQ ID NO: 23906 - protein, 17 aa, Mycobacterium avium
GLYVLAPQLRPVATWLN

SEQ ID NO: 23907 - protein, 24 aa, Mycobacterium avium
GMAAPPVRLLPTNLAPHAVGALYR

SEQ ID NO: 23908 - protein, 40 aa, Mycobacterium avium
GMGRHWHFFAVIGWVLVGLSYYVLLFATGQWHRYWPYSWS

SEQ ID NO: 23909 - protein, 20 aa, Mycobacterium avium
GMIYIWMPLAMGKVAFWAMG

SEQ ID NO: 23910 - protein, 31 aa, Mycobacterium avium
GMRLISPQTLFFPFVLLLAATAMYRGNDNKT

SEQ ID NO: 23911 - protein, 35 aa, Mycobacterium avium
GMSKSHHHRSVWWSWLVGVLTVVGLGLGLGSGVGL

SEQ ID NO: 23912 - protein, 21 aa, Mycobacterium avium
GMSLVAGPRPWHGPVAVLLGL

SEQ ID NO: 23913 - protein, 18 aa, Mycobacterium avium
GMSTMFCSFLAGLLATMA

SEQ ID NO: 23914 - protein, 18 aa, Mycobacterium avium
GMSWRARPKLAITPGGLA

SEQ ID NO: 23915 - protein, 30 aa, Mycobacterium avium
GMVPVTRRVFLDQLSWLVPSRWGYAAQAAT

SEQ ID NO: 23916 - protein, 17 aa, Mycobacterium avium
GMWYFRQILGSANLIGG

SEQ ID NO: 23917 - protein, 42 aa, Mycobacterium avium
GNAGALTLRLLTIGGCVLLYLTPLILGLWRGETSHDRRAAAR

SEQ ID NO: 23918 - protein, 24 aa, Mycobacterium avium
GNHLATLPIGWFRTDRTGPIGRLL

SEQ ID NO: 23919 - protein, 20 aa, Mycobacterium avium
GPAVLLLPKDIQQARVGVGE

SEQ ID NO: 23920 - protein, 25 aa, Mycobacterium avium
GPAVSFLPNNPPPPGPPGPPGPPGP

SEQ ID NO: 23921 - protein, 25 aa, Mycobacterium avium
GPDGRPPIHLPLDDPYQAPEGYPIK

SEQ ID NO: 23922 - protein, 25 aa, Mycobacterium avium
GPFLPLAIILYWFANNIWTFGQQHY

SEQ ID NO: 23923 - protein, 19 aa, Mycobacterium avium
GPGALVLTATFAAGNALPL

SEQ ID NO: 23924 - protein, 30 aa, Mycobacterium avium
GPGSAGWLRLGVLTALIATALALLINRRLP

SEQ ID NO: 23925 - protein, 18 aa, Mycobacterium avium
GPKCLVKEIQKLSGLSIN

SEQ ID NO: 23926 - protein, 52 aa, Mycobacterium avium
GPPNPTQWAPAFPPQPPRSRTWPAVALAAVAVLLGGAALVVALTRPTGGSST

SEQ ID NO: 23927 - protein, 17 aa, Mycobacterium avium
GPTDHQLLALGATVLLI

SEQ ID NO: 23928 - protein, 44 aa, Mycobacterium avium
GPVEPPPPYPPPLPPPYPPPAYPPPYPPPYPPPPGPLPDTTATA

SEQ ID NO: 23929 - protein, 17 aa, Mycobacterium avium
GPVLLLGADARTAALGG

SEQ ID NO: 23930 - protein, 34 aa, Mycobacterium avium
GPVSVTGFQNPWFFLALLAVLLVIGLYVVQQFAR

SEQ ID NO: 23931 - protein, 32 aa, Mycobacterium avium
GPWLPARWRRWWWALLLAFVPIHLVVSAIVPA

SEQ ID NO: 23932 - protein, 20 aa, Mycobacterium avium
GPYLVGYLRDQLETPLTLVG

SEQ ID NO: 23933 - protein, 23 aa, Mycobacterium avium
GQALRDFILEQRKIRDIAKVVNL

SEQ ID NO: 23934 - protein, 31 aa, Mycobacterium avium
GQIHFGLGLALLAWFGFYLYKISHGNVEEPD

SEQ ID NO: 23935 - protein, 25 aa, Mycobacterium avium
GQRILQLPLSRRLATLPLSATPSGV

SEQ ID NO: 23936 - protein, 24 aa, Mycobacterium avium
GQSFTSVPMLFAKPSYYGQFTDSG

SEQ ID NO: 23937 - protein, 25 aa, Mycobacterium avium
GQSFTSVPMLFAKPSYYGQFTDSGG

SEQ ID NO: 23938 - protein, 23 aa, Mycobacterium avium
GQTMQIPLYGPILWSLVLSSSGA

SEQ ID NO: 23939 - protein, 22 aa, Mycobacterium avium
GQVPPPSPPGPAPPPIAAVQYD

SEQ ID NO: 23940 - protein, 19 aa, Mycobacterium avium
GQWDRLRWQLPASLAGAGL

SEQ ID NO: 23941 - protein, 33 aa, Mycobacterium avium
GRALGMVAFMSYFFTLYLRARVSELPWMIGAVA

SEQ ID NO: 23942 - protein, 34 aa, Mycobacterium avium
GRALGMVAFMSYFFTLYLRARVSELPWMIGAVAV

SEQ ID NO: 23943 - protein, 17 aa, Mycobacterium avium
GRKTVIDTLVLATGFDL

SEQ ID NO: 23944 - protein, 19 aa, Mycobacterium avium
GRLLGPMERLLILSLGVGG

SEQ ID NO: 23945 - protein, 25 aa, Mycobacterium avium
GRLPLPNRLLATRPLVELGAIAYSL

SEQ ID NO: 23946 - protein, 18 aa, Mycobacterium avium
GRMAVRVDFLCEMGDLIP

SEQ ID NO: 23947 - protein, 18 aa, Mycobacterium avium
GRPPLTTSIPIVSTPSGP

SEQ ID NO: 23948 - protein, 17 aa, Mycobacterium avium
GRPWLIVGYFAVLAAIT

SEQ ID NO: 23949 - protein, 25 aa, Mycobacterium avium
GRQESRVLLAGWPVASLLLTTVVGA

SEQ ID NO: 23950 - protein, 46 aa, Mycobacterium avium
GRRAWVYVEGVFLLLVCALVLALVYLQFRGDFTPKTKLTMVATRAG

SEQ ID NO: 23951 - protein, 46 aa, Mycobacterium avium
GRRAWVYVEGVLLLLVCALVLALVYLQFRGDFTPKTKLTMVATRAG

SEQ ID NO: 23952 - protein, 19 aa, Mycobacterium avium
GRRELAAYAPLSLPNSDLH

SEQ ID NO: 23953 - protein, 18 aa, Mycobacterium avium
GRRLPLMVDVMFYSVVGF

SEQ ID NO: 23954 - protein, 19 aa, Mycobacterium avium
GRRLTLRMVLAEAAGIGCV

SEQ ID NO: 23955 - protein, 25 aa, Mycobacterium avium
GRRRYGWLALTTALLGWAVGEIIWA

SEQ ID NO: 23956 - protein, 19 aa, Mycobacterium avium
GRRVGVTLRLLVIGSLIGT

SEQ ID NO: 23957 - protein, 24 aa, Mycobacterium avium
GRSPLLERTFDWLEAHWPAAADAA

SEQ ID NO: 23958 - protein, 29 aa, Mycobacterium avium
GRSSPLGGLLAVAALLLITRGLHIDGVAD

SEQ ID NO: 23959 - protein, 30 aa, Mycobacterium avium
GRSSPLGGLLAVAALLLITRGLHIDGVADT

SEQ ID NO: 23960 - protein, 22 aa, Mycobacterium avium
GRTVFRVRLPLIGGPGTLGVAG

SEQ ID NO: 23961 - protein, 19 aa, Mycobacterium avium
GRVARWRELARRRRLSRAA

SEQ ID NO: 23962 - protein, 19 aa, Mycobacterium avium
GRVARWRELARRRRLSRAE

SEQ ID NO: 23963 - protein, 23 aa, Mycobacterium avium
GRVDGHAVAIGRPSWLAERGLRP

SEQ ID NO: 23964 - protein, 31 aa, Mycobacterium avium
GRWAGFSVAWLYWYFWVIVVGFEAVAGGKVL

SEQ ID NO: 23965 - protein, 25 aa, Mycobacterium avium
GRWDALGFLQDFFATAVFLGIATFA

SEQ ID NO: 23966 - protein, 26 aa, Mycobacterium avium
GRWDALGFLQDFFATAVFLGIATFAV

SEQ ID NO: 23967 - protein, 29 aa, Mycobacterium avium
GRWDALGFLQDFFATAVFLGIATFTVIRL

SEQ ID NO: 23968 - protein, 18 aa, Mycobacterium avium
GSATNWARTALLLVEPTS

SEQ ID NO: 23969 - protein, 17 aa, Mycobacterium avium
GSDLSAVWQLSRGAGQR

SEQ ID NO: 23970 - protein, 19 aa, Mycobacterium avium
GSFFFSVYFQHVTPGAWAA

SEQ ID NO: 23971 - protein, 60 aa, Mycobacterium avium
GSGPWRDWSWTQQINWLWVRRAAYLCAAVLVLLPIVTFAMAYFIVDIPKPGDLRTNQVST

SEQ ID NO: 23972 - protein, 22 aa, Mycobacterium avium
GSIYAFECPLLLGTTAVLMDRW

SEQ ID NO: 23973 - protein, 21 aa, Mycobacterium avium
GSLLLLACLLATLGIWRWSQG

SEQ ID NO: 23974 - protein, 21 aa, Mycobacterium avium
GSLLLLACLLATLGLWRWSQG

SEQ ID NO: 23975 - protein, 21 aa, Mycobacterium avium
GSLQALLPPEQRARPGARATL

SEQ ID NO: 23976 - protein, 25 aa, Mycobacterium avium
GSLVMVFQWGWLRDLGFAQISSIDS

SEQ ID NO: 23977 - protein, 18 aa, Mycobacterium avium
GSQSRLLGACRRAKEQLS

SEQ ID NO: 23978 - protein, 24 aa, Mycobacterium avium
GSTPSQLVAWLNDAIYRMLQKIST

SEQ ID NO: 23979 - protein, 20 aa, Mycobacterium avium
GTAIVRWPTPILTATIAVAL

SEQ ID NO: 23980 - protein, 29 aa, Mycobacterium avium
GTDAYRSQALLYTSMLVQAYQSANIHVQV

SEQ ID NO: 23981 - protein, 28 aa, Mycobacterium avium
GTDAYRSQALLYTSMLVQAYQSANVHVQ

SEQ ID NO: 23982 - protein, 23 aa, Mycobacterium avium
GTDYAVFLISRYHDYLRRGDDFD

SEQ ID NO: 23983 - protein, 19 aa, Mycobacterium avium
GTHLANWRRVGFATWIADA

SEQ ID NO: 23984 - protein, 17 aa, Mycobacterium avium
GTNWWAFRSACTSSGCA

SEQ ID NO: 23985 - protein, 20 aa, Mycobacterium avium
GTPFFVMDYVDGLVPPDVMP

SEQ ID NO: 23986 - protein, 28 aa, Mycobacterium avium
GTTIGLGLLFDTLIVRAFMTPSAAALLG

SEQ ID NO: 23987 - protein, 25 aa, Mycobacterium avium
GTVALAFLAMVFATLSVFAGLGPAC

SEQ ID NO: 23988 - protein, 27 aa, Mycobacterium avium
GVEEQYYFVWPLLLIAVALALAARARR

SEQ ID NO: 23989 - protein, 27 aa, Mycobacterium avium
GVGVTQLTLLRYLIGQLRLSAPDRMRM

SEQ ID NO: 23990 - protein, 18 aa, Mycobacterium avium
GVHQWLNATLLAGAALAG

SEQ ID NO: 23991 - protein, 31 aa, Mycobacterium avium
GVLAYAIYAAWYIGPLLPIFYARDEYFSSPG

SEQ ID NO: 23992 - protein, 30 aa, Mycobacterium avium
GVLLGQLIGARPLDFLLGGQVGGWLLLVGA

SEQ ID NO: 23993 - protein, 29 aa, Mycobacterium avium
GVLLGVLVIVILVAWRWVPAKVRRVPGPL

SEQ ID NO: 23994 - protein, 18 aa, Mycobacterium avium
GVLLLWSWLVLPLAQGYY

SEQ ID NO: 23995 - protein, 31 aa, Mycobacterium avium
GVLRAMGAGRRFILRMVLAEAAGIGCVGGGL

SEQ ID NO: 23996 - protein, 24 aa, Mycobacterium avium
GVLVFQFLLGQQLHWSVPPLAFVV

SEQ ID NO: 23997 - protein, 20 aa, Mycobacterium avium
GVMRTWYLIGRKPAEAPTDL

SEQ ID NO: 23998 - protein, 17 aa, Mycobacterium avium
GVPIFFVLSGYLLFRPW

SEQ ID NO: 23999 - protein, 30 aa, Mycobacterium avium
GVPLEWNVFMIFGVLWLFLAHAPVGLSSVA

SEQ ID NO: 24000 - protein, 27 aa, Mycobacterium avium
GVPLEWNVFMIFGVLWLFVAHAPVGLS

SEQ ID NO: 24001 - protein, 26 aa, Mycobacterium avium
GVPLEWNVFMIFGVLWLFVAHARVGL

SEQ ID NO: 24002 - protein, 30 aa, Mycobacterium avium
GVPPVPPQLPYPKWLPPPAPPEGINPPPAG

SEQ ID NO: 24003 - protein, 30 aa, Mycobacterium avium
GVPPVPPQLPYPKWLPPPAPPEGINPPPAS

SEQ ID NO: 24004 - protein, 18 aa, Mycobacterium avium
GVQLYRKLTTTTVVAYFS

SEQ ID NO: 24005 - protein, 17 aa, Mycobacterium avium
GVRDSIPLTPPQTIRAL

SEQ ID NO: 24006 - protein, 29 aa, Mycobacterium avium
GVRQTVHVGWLLPLSGLQLDLDPVGGFFM

SEQ ID NO: 24007 - protein, 28 aa, Mycobacterium avium
GVSAWLITRAWQMPPVLDLSVAAVAVRM

SEQ ID NO: 24008 - protein, 18 aa, Mycobacterium avium
GVSPHRANWGVAGWSMGG

SEQ ID NO: 24009 - protein, 31 aa, Mycobacterium avium
GVTVAVVLLVRPLWLLLTQSLPRSLHTRLGN

SEQ ID NO: 24010 - protein, 34 aa, Mycobacterium avium
GVTVLLFPVVQPWYLLWAIIPLAAWATRTGFRVA

SEQ ID NO: 24011 - protein, 33 aa, Mycobacterium avium
GVVFPVIGWWLYDIFYITPFLAIPYLHTVNRET

SEQ ID NO: 24012 - protein, 18 aa, Mycobacterium avium
GVVSVRLFGFTPGQLVLR

SEQ ID NO: 24013 - protein, 19 aa, Mycobacterium avium
GVVTLILALILKYTMGLRL

SEQ ID NO: 24014 - protein, 19 aa, Mycobacterium avium
GWADRKPRKGFFTDTSICI

SEQ ID NO: 24015 - protein, 26 aa, Mycobacterium avium
GWGFFISGVVLLIAAVGWVMAPETRT

SEQ ID NO: 24016 - protein, 18 aa, Mycobacterium avium
GWLLFEQHQKDVAAAQAL

SEQ ID NO: 24017 - protein, 17 aa, Mycobacterium avium
GWLLLVGATLACAGLLW

SEQ ID NO: 24018 - protein, 18 aa, Mycobacterium avium
GWRIGFLLSVLLVAIGIV

SEQ ID NO: 24019 - protein, 21 aa, Mycobacterium avium
GWTRRIFYRLTHVLDPLIALE

SEQ ID NO: 24020 - protein, 17 aa, Mycobacterium avium
GWTWAANTFEFAGVAFA

SEQ ID NO: 24021 - protein, 27 aa, Mycobacterium avium
GWVFAVRAFLLMAFPHAFMAAADAAVR

SEQ ID NO: 24022 - protein, 30 aa, Mycobacterium avium
GWVHRHGLWPWALALLALAAVPFGHAWRRG

SEQ ID NO: 24023 - protein, 30 aa, Mycobacterium avium
GWVHRHGLWPWALALLALAAVRFGRARRRG

SEQ ID NO: 24024 - protein, 23 aa, Mycobacterium avium
GWWIGVLVYFLPRRSWLRAAAED

SEQ ID NO: 24025 - protein, 35 aa, Mycobacterium avium
GYAFVFGLAFYLPLLPWVGLLVGAVPWLVLAAVSA

SEQ ID NO: 24026 - protein, 17 aa, Mycobacterium avium
GYEGWLLFEQHQKDVAA

SEQ ID NO: 24027 - protein, 25 aa, Mycobacterium avium
GYFTTRLLERLPTSSYRRPLLGTGF

SEQ ID NO: 24028 - protein, 17 aa, Mycobacterium avium
GYGVLKPGIIPLRPLTL

SEQ ID NO: 24029 - protein, 17 aa, Mycobacterium avium
GYRLAARPFGLAPSVVG

SEQ ID NO: 24030 - protein, 25 aa, Mycobacterium avium
GYTAVFIAFVVFIAVKMLGTLKIVN

SEQ ID NO: 24031 - protein, 33 aa, Mycobacterium avium
HAAILPPSVFSPGPLKWIYLTMGVLMAAAMVNT

SEQ ID NO: 24032 - protein, 34 aa, Mycobacterium avium
HAAILPPSVFSPGPLKWIYLTMGVLMAAAMVNTY

SEQ ID NO: 24033 - protein, 31 aa, Mycobacterium avium
HAHPGSGGVSLWWMIGLLAAAGVLGLMVVLP

SEQ ID NO: 24034 - protein, 27 aa, Mycobacterium avium
HAPERWEDSPLYFKEIALVGSNAFGVE

SEQ ID NO: 24035 - protein, 33 aa, Mycobacterium avium
HAPKTVWVGLAYPWCDLMLLALAAGMLPILGWR

SEQ ID NO: 24036 - protein, 29 aa, Mycobacterium avium
HATPEKLFTPILLLAVAALGIGLVSTLLV

SEQ ID NO: 24037 - protein, 17 aa, Mycobacterium avium
HDGVYTAARLAKDEGVP

SEQ ID NO: 24038 - protein, 23 aa, Mycobacterium avium
HGGDLVCLPHRGGARFRLTLPRA

SEQ ID NO: 24039 - protein, 25 aa, Mycobacterium avium
HHWQMPLLGHHLLVAGATGAGKGSV

SEQ ID NO: 24040 - protein, 17 aa, Mycobacterium avium
HIGFLLIATVTALILVL

SEQ ID NO: 24041 - protein, 20 aa, Mycobacterium avium
HILEIFMSQPELLAPALLLA

SEQ ID NO: 24042 - protein, 32 aa, Mycobacterium avium
HIPRGVLPSVPRWLWIFLGVVGVTAALAGGAP

SEQ ID NO: 24043 - protein, 26 aa, Mycobacterium avium
HKLGSVIRIPIVLGVAQLLGRIPLPG

SEQ ID NO: 24044 - protein, 27 aa, Mycobacterium avium
HKSIEQLLVVLPALFAAITTAAGGGPQ

SEQ ID NO: 24045 - protein, 17 aa, Mycobacterium avium
HKWIKRAVLVCLVALVI

SEQ ID NO: 24046 - protein, 23 aa, Mycobacterium avium
HLIGWLTLVLLVAPGQYSLGGKA

SEQ ID NO: 24047 - protein, 25 aa, Mycobacterium avium
HLLMNLHFLLSGYLFYWVVIGVDPT

SEQ ID NO: 24048 - protein, 18 aa, Mycobacterium avium
HLWFLAVYLVVVSSTPIA

SEQ ID NO: 24049 - protein, 24 aa, Mycobacterium avium
HMNTVFVGIILFTAAITAAIAVAD

SEQ ID NO: 24050 - protein, 33 aa, Mycobacterium avium
HPARYLSVFLLLLVGVYLLVFLTGDKRAAPKLG

SEQ ID NO: 24051 - protein, 36 aa, Mycobacterium avium
HPGPGWGLIVAWITVLVLIYQWARVVWSRTIVQLAA

SEQ ID NO: 24052 - protein, 19 aa, Mycobacterium avium
HPPSYLWKKHFHGCFIEDD

SEQ ID NO: 24053 - protein, 24 aa, Mycobacterium avium
HPPYDQLFPQVWVDGFFAISGFLI

SEQ ID NO: 24054 - protein, 20 aa, Mycobacterium avium
HPPYDQLFTQVWVDGFFAIS

SEQ ID NO: 24055 - protein, 35 aa, Mycobacterium avium
HQLLALGATVLLIAGLITGGLLLKSTGRLNDYIRV

SEQ ID NO: 24056 - protein, 35 aa, Mycobacterium avium
HQLLALGATVLLIAGLITGGLLLKSTGRLNDYVRV

SEQ ID NO: 24057 - protein, 17 aa, Mycobacterium avium
HRFGAPTARPFRPYPRC

SEQ ID NO: 24058 - protein, 28 aa, Mycobacterium avium
HRGELVYLPPEWFATTPPPALPTVMMIG

SEQ ID NO: 24059 - protein, 21 aa, Mycobacterium avium
HRGLVWLTMLAAVALVTARRE

SEQ ID NO: 24060 - protein, 28 aa, Mycobacterium avium
HRKQPPLQRLLRALLGLDAKLSQYTRGK

SEQ ID NO: 24061 - protein, 30 aa, Mycobacterium avium
HRLDAIVLYLGFIVAAWLLGYLMRTQRLLV

SEQ ID NO: 24062 - protein, 21 aa, Mycobacterium avium
HRSEILLADALRALAYAATGG

SEQ ID NO: 24063 - protein, 18 aa, Mycobacterium avium
HSARPPLRPARAIAAVAG

SEQ ID NO: 24064 - protein, 22 aa, Mycobacterium avium
HSLLIFIVTVVILVTVLVQGST

SEQ ID NO: 24065 - protein, 33 aa, Mycobacterium avium
HSPLARPAFLLRSYLIPLGALLVLLVNVARMPA

SEQ ID NO: 24066 - protein, 32 aa, Mycobacterium avium
HSPRRLLLDGLIVATSLFVISWVFVVEAQLRE

SEQ ID NO: 24067 - protein, 28 aa, Mycobacterium avium
HTAVQYRLPMTFVLFNNNAHAMCVTREQ

SEQ ID NO: 24068 - protein, 23 aa, Mycobacterium avium
HTLALLTAVGFAGPLLASAKRFR

SEQ ID NO: 24069 - protein, 17 aa, Mycobacterium avium
HTRFRRMLDPFFSPKKM

SEQ ID NO: 24070 - protein, 33 aa, Mycobacterium avium
HVGSLTAFLAYFTQILMAVLMATMTLVVLPRAS

SEQ ID NO: 24071 - protein, 19 aa, Mycobacterium avium
HVTVYILAGLAAVEAGALA

SEQ ID NO: 24072 - protein, 18 aa, Mycobacterium avium
HWPAMMPLGYLNLAIWLI

SEQ ID NO: 24073 - protein, 20 aa, Mycobacterium avium
HYFARDPLKPELTLADYKVT

SEQ ID NO: 24074 - protein, 17 aa, Mycobacterium avium
HYLKRPGANDRVATFTS

SEQ ID NO: 24075 - protein, 24 aa, Mycobacterium avium
HYRALLVALARLAGTHRAGGLPAA

SEQ ID NO: 24076 - protein, 20 aa, Mycobacterium avium
HYVLAPLALAQRVTARAGQL

SEQ ID NO: 24077 - protein, 20 aa, Mycobacterium avium
HYVLAPLALAQRVTGRAGQL

SEQ ID NO: 24078 - protein, 24 aa, Mycobacterium avium
IAAAHIVLGLLLKVGSTGVVFRTS

SEQ ID NO: 24079 - protein, 25 aa, Mycobacterium avium
IAAAVLVLYALRWPVTVVVSGDEDA

SEQ ID NO: 24080 - protein, 24 aa, Mycobacterium avium
IAAPRRIIALGVLVFLAAAVFGIP

SEQ ID NO: 24081 - protein, 36 aa, Mycobacterium avium
IAAVAVIFVGGIVALAWALAFIRPHADQRPEVGTQV

SEQ ID NO: 24082 - protein, 17 aa, Mycobacterium avium
IAAVSRLDLRLAQRLAA

SEQ ID NO: 24083 - protein, 24 aa, Mycobacterium avium
IAFGLLLLIVFCFIELRAPQPMVN

SEQ ID NO: 24084 - protein, 32 aa, Mycobacterium avium
IAGRIFDILVTLKFLLEQPLLYVVGLGMAVTS

SEQ ID NO: 24085 - protein, 25 aa, Mycobacterium avium
IAGVLWGAGWVAVLAVLTRLRHLFF

SEQ ID NO: 24086 - protein, 25 aa, Mycobacterium avium
IAGVSYMRYPLFLGFDIVGGIAWGG

SEQ ID NO: 24087 - protein, 18 aa, Mycobacterium avium
IAIAFLGTVLLYFAARHA

SEQ ID NO: 24088 - protein, 43 aa, Mycobacterium avium
IAILLLGWRGARWWRRGLSILAVPLCLLCSLLVLNQWVGYFQT

SEQ ID NO: 24089 - protein, 30 aa, Mycobacterium avium
IAISARKYAFRKRVLMAMAVVLVGSATAAF

SEQ ID NO: 24090 - protein, 25 aa, Mycobacterium avium
IAKYFAIIPAMFVALFPGLDLINVM

SEQ ID NO: 24091 - protein, 18 aa, Mycobacterium avium
IALTIAGGLAAILTPRPQ

SEQ ID NO: 24092 - protein, 20 aa, Mycobacterium avium
IALTVLTRLRQLAFHAIGAA

SEQ ID NO: 24093 - protein, 19 aa, Mycobacterium avium
IAVAVGALITLGPLALSLQ

SEQ ID NO: 24094 - protein, 38 aa, Mycobacterium avium
IAVLVVITALVLGLARYRRRRISFSTRPEPGAIDRSGG

SEQ ID NO: 24095 - protein, 17 aa, Mycobacterium avium
IAVMLVVHALGAGYRHY

SEQ ID NO: 24096 - protein, 18 aa, Mycobacterium avium
IAVMLVVHALGAGYRHYT

SEQ ID NO: 24097 - protein, 23 aa, Mycobacterium avium
IAVSYGLLTVSWLALTATNADGP

SEQ ID NO: 24098 - protein, 24 aa, Mycobacterium avium
IAVTWMVYATLRRDVAGPTTPYAA

SEQ ID NO: 24099 - protein, 29 aa, Mycobacterium avium
IAWWHDPLINWFQPALFYNAGLLNFGNWT

SEQ ID NO: 24100 - protein, 37 aa, Mycobacterium avium
IDAALSNYFRRGNLTALRELVLLWLADQVDTALAKYR

SEQ ID NO: 24101 - protein, 20 aa, Mycobacterium avium
IDAARLLTWRASWMAANNVP

SEQ ID NO: 24102 - protein, 17 aa, Mycobacterium avium
IDALLRLARRSAASGAA

SEQ ID NO: 24103 - protein, 19 aa, Mycobacterium avium
IDELTLSAPLPLPASGGVR

SEQ ID NO: 24104 - protein, 20 aa, Mycobacterium avium
IDPEDFWRSAGLPAYRFPDP

SEQ ID NO: 24105 - protein, 31 aa, Mycobacterium avium
IDPGARGFVVSILVFVLLGSFILPHTGDVRG

SEQ ID NO: 24106 - protein, 41 aa, Mycobacterium avium
IDPWSTLKVSLLLSVALFFVWMIAVAFLYLVLGGMGVWSKL

SEQ ID NO: 24107 - protein, 21 aa, Mycobacterium avium
IDQLVLDHLLASDVSTAMLGG

SEQ ID NO: 24108 - protein, 24 aa, Mycobacterium avium
IESEARRMALLVDELLLLSRLGEG

SEQ ID NO: 24109 - protein, 21 aa, Mycobacterium avium
IEVAPGITIPVGPPTTVTLAP

SEQ ID NO: 24110 - protein, 18 aa, Mycobacterium avium
IEWLRLPGDFVFILGGVL

SEQ ID NO: 24111 - protein, 18 aa, Mycobacterium avium
IFAGLIAAALPGAAVAVL

SEQ ID NO: 24112 - protein, 22 aa, Mycobacterium avium
IFRPGVLTYEFWLKAGIVALGS

SEQ ID NO: 24113 - protein, 24 aa, Mycobacterium avium
IGGMPLLLLARLLGQRILQLPLSR

SEQ ID NO: 24114 - protein, 25 aa, Mycobacterium avium
IGGMPLLLLARLLGQRILQLPLSRR

SEQ ID NO: 24115 - protein, 29 aa, Mycobacterium avium
IGGTVFVALPFWIIAHLQRRRILSTGALR

SEQ ID NO: 24116 - protein, 28 aa, Mycobacterium avium
IGGTVFVALPFWIIAHLQRRRLLSTGAL

SEQ ID NO: 24117 - protein, 29 aa, Mycobacterium avium
IGGTVFVALPFWIIAHLQRRRLLSTGALR

SEQ ID NO: 24118 - protein, 17 aa, Mycobacterium avium
IGLAWMVFATLLPLGVL

SEQ ID NO: 24119 - protein, 18 aa, Mycobacterium avium
IGLAWMVFATLLPLGVLQ

SEQ ID NO: 24120 - protein, 20 aa, Mycobacterium avium
IGMIYIWMPLAMGSIARWTM

SEQ ID NO: 24121 - protein, 19 aa, Mycobacterium avium
IGPLLVLGLLGARVWADRP

SEQ ID NO: 24122 - protein, 22 aa, Mycobacterium avium
IGQAITMPLFFASNALYPVELM

SEQ ID NO: 24123 - protein, 17 aa, Mycobacterium avium
IGVAVVAVLFAWGGWQR

SEQ ID NO: 24124 - protein, 17 aa, Mycobacterium avium
IGVTLSIQFALLANQVG

SEQ ID NO: 24125 - protein, 35 aa, Mycobacterium avium
IGVVPAGLLILIFGFPWYWFSPRSSAPAPSVAAPT

SEQ ID NO: 24126 - protein, 18 aa, Mycobacterium avium
IGWRAASALAYLRGFGRK

SEQ ID NO: 24127 - protein, 46 aa, Mycobacterium avium
IGYGLGVFAVWLYRYLWAKPSSPPPPRWAWKILIPVGAVGMVLMAI

SEQ ID NO: 24128 - protein, 39 aa, Mycobacterium avium
IHELWAGTKLLVVFAMSLLLTVFPGWVAIGLATALAAAG

SEQ ID NO: 24129 - protein, 38 aa, Mycobacterium avium
IHELWAGTKLLVVFAMSLLLTVFPGWVAVGLATALAAA

SEQ ID NO: 24130 - protein, 19 aa, Mycobacterium avium
IHWTPARYLMLAASSGFGF

SEQ ID NO: 24131 - protein, 20 aa, Mycobacterium avium
IIANRVSYFYDFRGPSVAVD

SEQ ID NO: 24132 - protein, 28 aa, Mycobacterium avium
IIGLGAALLIAALLLTTYTTSRITKVPL

SEQ ID NO: 24133 - protein, 17 aa, Mycobacterium avium
IIGNWRYWNRPNSGFGE

SEQ ID NO: 24134 - protein, 31 aa, Mycobacterium avium
IILIVVMLLLVYRTPSTLLVPLLGVLIEMLV

SEQ ID NO: 24135 - protein, 25 aa, Mycobacterium avium
IIQPPLILFCAVPGAYWLFHDAKVG

SEQ ID NO: 24136 - protein, 17 aa, Mycobacterium avium
IIRRFVYLVLLMTAFNW

SEQ ID NO: 24137 - protein, 19 aa, Mycobacterium avium
IIRRFVYLVLLMTAFNWMS

SEQ ID NO: 24138 - protein, 20 aa, Mycobacterium avium
IIRRFVYLVLLMTAFNWMSH

SEQ ID NO: 24139 - protein, 25 aa, Mycobacterium avium
IKTLLEQMIVLIPAILPLLTVSVVP

SEQ ID NO: 24140 - protein, 41 aa, Mycobacterium avium
ILDTALVLAAIVIALAVVLLVARALVRPLRTLRDGALKVAH

SEQ ID NO: 24141 - protein, 19 aa, Mycobacterium avium
ILEIFMSQPELLAPALLLA

SEQ ID NO: 24142 - protein, 18 aa, Mycobacterium avium
ILGGVLPFVWIAWTAIRN

SEQ ID NO: 24143 - protein, 18 aa, Mycobacterium avium
ILGVIKYRGITTPGPVLE

SEQ ID NO: 24144 - protein, 22 aa, Mycobacterium avium
ILPGLWVCLVVIAFVIAPIAVA

SEQ ID NO: 24145 - protein, 23 aa, Mycobacterium avium
ILPGLWVCLVVIAFVIAPIGVAI

SEQ ID NO: 24146 - protein, 18 aa, Mycobacterium avium
ILSVFGFIVMFGGVVFAI

SEQ ID NO: 24147 - protein, 27 aa, Mycobacterium avium
ILTTAFGLLVLVLLLSGLNATVFERAP

SEQ ID NO: 24148 - protein, 17 aa, Mycobacterium avium
ILVLSRIDVPLPAPRYR

SEQ ID NO: 24149 - protein, 18 aa, Mycobacterium avium
IMCIWPNLIAYWAGKPPI

SEQ ID NO: 24150 - protein, 17 aa, Mycobacterium avium
IMSQLVFSSGMIPVYQR

SEQ ID NO: 24151 - protein, 21 aa, Mycobacterium avium
INQPPPCLTGFIPASEWRSPA

SEQ ID NO: 24152 - protein, 21 aa, Mycobacterium avium
IPAILPLLTVSVVPLVVPTLV

SEQ ID NO: 24153 - protein, 21 aa, Mycobacterium avium
IPHLITPIITQPKKAAAALAW

SEQ ID NO: 24154 - protein, 24 aa, Mycobacterium avium
IPLAALGMLNPMLAGAAMALSSVL

SEQ ID NO: 24155 - protein, 20 aa, Mycobacterium avium
IPLSRAEILGLLDRGPDFGP

SEQ ID NO: 24156 - protein, 31 aa, Mycobacterium avium
IPRGVLPSVPRWLWIFLGVVGVTAALAGGAP

SEQ ID NO: 24157 - protein, 24 aa, Mycobacterium avium
IPRMKVPVWSLLIIGVAALAVSVA

SEQ ID NO: 24158 - protein, 25 aa, Mycobacterium avium
IPRMKVPVWSLLIIGVAALAVSVAQ

SEQ ID NO: 24159 - protein, 29 aa, Mycobacterium avium
IPSVIGLALILFSGRRWVTTLGAFVLAVA

SEQ ID NO: 24160 - protein, 30 aa, Mycobacterium avium
IPSVIGLALILFSGRRWVTTLGAFVLAVAP

SEQ ID NO: 24161 - protein, 19 aa, Mycobacterium avium
IPVGPPTTVTLAPAPPAGG

SEQ ID NO: 24162 - protein, 20 aa, Mycobacterium avium
IPVLRDTGLAMVVWAVAVAA

SEQ ID NO: 24163 - protein, 17 aa, Mycobacterium avium
IPYYLCMLELRGTDLQG

SEQ ID NO: 24164 - protein, 17 aa, Mycobacterium avium
IRDLIGERAIFLREQAV

SEQ ID NO: 24165 - protein, 20 aa, Mycobacterium avium
IRGQRFGRLPAGRAILLGDS

SEQ ID NO: 24166 - protein, 24 aa, Mycobacterium avium
IRRVRELLTVPPLPEPTHPGQATG

SEQ ID NO: 24167 - protein, 26 aa, Mycobacterium avium
IRSRLRSLLLLLVLGSAAIAATLLAA

SEQ ID NO: 24168 - protein, 29 aa, Mycobacterium avium
ISDFEDFWRPIRSYFYWEKHCYDIPICFS

SEQ ID NO: 24169 - protein, 25 aa, Mycobacterium avium
ISIQSKVMVMLLVSSLASLGVIGTV

SEQ ID NO: 24170 - protein, 18 aa, Mycobacterium avium
ISLFPDGSVTSLLVAALV

SEQ ID NO: 24171 - protein, 33 aa, Mycobacterium avium
ISLLTAAGYLLWWAVLFPAISVPIIASLTLGIT

SEQ ID NO: 24172 - protein, 29 aa, Mycobacterium avium
ISPLLAGITLLTVPLSLLATRVIVRRSQR

SEQ ID NO: 24173 - protein, 24 aa, Mycobacterium avium
ISWTHHWVWLVPLMIWAIHGPVRA

SEQ ID NO: 24174 - protein, 17 aa, Mycobacterium avium
ITGPLPVLPTPGGPPDP

SEQ ID NO: 24175 - protein, 27 aa, Mycobacterium avium
ITGREWAWALLLAVALAVLIAVGDPTG

SEQ ID NO: 24176 - protein, 20 aa, Mycobacterium avium
ITRLTMMRLWLLRPGMRLWD

SEQ ID NO: 24177 - protein, 19 aa, Mycobacterium avium
ITVAVAVALVLWWRMVRFE

SEQ ID NO: 24178 - protein, 27 aa, Mycobacterium avium
ITVIQLAPFVLLVELARRLVAGAPAAR

SEQ ID NO: 24179 - protein, 19 aa, Mycobacterium avium
ITVLLPPMLVLTWSGLRAG

SEQ ID NO: 24180 - protein, 24 aa, Mycobacterium avium
ITVSTVFFAMFVAAALYAIGLHFA

SEQ ID NO: 24181 - protein, 24 aa, Mycobacterium avium
ITVSTVFFAMFVAAALYATWLHFA

SEQ ID NO: 24182 - protein, 25 aa, Mycobacterium avium
ITVSTVFFSMFVAAALYAIWLHFAS

SEQ ID NO: 24183 - protein, 17 aa, Mycobacterium avium
IVAGYIAALGVGALLAK

SEQ ID NO: 24184 - protein, 18 aa, Mycobacterium avium
IVALFATGMRLISPQTLF

SEQ ID NO: 24185 - protein, 28 aa, Mycobacterium avium
IVFIISSVFFVGAFIWKHSYYHCHHHHG

SEQ ID NO: 24186 - protein, 19 aa, Mycobacterium avium
IVFMRILFTLIAIGALWLL

SEQ ID NO: 24187 - protein, 23 aa, Mycobacterium avium
IVGALLVMSLLITPAAAAARVVS

SEQ ID NO: 24188 - protein, 30 aa, Mycobacterium avium
IVGTKPRIPPLLWAGLIFGAVVLVAFTGFL

SEQ ID NO: 24189 - protein, 19 aa, Mycobacterium avium
IVLALVVGYVGWRLYEKLT

SEQ ID NO: 24190 - protein, 19 aa, Mycobacterium avium
IVLLPLVIDIRRAPTATLG

SEQ ID NO: 24191 - protein, 18 aa, Mycobacterium avium
IVRLDRATFTYPGADRRV

SEQ ID NO: 24192 - protein, 18 aa, Mycobacterium avium
IVRYEQGRWVAIDNGSLN

SEQ ID NO: 24193 - protein, 17 aa, Mycobacterium avium
IVSWLPVGAAAAALVVG

SEQ ID NO: 24194 - protein, 23 aa, Mycobacterium avium
IVTVLVLIYLVTNLVVDLLYAVL

SEQ ID NO: 24195 - protein, 18 aa, Mycobacterium avium
IVVVIAGAVVWFGITSAW

SEQ ID NO: 24196 - protein, 17 aa, Mycobacterium avium
IVWLVLSALTLAYLGID

SEQ ID NO: 24197 - protein, 25 aa, Mycobacterium avium
KAAHPWAFLMRSLVGGAMVAFGVLL

SEQ ID NO: 24198 - protein, 25 aa, Mycobacterium avium
KAGLVPLHAWLPRAHPEAPSPVSAL

SEQ ID NO: 24199 - protein, 35 aa, Mycobacterium avium
KALKADPLLYPFQPIHVTVAAWFTIGIPSFILSLA

SEQ ID NO: 24200 - protein, 42 aa, Mycobacterium avium
KATVLDLIPANVYWVVGQLAVVVLLVAVWQGRRPGPLVAEEL

SEQ ID NO: 24201 - protein, 42 aa, Mycobacterium avium
KATVLDLIPANVYWVVGQLAVVVLLVAVWRGRRPGPLVAEEL

SEQ ID NO: 24202 - protein, 18 aa, Mycobacterium avium
KAVPRWYARLRQPAYQPP

SEQ ID NO: 24203 - protein, 18 aa, Mycobacterium avium
KCMGLPTLPFNTNPPQFI

SEQ ID NO: 24204 - protein, 25 aa, Mycobacterium avium
KDAEVWDRLTGNFWLPEKVPVSNDL

SEQ ID NO: 24205 - protein, 33 aa, Mycobacterium avium
KDLLINCGYPLIERFPLMLGTAGAVLAIGLVRW

SEQ ID NO: 24206 - protein, 23 aa, Mycobacterium avium
KDQTVLPFSWQGVALHASGASRA

SEQ ID NO: 24207 - protein, 22 aa, Mycobacterium avium
KDWVATLRLDLDPGVRLPANAT

SEQ ID NO: 24208 - protein, 25 aa, Mycobacterium avium
KENDRLLASLMPEPVARRYREGEQT

SEQ ID NO: 24209 - protein, 24 aa, Mycobacterium avium
KFAAWMVFVPVWTVAVYSVVAHWV

SEQ ID NO: 24210 - protein, 36 aa, Mycobacterium avium
KFAVFAVVMAMLTAFLFFIFGQYRTGATNGYSAVFT

SEQ ID NO: 24211 - protein, 21 aa, Mycobacterium avium
KGALARWNWVLDGMVETKALP

SEQ ID NO: 24212 - protein, 25 aa, Mycobacterium avium
KGASPLSFRRWLNPVNAAAATALVA

SEQ ID NO: 24213 - protein, 23 aa, Mycobacterium avium
KHAVWIALWLAVNPFIFGEPAHH

SEQ ID NO: 24214 - protein, 27 aa, Mycobacterium avium
KHREELVYLPPAWFASYPPPQLPTVLM

SEQ ID NO: 24215 - protein, 28 aa, Mycobacterium avium
KHREELVYLPPAWFASYPPPQLPTVLMI

SEQ ID NO: 24216 - protein, 33 aa, Mycobacterium avium
KHSPLARPVFLLRSYLIPLGALLVLLVNVARMP

SEQ ID NO: 24217 - protein, 34 aa, Mycobacterium avium
KHSPLARPVFLLRSYLIPLGALLVLLVNVARMPA

SEQ ID NO: 24218 - protein, 19 aa, Mycobacterium avium
KIDGRLYPALNLTSARLAT

SEQ ID NO: 24219 - protein, 21 aa, Mycobacterium avium
KIRGQRFGRLPAGRAILLGDS

SEQ ID NO: 24220 - protein, 37 aa, Mycobacterium avium
KISPTAWWVCGAATTVTLLYLGYLRRQTRIEEKVRRR

SEQ ID NO: 24221 - protein, 21 aa, Mycobacterium avium
KLDPRTLWRNPVMFIVEIGAA

SEQ ID NO: 24222 - protein, 17 aa, Mycobacterium avium
KLHFWLTFIGFHTTFLV

SEQ ID NO: 24223 - protein, 21 aa, Mycobacterium avium
KLLSRNLYIYGLGGIVAPFIG

SEQ ID NO: 24224 - protein, 22 aa, Mycobacterium avium
KMWTGLLGMFLVVLLVIGAVRL

SEQ ID NO: 24225 - protein, 20 aa, Mycobacterium avium
KNFYYFPDQLSIDRYLDRNG

SEQ ID NO: 24226 - protein, 28 aa, Mycobacterium avium
KPAAKFTLEVYPRYLKLIPSNVNADIKA

SEQ ID NO: 24227 - protein, 66 aa, Mycobacterium avium
KPLSPPVAAPLPAAPPPAAPPLPEAPPIPAAPPVVPVPVVVPPVPVPVPVRIPVPDPVSPPQLLAP

SEQ ID NO: 24228 - protein, 26 aa, Mycobacterium avium
KPLVEQFWYRSTKYVLRRALPVGLSV

SEQ ID NO: 24229 - protein, 21 aa, Mycobacterium avium
KPPHPSWLPRQRRGTTPQMIG

SEQ ID NO: 24230 - protein, 17 aa, Mycobacterium avium
KPRLYNWQYQPLDAADA

SEQ ID NO: 24231 - protein, 24 aa, Mycobacterium avium
KPTKLTLDPVLRFASLQMVFHHGR

SEQ ID NO: 24232 - protein, 26 aa, Mycobacterium avium
KPVPRRDMVPIWVAAGGLFGALLIGG

SEQ ID NO: 24233 - protein, 26 aa, Mycobacterium avium
KQPRPAIGPLRRTGLSGVLRGGRSRF

SEQ ID NO: 24234 - protein, 22 aa, Mycobacterium avium
KRGWMVLVVVVVVGVAGFCVYR

SEQ ID NO: 24235 - protein, 18 aa, Mycobacterium avium
KRRLWLMGLIAPTALFVM

SEQ ID NO: 24236 - protein, 23 aa, Mycobacterium avium
KRRWPAVVVFILLLVFSALVAYP

SEQ ID NO: 24237 - protein, 19 aa, Mycobacterium avium
KRRWPAVVVFILLVVFSAL

SEQ ID NO: 24238 - protein, 20 aa, Mycobacterium avium
KRRWPAVVVFILLVVFSALV

SEQ ID NO: 24239 - protein, 38 aa, Mycobacterium avium
KSARGRLRIPRRPGRPRWLRLPGRRAIAAGAGILLASA

SEQ ID NO: 24240 - protein, 39 aa, Mycobacterium avium
KSARGRLRLPRRPGRPRWLRLPGRRAIAAGAGILLASAS

SEQ ID NO: 24241 - protein, 25 aa, Mycobacterium avium
KSIEQLLVVLPALFAAITTAAGGGP

SEQ ID NO: 24242 - protein, 33 aa, Mycobacterium avium
KSWVRRYTLRRGALLFGKLLPVGIGVVVGAVGN

SEQ ID NO: 24243 - protein, 31 aa, Mycobacterium avium
KTAAWAWRLLVILAAALALFWVLAKLEVIVV

SEQ ID NO: 24244 - protein, 26 aa, Mycobacterium avium
KTAAWAWRLLVILAAALAVFWVLAKL

SEQ ID NO: 24245 - protein, 20 aa, Mycobacterium avium
KTLLEQMIVLIPAILPLLTV

SEQ ID NO: 24246 - protein, 20 aa, Mycobacterium avium
KTPYWSEPEPRWPKSPPQPK

SEQ ID NO: 24247 - protein, 24 aa, Mycobacterium avium
KTPYWSEPEPRWPKSPPQPKRAPG

SEQ ID NO: 24248 - protein, 21 aa, Mycobacterium avium
KTRVLEVLALLCRNAKLTLST

SEQ ID NO: 24249 - protein, 19 aa, Mycobacterium avium
KVFAEIVPVLLVAALVLVV

SEQ ID NO: 24250 - protein, 33 aa, Mycobacterium avium
KVTVITVLVILAMLLWVYRSVTAVFVLVTVIVE

SEQ ID NO: 24251 - protein, 19 aa, Mycobacterium avium
KVVLALQHDKLPPSINFAG

SEQ ID NO: 24252 - protein, 18 aa, Mycobacterium avium
KVVVLLFIDQTVTNTAAP

SEQ ID NO: 24253 - protein, 17 aa, Mycobacterium avium
KVWLPITAAVYTANGLM

SEQ ID NO: 24254 - protein, 22 aa, Mycobacterium avium
KVWTGLLGMFLVVLLVIGAVRL

SEQ ID NO: 24255 - protein, 35 aa, Mycobacterium avium
LAAGMLPILGWRNEIRWALLVAGLVLFAVADGAYL

SEQ ID NO: 24256 - protein, 20 aa, Mycobacterium avium
LAAMFAWGISFLGRTRGQMA

SEQ ID NO: 24257 - protein, 23 aa, Mycobacterium avium
LAARFHPVLYWATIVASTTFGTV

SEQ ID NO: 24258 - protein, 18 aa, Mycobacterium avium
LAATAFHLLTGAPPFQHS

SEQ ID NO: 24259 - protein, 19 aa, Mycobacterium avium
LAATAFHLLTGAPPFQHSN

SEQ ID NO: 24260 - protein, 26 aa, Mycobacterium avium
LAATVFFALLALYLVGVDQGAVSLFG

SEQ ID NO: 24261 - protein, 18 aa, Mycobacterium avium
LACTAGALGITLLGSVPP

SEQ ID NO: 24262 - protein, 25 aa, Mycobacterium avium
LADRDGTTWLLWDGKRSQINLTDHA

SEQ ID NO: 24263 - protein, 25 aa, Mycobacterium avium
LAEGGPVLSPLWQAALWAGVLVAVF

SEQ ID NO: 24264 - protein, 24 aa, Mycobacterium avium
LAFTGDNLPLLLKGFARAVSEGSY

SEQ ID NO: 24265 - protein, 20 aa, Mycobacterium avium
LAGLALALSSAPWLIAVGAA

SEQ ID NO: 24266 - protein, 25 aa, Mycobacterium avium
LAGLHAIPVPPFVPAPTLVPVALAP

SEQ ID NO: 24267 - protein, 22 aa, Mycobacterium avium
LAGRDLPPVPVLLVIVDEYLEL

SEQ ID NO: 24268 - protein, 23 aa, Mycobacterium avium
LAGRDLPPVPVLLVIVDEYLELF

SEQ ID NO: 24269 - protein, 32 aa, Mycobacterium avium
LAGRYFPPMGSILYWLRPGTIRLPPWPNRIPL

SEQ ID NO: 24270 - protein, 30 aa, Mycobacterium avium
LAHQRIKPREWAWALILAAALAVVIIVGDP

SEQ ID NO: 24271 - protein, 20 aa, Mycobacterium avium
LAIIIAVLIVINSRADQQQQ

SEQ ID NO: 24272 - protein, 30 aa, Mycobacterium avium
LAIPELIQPFFDYYFGFRRNDPNMPRALFP

SEQ ID NO: 24273 - protein, 20 aa, Mycobacterium avium
LAIWLRRQLANLAARLVTSL

SEQ ID NO: 24274 - protein, 34 aa, Mycobacterium avium
LAKALRMDKLLRTKILPISFGFPFGLSAVLPVNL

SEQ ID NO: 24275 - protein, 22 aa, Mycobacterium avium
LAKGIVYALITLGLLVAVNQIE

SEQ ID NO: 24276 - protein, 25 aa, Mycobacterium avium
LALALRTFPMLIDEFRVLYAARRLR

SEQ ID NO: 24277 - protein, 20 aa, Mycobacterium avium
LALFWVLAKLEVIVVPVLVA

SEQ ID NO: 24278 - protein, 18 aa, Mycobacterium avium
LALGWWQWTRFQSVSGSF

SEQ ID NO: 24279 - protein, 19 aa, Mycobacterium avium
LALGWWQWTRFQSVSGSFQ

SEQ ID NO: 24280 - protein, 18 aa, Mycobacterium avium
LALIAPPDQILPALTEPL

SEQ ID NO: 24281 - protein, 21 aa, Mycobacterium avium
LALLTAVGFAGPLLASAKRFR

SEQ ID NO: 24282 - protein, 25 aa, Mycobacterium avium
LALNGWVGYFPTVLAAWNQLTQAPL

SEQ ID NO: 24283 - protein, 22 aa, Mycobacterium avium
LALPLASLVFLGAFIPLVGAVV

SEQ ID NO: 24284 - protein, 21 aa, Mycobacterium avium
LAMALTCWWVISREVMPRLGH

SEQ ID NO: 24285 - protein, 23 aa, Mycobacterium avium
LAMDPQQRLLLEVSWEALERAGI

SEQ ID NO: 24286 - protein, 30 aa, Mycobacterium avium
LAPAKQWGFFTLLFLLLAPGLNRWFFGIVY

SEQ ID NO: 24287 - protein, 20 aa, Mycobacterium avium
LAPDRLVTWATTIRYEALFS

SEQ ID NO: 24288 - protein, 24 aa, Mycobacterium avium
LAPRGWWAQLSWLPQRPVLVPGTV

SEQ ID NO: 24289 - protein, 17 aa, Mycobacterium avium
LAQFVFGVRLGIAPVTV

SEQ ID NO: 24290 - protein, 25 aa, Mycobacterium avium
LAQGGPVLSPLWQAGLWGGVLVAVF

SEQ ID NO: 24291 - protein, 22 aa, Mycobacterium avium
LAQLRAWFDRPAATTLQITAAP

SEQ ID NO: 24292 - protein, 21 aa, Mycobacterium avium
LARLREIDGLLPTLVRGRGTE

SEQ ID NO: 24293 - protein, 19 aa, Mycobacterium avium
LARLTTAMLTLYFVLAVGA

SEQ ID NO: 24294 - protein, 17 aa, Mycobacterium avium
LARRLIRDGVAPGRAVG

SEQ ID NO: 24295 - protein, 29 aa, Mycobacterium avium
LARYGPRAPQLWLPPLDEPIPLSAMLARA

SEQ ID NO: 24296 - protein, 24 aa, Mycobacterium avium
LARYGYICGLVGLVFLVIPALLPA

SEQ ID NO: 24297 - protein, 28 aa, Mycobacterium avium
LASALAILLLKPVLTALYLRAGGAGGLL

SEQ ID NO: 24298 - protein, 18 aa, Mycobacterium avium
LASASLGASGYMVWQHRV

SEQ ID NO: 24299 - protein, 18 aa, Mycobacterium avium
LASPFAFSGLSFFHTIEY

SEQ ID NO: 24300 - protein, 26 aa, Mycobacterium avium
LAVFAGFLAVVFYLVAVARVIDVGEI

SEQ ID NO: 24301 - protein, 17 aa, Mycobacterium avium
LAVGWRSRRWRTVWVPV

SEQ ID NO: 24302 - protein, 25 aa, Mycobacterium avium
LAVLALIVGIIYRPLLFASVNPVVA

SEQ ID NO: 24303 - protein, 19 aa, Mycobacterium avium
LAVMSSYIWGVRIGGLFTA

SEQ ID NO: 24304 - protein, 25 aa, Mycobacterium avium
LAVTKVVLPQWYWIGLAAGLVVGAV

SEQ ID NO: 24305 - protein, 25 aa, Mycobacterium avium
LAVTKVVLPQWYWIGLTAGLVVGAV

SEQ ID NO: 24306 - protein, 25 aa, Mycobacterium avium
LAVTKVVLPQWYWMGLTAGLVVGAV

SEQ ID NO: 24307 - protein, 27 aa, Mycobacterium avium
LAVVARPYQWWRVALVIASGLAYVVIF

SEQ ID NO: 24308 - protein, 18 aa, Mycobacterium avium
LAVYLWSLLSMLTTLART

SEQ ID NO: 24309 - protein, 25 aa, Mycobacterium avium
LAWSLTVLVAVAWIARGIFLGRPVT

SEQ ID NO: 24310 - protein, 28 aa, Mycobacterium avium
LAWVLGAAMLLIAIAFAALVRNASRMLL

SEQ ID NO: 24311 - protein, 24 aa, Mycobacterium avium
LCLRFTRLNYFQSLGIPAAIGIGV

SEQ ID NO: 24312 - protein, 18 aa, Mycobacterium avium
LCTVIVGMLLRKASSAGV

SEQ ID NO: 24313 - protein, 17 aa, Mycobacterium avium
LDALRERQQRDLGGDEA

SEQ ID NO: 24314 - protein, 18 aa, Mycobacterium avium
LDAMIGHRSPSYLRFGWA

SEQ ID NO: 24315 - protein, 23 aa, Mycobacterium avium
LDARHPFLVMELIEGGTLRELLG

SEQ ID NO: 24316 - protein, 45 aa, Mycobacterium avium
LDDIERFAGPFFAFRSPHYLVVIVLWIAHTWTVGAFYVTPRLIID

SEQ ID NO: 24317 - protein, 26 aa, Mycobacterium avium
LDERRRLLGQPPLGPALLTADARAAG

SEQ ID NO: 24318 - protein, 20 aa, Mycobacterium avium
LDGRWLIRIAQLLLVIAAVG

SEQ ID NO: 24319 - protein, 17 aa, Mycobacterium avium
LDLIAGIPTLRALGRSS

SEQ ID NO: 24320 - protein, 17 aa, Mycobacterium avium
LDLLVGLQRISAIPIDT

SEQ ID NO: 24321 - protein, 23 aa, Mycobacterium avium
LDNAGRLFIVGREDDMIISGGEN

SEQ ID NO: 24322 - protein, 27 aa, Mycobacterium avium
LDRIAAYERYWLYPGAENLAIFRAHLD

SEQ ID NO: 24323 - protein, 17 aa, Mycobacterium avium
LDTFVVRTLVIPALFTL

SEQ ID NO: 24324 - protein, 30 aa, Mycobacterium avium
LDTFVVRTLVIPALFTLVGDRIWWPNNPAR

SEQ ID NO: 24325 - protein, 30 aa, Mycobacterium avium
LDTFVVRTLVIPALFTLVGDRIWWPNNPSR

SEQ ID NO: 24326 - protein, 20 aa, Mycobacterium avium
LDVCDQVLLLAPGGKTAFCG

SEQ ID NO: 24327 - protein, 17 aa, Mycobacterium avium
LEDGRHVWAIRGALQAP

SEQ ID NO: 24328 - protein, 26 aa, Mycobacterium avium
LEFMVFDELYRQAWASGYRGLTPASD

SEQ ID NO: 24329 - protein, 22 aa, Mycobacterium avium
LELLEDFEQFGYYLVHNPALAF

SEQ ID NO: 24330 - protein, 17 aa, Mycobacterium avium
LFALILAMPVALGVAIF

SEQ ID NO: 24331 - protein, 28 aa, Mycobacterium avium
LFATGVTVFTGYPFLRGALRSLRSGRAG

SEQ ID NO: 24332 - protein, 18 aa, Mycobacterium avium
LFGALLIGGAVFGTAMLM

SEQ ID NO: 24333 - protein, 22 aa, Mycobacterium avium
LFIATLVLTIPLAWLLHRFTRV

SEQ ID NO: 24334 - protein, 20 aa, Mycobacterium avium
LFLTKTVYSVLLALLVGFEC

SEQ ID NO: 24335 - protein, 21 aa, Mycobacterium avium
LFVLGFLRYALPPEDRIQLQD

SEQ ID NO: 24336 - protein, 24 aa, Mycobacterium avium
LFYAVMTQLGFVAILIGLMVLSAA

SEQ ID NO: 24337 - protein, 17 aa, Mycobacterium avium
LFYHGRADDMFKVSGAT

SEQ ID NO: 24338 - protein, 25 aa, Mycobacterium avium
LGAIAIMLLLVYRSIVTTLVQLFMT

SEQ ID NO: 24339 - protein, 17 aa, Mycobacterium avium
LGALMIDWLISYGLAAL

SEQ ID NO: 24340 - protein, 26 aa, Mycobacterium avium
LGATVLLIAGLITGGLLLKSTGRLND

SEQ ID NO: 24341 - protein, 26 aa, Mycobacterium avium
LGAVFTLMLVSLNYDKLPFFHSDRTY

SEQ ID NO: 24342 - protein, 32 aa, Mycobacterium avium
LGAWFIIFQVTFFVFLIIPLVVLRTVTGADSP

SEQ ID NO: 24343 - protein, 19 aa, Mycobacterium avium
LGGAALVVALTRPTGGSST

SEQ ID NO: 24344 - protein, 23 aa, Mycobacterium avium
LGGLLDFLRATALTVVLLGLGAL

SEQ ID NO: 24345 - protein, 20 aa, Mycobacterium avium
LGLLVDTLIVRSFMTPSIAA

SEQ ID NO: 24346 - protein, 21 aa, Mycobacterium avium
LGLLVDTLIVRSFMTPSIAAA

SEQ ID NO: 24347 - protein, 44 aa, Mycobacterium avium
LGLMFDTLILRSFMTPTIAALLGRWFWWPQLVRRRPASQLLRSE

SEQ ID NO: 24348 - protein, 17 aa, Mycobacterium avium
LGLMLFIPPVRGAAAPR

SEQ ID NO: 24349 - protein, 21 aa, Mycobacterium avium
LGLMVFAYITAYLVLFCTAWA

SEQ ID NO: 24350 - protein, 28 aa, Mycobacterium avium
LGLTRIHPALLHTLSLAIALAIVVTLHV

SEQ ID NO: 24351 - protein, 17 aa, Mycobacterium avium
LGLVIWQGSLIGASYYA

SEQ ID NO: 24352 - protein, 27 aa, Mycobacterium avium
LGMLATPWLLYLTPWYTAALHNEWVGA

SEQ ID NO: 24353 - protein, 41 aa, Mycobacterium avium
LGQALRLSYMILLSIPVLAPLVLRLTLSIPALRRNAVDNIP

SEQ ID NO: 24354 - protein, 20 aa, Mycobacterium avium
LGRRELAAYAPLSLPNSDLH

SEQ ID NO: 24355 - protein, 18 aa, Mycobacterium avium
LGSYWGLLFVVPGTALLA

SEQ ID NO: 24356 - protein, 25 aa, Mycobacterium avium
LGTAAAALCPIWPAGARLLIRFTGP

SEQ ID NO: 24357 - protein, 24 aa, Mycobacterium avium
LGTVMPFWYAMTLLLLGSLAVQER

SEQ ID NO: 24358 - protein, 23 aa, Mycobacterium avium
LGVDLLYYAYHRIAHRVRLIWAT

SEQ ID NO: 24359 - protein, 31 aa, Mycobacterium avium
LGVLLGQLIGARPLDFLLGGQVGGWLLLVGA

SEQ ID NO: 24360 - protein, 30 aa, Mycobacterium avium
LGVPGWITQRLWWALLLTVGFWGLLRVAEA

SEQ ID NO: 24361 - protein, 18 aa, Mycobacterium avium
LGWVFVAVALGVLSPSLD

SEQ ID NO: 24362 - protein, 27 aa, Mycobacterium avium
LGYAAGCALAPVLLSLGTMAGAGGPTA

SEQ ID NO: 24363 - protein, 19 aa, Mycobacterium avium
LGYLAIIGVPPFAGFFSKD

SEQ ID NO: 24364 - protein, 22 aa, Mycobacterium avium
LGYLYFLLCLLVFRPSAPDRSG

SEQ ID NO: 24365 - protein, 20 aa, Mycobacterium avium
LGYRIMAWTTGLWLIALCYE

SEQ ID NO: 24366 - protein, 25 aa, Mycobacterium avium
LHDELFDACGWRRLVFATPEELEAT

SEQ ID NO: 24367 - protein, 20 aa, Mycobacterium avium
LHFPRSWPYMNISPNLEPAL

SEQ ID NO: 24368 - protein, 27 aa, Mycobacterium avium
LHLPQDAIRWTALVVLTVIGLGLIFPP

SEQ ID NO: 24369 - protein, 46 aa, Mycobacterium avium
LHLTRRTKIQLAIFTVISLSAASLMFFDYMQIPTVFFGVDRYTVTV

SEQ ID NO: 24370 - protein, 19 aa, Mycobacterium avium
LHPVLNLTSARLIVGKPVN

SEQ ID NO: 24371 - protein, 30 aa, Mycobacterium avium
LIAGVSALCLIFIIMLIMTRSFIAAMVIVG

SEQ ID NO: 24372 - protein, 26 aa, Mycobacterium avium
LIAVVTFMLLFLLTGSAVLPVQALVC

SEQ ID NO: 24373 - protein, 17 aa, Mycobacterium avium
LIDFAAGGLVLAAVLIV

SEQ ID NO: 24374 - protein, 19 aa, Mycobacterium avium
LIGARPLDFLLGGQVGGWL

SEQ ID NO: 24375 - protein, 30 aa, Mycobacterium avium
LIGLAAIVLYRVILYILKERYFASEEFLAH

SEQ ID NO: 24376 - protein, 21 aa, Mycobacterium avium
LIGLYLVYPLCIVVAGIAIVC

SEQ ID NO: 24377 - protein, 17 aa, Mycobacterium avium
LIHLVAAALWAGGLLAL

SEQ ID NO: 24378 - protein, 17 aa, Mycobacterium avium
LIHLVAAALWSGGLLAL

SEQ ID NO: 24379 - protein, 19 aa, Mycobacterium avium
LIPAFIEELLRVDGPVPFA

SEQ ID NO: 24380 - protein, 22 aa, Mycobacterium avium
LIPLCYVAFLGLEAYFCYFVIR

SEQ ID NO: 24381 - protein, 27 aa, Mycobacterium avium
LIPVRPDLPDVLLPQNYQPPKDLAPPP

SEQ ID NO: 24382 - protein, 21 aa, Mycobacterium avium
LIRARFPALTARQVMQRIEAT

SEQ ID NO: 24383 - protein, 27 aa, Mycobacterium avium
LISPQTLFFPFVLLLAATAMYRGNDNK

SEQ ID NO: 24384 - protein, 18 aa, Mycobacterium avium
LIVPTLVYLVVLGGASTL

SEQ ID NO: 24385 - protein, 19 aa, Mycobacterium avium
LIVPTLVYLVVLGGASTLI

SEQ ID NO: 24386 - protein, 20 aa, Mycobacterium avium
LIVPTLVYLVVLGGASTLIG

SEQ ID NO: 24387 - protein, 23 aa, Mycobacterium avium
LKARVIGFVQKPVVLASLAGVGA

SEQ ID NO: 24388 - protein, 34 aa, Mycobacterium avium
LKDLLINCGYPLIERFPLMLGTAGAVLAIGLVRW

SEQ ID NO: 24389 - protein, 23 aa, Mycobacterium avium
LKDYVAFPLLAGPFAPFVFTGNL

SEQ ID NO: 24390 - protein, 21 aa, Mycobacterium avium
LKHFNGFVTSLWLSPSDITTD

SEQ ID NO: 24391 - protein, 29 aa, Mycobacterium avium
LKMSLNTSYYRLMLKLKGGPQAVADAAHQ

SEQ ID NO: 24392 - protein, 22 aa, Mycobacterium avium
LKTVFADFPGLEVCVYAAPSQT

SEQ ID NO: 24393 - protein, 22 aa, Mycobacterium avium
LKVPLVELYALLWRVGVVEIRH

SEQ ID NO: 24394 - protein, 18 aa, Mycobacterium avium
LLAALALVAFVVVVQPTA

SEQ ID NO: 24395 - protein, 27 aa, Mycobacterium avium
LLAASLAVSGFLGWRQWQEHQVKAAGE

SEQ ID NO: 24396 - protein, 18 aa, Mycobacterium avium
LLALFVVQFPIVSTQGRL

SEQ ID NO: 24397 - protein, 24 aa, Mycobacterium avium
LLALLVGFECLFAKALKADPLLYP

SEQ ID NO: 24398 - protein, 18 aa, Mycobacterium avium
LLAQPLIGWAMLSAARFP

SEQ ID NO: 24399 - protein, 26 aa, Mycobacterium avium
LLAVRAARPILLRLGVLLVLLCAQAT

SEQ ID NO: 24400 - protein, 27 aa, Mycobacterium avium
LLAVRAARPILLRLGVLLVLLCTQAAV

SEQ ID NO: 24401 - protein, 17 aa, Mycobacterium avium
LLCWRDTGHPQGGGSEA

SEQ ID NO: 24402 - protein, 18 aa, Mycobacterium avium
LLDNISLTALPGTLTAII

SEQ ID NO: 24403 - protein, 19 aa, Mycobacterium avium
LLDVCWPASSVLIAMASWA

SEQ ID NO: 24404 - protein, 19 aa, Mycobacterium avium
LLEDFEQFGYYLVHNPALA

SEQ ID NO: 24405 - protein, 36 aa, Mycobacterium avium
LLERQLDLLLDGRKLLWWTLSRFTTLGNLPFRYEED

SEQ ID NO: 24406 - protein, 17 aa, Mycobacterium avium
LLGIFAFYLSFVAELPP

SEQ ID NO: 24407 - protein, 18 aa, Mycobacterium avium
LLGIFAFYLSFVAELPPP

SEQ ID NO: 24408 - protein, 19 aa, Mycobacterium avium
LLGIFAFYLSFVAELPPPP

SEQ ID NO: 24409 - protein, 17 aa, Mycobacterium avium
LLGMSLVAGPRPWHGPV

SEQ ID NO: 24410 - protein, 18 aa, Mycobacterium avium
LLIHLVAAALWAGGLLAL

SEQ ID NO: 24411 - protein, 28 aa, Mycobacterium avium
LLIMGLHPLMFFLPMWHGADSMMLRALV

SEQ ID NO: 24412 - protein, 18 aa, Mycobacterium avium
LLKGWYMSFWPVLSLALV

SEQ ID NO: 24413 - protein, 20 aa, Mycobacterium avium
LLLAAMVGVLYWFGAHPISG

SEQ ID NO: 24414 - protein, 18 aa, Mycobacterium avium
LLLAISCAILMLGPQAHD

SEQ ID NO: 24415 - protein, 41 aa, Mycobacterium avium
LLLDTLIVRTLLMPSIATLLGRWFWWPMVVHPRGDNARRPV

SEQ ID NO: 24416 - protein, 21 aa, Mycobacterium avium
LLLGLGVPWYFTQHATGSLPA

SEQ ID NO: 24417 - protein, 18 aa, Mycobacterium avium
LLLLVIYTGFIAGSGSGP

SEQ ID NO: 24418 - protein, 19 aa, Mycobacterium avium
LLLVALTDEKGLGPADEAV

SEQ ID NO: 24419 - protein, 17 aa, Mycobacterium avium
LLMTPGLAFFYGGMVRA

SEQ ID NO: 24420 - protein, 18 aa, Mycobacterium avium
LLPAIMVLAGPRGWIRPR

SEQ ID NO: 24421 - protein, 33 aa, Mycobacterium avium
LLPEAHRMRALIDDLLLLARADERNLLRRKELV

SEQ ID NO: 24422 - protein, 19 aa, Mycobacterium avium
LLSTALGLMLFIPPVRGAA

SEQ ID NO: 24423 - protein, 21 aa, Mycobacterium avium
LLVHFVLVLVPLTALLDIVCG

SEQ ID NO: 24424 - protein, 26 aa, Mycobacterium avium
LLVIPVSLILWRTFRPGFGQFYAWVS

SEQ ID NO: 24425 - protein, 25 aa, Mycobacterium avium
LLVNLPVLVFFPRGWSEFFRLNTRR

SEQ ID NO: 24426 - protein, 20 aa, Mycobacterium avium
LMCSAATMYSPARVTFFCIG

SEQ ID NO: 24427 - protein, 19 aa, Mycobacterium avium
LMFALAWLLLPDLPEYRTG

SEQ ID NO: 24428 - protein, 26 aa, Mycobacterium avium
LMGSLLLPVFLLFCYQIVLGEQVHRV

SEQ ID NO: 24429 - protein, 18 aa, Mycobacterium avium
LMGVILLGVALLAMHLLI

SEQ ID NO: 24430 - protein, 19 aa, Mycobacterium avium
LMGVILLGVALLAMHLLIP

SEQ ID NO: 24431 - protein, 23 aa, Mycobacterium avium
LMNNPFFQSLFSGFDPWLPSLGN

SEQ ID NO: 24432 - protein, 30 aa, Mycobacterium avium
LMSGFVYNFTLYGLVLVYSYVFQSARGYSP

SEQ ID NO: 24433 - protein, 17 aa, Mycobacterium avium
LMTLCIPGALFMLGCFF

SEQ ID NO: 24434 - protein, 18 aa, Mycobacterium avium
LMTNPLLRRFNDLQATTL

SEQ ID NO: 24435 - protein, 17 aa, Mycobacterium avium
LNGWVGYFPTVLAAWNQ

SEQ ID NO: 24436 - protein, 18 aa, Mycobacterium avium
LNGWVGYFPTVLAAWNQL

SEQ ID NO: 24437 - protein, 25 aa, Mycobacterium avium
LNPCGFAMLPAYLLLVVRGAGARAP

SEQ ID NO: 24438 - protein, 25 aa, Mycobacterium avium
LNPCGFAMLPAYLLLVVRGAGTRAP

SEQ ID NO: 24439 - protein, 18 aa, Mycobacterium avium
LPAYWQQELPPGGDPHAP

SEQ ID NO: 24440 - protein, 26 aa, Mycobacterium avium
LPDTKGALASWLPPGAAAVADYPTVL

SEQ ID NO: 24441 - protein, 25 aa, Mycobacterium avium
LPHTEWLPRRRTLQPVFTRQRVREF

SEQ ID NO: 24442 - protein, 23 aa, Mycobacterium avium
LPISVVAAWRYRSWRPVLLAVVA

SEQ ID NO: 24443 - protein, 20 aa, Mycobacterium avium
LPKLIHLACIWIVAIGVNAS

SEQ ID NO: 24444 - protein, 27 aa, Mycobacterium avium
LPKVGPWALYGLLFTIVILFALQGAQI

SEQ ID NO: 24445 - protein, 22 aa, Mycobacterium avium
LPMMLAPWVLLPTILALRATGP

SEQ ID NO: 24446 - protein, 28 aa, Mycobacterium avium
LPNWVEAAVTFWASALLSAVVVPIVHFY

SEQ ID NO: 24447 - protein, 17 aa, Mycobacterium avium
LPPMLVLTWSGLRAGEC

SEQ ID NO: 24448 - protein, 38 aa, Mycobacterium avium
LPRVIPPSFLRRAMPYVLVILIVGMIVALFATGMRLIS

SEQ ID NO: 24449 - protein, 39 aa, Mycobacterium avium
LPRVIPPSFLRRAMPYVLVILIVGMIVALFATGMRLISP

SEQ ID NO: 24450 - protein, 27 aa, Mycobacterium avium
LPSRVFGWLALVFGVGFSTLALVTRRW

SEQ ID NO: 24451 - protein, 30 aa, Mycobacterium avium
LPVLAAVPRPPLGPVWVALLIIGASSGVAV

SEQ ID NO: 24452 - protein, 29 aa, Mycobacterium avium
LPVLGWWAFNIFYVTPFLAIPYLHTVNRE

SEQ ID NO: 24453 - protein, 23 aa, Mycobacterium avium
LPVLLAGFCAGFLLLRGRSYVDR

SEQ ID NO: 24454 - protein, 24 aa, Mycobacterium avium
LPVNLPLPTKIVTQVLPPVDIVAE

SEQ ID NO: 24455 - protein, 18 aa, Mycobacterium avium
LPVVGLALGALAAAVAWG

SEQ ID NO: 24456 - protein, 25 aa, Mycobacterium avium
LPVVGLALGALAAAVAWGGAVVFGR

SEQ ID NO: 24457 - protein, 19 aa, Mycobacterium avium
LQALLGAAHWNSDDKAVLR

SEQ ID NO: 24458 - protein, 27 aa, Mycobacterium avium
LQTVGNRRTWLVRRFRVAAEGIADVEV

SEQ ID NO: 24459 - protein, 21 aa, Mycobacterium avium
LQVLLGFSRIARAVLAISPVV

SEQ ID NO: 24460 - protein, 24 aa, Mycobacterium avium
LRDIVLGVVRRPAAAHRRPRGGRG

SEQ ID NO: 24461 - protein, 25 aa, Mycobacterium avium
LREFGNIVFHFSLLGLLVAVAVGKL

SEQ ID NO: 24462 - protein, 21 aa, Mycobacterium avium
LRGLMIAAGIVTLLIAALLLI

SEQ ID NO: 24463 - protein, 20 aa, Mycobacterium avium
LRILPGYYVCLIVTAFAVAP

SEQ ID NO: 24464 - protein, 17 aa, Mycobacterium avium
LRLARNYIPLRGTGKVA

SEQ ID NO: 24465 - protein, 23 aa, Mycobacterium avium
LRNYLLPLGALLLFLVQASGIPA

SEQ ID NO: 24466 - protein, 18 aa, Mycobacterium avium
LRPGSLQALLPPEQRARP

SEQ ID NO: 24467 - protein, 18 aa, Mycobacterium avium
LRPIPFVVGTRVLGGLMC

SEQ ID NO: 24468 - protein, 20 aa, Mycobacterium avium
LRPLRAPEWLPTPSRRRARA

SEQ ID NO: 24469 - protein, 21 aa, Mycobacterium avium
LRRMVPFVDRISGAVLVLVGL

SEQ ID NO: 24470 - protein, 26 aa, Mycobacterium avium
LRTRGRWLRWGLLSVWGPGLVVMLAD

SEQ ID NO: 24471 - protein, 18 aa, Mycobacterium avium
LRTRIHGLLGALPAGDGP

SEQ ID NO: 24472 - protein, 17 aa, Mycobacterium avium
LRTSAWTPVLPASSLNG

SEQ ID NO: 24473 - protein, 29 aa, Mycobacterium avium
LRVGAIILHPYIELRLRKSFFAEPELRRW

SEQ ID NO: 24474 - protein, 17 aa, Mycobacterium avium
LRWGLIFTAGCAFWAVL

SEQ ID NO: 24475 - protein, 18 aa, Mycobacterium avium
LSAGLLAPPAGAQPPLRL

SEQ ID NO: 24476 - protein, 29 aa, Mycobacterium avium
LSDEPAPAALWLWVMLTGTAVAVLVLGWR

SEQ ID NO: 24477 - protein, 27 aa, Mycobacterium avium
LSFLLRPGWVVLALVVVAFAYLCFTVL

SEQ ID NO: 24478 - protein, 18 aa, Mycobacterium avium
LSGFLITSLLLDELGRTG

SEQ ID NO: 24479 - protein, 17 aa, Mycobacterium avium
LSGLSINHFIAVDFAGF

SEQ ID NO: 24480 - protein, 22 aa, Mycobacterium avium
LSGLSINHFIAVDFAGFAKMVD

SEQ ID NO: 24481 - protein, 23 aa, Mycobacterium avium
LSGLSINHFIAVDFAGFAKMVDA

SEQ ID NO: 24482 - protein, 21 aa, Mycobacterium avium
LSIDYAIFVIAIIGAAESFGL

SEQ ID NO: 24483 - protein, 17 aa, Mycobacterium avium
LSLFGVHLLAKTAGPLK

SEQ ID NO: 24484 - protein, 35 aa, Mycobacterium avium
LSLVAAAGVPVVFLTALYGLSVLSGLRPGERVLVH

SEQ ID NO: 24485 - protein, 26 aa, Mycobacterium avium
LSMDYEIFLLTRIRERFLHSGNTRDA

SEQ ID NO: 24486 - protein, 25 aa, Mycobacterium avium
LSMDYEVFLLSRIREYWLASGAARP

SEQ ID NO: 24487 - protein, 26 aa, Mycobacterium avium
LSNFDAPYLVWVPAALLVLLGVLLAA

SEQ ID NO: 24488 - protein, 20 aa, Mycobacterium avium
LSRGEWLAKALRMDKLLRTK

SEQ ID NO: 24489 - protein, 24 aa, Mycobacterium avium
LSTSAYLLAKVCIYTVFAIVQSAI

SEQ ID NO: 24490 - protein, 24 aa, Mycobacterium avium
LSYGVYIYAFPVQQLLAVCGLAPA

SEQ ID NO: 24491 - protein, 17 aa, Mycobacterium avium
LTAFATLAAQLLVVRPF

SEQ ID NO: 24492 - protein, 22 aa, Mycobacterium avium
LTDAFSRMIIGWRVASHMRTTV

SEQ ID NO: 24493 - protein, 26 aa, Mycobacterium avium
LTELARELRPWVPVVSLVKGLEQGTN

SEQ ID NO: 24494 - protein, 24 aa, Mycobacterium avium
LTEVSWRLAFLVNVPIGLVMMYLA

SEQ ID NO: 24495 - protein, 18 aa, Mycobacterium avium
LTGPYRQSNLRGAYEKAM

SEQ ID NO: 24496 - protein, 22 aa, Mycobacterium avium
LTHVFAGFYIAGCVAAVLAVRQ

SEQ ID NO: 24497 - protein, 23 aa, Mycobacterium avium
LTHVFAGFYIAGCVAAVLAVRQD

SEQ ID NO: 24498 - protein, 18 aa, Mycobacterium avium
LTIPKPVPHRDMVPIWVA

SEQ ID NO: 24499 - protein, 18 aa, Mycobacterium avium
LTIPKPVPRRDMVPIWVA

SEQ ID NO: 24500 - protein, 18 aa, Mycobacterium avium
LTNNTVVAYFPAANALYP

SEQ ID NO: 24501 - protein, 19 aa, Mycobacterium avium
LTNNTVVAYFPAANALYPG

SEQ ID NO: 24502 - protein, 24 aa, Mycobacterium avium
LTPIAVNGWQQGWLVPAGAPGVIT

SEQ ID NO: 24503 - protein, 31 aa, Mycobacterium avium
LTQLTVRGWLALVLWIMGTTVLIGALVGAVL

SEQ ID NO: 24504 - protein, 31 aa, Mycobacterium avium
LTQLTVRGWLALVLWIMGTTVLVGAVLLHRT

SEQ ID NO: 24505 - protein, 23 aa, Mycobacterium avium
LTRILFDWRFDLIFGTAAIVLAG

SEQ ID NO: 24506 - protein, 17 aa, Mycobacterium avium
LTTVFLVDIVIMVVASH

SEQ ID NO: 24507 - protein, 19 aa, Mycobacterium avium
LTVLLLAPDVYWPLRRIGV

SEQ ID NO: 24508 - protein, 40 aa, Mycobacterium avium
LVAFGILTVISLLVLGIYYLQIPSLVGIGRYTLKAELPAS

SEQ ID NO: 24509 - protein, 29 aa, Mycobacterium avium
LVALICVPPIALSPWPATVFTTLLAALAV

SEQ ID NO: 24510 - protein, 18 aa, Mycobacterium avium
LVALPIGVTLSIQFALLA

SEQ ID NO: 24511 - protein, 17 aa, Mycobacterium avium
LVALTRAPLGLHPPRLW

SEQ ID NO: 24512 - protein, 28 aa, Mycobacterium avium
LVDGLGWQWIFFVNVPIGVLGLALAYWL

SEQ ID NO: 24513 - protein, 20 aa, Mycobacterium avium
LVEPTILLAVFALSIPAGSA

SEQ ID NO: 24514 - protein, 17 aa, Mycobacterium avium
LVFTLRALLYKPFVRQI

SEQ ID NO: 24515 - protein, 20 aa, Mycobacterium avium
LVGALITLAPFTLGLLTAFT

SEQ ID NO: 24516 - protein, 23 aa, Mycobacterium avium
LVGSGVDVPLIKPALEAATSLEL

SEQ ID NO: 24517 - protein, 18 aa, Mycobacterium avium
LVGWSFVGPRLPAGARMV

SEQ ID NO: 24518 - protein, 18 aa, Mycobacterium avium
LVILMRYRGLGWADLGLG

SEQ ID NO: 24519 - protein, 20 aa, Mycobacterium avium
LVIMDLRDHWMAKAPYILGD

SEQ ID NO: 24520 - protein, 17 aa, Mycobacterium avium
LVIVAVIAVAGLCVSRL

SEQ ID NO: 24521 - protein, 17 aa, Mycobacterium avium
LVIVFIETGLLFPLLPG

SEQ ID NO: 24522 - protein, 17 aa, Mycobacterium avium
LVKPYAGDRWWVLVLHL

SEQ ID NO: 24523 - protein, 17 aa, Mycobacterium avium
LVKRGWMVLVVVVVVGV

SEQ ID NO: 24524 - protein, 19 aa, Mycobacterium avium
LVLGALAFLFLASTVLVVC

SEQ ID NO: 24525 - protein, 17 aa, Mycobacterium avium
LVLLCEINPLVLSTILA

SEQ ID NO: 24526 - protein, 18 aa, Mycobacterium avium
LVLLGWRVAAGLTLRRRS

SEQ ID NO: 24527 - protein, 18 aa, Mycobacterium avium
LVLLLFPVGAMTSLVLLS

SEQ ID NO: 24528 - protein, 18 aa, Mycobacterium avium
LVLLNVGAVFMGTALTIR

SEQ ID NO: 24529 - protein, 19 aa, Mycobacterium avium
LVLSRLRLVSVGVPVAIGL

SEQ ID NO: 24530 - protein, 23 aa, Mycobacterium avium
LVLYGCAFLLQALGAIGVIRDVR

SEQ ID NO: 24531 - protein, 25 aa, Mycobacterium avium
LVPSPTCIIVGLPAGLRLAVDNAIA

SEQ ID NO: 24532 - protein, 17 aa, Mycobacterium avium
LVQPLTLGRHHDWVILV

SEQ ID NO: 24533 - protein, 20 aa, Mycobacterium avium
LVRSGLLNPPSPRAVLRLLR

SEQ ID NO: 24534 - protein, 26 aa, Mycobacterium avium
LVSMWGLQQISWLVPARWGFAASAST

SEQ ID NO: 24535 - protein, 27 aa, Mycobacterium avium
LVSMWGLQQISWLVPARWGFAASASTV

SEQ ID NO: 24536 - protein, 17 aa, Mycobacterium avium
LVTFTVASNLRLGERTE

SEQ ID NO: 24537 - protein, 19 aa, Mycobacterium avium
LVVLAPAWSRRLADRGWPK

SEQ ID NO: 24538 - protein, 32 aa, Mycobacterium avium
LVVMDWLELSWRWLFGLSIVPALISLIIRYRV

SEQ ID NO: 24539 - protein, 18 aa, Mycobacterium avium
LWIMGTTVLIGALVGAVL

SEQ ID NO: 24540 - protein, 17 aa, Mycobacterium avium
LWQQLPALIWPVFGRDT

SEQ ID NO: 24541 - protein, 20 aa, Mycobacterium avium
LWRLAIYVVVSVLGMFTLVA

SEQ ID NO: 24542 - protein, 21 aa, Mycobacterium avium
LWVTDLTFVPTWAGVAYVCFL

SEQ ID NO: 24543 - protein, 23 aa, Mycobacterium avium
LYNPRSWWQSIIVWFAAAVVGHD

SEQ ID NO: 24544 - protein, 29 aa, Mycobacterium avium
LYRAGLAVGLALLPVLALLACWRTRKRGT

SEQ ID NO: 24545 - protein, 25 aa, Mycobacterium avium
LYTDRHIRLWVVYVDTFSGQTATRW

SEQ ID NO: 24546 - protein, 22 aa, Mycobacterium avium
LYWAAAVVFGLPLLLIVLTEWH

SEQ ID NO: 24547 - protein, 22 aa, Mycobacterium avium
LYWATAVVFGLPLLLIVLTEWH

SEQ ID NO: 24548 - protein, 25 aa, Mycobacterium avium
MAISAWLLTRWLIPGWTGRVLVWAL

SEQ ID NO: 24549 - protein, 24 aa, Mycobacterium avium
MALGFLTVFGLFGALTVSAAGAVQ

SEQ ID NO: 24550 - protein, 19 aa, Mycobacterium avium
MAPPPGEPKSPRGLWIAAG

SEQ ID NO: 24551 - protein, 18 aa, Mycobacterium avium
MATALAPLTVVIASVVHS

SEQ ID NO: 24552 - protein, 20 aa, Mycobacterium avium
MAWATPARWGFAASASTADL

SEQ ID NO: 24553 - protein, 26 aa, Mycobacterium avium
MCVVPGFLLTLIVSFFTCDLIIGSRT

SEQ ID NO: 24554 - protein, 18 aa, Mycobacterium avium
MEFGLTMPIAREVDAVIN

SEQ ID NO: 24555 - protein, 23 aa, Mycobacterium avium
MESIAIRPIPYLVTTRLIASVVA

SEQ ID NO: 24556 - protein, 18 aa, Mycobacterium avium
MEVLERVAPPHPSRWRHV

SEQ ID NO: 24557 - protein, 20 aa, Mycobacterium avium
MFDAGYFWHYNELWIGGAAG

SEQ ID NO: 24558 - protein, 20 aa, Mycobacterium avium
MFDAGYFWHYNELWIGGSAG

SEQ ID NO: 24559 - protein, 30 aa, Mycobacterium avium
MGEGEAMLFGEYIRFMALVEYSADELKTVF

SEQ ID NO: 24560 - protein, 31 aa, Mycobacterium avium
MGHARPLYGPGLRFLIPLLDKMIRVDQRLVT

SEQ ID NO: 24561 - protein, 31 aa, Mycobacterium avium
MGHARPLYGPGLRWLIPLVDKMIRVDQRVVT

SEQ ID NO: 24562 - protein, 17 aa, Mycobacterium avium
MIGIPLALGSYWGLLFV

SEQ ID NO: 24563 - protein, 24 aa, Mycobacterium avium
MIMMSFISIPLVTVAWLLVGYTMA

SEQ ID NO: 24564 - protein, 32 aa, Mycobacterium avium
MITFGVIIVMLLWVYRSIVTVLITLMMVGVEL

SEQ ID NO: 24565 - protein, 26 aa, Mycobacterium avium
MITVLLPPVLVLTWSGLRAGECRAGG

SEQ ID NO: 24566 - protein, 20 aa, Mycobacterium avium
MIVALFATGMRLISPQTLFF

SEQ ID NO: 24567 - protein, 23 aa, Mycobacterium avium
MLGGIIIGDLLSSGMRGGFGGWS

SEQ ID NO: 24568 - protein, 17 aa, Mycobacterium avium
MLNLFIATLVLTIPLAW

SEQ ID NO: 24569 - protein, 19 aa, Mycobacterium avium
MLQRKLRVGFAKAGRLMDL

SEQ ID NO: 24570 - protein, 17 aa, Mycobacterium avium
MLVLAGREPTSGTIERP

SEQ ID NO: 24571 - protein, 17 aa, Mycobacterium avium
MLVNIPANRKRVVAVSF

SEQ ID NO: 24572 - protein, 17 aa, Mycobacterium avium
MLWFQLQHHGTVPSAVG

SEQ ID NO: 24573 - protein, 27 aa, Mycobacterium avium
MMPLGYLNLAIWLIPAMFGVAYRRGLL

SEQ ID NO: 24574 - protein, 20 aa, Mycobacterium avium
MPIDLSWELWAYGVFAIAAV

SEQ ID NO: 24575 - protein, 22 aa, Mycobacterium avium
MPIDLSWELWAYGVFAIAAVGI

SEQ ID NO: 24576 - protein, 20 aa, Mycobacterium avium
MPSWWPLNMTWGGLPLFVPI

SEQ ID NO: 24577 - protein, 29 aa, Mycobacterium avium
MRKRFGSTLGYRLVIYPTYAALDRPDPSD

SEQ ID NO: 24578 - protein, 30 aa, Mycobacterium avium
MRLISPQTLFFPFVLLLAATAMYRGNDNKT

SEQ ID NO: 24579 - protein, 30 aa, Mycobacterium avium
MRMRGHDGWTAYLLPVAIDVLAAAAAYALV

SEQ ID NO: 24580 - protein, 31 aa, Mycobacterium avium
MRRCTRLFRPVFYYLAFWAVTLTVLYQALPQ

SEQ ID NO: 24581 - protein, 31 aa, Mycobacterium avium
MRRCTRLFRPVFYYLAFWAVTLTVLYQGLPQ

SEQ ID NO: 24582 - protein, 30 aa, Mycobacterium avium
MRRCTRLFRPVFYYLVFWAVMLTVLYQALP

SEQ ID NO: 24583 - protein, 45 aa, Mycobacterium avium
MRRIADFVVRWPWLVIGFWAALAVALPLAFPSLAEMAQKHPLAIL

SEQ ID NO: 24584 - protein, 28 aa, Mycobacterium avium
MSAHFTFGLALLAGLYVAASPWIVGFSA

SEQ ID NO: 24585 - protein, 28 aa, Mycobacterium avium
MSDFEDFWRPLRSYFYWEKHCYDIPICW

SEQ ID NO: 24586 - protein, 23 aa, Mycobacterium avium
MSLLLTVFPGWVAIGLATALAAA

SEQ ID NO: 24587 - protein, 26 aa, Mycobacterium avium
MSQPELLAPALLLAAAPFAAVGGFAG

SEQ ID NO: 24588 - protein, 29 aa, Mycobacterium avium
MTALTDWLFSHTLYRHPNLKIGLSEGGIG

SEQ ID NO: 24589 - protein, 17 aa, Mycobacterium avium
MTEVLVPHHPGDTIAVH

SEQ ID NO: 24590 - protein, 25 aa, Mycobacterium avium
MTHYTPLLVALPLAGAAILLFGGRR

SEQ ID NO: 24591 - protein, 26 aa, Mycobacterium avium
MTLSGFYSHPWAWNEIGFGGPAYPRG

SEQ ID NO: 24592 - protein, 31 aa, Mycobacterium avium
MTSIAQPLTSLSLQCKLPISIPQALGMVQQA

SEQ ID NO: 24593 - protein, 25 aa, Mycobacterium avium
MVRAFAIPIIFFWGLLAVTTNTFMP

SEQ ID NO: 24594 - protein, 24 aa, Mycobacterium avium
MVTAAYVLITFWQYRNACVTAPGL

SEQ ID NO: 24595 - protein, 18 aa, Mycobacterium avium
MVVNPILPSLRDHDLRFI

SEQ ID NO: 24596 - protein, 26 aa, Mycobacterium avium
MWIGYRHGWGWLARMDWSFLNGTRDL

SEQ ID NO: 24597 - protein, 19 aa, Mycobacterium avium
MWRRRPTGPDFCVVRVGMG

SEQ ID NO: 24598 - protein, 41 aa, Mycobacterium avium
NAGALALRLLTIGGCVLLYLTPLILGLWRGETSHDRRAAAR

SEQ ID NO: 24599 - protein, 41 aa, Mycobacterium avium
NAGALTLRLLTIGGCVLLYLTPLILGLWRGETSHDRRAAAR

SEQ ID NO: 24600 - protein, 26 aa, Mycobacterium avium
NARDFLRIDIIIFGLTIYALLGIITD

SEQ ID NO: 24601 - protein, 24 aa, Mycobacterium avium
NAYGKVLFAITLSAAAVLVLLAGR

SEQ ID NO: 24602 - protein, 25 aa, Mycobacterium avium
NAYGKVLFAITLSAAAVLVLLAGRR

SEQ ID NO: 24603 - protein, 26 aa, Mycobacterium avium
NDDEAGPRILRPLLRVAGIGPEPDSA

SEQ ID NO: 24604 - protein, 23 aa, Mycobacterium avium
NDGWIAMLAFVLVPVTISAGMAT

SEQ ID NO: 24605 - protein, 18 aa, Mycobacterium avium
NDYFREIATRFEYRDALL

SEQ ID NO: 24606 - protein, 17 aa, Mycobacterium avium
NDYSLIPAFIEELLRVD

SEQ ID NO: 24607 - protein, 24 aa, Mycobacterium avium
NEQIMPLLVVAVMSQLVFSGGMIP

SEQ ID NO: 24608 - protein, 20 aa, Mycobacterium avium
NFLNRRIGPALAASGAPPGA

SEQ ID NO: 24609 - protein, 23 aa, Mycobacterium avium
NFRSRPYSAWLAYSQSKLANLLF

SEQ ID NO: 24610 - protein, 23 aa, Mycobacterium avium
NGTPGKFMPILPSQQQAPLPPPP

SEQ ID NO: 24611 - protein, 24 aa, Mycobacterium avium
NGTPGKFMPILPSQQQAPLPPPPA

SEQ ID NO: 24612 - protein, 26 aa, Mycobacterium avium
NIAAWTIVWCLVLLSLALTATTFFPD

SEQ ID NO: 24613 - protein, 29 aa, Mycobacterium avium
NIDATLIRMLVIFGIVTVIALAAATIAGV

SEQ ID NO: 24614 - protein, 18 aa, Mycobacterium avium
NIIVTPDDFAYLVDFGIA

SEQ ID NO: 24615 - protein, 18 aa, Mycobacterium avium
NIPPTRFKRKEHWLDVHF

SEQ ID NO: 24616 - protein, 20 aa, Mycobacterium avium
NIQYDYIFGFSFYTAHYFGA

SEQ ID NO: 24617 - protein, 24 aa, Mycobacterium avium
NLRGPRPLDPPPAPPKPGPDAFSG

SEQ ID NO: 24618 - protein, 25 aa, Mycobacterium avium
NLRGPRPLDPPPPTPPKPGPDAFSG

SEQ ID NO: 24619 - protein, 26 aa, Mycobacterium avium
NLVGDRYLELIIGPGSMRVLPEGSQI

SEQ ID NO: 24620 - protein, 17 aa, Mycobacterium avium
NLWVGYFPTVQSAWSQL

SEQ ID NO: 24621 - protein, 21 aa, Mycobacterium avium
NMFDAGYFWHYNELWIGGAAG

SEQ ID NO: 24622 - protein, 24 aa, Mycobacterium avium
NMTGNVIFLGFWLAPRTSIDLTAV

SEQ ID NO: 24623 - protein, 18 aa, Mycobacterium avium
NPAGLPPTPGIPIAGRPG

SEQ ID NO: 24624 - protein, 22 aa, Mycobacterium avium
NPATIAWTLLFTTIEVIGTVIT

SEQ ID NO: 24625 - protein, 27 aa, Mycobacterium avium
NPGQLWRSFELYALVFCGVAGMIYHQS

SEQ ID NO: 24626 - protein, 43 aa, Mycobacterium avium
NPNPGWAPNPNPLVPVPIPIPVPIPGWNPPYNPPYTPPYNPTT

SEQ ID NO: 24627 - protein, 24 aa, Mycobacterium avium
NPPAFILKHYFGEFMKHVGVELSP

SEQ ID NO: 24628 - protein, 32 aa, Mycobacterium avium
NPTAWTNWLEVFLILVIGFSLPRTFGRMVGNP

SEQ ID NO: 24629 - protein, 17 aa, Mycobacterium avium
NQLFLSRGEWLAKALRM

SEQ ID NO: 24630 - protein, 24 aa, Mycobacterium avium
NSDRKAFTRLLLGCTTVSLAGNVA

SEQ ID NO: 24631 - protein, 22 aa, Mycobacterium avium
NSKFTVSLLWPGDRAWRQGGDR

SEQ ID NO: 24632 - protein, 25 aa, Mycobacterium avium
NSPDVLNLLLIDFKGGATFLDYANA

SEQ ID NO: 24633 - protein, 17 aa, Mycobacterium avium
NVALPWTLSVITTLPSM

SEQ ID NO: 24634 - protein, 18 aa, Mycobacterium avium
NVFAIAVGMGYSLGIALV

SEQ ID NO: 24635 - protein, 33 aa, Mycobacterium avium
NVFAVRLRWDPYPFILLNLAFSTQAAYAAPLIL

SEQ ID NO: 24636 - protein, 20 aa, Mycobacterium avium
NVRELIEITLVKNPAMRYRS

SEQ ID NO: 24637 - protein, 35 aa, Mycobacterium avium
NVVAALIFAIVPWLHRFGDLVAPLTFLGAAYVTVF

SEQ ID NO: 24638 - protein, 20 aa, Mycobacterium avium
NWHEAAVIYLAATLAGMVVN

SEQ ID NO: 24639 - protein, 28 aa, Mycobacterium avium
PAAAIALFQAVVLYCVVRFALGMHAVHP

SEQ ID NO: 24640 - protein, 22 aa, Mycobacterium avium
PAAAVLLVGTALMIGLTAQNKS

SEQ ID NO: 24641 - protein, 28 aa, Mycobacterium avium
PAAIAVAIVPVSWQLGLAALGGLPLMLG

SEQ ID NO: 24642 - protein, 27 aa, Mycobacterium avium
PAAIAVALVPVSWQLGLAALGGLPLML

SEQ ID NO: 24643 - protein, 28 aa, Mycobacterium avium
PAAIAVALVPVSWQLGLAALGGLPLMLG

SEQ ID NO: 24644 - protein, 23 aa, Mycobacterium avium
PAAKIPTRLFAGAALPMAQGSSA

SEQ ID NO: 24645 - protein, 24 aa, Mycobacterium avium
PADLQALLVPTAPQSGPAPAGGAP

SEQ ID NO: 24646 - protein, 18 aa, Mycobacterium avium
PADLVRFLNRLYIAFDDL

SEQ ID NO: 24647 - protein, 31 aa, Mycobacterium avium
PAGARLLIRFTGPELWWVGGVAHRAAGLPGA

SEQ ID NO: 24648 - protein, 29 aa, Mycobacterium avium
PAGRLVLWTLFWLGWVIALAATFMVSHFD

SEQ ID NO: 24649 - protein, 17 aa, Mycobacterium avium
PAHVSFMRMLGLGLTLG

SEQ ID NO: 24650 - protein, 20 aa, Mycobacterium avium
PAILPLLTVSVVPLVVPTLV

SEQ ID NO: 24651 - protein, 17 aa, Mycobacterium avium
PAIPRMPSWWPLNMTWG

SEQ ID NO: 24652 - protein, 40 aa, Mycobacterium avium
PAKKKRRFLRDPVSVLLIFIIVFALLIAGFIGAELYVRHV

SEQ ID NO: 24653 - protein, 27 aa, Mycobacterium avium
PAKQWGFFILLFLLLAPGLNRWFFGIV

SEQ ID NO: 24654 - protein, 25 aa, Mycobacterium avium
PALVMFAIIFFWTPPHTWALAMRYK

SEQ ID NO: 24655 - protein, 22 aa, Mycobacterium avium
PANYFRSFAIRKQGVAVIDVPV

SEQ ID NO: 24656 - protein, 25 aa, Mycobacterium avium
PAPAPDWLLLRIPVGTVWSEEAAFR

SEQ ID NO: 24657 - protein, 26 aa, Mycobacterium avium
PAPGRPAPPLPAFVAPPDLGANCQYR

SEQ ID NO: 24658 - protein, 27 aa, Mycobacterium avium
PAPGRPAPPLPAFVAPPDLGANCQYRA

SEQ ID NO: 24659 - protein, 29 aa, Mycobacterium avium
PARGRLVTMLLVGVVLMAAGYSGGLGSPA

SEQ ID NO: 24660 - protein, 23 aa, Mycobacterium avium
PASPRWRPTVALLTAVVLVTTGA

SEQ ID NO: 24661 - protein, 24 aa, Mycobacterium avium
PASPRWRPTVALLTAVVLVTTGAL

SEQ ID NO: 24662 - protein, 20 aa, Mycobacterium avium
PATIAWTLLFTTIEVIGTVI

SEQ ID NO: 24663 - protein, 27 aa, Mycobacterium avium
PAVEDKWLPKPARPAPPWPTAQREVCA

SEQ ID NO: 24664 - protein, 27 aa, Mycobacterium avium
PAYEPPPIPVPVQSPLVLPPPNAGQGA

SEQ ID NO: 24665 - protein, 17 aa, Mycobacterium avium
PCHAGYLSVSGKDNTVT

SEQ ID NO: 24666 - protein, 18 aa, Mycobacterium avium
PCHAGYLSVSGKDNTVTL

SEQ ID NO: 24667 - protein, 18 aa, Mycobacterium avium
PDDWRRWYRLARAYDYAG

SEQ ID NO: 24668 - protein, 31 aa, Mycobacterium avium
PDEIEFRTRLWLPYLPLILAAAVGWGHAAGK

SEQ ID NO: 24669 - protein, 17 aa, Mycobacterium avium
PDGARLWLPTYLAWFLA

SEQ ID NO: 24670 - protein, 19 aa, Mycobacterium avium
PDGARLWLPTYLAWFLAGM

SEQ ID NO: 24671 - protein, 22 aa, Mycobacterium avium
PDGARLWLPTYLAWFLAGMMLT

SEQ ID NO: 24672 - protein, 20 aa, Mycobacterium avium
PDGSIDILVALRVKVASDQS

SEQ ID NO: 24673 - protein, 21 aa, Mycobacterium avium
PDLDWQSVWDRGWTLAAAAED

SEQ ID NO: 24674 - protein, 28 aa, Mycobacterium avium
PDLENPDWSWLKWLPHIDIPGELDGVGP

SEQ ID NO: 24675 - protein, 24 aa, Mycobacterium avium
PDRDLLLFCTLVVVLVTLIGQGVT

SEQ ID NO: 24676 - protein, 20 aa, Mycobacterium avium
PDTRLRKDLTWWDLVVFGVA

SEQ ID NO: 24677 - protein, 26 aa, Mycobacterium avium
PDVAVRGAAFCLVALTLAAAAGAVRA

SEQ ID NO: 24678 - protein, 20 aa, Mycobacterium avium
PDVLNLLLVDFKGGATFLDY

SEQ ID NO: 24679 - protein, 26 aa, Mycobacterium avium
PDVVAQRYRGARYRAFDLMEACPDRT

SEQ ID NO: 24680 - protein, 24 aa, Mycobacterium avium
PEAPPAAPPPPPPPAPEAPPGGPP

SEQ ID NO: 24681 - protein, 18 aa, Mycobacterium avium
PEEPLMPPRPQQPAPLRR

SEQ ID NO: 24682 - protein, 18 aa, Mycobacterium avium
PEEPLMPPRPQQPAPPRR

SEQ ID NO: 24683 - protein, 19 aa, Mycobacterium avium
PEFVPWLLVALTGMIFQQS

SEQ ID NO: 24684 - protein, 24 aa, Mycobacterium avium
PELASLRRRLVTAIALAGPVIAVA

SEQ ID NO: 24685 - protein, 21 aa, Mycobacterium avium
PELASLRRRLVTATALAGPVI

SEQ ID NO: 24686 - protein, 23 aa, Mycobacterium avium
PEPVLPHEDWVLTRPRLTGICGS

SEQ ID NO: 24687 - protein, 22 aa, Mycobacterium avium
PEVLASRHHATLIPTPAGTEIH

SEQ ID NO: 24688 - protein, 20 aa, Mycobacterium avium
PFIIGAIGLGAVFTLMLVSL

SEQ ID NO: 24689 - protein, 22 aa, Mycobacterium avium
PFLPLVQLGGVALLSFAITLVG

SEQ ID NO: 24690 - protein, 20 aa, Mycobacterium avium
PFQLPKLPCILPAPFCPPST

SEQ ID NO: 24691 - protein, 17 aa, Mycobacterium avium
PFTSWQPPGVPPVPPQL

SEQ ID NO: 24692 - protein, 17 aa, Mycobacterium avium
PGGPGLIIPMPPGGPGG

SEQ ID NO: 24693 - protein, 25 aa, Mycobacterium avium
PGLNRWFFGIVYWLFDFSGVPHWLA

SEQ ID NO: 24694 - protein, 25 aa, Mycobacterium avium
PGMAAPPVRLLPTNLAPHAVGALYR

SEQ ID NO: 24695 - protein, 22 aa, Mycobacterium avium
PGNLIAVLRNGAVIGSAVFSED

SEQ ID NO: 24696 - protein, 19 aa, Mycobacterium avium
PGNSLIEWLRLPGDFVFIL

SEQ ID NO: 24697 - protein, 18 aa, Mycobacterium avium
PGPVAALLLGLMSGSLWG

SEQ ID NO: 24698 - protein, 19 aa, Mycobacterium avium
PGQILVLLNVGAVFMGTAL

SEQ ID NO: 24699 - protein, 22 aa, Mycobacterium avium
PGQILVLLNVGAVFMGTALTIR

SEQ ID NO: 24700 - protein, 30 aa, Mycobacterium avium
PGQRPSGNRVWWVVGTLIAVGVLALAGGIA

SEQ ID NO: 24701 - protein, 31 aa, Mycobacterium avium
PGQRPSGNRVWWVVGTLIAVGVLALAGGIAA

SEQ ID NO: 24702 - protein, 17 aa, Mycobacterium avium
PGRRLFCTAAPQLRRVL

SEQ ID NO: 24703 - protein, 23 aa, Mycobacterium avium
PGRRLFCTAAPQLRRVLFAPQTV

SEQ ID NO: 24704 - protein, 23 aa, Mycobacterium avium
PGRTAPPLPAFVAPPDLGVNCQY

SEQ ID NO: 24705 - protein, 21 aa, Mycobacterium avium
PGSWIDQAIVQWVLIALVTAM

SEQ ID NO: 24706 - protein, 24 aa, Mycobacterium avium
PGVILRQILTWMLSTAVPVLAIVL

SEQ ID NO: 24707 - protein, 18 aa, Mycobacterium avium
PGYGVLKPGIIPLRPLTL

SEQ ID NO: 24708 - protein, 23 aa, Mycobacterium avium
PHDAMTGLLWPVVAVATFAAFGL

SEQ ID NO: 24709 - protein, 17 aa, Mycobacterium avium
PHLITPIITQPKKAAAA

SEQ ID NO: 24710 - protein, 19 aa, Mycobacterium avium
PHVIPIHDWGEINGVLYID

SEQ ID NO: 24711 - protein, 29 aa, Mycobacterium avium
PIAPLDVPTPTELPPPPPPPAPAAPDQVD

SEQ ID NO: 24712 - protein, 18 aa, Mycobacterium avium
PIAWPLEITVAWAVVLVA

SEQ ID NO: 24713 - protein, 18 aa, Mycobacterium avium
PIDLSWELWAYGVFAIAA

SEQ ID NO: 24714 - protein, 22 aa, Mycobacterium avium
PIFFVLSGYLLFRPWVKSAATG

SEQ ID NO: 24715 - protein, 18 aa, Mycobacterium avium
PIGVLGLALAYWLVPVLP

SEQ ID NO: 24716 - protein, 20 aa, Mycobacterium avium
PINVIFKRLPNGLGPLLPIE

SEQ ID NO: 24717 - protein, 21 aa, Mycobacterium avium
PINVIFKRLPNGLGPLLPIEY

SEQ ID NO: 24718 - protein, 20 aa, Mycobacterium avium
PINVVFKRLPNGLGPLLPIE

SEQ ID NO: 24719 - protein, 19 aa, Mycobacterium avium
PIPLRLAFEGYCLALWAVL

SEQ ID NO: 24720 - protein, 19 aa, Mycobacterium avium
PIRRLRADAPPFFVLHGRD

SEQ ID NO: 24721 - protein, 20 aa, Mycobacterium avium
PIRRLRADAPPFFVLHGRDD

SEQ ID NO: 24722 - protein, 20 aa, Mycobacterium avium
PIRVPYPVYVFEYVSAGGNS

SEQ ID NO: 24723 - protein, 17 aa, Mycobacterium avium
PIVMAFHRVIIAEFVCL

SEQ ID NO: 24724 - protein, 26 aa, Mycobacterium avium
PKGPAAPPVVPLPPGGPGGGPGAGTP

SEQ ID NO: 24725 - protein, 24 aa, Mycobacterium avium
PKRFHRYIINALPLAFQRGSMLWV

SEQ ID NO: 24726 - protein, 21 aa, Mycobacterium avium
PKSPRGLWIAAGAAVLLVVAL

SEQ ID NO: 24727 - protein, 25 aa, Mycobacterium avium
PKTPYWSEPEPRWPKSPPQPKRAPG

SEQ ID NO: 24728 - protein, 26 aa, Mycobacterium avium
PKYQQALLELLPHITLINGYGSSETG

SEQ ID NO: 24729 - protein, 26 aa, Mycobacterium avium
PLGALHLDLRYVNGKPWLVFGPYAGW

SEQ ID NO: 24730 - protein, 37 aa, Mycobacterium avium
PLGALHLDLRYVNGKPWLVFGPYAGWSPKFLKHGHFT

SEQ ID NO: 24731 - protein, 23 aa, Mycobacterium avium
PLGWGILGLFFSILTLIVVIVIP

SEQ ID NO: 24732 - protein, 31 aa, Mycobacterium avium
PLKSRRQETWLMILFGVGFGLGVALTLSRLM

SEQ ID NO: 24733 - protein, 30 aa, Mycobacterium avium
PLKSRRQETWLMILLGVGFGLGVALTLSRL

SEQ ID NO: 24734 - protein, 31 aa, Mycobacterium avium
PLKSRRQETWLMILLGVGFGLGVALTLSRLM

SEQ ID NO: 24735 - protein, 18 aa, Mycobacterium avium
PLKWRLMLTVGEPGDPTH

SEQ ID NO: 24736 - protein, 26 aa, Mycobacterium avium
PLLGIPPWMVFFSFSLNLIYQFWIHT

SEQ ID NO: 24737 - protein, 23 aa, Mycobacterium avium
PLLYPNIPFGLFGAVTAFLIGWT

SEQ ID NO: 24738 - protein, 17 aa, Mycobacterium avium
PLQLPWLPLLAPLGALA

SEQ ID NO: 24739 - protein, 24 aa, Mycobacterium avium
PLWAAMLMWLTLWVLYLSIVNVGQ

SEQ ID NO: 24740 - protein, 41 aa, Mycobacterium avium
PMAALLKWLGIPQFVVFDWLFWIFSILIATLVSWLLFTWMI

SEQ ID NO: 24741 - protein, 19 aa, Mycobacterium avium
PMERLLILSLGVGGQLAAA

SEQ ID NO: 24742 - protein, 18 aa, Mycobacterium avium
PMLVLTWSGLRAGECRAG

SEQ ID NO: 24743 - protein, 32 aa, Mycobacterium avium
PNEIALNILLAALTIIFVFAVATLQPLAIYSK

SEQ ID NO: 24744 - protein, 43 aa, Mycobacterium avium
PNFGTGMAPFFLTLALFFGALVLWMVLRPLQYRAIAAEVIAIR

SEQ ID NO: 24745 - protein, 20 aa, Mycobacterium avium
PNFTVLVILRLLYGIGMGGE

SEQ ID NO: 24746 - protein, 25 aa, Mycobacterium avium
PNLVAARFIQLTPAYTGGPALADGA

SEQ ID NO: 24747 - protein, 23 aa, Mycobacterium avium
PNSKFTVSLLWPGDRAWRQGGDR

SEQ ID NO: 24748 - protein, 26 aa, Mycobacterium avium
PPAPAPDWLLLRIPVGTVWSEEAAFR

SEQ ID NO: 24749 - protein, 21 aa, Mycobacterium avium
PPDMRLPISLALGWPHRVPGA

SEQ ID NO: 24750 - protein, 18 aa, Mycobacterium avium
PPFTSWQPPGVPPVPPQL

SEQ ID NO: 24751 - protein, 26 aa, Mycobacterium avium
PPGTFTAIPPYWQQTADWLTQHNTGS

SEQ ID NO: 24752 - protein, 19 aa, Mycobacterium avium
PPKPRRPWRRLRFSQLIIG

SEQ ID NO: 24753 - protein, 47 aa, Mycobacterium avium
PPNPTQWAPAFPPQPPRSRTWPAVALAAVAVLLGGAALVVALTRPTG

SEQ ID NO: 24754 - protein, 51 aa, Mycobacterium avium
PPNPTQWAPAFPPQPPRSRTWPAVALAAVAVLLGGAALVVALTRPTGGSST

SEQ ID NO: 24755 - protein, 25 aa, Mycobacterium avium
PPPDDRLHRWRPDAAALEPVAAPED

SEQ ID NO: 24756 - protein, 26 aa, Mycobacterium avium
PPPDDRLHRWRPDAAALEPVAAPEDD

SEQ ID NO: 24757 - protein, 26 aa, Mycobacterium avium
PPPPPPSPAPPGPPPSPAPPGAVAPA

SEQ ID NO: 24758 - protein, 28 aa, Mycobacterium avium
PPPQHPRIPLQAKLIAALTARQLRDREA

SEQ ID NO: 24759 - protein, 28 aa, Mycobacterium avium
PPRPRKRRRLKLVRAIAAGILAAVLATA

SEQ ID NO: 24760 - protein, 20 aa, Mycobacterium avium
PPRRPRMPGSPPTGPLPPVP

SEQ ID NO: 24761 - protein, 20 aa, Mycobacterium avium
PPTGELPPPGFPPDRPEGFE

SEQ ID NO: 24762 - protein, 20 aa, Mycobacterium avium
PPTTVTLAPAPPAGGPPGGP

SEQ ID NO: 24763 - protein, 17 aa, Mycobacterium avium
PPTVQGLALLMLVAAIH

SEQ ID NO: 24764 - protein, 17 aa, Mycobacterium avium
PPVLALAATRGIGEPKP

SEQ ID NO: 24765 - protein, 25 aa, Mycobacterium avium
PPVTITQVLPPPPPPPPPPPEGGGA

SEQ ID NO: 24766 - protein, 26 aa, Mycobacterium avium
PPVTITQVLPPPPPPPPPPPEGGGAT

SEQ ID NO: 24767 - protein, 17 aa, Mycobacterium avium
PPYDQLFTQVWVDGFFA

SEQ ID NO: 24768 - protein, 21 aa, Mycobacterium avium
PPYKLAGLAILVVGALALALI

SEQ ID NO: 24769 - protein, 24 aa, Mycobacterium avium
PQFLPDVWWLPYAAVSLPFLLLFR

SEQ ID NO: 24770 - protein, 25 aa, Mycobacterium avium
PQQALNVPLPWSKVLSSTKPGIPAN

SEQ ID NO: 24771 - protein, 19 aa, Mycobacterium avium
PQTRWAAALVCAVLVAVAA

SEQ ID NO: 24772 - protein, 20 aa, Mycobacterium avium
PQTRWAAALVCAVLVAVAAT

SEQ ID NO: 24773 - protein, 26 aa, Mycobacterium avium
PREAAVLAVVPFFSTVIGTVGMDLAQ

SEQ ID NO: 24774 - protein, 37 aa, Mycobacterium avium
PRIVGDPMLLTMLWQNLIGNAIKFRHKDRRPRVVIEC

SEQ ID NO: 24775 - protein, 28 aa, Mycobacterium avium
PRLGPPPAMPPSLAWWASSLQLSGLSSG

SEQ ID NO: 24776 - protein, 29 aa, Mycobacterium avium
PRLGPPPAMPPSLAWWASSLQLSGLSSGQ

SEQ ID NO: 24777 - protein, 22 aa, Mycobacterium avium
PRLVALPLWTWLLTVAVISMGG

SEQ ID NO: 24778 - protein, 26 aa, Mycobacterium avium
PRPRKRRRIKLVRAIAAGILAAVLAT

SEQ ID NO: 24779 - protein, 38 aa, Mycobacterium avium
PRQWRKQTWLGRFVSTYGWRAYALPALVVLTAVVIYQT

SEQ ID NO: 24780 - protein, 32 aa, Mycobacterium avium
PRRLGRLMSILSIPMLLAPIAGPILGGWLIDT

SEQ ID NO: 24781 - protein, 20 aa, Mycobacterium avium
PRRVWATVMTVLIGVLTTVV

SEQ ID NO: 24782 - protein, 17 aa, Mycobacterium avium
PRSWLLARASRAAPEGT

SEQ ID NO: 24783 - protein, 36 aa, Mycobacterium avium
PRVIPPSFLRRAMPYVLVILIVGMIVALFATGMRLI

SEQ ID NO: 24784 - protein, 29 aa, Mycobacterium avium
PSAAALLGRWFWWPQLVRPRPASTMLRPT

SEQ ID NO: 24785 - protein, 23 aa, Mycobacterium avium
PSALRAFLSVLLVHAIGAGIGVW

SEQ ID NO: 24786 - protein, 27 aa, Mycobacterium avium
PSAPPPVPPPPPPAPPPAPPAPAPEPP

SEQ ID NO: 24787 - protein, 37 aa, Mycobacterium avium
PSIAWPRVFGYGILPGLALVLALGAGYLRWSAGSADD

SEQ ID NO: 24788 - protein, 25 aa, Mycobacterium avium
PSLGNPLSFLNPFNIAFALGYPMDF

SEQ ID NO: 24789 - protein, 23 aa, Mycobacterium avium
PSRCRWRRRWPSSPASWCRRPAG

SEQ ID NO: 24790 - protein, 17 aa, Mycobacterium avium
PSTFSLAGPWVDVAAPG

SEQ ID NO: 24791 - protein, 26 aa, Mycobacterium avium
PTGPGYPPAPAPWSYGGPVPGPPGQR

SEQ ID NO: 24792 - protein, 21 aa, Mycobacterium avium
PTLTLTLPRPTQVAGVRLVPS

SEQ ID NO: 24793 - protein, 27 aa, Mycobacterium avium
PTPKTVRLFILLVIALALIPVGAVPGF

SEQ ID NO: 24794 - protein, 27 aa, Mycobacterium avium
PTPRTLRLFIVLVIAFALIPVGAVPGF

SEQ ID NO: 24795 - protein, 26 aa, Mycobacterium avium
PTQPQYIMVLLNIGAVFMGTALTIRD

SEQ ID NO: 24796 - protein, 30 aa, Mycobacterium avium
PTTVSHFLPPVLRKLTIYLPQSPSTAESDT

SEQ ID NO: 24797 - protein, 32 aa, Mycobacterium avium
PTTVSHFLPPVLRKLTIYLPQSPSTAESDTAI

SEQ ID NO: 24798 - protein, 17 aa, Mycobacterium avium
PTVFFGVDRYTVTVELP

SEQ ID NO: 24799 - protein, 19 aa, Mycobacterium avium
PVAAPKPLSPPVAAPLPAA

SEQ ID NO: 24800 - protein, 19 aa, Mycobacterium avium
PVEVPPPVAPPPPPPPVTI

SEQ ID NO: 24801 - protein, 17 aa, Mycobacterium avium
PVFVFHPAGGSTVVYEP

SEQ ID NO: 24802 - protein, 29 aa, Mycobacterium avium
PVGAVGMVLMAIWFHVWQDKVRDLMGVAH

SEQ ID NO: 24803 - protein, 30 aa, Mycobacterium avium
PVGAVGMVLMAIWFHVWQDKVRDLMGVAHL

SEQ ID NO: 24804 - protein, 26 aa, Mycobacterium avium
PVGHLALFGMLLRDTRWWLGGLGDIG

SEQ ID NO: 24805 - protein, 27 aa, Mycobacterium avium
PVGHLALFGMLLRDTRWWLGGLGDIGS

SEQ ID NO: 24806 - protein, 20 aa, Mycobacterium avium
PVHLALLCVGATFGYLLLAG

SEQ ID NO: 24807 - protein, 29 aa, Mycobacterium avium
PVIVAVAAGATYWLVRRSLKSVDAIRARV

SEQ ID NO: 24808 - protein, 29 aa, Mycobacterium avium
PVKLRTTTLTLIYPTVPLASWTAGSREVA

SEQ ID NO: 24809 - protein, 30 aa, Mycobacterium avium
PVKLRTTTLTLIYPTVPLASWTAGSREVAC

SEQ ID NO: 24810 - protein, 26 aa, Mycobacterium avium
PVLAQRLSWWALTLGSWAVAAGWAFA

SEQ ID NO: 24811 - protein, 19 aa, Mycobacterium avium
PVLGRLYSTEFYALAAHAL

SEQ ID NO: 24812 - protein, 20 aa, Mycobacterium avium
PVLGRLYSTEFYALAARALA

SEQ ID NO: 24813 - protein, 20 aa, Mycobacterium avium
PVLGRLYSTEFYTLAARALA

SEQ ID NO: 24814 - protein, 17 aa, Mycobacterium avium
PVLPQTVSMLKTSRVAL

SEQ ID NO: 24815 - protein, 25 aa, Mycobacterium avium
PVLVAIPFFLLLLTLEWTAARKLEH

SEQ ID NO: 24816 - protein, 25 aa, Mycobacterium avium
PVNNDPWYTSLWHTIADAPHLPPAN

SEQ ID NO: 24817 - protein, 25 aa, Mycobacterium avium
PVPHRDMVPIWVAAGGLFGALLIGG

SEQ ID NO: 24818 - protein, 25 aa, Mycobacterium avium
PVPRRDMVPIWVAAGGLFGALLIGG

SEQ ID NO: 24819 - protein, 17 aa, Mycobacterium avium
PVPVAPPTKRPAARRRP

SEQ ID NO: 24820 - protein, 18 aa, Mycobacterium avium
PVPYAVVLALIGAASLVA

SEQ ID NO: 24821 - protein, 19 aa, Mycobacterium avium
PVPYAVVLALIGAASLVAG

SEQ ID NO: 24822 - protein, 17 aa, Mycobacterium avium
PVRAACAAGVRAVVLTN

SEQ ID NO: 24823 - protein, 23 aa, Mycobacterium avium
PVRALAMIFMALLGLTVTMAVQA

SEQ ID NO: 24824 - protein, 26 aa, Mycobacterium avium
PVTITQVLPPPPPPPPPPPEGGGATA

SEQ ID NO: 24825 - protein, 18 aa, Mycobacterium avium
PVVVTAVAVLMLIAGVVL

SEQ ID NO: 24826 - protein, 20 aa, Mycobacterium avium
PVWAMAGFGAQHRKMGKNLY

SEQ ID NO: 24827 - protein, 30 aa, Mycobacterium avium
PVYQRIGLEQLAWLTPARWGYAAGASSIDF

SEQ ID NO: 24828 - protein, 21 aa, Mycobacterium avium
PWGSPTIIGLFAAAAVALGVF

SEQ ID NO: 24829 - protein, 22 aa, Mycobacterium avium
PWGSPTIIGLFAAAAVALGVFV

SEQ ID NO: 24830 - protein, 20 aa, Mycobacterium avium
PWWFVVVLLVRDGLLAATLP

SEQ ID NO: 24831 - protein, 23 aa, Mycobacterium avium
PYAVYLFYVFKIAGYIAGAAAVI

SEQ ID NO: 24832 - protein, 21 aa, Mycobacterium avium
PYAVYLFYVFKIAGYVAGAAA

SEQ ID NO: 24833 - protein, 23 aa, Mycobacterium avium
PYAVYLFYVFKIAGYVAGAAAVI

SEQ ID NO: 24834 - protein, 20 aa, Mycobacterium avium
PYQPQLGQPTAWLVAPIGAP

SEQ ID NO: 24835 - protein, 40 aa, Mycobacterium avium
QADLLVMEMIALPLSFLVLIWVFGGLLAAALPMALGALAV

SEQ ID NO: 24836 - protein, 28 aa, Mycobacterium avium
QAPLHQSMFIANAVWIIVVAVAAVALLN

SEQ ID NO: 24837 - protein, 29 aa, Mycobacterium avium
QAPLHQSMFIANAVWIIVVAVAAVALLNT

SEQ ID NO: 24838 - protein, 25 aa, Mycobacterium avium
QAPNNYLVWSILVTLFCCLPFGIVA

SEQ ID NO: 24839 - protein, 22 aa, Mycobacterium avium
QCEAWDPSTGKYGPIYDPKTKS

SEQ ID NO: 24840 - protein, 31 aa, Mycobacterium avium
QCIRSFMPDLPLPYAFPPPPGSAAPTAVAAV

SEQ ID NO: 24841 - protein, 31 aa, Mycobacterium avium
QDARRAQRRGKRPWIIAGVAVAVLAGGAAAF

SEQ ID NO: 24842 - protein, 42 aa, Mycobacterium avium
QDGIFTTIIQPPLILFCAVPGAYWLFHDAKVGRLKDLLINCG

SEQ ID NO: 24843 - protein, 31 aa, Mycobacterium avium
QDMLSYGWRIPLLLGLPFGLVALYLRLRLEE

SEQ ID NO: 24844 - protein, 23 aa, Mycobacterium avium
QDPFLGRWLLLTAAMFALSAGSY

SEQ ID NO: 24845 - protein, 17 aa, Mycobacterium avium
QDYANIPPTRFKRKEHW

SEQ ID NO: 24846 - protein, 17 aa, Mycobacterium avium
QEGVLTPLPLKTFDVRC

SEQ ID NO: 24847 - protein, 24 aa, Mycobacterium avium
QETGLRGYLIAADRQFLAPYYDGQ

SEQ ID NO: 24848 - protein, 25 aa, Mycobacterium avium
QEVSRAFAHFFLDWAKSTSVAAVIA

SEQ ID NO: 24849 - protein, 25 aa, Mycobacterium avium
QFTANPWLPGYMSQALALLTRDTGD

SEQ ID NO: 24850 - protein, 19 aa, Mycobacterium avium
QFTVAFMTAILLGAGTDYT

SEQ ID NO: 24851 - protein, 22 aa, Mycobacterium avium
QFTVGYAALLLAISCAILVLGP

SEQ ID NO: 24852 - protein, 25 aa, Mycobacterium avium
QGLSQFGINLPPVPALSGGATSTPG

SEQ ID NO: 24853 - protein, 28 aa, Mycobacterium avium
QGVSMPYFPNYLSLASPFAFSGLSFFHT

SEQ ID NO: 24854 - protein, 28 aa, Mycobacterium avium
QHIATAWLFDMAMLAVLSVGYAALVRWR

SEQ ID NO: 24855 - protein, 18 aa, Mycobacterium avium
QIGYGWGFFISGVVLLIA

SEQ ID NO: 24856 - protein, 30 aa, Mycobacterium avium
QIHFGLGLALLAWFGFYLYKISHGNVEEPD

SEQ ID NO: 24857 - protein, 45 aa, Mycobacterium avium
QINDPRVPPYKLLTFITVVVLAVIFTLVYIQFRGGFTPKTELTML

SEQ ID NO: 24858 - protein, 21 aa, Mycobacterium avium
QIPLYGPILWSLVLSSTGALM

SEQ ID NO: 24859 - protein, 26 aa, Mycobacterium avium
QITDKALIALVVFLALVGLYITVRYE

SEQ ID NO: 24860 - protein, 41 aa, Mycobacterium avium
QKMLQDFWANLPAFLAANGPLLFFVAYQVFFNAVGWPTWGA

SEQ ID NO: 24861 - protein, 43 aa, Mycobacterium avium
QLAIATLVIVGLILIALLRALIAPLYLLGTVVLNYLASLGIGV

SEQ ID NO: 24862 - protein, 17 aa, Mycobacterium avium
QLEAAALRDALAARRID

SEQ ID NO: 24863 - protein, 18 aa, Mycobacterium avium
QLFTQVWVDGFFAISGFL

SEQ ID NO: 24864 - protein, 19 aa, Mycobacterium avium
QLFTQVWVDGFFAISGFLI

SEQ ID NO: 24865 - protein, 18 aa, Mycobacterium avium
QLLALGATVLLIAGLITG

SEQ ID NO: 24866 - protein, 18 aa, Mycobacterium avium
QLLAYLVLAAQFAATLGL

SEQ ID NO: 24867 - protein, 17 aa, Mycobacterium avium
QLLIGVLALLVAAALAV

SEQ ID NO: 24868 - protein, 24 aa, Mycobacterium avium
QLMNNPFFQSLFSGFDPWLPSLGN

SEQ ID NO: 24869 - protein, 17 aa, Mycobacterium avium
QLNRVLAHLVRTARVET

SEQ ID NO: 24870 - protein, 20 aa, Mycobacterium avium
QLPAYWQQELPPGGDPHAPG

SEQ ID NO: 24871 - protein, 23 aa, Mycobacterium avium
QLRGLMIAAGIVTLLIAALLLIA

SEQ ID NO: 24872 - protein, 24 aa, Mycobacterium avium
QLSAPLTIPKPVPRRDMVPIWVAA

SEQ ID NO: 24873 - protein, 35 aa, Mycobacterium avium
QLTALPVGHFIGMLGAFLMLVLDGAPIDLTDVWDP

SEQ ID NO: 24874 - protein, 17 aa, Mycobacterium avium
QLTIFALASVVAMAFMF

SEQ ID NO: 24875 - protein, 28 aa, Mycobacterium avium
QLVKDLLSGFFILAERQYGFGDLVTLTV

SEQ ID NO: 24876 - protein, 30 aa, Mycobacterium avium
QLVSMWGLQQISWLIPARWGFAASASTVNL

SEQ ID NO: 24877 - protein, 19 aa, Mycobacterium avium
QLWFVPFFDDSSWDGPAWS

SEQ ID NO: 24878 - protein, 28 aa, Mycobacterium avium
QMATRGWRRIGTAIVRWPGPILVVATGV

SEQ ID NO: 24879 - protein, 18 aa, Mycobacterium avium
QMIVLIPAILPLLTVSVV

SEQ ID NO: 24880 - protein, 18 aa, Mycobacterium avium
QMTMRVFTGLTLLDTIQG

SEQ ID NO: 24881 - protein, 25 aa, Mycobacterium avium
QNGTPGKFMPILPSQQQAPLPPPPA

SEQ ID NO: 24882 - protein, 24 aa, Mycobacterium avium
QNQAYGYLFPHGTFFLIGHALGVP

SEQ ID NO: 24883 - protein, 19 aa, Mycobacterium avium
QPALWLLVFGTTFSHLHMI

SEQ ID NO: 24884 - protein, 17 aa, Mycobacterium avium
QPIHWTPARYLMLAASS

SEQ ID NO: 24885 - protein, 21 aa, Mycobacterium avium
QPRQSGWGLALRFGGFAVVVG

SEQ ID NO: 24886 - protein, 17 aa, Mycobacterium avium
QQISFLPAMRYYAGNWA

SEQ ID NO: 24887 - protein, 19 aa, Mycobacterium avium
QQPVLYPRGTLAMANAGPG

SEQ ID NO: 24888 - protein, 19 aa, Mycobacterium avium
QQPYQQQFDWRYRSQPSQT

SEQ ID NO: 24889 - protein, 28 aa, Mycobacterium avium
QQRDDWAWLKAAFVIAGIALATAGLIWF

SEQ ID NO: 24890 - protein, 40 aa, Mycobacterium avium
QQWEYLDLPRLWQILLIAGMFMWIAIIWRGIRGRLKGESK

SEQ ID NO: 24891 - protein, 27 aa, Mycobacterium avium
QRDDWAWLKAAFVIAGIALATAGLIWF

SEQ ID NO: 24892 - protein, 27 aa, Mycobacterium avium
QRDDWAWLKAAFVIAGITLATAGLIWF

SEQ ID NO: 24893 - protein, 17 aa, Mycobacterium avium
QRFPGAAAALRAAPRTE

SEQ ID NO: 24894 - protein, 24 aa, Mycobacterium avium
QRILQLPLSRRLATLPLSATPSGV

SEQ ID NO: 24895 - protein, 21 aa, Mycobacterium avium
QSGSIGLGFAIPVDQAKRIAD

SEQ ID NO: 24896 - protein, 20 aa, Mycobacterium avium
QSPLVLPPPNAGQGAVPVLE

SEQ ID NO: 24897 - protein, 20 aa, Mycobacterium avium
QSSWWPYAALFAVAAAALLW

SEQ ID NO: 24898 - protein, 32 aa, Mycobacterium avium
QTGTVWLLVVAVLVLMFVAPPALRPSAAAPSV

SEQ ID NO: 24899 - protein, 50 aa, Mycobacterium avium
QTNNLHRRVILICALSIGAAAVFAWLLAAFAVRPFKRLAQQARSIDADER

SEQ ID NO: 24900 - protein, 28 aa, Mycobacterium avium
QTPRGRYWWVRWVILGVVAIVLAVEVSL

SEQ ID NO: 24901 - protein, 28 aa, Mycobacterium avium
QTSRGRYWWVRWVILGVVAIVLAVEVSL

SEQ ID NO: 24902 - protein, 20 aa, Mycobacterium avium
QVLLLAPGGKTAFCGPPGQI

SEQ ID NO: 24903 - protein, 23 aa, Mycobacterium avium
QWGYRMVLPQLILMPVLYVVQEM

SEQ ID NO: 24904 - protein, 36 aa, Mycobacterium avium
QWRKQTWLGRFVSTYGWRAYALPALVVLTAVVIYQT

SEQ ID NO: 24905 - protein, 32 aa, Mycobacterium avium
RAAARNLLSSFKIPTVWLVLRSDDDLPRGGTG

SEQ ID NO: 24906 - protein, 31 aa, Mycobacterium avium
RAAEPILPVRLFASPVFTVCCVLSFVVGFAM

SEQ ID NO: 24907 - protein, 17 aa, Mycobacterium avium
RAAGFIGFAIGGPLSDG

SEQ ID NO: 24908 - protein, 29 aa, Mycobacterium avium
RAAPTPVQIPRFLRKLLRELAPAPDTDRS

SEQ ID NO: 24909 - protein, 29 aa, Mycobacterium avium
RAATLIAHLAWLVLLLGSGAGVLLGAWWR

SEQ ID NO: 24910 - protein, 29 aa, Mycobacterium avium
RAATLIAHLAWLVLLLGSGAGVLVGAWRR

SEQ ID NO: 24911 - protein, 17 aa, Mycobacterium avium
RADLRVAHPLISRTHLI

SEQ ID NO: 24912 - protein, 20 aa, Mycobacterium avium
RAGLRLWVPSLALTAAWVGL

SEQ ID NO: 24913 - protein, 20 aa, Mycobacterium avium
RAGRHHVPLATALRVNDTAD

SEQ ID NO: 24914 - protein, 20 aa, Mycobacterium avium
RAKSRWLVTRMTTITSLDLT

SEQ ID NO: 24915 - protein, 17 aa, Mycobacterium avium
RALDLLVGLQRISAIPI

SEQ ID NO: 24916 - protein, 19 aa, Mycobacterium avium
RALDLLVGLQRISAIPIDT

SEQ ID NO: 24917 - protein, 18 aa, Mycobacterium avium
RALRAGWMLAARGTGGAA

SEQ ID NO: 24918 - protein, 18 aa, Mycobacterium avium
RALTAAPVPLAAGFMALV

SEQ ID NO: 24919 - protein, 18 aa, Mycobacterium avium
RALYFPGMIAAVQGDTPL

SEQ ID NO: 24920 - protein, 20 aa, Mycobacterium avium
RAMFEPLLAGLRDLGCMSLT

SEQ ID NO: 24921 - protein, 41 aa, Mycobacterium avium
RANLYRSLLSLQRPLRQLVPAAPFVAGALKLGLTAPFNIDD

SEQ ID NO: 24922 - protein, 20 aa, Mycobacterium avium
RAPLQTWLVVAAVIGPLLVL

SEQ ID NO: 24923 - protein, 30 aa, Mycobacterium avium
RAPQALFVWIALAGMAIAILLLGWRGARWW

SEQ ID NO: 24924 - protein, 21 aa, Mycobacterium avium
RAPRLRSAVGVWVTILDRTRL

SEQ ID NO: 24925 - protein, 17 aa, Mycobacterium avium
RAPRRVWATVMTVLIGV

SEQ ID NO: 24926 - protein, 22 aa, Mycobacterium avium
RAPRRVWATVMTVLIGVLTTVV

SEQ ID NO: 24927 - protein, 18 aa, Mycobacterium avium
RAPRVFQVAAWVAIVAGI

SEQ ID NO: 24928 - protein, 30 aa, Mycobacterium avium
RAQAAGRLLAPLRWALILSGVLQAVITVIQ

SEQ ID NO: 24929 - protein, 23 aa, Mycobacterium avium
RAQRRGKRPWVIAGVAVAVLAGG

SEQ ID NO: 24930 - protein, 21 aa, Mycobacterium avium
RARRLLPALVLMVLTVAAARQ

SEQ ID NO: 24931 - protein, 30 aa, Mycobacterium avium
RASAIMHGVWILLFTIPFAGLVDEIPTAAL

SEQ ID NO: 24932 - protein, 29 aa, Mycobacterium avium
RATVFERFARGCLLLVYPNVIAVERQLRI

SEQ ID NO: 24933 - protein, 21 aa, Mycobacterium avium
RAYRYARAMARWSPTSRSEID

SEQ ID NO: 24934 - protein, 25 aa, Mycobacterium avium
RDEAVHGYYIGYKYQRGLALVDDAK

SEQ ID NO: 24935 - protein, 25 aa, Mycobacterium avium
RDLRAIVGLLAWQGVALAAIPLVRG

SEQ ID NO: 24936 - protein, 17 aa, Mycobacterium avium
RDLTAFFAWTAWAAAAE

SEQ ID NO: 24937 - protein, 17 aa, Mycobacterium avium
RDRTSFIIAHRLSTIRD

SEQ ID NO: 24938 - protein, 26 aa, Mycobacterium avium
RDRVLMWLVDLLLVVPSFILIAIVTP

SEQ ID NO: 24939 - protein, 34 aa, Mycobacterium avium
RDVFALLSPFLLVAAVIFVPMLDLLLAIVRRTRA

SEQ ID NO: 24940 - protein, 25 aa, Mycobacterium avium
REAAVLAVVPFFSTVIGTVGMDLAQ

SEQ ID NO: 24941 - protein, 36 aa, Mycobacterium avium
REKIPRFIRAFAVPIIIGWIALIAVLNVVVPQLDEV

SEQ ID NO: 24942 - protein, 24 aa, Mycobacterium avium
RELARRRRLSRAETVLAVGAVMVA

SEQ ID NO: 24943 - protein, 23 aa, Mycobacterium avium
RELATPWWEASPAPRPAPEPQQP

SEQ ID NO: 24944 - protein, 24 aa, Mycobacterium avium
RELATPWWEASPAPRPAPERAPEP

SEQ ID NO: 24945 - protein, 27 aa, Mycobacterium avium
REPIPPLKFAQLVGLIFAVLGAAGFAA

SEQ ID NO: 24946 - protein, 27 aa, Mycobacterium avium
REQPWTPIMIILVITAVKILGSVLAPH

SEQ ID NO: 24947 - protein, 27 aa, Mycobacterium avium
REQPWTPIVIILVITAVKILGSMLAPH

SEQ ID NO: 24948 - protein, 27 aa, Mycobacterium avium
REQPWTPIVIILVITAVKILGSVLAPH

SEQ ID NO: 24949 - protein, 25 aa, Mycobacterium avium
RERIALRVIFLDIILYSAGGVIGTM

SEQ ID NO: 24950 - protein, 35 aa, Mycobacterium avium
RERLGPVLRRLTVNYPPLMFHPLNTITAYKGQIIY

SEQ ID NO: 24951 - protein, 30 aa, Mycobacterium avium
REVGELFDYLRPRAVIYHRGLGPKFADVLG

SEQ ID NO: 24952 - protein, 36 aa, Mycobacterium avium
RFAEQVRISRFQTLLLKWAMMVLLGLLTSAVYLAIA

SEQ ID NO: 24953 - protein, 37 aa, Mycobacterium avium
RFAEQVRISRFQTLLLKWAMMVLLGLLTSAVYLAIAN

SEQ ID NO: 24954 - protein, 19 aa, Mycobacterium avium
RFRAAAAAALLIDLAWVLS

SEQ ID NO: 24955 - protein, 19 aa, Mycobacterium avium
RFVWNLRVLRTLGLIDLAV

SEQ ID NO: 24956 - protein, 17 aa, Mycobacterium avium
RGIRRALRIFTACDRYG

SEQ ID NO: 24957 - protein, 18 aa, Mycobacterium avium
RGIRVGRITSLRPIPSGV

SEQ ID NO: 24958 - protein, 41 aa, Mycobacterium avium
RGKPSIAWPRVFGYGILPGLALVLALGAGYLRWSAGSADDL

SEQ ID NO: 24959 - protein, 17 aa, Mycobacterium avium
RGLLHRDVKPANILLTH

SEQ ID NO: 24960 - protein, 32 aa, Mycobacterium avium
RGPSRLGRGWLAAIAAVLVLCAAGIGAGGYLA

SEQ ID NO: 24961 - protein, 18 aa, Mycobacterium avium
RGPTDHQLLALGATVLLI

SEQ ID NO: 24962 - protein, 24 aa, Mycobacterium avium
RGRLVTMLLVGVVLMAAGYSGGLG

SEQ ID NO: 24963 - protein, 41 aa, Mycobacterium avium
RGRPTWRVLLIGLGVIVAWLLIVMLLARLFASHGLAPAPPP

SEQ ID NO: 24964 - protein, 41 aa, Mycobacterium avium
RGRPTWRVLLIGLGVIVAWLLIVMLLARLFASHGLSPAPPP

SEQ ID NO: 24965 - protein, 26 aa, Mycobacterium avium
RGSVLLVMSLQVTALLFALPIYARMT

SEQ ID NO: 24966 - protein, 30 aa, Mycobacterium avium
RGTQDPPARPWRPGVWAAVPALAAGAVIAG

SEQ ID NO: 24967 - protein, 42 aa, Mycobacterium avium
RGVVRGLKMLMVTILLVVVGIGLALVLYFTPAMSARNIVVVG

SEQ ID NO: 24968 - protein, 18 aa, Mycobacterium avium
RGWMLYSHKPPRGTPIDR

SEQ ID NO: 24969 - protein, 43 aa, Mycobacterium avium
RHGGALRRAGLLAALPLSLIAVAAAAVMIFFVHQRDSTAPATE

SEQ ID NO: 24970 - protein, 17 aa, Mycobacterium avium
RHRVLVVTILMMTVSTT

SEQ ID NO: 24971 - protein, 23 aa, Mycobacterium avium
RHTDRLAGLGYLTLAVDLFSAGG

SEQ ID NO: 24972 - protein, 22 aa, Mycobacterium avium
RHVAFVFQDAELLRMSIRDNIR

SEQ ID NO: 24973 - protein, 17 aa, Mycobacterium avium
RHVWAIRGALQAPDDPE

SEQ ID NO: 24974 - protein, 24 aa, Mycobacterium avium
RIAFWVGVGLAVLVTLLSLVTYHG

SEQ ID NO: 24975 - protein, 24 aa, Mycobacterium avium
RIAVSYGLLTVSWLALTATNADGP

SEQ ID NO: 24976 - protein, 18 aa, Mycobacterium avium
RIGHIHFPLIMAVYDSFI

SEQ ID NO: 24977 - protein, 18 aa, Mycobacterium avium
RIGMGWPLTVLAALPTYA

SEQ ID NO: 24978 - protein, 26 aa, Mycobacterium avium
RIIAGILVVIPLYAVAVLMSFIAAKL

SEQ ID NO: 24979 - protein, 27 aa, Mycobacterium avium
RIIAGILVVIPLYAVAVLMSFIAAKLL

SEQ ID NO: 24980 - protein, 32 aa, Mycobacterium avium
RIIHRLSVPIILGWLAVAVLITIGVPSLEQVE

SEQ ID NO: 24981 - protein, 17 aa, Mycobacterium avium
RILAAAAIAFAPLSVVV

SEQ ID NO: 24982 - protein, 27 aa, Mycobacterium avium
RILILIALGVIALLLAGPRLIDAYVDW

SEQ ID NO: 24983 - protein, 24 aa, Mycobacterium avium
RILPGLWVCLVVIAFVIAPIGVAI

SEQ ID NO: 24984 - protein, 30 aa, Mycobacterium avium
RIMAGLVVIIPLYALAMIMSFLSPQITTTV

SEQ ID NO: 24985 - protein, 19 aa, Mycobacterium avium
RISGAVLVLVGLYVAYYGG

SEQ ID NO: 24986 - protein, 24 aa, Mycobacterium avium
RKDLTWWDLVVFGVAVVIGAGIFT

SEQ ID NO: 24987 - protein, 20 aa, Mycobacterium avium
RKMAAWAGILAVPTMIAAIY

SEQ ID NO: 24988 - protein, 31 aa, Mycobacterium avium
RKPAWVLAELVVVVLLMWSNNLVASPHWAAD

SEQ ID NO: 24989 - protein, 23 aa, Mycobacterium avium
RKPLALLTNAAMCAAVIVALGAS

SEQ ID NO: 24990 - protein, 24 aa, Mycobacterium avium
RKRALLEVTYFSGLGALIIFVGGV

SEQ ID NO: 24991 - protein, 18 aa, Mycobacterium avium
RKRLPTIFIDVARLALIC

SEQ ID NO: 24992 - protein, 28 aa, Mycobacterium avium
RKSLLLVSSTLPVIFIAAVVALGDRPGD

SEQ ID NO: 24993 - protein, 36 aa, Mycobacterium avium; identical to SEQ ID NO: 17410

SEQ ID NO: 24994 - protein, 26 aa, Mycobacterium avium
RLAGRDLPPVPVLLVIVDEYLELFAN

SEQ ID NO: 24995 - protein, 20 aa, Mycobacterium avium
RLEAIWRGSVVVLQSILAVA

SEQ ID NO: 24996 - protein, 39 aa, Mycobacterium avium
RLGGKLRTSRQFNWGWILALVVIVLALAAIAILGTVLLT

SEQ ID NO: 24997 - protein, 17 aa, Mycobacterium avium
RLGHLLVFFVRALVAVP

SEQ ID NO: 24998 - protein, 21 aa, Mycobacterium avium
RLHRWRPDAAALEPVAAPEDD

SEQ ID NO: 24999 - protein, 32 aa, Mycobacterium avium
RLHWPALMPLGYLNLAVWLIPAMFGAAYRRGL

SEQ ID NO: 25000 - protein, 33 aa, Mycobacterium avium
RLHWPALMPLGYLNLAVWLIPAMFGVAYRRGLL

SEQ ID NO: 25001 - protein, 20 aa, Mycobacterium avium
RLIFERFGRFWGAFSVGDLL

SEQ ID NO: 25002 - protein, 28 aa, Mycobacterium avium
RLPDLFAGIVCWLLLSREVLPRLGPAVA

SEQ ID NO: 25003 - protein, 17 aa, Mycobacterium avium
RLPLAYFDGRQRGELLS

SEQ ID NO: 25004 - protein, 24 aa, Mycobacterium avium
RLPLPNRLLATRPLVELGAIAYSL

SEQ ID NO: 25005 - protein, 18 aa, Mycobacterium avium
RLQPKYMDMLNLQEAWQF

SEQ ID NO: 25006 - protein, 19 aa, Mycobacterium avium
RLQPKYMDMLNLQEAWQFG

SEQ ID NO: 25007 - protein, 19 aa, Mycobacterium avium
RLRSETDAWWRHEIAAVSR

SEQ ID NO: 25008 - protein, 20 aa, Mycobacterium avium
RLSGLFRTRRFRVYTTDDVV

SEQ ID NO: 25009 - protein, 19 aa, Mycobacterium avium
RLSQIGLFVLLTTYSLSYL

SEQ ID NO: 25010 - protein, 17 aa, Mycobacterium avium
RLVSVGVPVAIGLLAGI

SEQ ID NO: 25011 - protein, 26 aa, Mycobacterium avium
RLVVPRFLGLLLITPSLVVIVIAMGV

SEQ ID NO: 25012 - protein, 18 aa, Mycobacterium avium
RLWLPTYLAWFLAGMMLK

SEQ ID NO: 25013 - protein, 18 aa, Mycobacterium avium
RLWLPTYLAWFLAGMMLT

SEQ ID NO: 25014 - protein, 17 aa, Mycobacterium avium
RLYNWQYQPLDAADATA

SEQ ID NO: 25015 - protein, 32 aa, Mycobacterium avium
RMVVVPAFMHVMGRWNWWAPKPLAWLHDRFGI

SEQ ID NO: 25016 - protein, 33 aa, Mycobacterium avium
RMVVVPAFMHVMGRWNWWAPKPLAWLHDRFGIS

SEQ ID NO: 25017 - protein, 20 aa, Mycobacterium avium
RMWRRRPTDPDFCVVRVGMG

SEQ ID NO: 25018 - protein, 20 aa, Mycobacterium avium
RNANRAFGAPPARWPRALHL

SEQ ID NO: 25019 - protein, 26 aa, Mycobacterium avium
RNVDNWVRRVLALPAFPGGSVDRPIQ

SEQ ID NO: 25020 - protein, 25 aa, Mycobacterium avium
RPDGLFYVVTYIGFGLPLILASVRP

SEQ ID NO: 25021 - protein, 26 aa, Mycobacterium avium
RPDLSTLRRIPWLPGTALVIADVVGA

SEQ ID NO: 25022 - protein, 17 aa, Mycobacterium avium
RPDRIVLGIKQDSLRAE

SEQ ID NO: 25023 - protein, 17 aa, Mycobacterium avium
RPDSPLTPPRFADRFEH

SEQ ID NO: 25024 - protein, 18 aa, Mycobacterium avium
RPGWPVFPYTTMVRSSLW

SEQ ID NO: 25025 - protein, 24 aa, Mycobacterium avium
RPHAHTFSFFLPQGHEYQITLIVM

SEQ ID NO: 25026 - protein, 17 aa, Mycobacterium avium
RPLLAAAGLLSPRLPRL

SEQ ID NO: 25027 - protein, 26 aa, Mycobacterium avium
RPLRRPRPVRWGPRSLRRARSVRRPR

SEQ ID NO: 25028 - protein, 23 aa, Mycobacterium avium
RPPHVGVLLENTPFFSAVLVAAG

SEQ ID NO: 25029 - protein, 19 aa, Mycobacterium avium
RPPVFVLVVVALTLAGFAV

SEQ ID NO: 25030 - protein, 21 aa, Mycobacterium avium
RPRGRLLDPWAIAVLATALSA

SEQ ID NO: 25031 - protein, 22 aa, Mycobacterium avium
RPVATWLNHSMGWCFLFADGNT

SEQ ID NO: 25032 - protein, 20 aa, Mycobacterium avium
RPVGPLWAPTARLGSMYGYG

SEQ ID NO: 25033 - protein, 20 aa, Mycobacterium avium
RPVPYAVVLALIGAASLVAG

SEQ ID NO: 25034 - protein, 20 aa, Mycobacterium avium
RPVRSYFYWEKHCFDIPACF

SEQ ID NO: 25035 - protein, 20 aa, Mycobacterium avium
RQAAPPPWSIGRPQPELERL

SEQ ID NO: 25036 - protein, 26 aa, Mycobacterium avium
RQAVWPERMFSLLAGFVEAGESFEVC

SEQ ID NO: 25037 - protein, 43 aa, Mycobacterium avium
RQDGIFTTIIQPPLILFCAVPGAYWLFHDAKVGRLKDLLINCG

SEQ ID NO: 25038 - protein, 30 aa, Mycobacterium avium
RQEDKRLLPYMIGAFLLVVGVSVGVGVWAG

SEQ ID NO: 25039 - protein, 28 aa, Mycobacterium avium
RQHVDLRPLWGIDQRLKRFGTLAAAMVL

SEQ ID NO: 25040 - protein, 25 aa, Mycobacterium avium
RQLLTIARAFLARPQLLILDEATSS

SEQ ID NO: 25041 - protein, 28 aa, Mycobacterium avium
RQNIAAWTIVWCLVLLSLALTATTFFPD

SEQ ID NO: 25042 - protein, 29 aa, Mycobacterium avium
RQNIAAWTIVWCLVLLSLALTATTFFPDL

SEQ ID NO: 25043 - protein, 24 aa, Mycobacterium avium
RQSAILVTAWAVSGGIFLLLNVAG

SEQ ID NO: 25044 - protein, 23 aa, Mycobacterium avium
RRARFAAAFTFQYSKRPGTPAAE

SEQ ID NO: 25045 - protein, 27 aa, Mycobacterium avium
RRDRISLPLWVLLLSVPLSTVYVGSIE

SEQ ID NO: 25046 - protein, 25 aa, Mycobacterium avium
RRDRNLVYFLFASALFRDGLAAIFA

SEQ ID NO: 25047 - protein, 28 aa, Mycobacterium avium
RRDRVSLPLWVLLLSVPLSTVYVGSIEK

SEQ ID NO: 25048 - protein, 24 aa, Mycobacterium avium
RRELTTGLWRRSGIRIVRRPRTHL

SEQ ID NO: 25049 - protein, 17 aa, Mycobacterium avium
RRFVYLVLLMTAFNWMS

SEQ ID NO: 25050 - protein, 37 aa, Mycobacterium avium
RRGGKRVARLRAGAVCWLAIAVCCLAAAGLAATGART

SEQ ID NO: 25051 - protein, 43 aa, Mycobacterium avium
RRIADFVVRWPWLVIGFWAALAVALPLAFPSLAEMAQKHPLAI

SEQ ID NO: 25052 - protein, 23 aa, Mycobacterium avium
RRIGKPAQLRWLGMIAPSDDEAV

SEQ ID NO: 25053 - protein, 21 aa, Mycobacterium avium
RRLFCTAAPQLRRVLFAPQTV

SEQ ID NO: 25054 - protein, 32 aa, Mycobacterium avium
RRMRTRGWRRVGTAIVRWPGPVLAVSVAVALV

SEQ ID NO: 25055 - protein, 18 aa, Mycobacterium avium
RRPGLSWISIQSKVMVML

SEQ ID NO: 25056 - protein, 17 aa, Mycobacterium avium
RRPWRRLRFSQLIIGMS

SEQ ID NO: 25057 - protein, 35 aa, Mycobacterium avium
RRQVRLVVADRAYFLFLAVLPFVMGALSLTVPGSA

SEQ ID NO: 25058 - protein, 24 aa, Mycobacterium avium
RRRLTWGFLFLFNSLAVYWMETIG

SEQ ID NO: 25059 - protein, 22 aa, Mycobacterium avium
RRRRRMRARTIRLNETALMVQS

SEQ ID NO: 25060 - protein, 21 aa, Mycobacterium avium
RRRSGFPLLLLAVLAAIACAD

SEQ ID NO: 25061 - protein, 18 aa, Mycobacterium avium
RRVTLVVLALLTVLLVVL

SEQ ID NO: 25062 - protein, 19 aa, Mycobacterium avium
RSAALALLALFVVQFPIFS

SEQ ID NO: 25063 - protein, 19 aa, Mycobacterium avium
RSAALALLALFVVQFPIVS

SEQ ID NO: 25064 - protein, 26 aa, Mycobacterium avium
RSAMATLRIAFLSALVLELLATLGVA

SEQ ID NO: 25065 - protein, 33 aa, Mycobacterium avium
RSGPGWLLFQWRWSIVALWFTAVFLLIMVRFWD

SEQ ID NO: 25066 - protein, 17 aa, Mycobacterium avium
RSGVPARVGWLLAGGYG

SEQ ID NO: 25067 - protein, 26 aa, Mycobacterium avium
RSIHPNIPGLPWYAAVLVAVTATAIG

SEQ ID NO: 25068 - protein, 20 aa, Mycobacterium avium
RSPRRPWLEPLEDPEPIDVL

SEQ ID NO: 25069 - protein, 28 aa, Mycobacterium avium
RSQRRLMVAMLIPLLPFGVPFAAFSARP

SEQ ID NO: 25070 - protein, 27 aa, Mycobacterium avium
RSSPLGGLLAVAALLLITRGLHIDGVA

SEQ ID NO: 25071 - protein, 17 aa, Mycobacterium avium
RSTVDLAAPWFIGTAMG

SEQ ID NO: 25072 - protein, 17 aa, Mycobacterium avium
RTASIARWGGLALILLT

SEQ ID NO: 25073 - protein, 27 aa, Mycobacterium avium
RTDAAPGPWRLLLRDLAHLLDTASIVG

SEQ ID NO: 25074 - protein, 34 aa, Mycobacterium avium
RTEPALDLDALIGGFRPLFRALDPDQVNKLTGQL

SEQ ID NO: 25075 - protein, 27 aa, Mycobacterium avium
RTHLVASVLVLIILASCAGLVRYNYDD

SEQ ID NO: 25076 - protein, 20 aa, Mycobacterium avium
RTLAQRPLKWRLMLTVGEPG

SEQ ID NO: 25077 - protein, 27 aa, Mycobacterium avium
RTLASKVPFVVLVIGALGVGLGLTLWL

SEQ ID NO: 25078 - protein, 19 aa, Mycobacterium avium
RTPRVFQVAAWVAIVAGIV

SEQ ID NO: 25079 - protein, 30 aa, Mycobacterium avium
RTQAAGRLLAPLRWALILSGVLQAVITLIQ

SEQ ID NO: 25080 - protein, 30 aa, Mycobacterium avium
RTQAAGRLLAPLRWALIPSGVLQAVITLIQ

SEQ ID NO: 25081 - protein, 29 aa, Mycobacterium avium
RTSTWRHLPAILLVASLVLFTIAMAGPTN

SEQ ID NO: 25082 - protein, 25 aa, Mycobacterium avium
RTVRQFNDLLRVLPPLPEETPQEAP

SEQ ID NO: 25083 - protein, 24 aa, Mycobacterium avium
RTWHLQLSLFWTAAAFLAGGIFLV

SEQ ID NO: 25084 - protein, 24 aa, Mycobacterium avium
RTWHVQLSLFWTAAAFLAGGIFLV

SEQ ID NO: 25085 - protein, 21 aa, Mycobacterium avium
RVAHDFTLIPAFIEEILRVDG

SEQ ID NO: 25086 - protein, 39 aa, Mycobacterium avium
RVALRRMKAVALSFLIGATGLFLACRWAQAQPGVGAWVG

SEQ ID NO: 25087 - protein, 23 aa, Mycobacterium avium
RVAPAAPIALPEREPRNIWVMIG

SEQ ID NO: 25088 - protein, 28 aa, Mycobacterium avium
RVAPPHPSRWRHVPTILLATSLVLLTTA

SEQ ID NO: 25089 - protein, 27 aa, Mycobacterium avium
RVDGELILFWTLPVALVLWIASFCLFP

SEQ ID NO: 25090 - protein, 23 aa, Mycobacterium avium
RVEALVLVLAVAISLLGVPIGAA

SEQ ID NO: 25091 - protein, 19 aa, Mycobacterium avium
RVGDRLYPALNLASARLIT

SEQ ID NO: 25092 - protein, 25 aa, Mycobacterium avium
RVGMARFNAIWTGPETLPLPVEIEE

SEQ ID NO: 25093 - protein, 18 aa, Mycobacterium avium
RVGWLLAGGYGTAALLVL

SEQ ID NO: 25094 - protein, 17 aa, Mycobacterium avium
RVLLWLTVATLALNVGL

SEQ ID NO: 25095 - protein, 17 aa, Mycobacterium avium
RVLRRAADLLALGADPA

SEQ ID NO: 25096 - protein, 17 aa, Mycobacterium avium
RVLTELPPLIRHFADTR

SEQ ID NO: 25097 - protein, 19 aa, Mycobacterium avium
RVRGWGTLAAAFVVSVLLG

SEQ ID NO: 25098 - protein, 31 aa, Mycobacterium avium
RVSGVFVPVVLLLAVATLAGWLAAGGTLATA

SEQ ID NO: 25099 - protein, 26 aa, Mycobacterium avium
RVSGVFVPVVLLLAVATLAGWLTAGG

SEQ ID NO: 25100 - protein, 19 aa, Mycobacterium avium
RVTFFCIGGATLAQAASLP

SEQ ID NO: 25101 - protein, 23 aa, Mycobacterium avium
RVTRMPLLQRLSQTAGFVGTMYR

SEQ ID NO: 25102 - protein, 19 aa, Mycobacterium avium
RVWADRPVAALLLAAVAGS

SEQ ID NO: 25103 - protein, 18 aa, Mycobacterium avium
RWAVLLDGPVRISIGCQS

SEQ ID NO: 25104 - protein, 24 aa, Mycobacterium avium
RWERAMFIFIAITLLQIPMLLMSH

SEQ ID NO: 25105 - protein, 17 aa, Mycobacterium avium
RWVGYALALMLAILLNL

SEQ ID NO: 25106 - protein, 19 aa, Mycobacterium avium
RWVTTLGAFVLAVAPGWFG

SEQ ID NO: 25107 - protein, 17 aa, Mycobacterium avium
RWYRLARAYDYAGDRRR

SEQ ID NO: 25108 - protein, 23 aa, Mycobacterium avium
RYIRMCRRLAGFSVINHGSTLSV

SEQ ID NO: 25109 - protein, 19 aa, Mycobacterium avium
RYKIFPVAGTALMALAFLL

SEQ ID NO: 25110 - protein, 20 aa, Mycobacterium avium
RYKIFPVAGTALMALAFLLM

SEQ ID NO: 25111 - protein, 19 aa, Mycobacterium avium
RYKMFPVAGTALMALAFLL

SEQ ID NO: 25112 - protein, 26 aa, Mycobacterium avium
SAASLILIIMLIITRSLVAAIVIVGT

SEQ ID NO: 25113 - protein, 23 aa, Mycobacterium avium
SAGGIFNPLPKLDADTAAKMAQR

SEQ ID NO: 25114 - protein, 24 aa, Mycobacterium avium
SAGVPWLLVSGPLNRTDESDTALL

SEQ ID NO: 25115 - protein, 26 aa, Mycobacterium avium
SAHFTFGLALLAGLYVAASPWIVGFS

SEQ ID NO: 25116 - protein, 21 aa, Mycobacterium avium
SAHRPPNRKPLALLTNAAMCA

SEQ ID NO: 25117 - protein, 23 aa, Mycobacterium avium
SALCRHYWPLALLAATMSRHFRR

SEQ ID NO: 25118 - protein, 28 aa, Mycobacterium avium
SALLAGITLLTVPLSLLATRVIVRRSQR

SEQ ID NO: 25119 - protein, 20 aa, Mycobacterium avium
SALPAALARATLAGGIAAVL

SEQ ID NO: 25120 - protein, 36 aa, Mycobacterium avium
SALSFAIGALLPLIAILLPPPTWRIPVTVVAVLIAL

SEQ ID NO: 25121 - protein, 26 aa, Mycobacterium avium
SALTLIFMIMLLLTRSVVAALVIVGT

SEQ ID NO: 25122 - protein, 25 aa, Mycobacterium avium
SAPSSYPPFAAQYPYPATGPVSATD

SEQ ID NO: 25123 - protein, 39 aa, Mycobacterium avium
SARGRLRLPRRPGRSRWLRLPGRRAIAAGAGILLASASL

SEQ ID NO: 25124 - protein, 23 aa, Mycobacterium avium
SARPGLCARLRLRPGRDRRGDHR

SEQ ID NO: 25125 - protein, 21 aa, Mycobacterium avium
SARQLALALCALAAALALLAG

SEQ ID NO: 25126 - protein, 25 aa, Mycobacterium avium
SASDKPVIFWTPEHGAYVVRGAINS

SEQ ID NO: 25127 - protein, 29 aa, Mycobacterium avium
SASTVGITFLLIGFARMGVFKTVGISSAI

SEQ ID NO: 25128 - protein, 24 aa, Mycobacterium avium
SATVAFPMYFLKSFAYAGVATVAF

SEQ ID NO: 25129 - protein, 23 aa, Mycobacterium avium
SAVIQSLYLFILGAGIGLSMQVL

SEQ ID NO: 25130 - protein, 19 aa, Mycobacterium avium
SAYALTPWIGLAVAAVMLV

SEQ ID NO: 25131 - protein, 23 aa, Mycobacterium avium
SAYHALTFGWLMSGLGRAVTGKG

SEQ ID NO: 25132 - protein, 24 aa, Mycobacterium avium
SDYERLLYVVLPAFHLMTDVLKLF

SEQ ID NO: 25133 - protein, 20 aa, Mycobacterium avium
SEHAGTVMFVIAVAAVIAIA

SEQ ID NO: 25134 - protein, 21 aa, Mycobacterium avium
SEHFFVAPTLLLGLLTVLAVV

SEQ ID NO: 25135 - protein, 24 aa, Mycobacterium avium
SEIPAPRPIALGLFNAIPEAPPLT

SEQ ID NO: 25136 - protein, 23 aa, Mycobacterium avium
SERRLMVAAVLPLLPFGVPFAAF

SEQ ID NO: 25137 - protein, 19 aa, Mycobacterium avium
SERTFLGVIPMLTSTNLAI

SEQ ID NO: 25138 - protein, 18 aa, Mycobacterium avium
SEWLLVQSLIHAAPQHNT

SEQ ID NO: 25139 - protein, 23 aa, Mycobacterium avium
SFDAAGFFRTGDLGRWALADSAG

SEQ ID NO: 25140 - protein, 32 aa, Mycobacterium avium
SFGLSVLIWQDLFGIRIHWIVAALSVIILLAV

SEQ ID NO: 25141 - protein, 26 aa, Mycobacterium avium
SFLLRPGWVVLALVVVAFAYLCFTVL

SEQ ID NO: 25142 - protein, 28 aa, Mycobacterium avium
SFRRWERLMFLLIAVNVLIFPMVLLVHP

SEQ ID NO: 25143 - protein, 29 aa, Mycobacterium avium
SFRRWERLMFLLIAVNVLIFPMVLLVHPA

SEQ ID NO: 25144 - protein, 27 aa, Mycobacterium avium
SFRRWERLMFLLIAVNVLIFPMVMLVH

SEQ ID NO: 25145 - protein, 34 aa, Mycobacterium avium
SFTGAVVWLGIASFAAAGVVGLLAWVSRDRSPRL

SEQ ID NO: 25146 - protein, 32 aa, Mycobacterium avium
SFTVPARGVWWWVGVCMLGVVTLLALVNRLLL

SEQ ID NO: 25147 - protein, 28 aa, Mycobacterium avium
SGAAGAPWFAVSPLMHAAGMWTAFAAIM

SEQ ID NO: 25148 - protein, 28 aa, Mycobacterium avium
SGAPHRALVWLGWLTAATAIGWAIDTAT

SEQ ID NO: 25149 - protein, 25 aa, Mycobacterium avium
SGDMMNFPVAFRLSPLALACTAGAL

SEQ ID NO: 25150 - protein, 36 aa, Mycobacterium avium
SGEILMWLPLPLLGIPPWMVFFSFSVNLIYQFWIHT

SEQ ID NO: 25151 - protein, 31 aa, Mycobacterium avium
SGHTTFLELAPNPVALMQIGLTTAAAGLHDA

SEQ ID NO: 25152 - protein, 26 aa, Mycobacterium avium
SGLALAYLGLLWWMMVCWAQPVRNRS

SEQ ID NO: 25153 - protein, 24 aa, Mycobacterium avium
SGPVAFWACGLLLCMFIGPSQSSS

SEQ ID NO: 25154 - protein, 27 aa, Mycobacterium avium
SGRRRYGWLALTTALLGWAVGEVIWAV

SEQ ID NO: 25155 - protein, 26 aa, Mycobacterium avium
SGTLQMLRLYLRRDRISLPLWVLLLS

SEQ ID NO: 25156 - protein, 25 aa, Mycobacterium avium
SGTLQMLRLYLRRDRVSLPLWVLLL

SEQ ID NO: 25157 - protein, 21 aa, Mycobacterium avium
SGTVLPFTALNTPLAVAVDRD

SEQ ID NO: 25158 - protein, 20 aa, Mycobacterium avium
SGVDALLKDIRDFTGLVSAH

SEQ ID NO: 25159 - protein, 20 aa, Mycobacterium avium
SGVVLLIAAVGWVMAPETRT

SEQ ID NO: 25160 - protein, 24 aa, Mycobacterium avium
SHLLFVPQLLLFMLSTGLAPEQTF

SEQ ID NO: 25161 - protein, 26 aa, Mycobacterium avium
SIAFGLLLLIVFCFIELRAPQPMVNV

SEQ ID NO: 25162 - protein, 25 aa, Mycobacterium avium
SIAFGLLLLIVFCLIELRAPQPMVN

SEQ ID NO: 25163 - protein, 28 aa, Mycobacterium avium
SIALAAVAPILLPVGVHFIPKAARVRRG

SEQ ID NO: 25164 - protein, 35 aa, Mycobacterium avium
SIALTTVLPLQVISWLLMPISRLLVVLGNAVTPGR

SEQ ID NO: 25165 - protein, 20 aa, Mycobacterium avium
SIGLARWWHLGVDVLWLLNG

SEQ ID NO: 25166 - protein, 21 aa, Mycobacterium avium
SLAMLPLFVAAMMLVPAAGSV

SEQ ID NO: 25167 - protein, 18 aa, Mycobacterium avium
SLAWTGRLTPPGTFTAIP

SEQ ID NO: 25168 - protein, 20 aa, Mycobacterium avium
SLFALILAMPVALGVAIFIT

SEQ ID NO: 25169 - protein, 24 aa, Mycobacterium avium
SLGALWAWIAPPIRAVVALTRSGE

SEQ ID NO: 25170 - protein, 25 aa, Mycobacterium avium
SLGALWAWIAPPIRAVVALTRSGER

SEQ ID NO: 25171 - protein, 41 aa, Mycobacterium avium
SLGASFGLSVLLWQYLLGLKLHWMVLAMAVILLLAVGSDYN

SEQ ID NO: 25172 - protein, 24 aa, Mycobacterium avium
SLGNPLSFLNPFNIAFALGYPMDF

SEQ ID NO: 25173 - protein, 20 aa, Mycobacterium avium
SLIVVVVITLFISLAVYGVS

SEQ ID NO: 25174 - protein, 25 aa, Mycobacterium avium
SLLGSVSPLIRYLIKVPREFINDYL

SEQ ID NO: 25175 - protein, 25 aa, Mycobacterium avium
SLLHGWLPPTVQGLALLMLVAAIHW

SEQ ID NO: 25176 - protein, 20 aa, Mycobacterium avium
SLLLLACLLATLGLWRWSQG

SEQ ID NO: 25177 - protein, 20 aa, Mycobacterium avium
SLLVLLLVHHLPGLEGGGFG

SEQ ID NO: 25178 - protein, 24 aa, Mycobacterium avium
SLRLRLLVGQIVVLALVCLGITAV

SEQ ID NO: 25179 - protein, 20 aa, Mycobacterium avium
SLTWPRLTTVFLVDIVIMVV

SEQ ID NO: 25180 - protein, 18 aa, Mycobacterium avium
SLVVFLVALPLSLGIAIA

SEQ ID NO: 25181 - protein, 17 aa, Mycobacterium avium
SLWDAPLRFDPDRFDPR

SEQ ID NO: 25182 - protein, 25 aa, Mycobacterium avium
SMAVIAPAAWYGLGALLGAAVMIPV

SEQ ID NO: 25183 - protein, 19 aa, Mycobacterium avium
SMEVLVGILLACALAATTL

SEQ ID NO: 25184 - protein, 26 aa, Mycobacterium avium
SMHVMGRWNWWAPKPLAWLHDRFGIS

SEQ ID NO: 25185 - protein, 17 aa, Mycobacterium avium
SMLAFSGRFGRARKITW

SEQ ID NO: 25186 - protein, 18 aa, Mycobacterium avium
SMVLYIGCWWRHLNPPAA

SEQ ID NO: 25187 - protein, 29 aa, Mycobacterium avium
SNFDAPYLVWVPAVLLVLLGVLLAAARRR

SEQ ID NO: 25188 - protein, 30 aa, Mycobacterium avium
SNFDAPYLVWVPAVLLVLLGVLLAAARRRP

SEQ ID NO: 25189 - protein, 25 aa, Mycobacterium avium
SNKDAWMVGYTPSLSTAVWLGTAKG

SEQ ID NO: 25190 - protein, 23 aa, Mycobacterium avium
SNLYSQWVPRTLPPGWKPGSQAA

SEQ ID NO: 25191 - protein, 24 aa, Mycobacterium avium
SPHSSWLVIRWVVASALGGPLLMT

SEQ ID NO: 25192 - protein, 26 aa, Mycobacterium avium
SPHTTWVLYAVIIVSALIIAGAIPIL

SEQ ID NO: 25193 - protein, 30 aa, Mycobacterium avium
SPIRVITRRLAIALVVLFAAAVIVYADRSG

SEQ ID NO: 25194 - protein, 28 aa, Mycobacterium avium
SPLLAGITLLTVPLSLLATRVIVRRSQR

SEQ ID NO: 25195 - protein, 20 aa, Mycobacterium avium
SPLRGPWLTSVFGSILLVTL

SEQ ID NO: 25196 - protein, 26 aa, Mycobacterium avium
SPRIPPYKLLAVAVLLVLALILALIY

SEQ ID NO: 25197 - protein, 18 aa, Mycobacterium avium
SPRRPWLEPLEDSEPIDV

SEQ ID NO: 25198 - protein, 24 aa, Mycobacterium avium
SQGWPAALLFLLVPSIVVTGFTAL

SEQ ID NO: 25199 - protein, 41 aa, Mycobacterium avium
SQQWEFLDLPRLWQILLTVGLFLWIAIIWRGIRGKLKGESK

SEQ ID NO: 25200 - protein, 23 aa, Mycobacterium avium
SQVFLTLFGLPMADRDRLVQWKD

SEQ ID NO: 25201 - protein, 20 aa, Mycobacterium avium
SQVWADLWYDIPYSIETFQG

SEQ ID NO: 25202 - protein, 33 aa, Mycobacterium avium
SRAADLLEWLALAALVPLTCWIAGLYGTVRGLT

SEQ ID NO: 25203 - protein, 24 aa, Mycobacterium avium
SRALFDALPATEPLGVPPVPLAGT

SEQ ID NO: 25204 - protein, 19 aa, Mycobacterium avium
SRAQLLIASGSLAADPGKA

SEQ ID NO: 25205 - protein, 20 aa, Mycobacterium avium
SRARYLARTGPRPPPPPAEQ

SEQ ID NO: 25206 - protein, 19 aa, Mycobacterium avium
SRAVAMGAVLLVTGLAGCF

SEQ ID NO: 25207 - protein, 29 aa, Mycobacterium avium
SRAVGTAWRRSLQLRVVALTLGLSLAVIL

SEQ ID NO: 25208 - protein, 28 aa, Mycobacterium avium
SRHDIVIVRRAIRRLLLRGDSPETASLA

SEQ ID NO: 25209 - protein, 23 aa, Mycobacterium avium
SRIITPAPPPPPPDHRARNIAIG

SEQ ID NO: 25210 - protein, 25 aa, Mycobacterium avium
SRNRMAFLAALLFMMALCFATTNGW

SEQ ID NO: 25211 - protein, 24 aa, Mycobacterium avium
SRVTLFWVAFILTRPLGATVGDFI

SEQ ID NO: 25212 - protein, 52 aa, Mycobacterium avium
SSAMPAHPKKFSWHWWWLMAAIPVAVLLVLLIWVLFVWRRRRPGPEATGYGV

SEQ ID NO: 25213 - protein, 17 aa, Mycobacterium avium
SSAPWLIAVGAACIAGA

SEQ ID NO: 25214 - protein, 23 aa, Mycobacterium avium
SSEFQMLLAGRKLSARDRRVLSA

SEQ ID NO: 25215 - protein, 25 aa, Mycobacterium avium
SSGQRALLWAAGVLGALAIIIAVLI

SEQ ID NO: 25216 - protein, 44 aa, Mycobacterium avium
SSKATILDLIPANVYWVVGQLAVVVLLVAVWRGRRPGPLVAEEL

SEQ ID NO: 25217 - protein, 23 aa, Mycobacterium avium
SSQLLLLPQLVLVLLSTGIAPAE

SEQ ID NO: 25218 - protein, 24 aa, Mycobacterium avium
SSQLLLLPQLVLVLLSTGIAPAES

SEQ ID NO: 25219 - protein, 53 aa, Mycobacterium avium
SSSAMPAHPKKFSWHWWWLMAAIPVAVLLVLLIWVLFVWRRRRPGPEATGYGV

SEQ ID NO: 25220 - protein, 53 aa, Mycobacterium avium
SSSAMPAHPKKFSWHWWWLMAAVPVAVLLVLLIWVLFVWRRRRPGPEATGYGV

SEQ ID NO: 25221 - protein, 19 aa, Mycobacterium avium
SSVHYLLDVLRRVATDFDR

SEQ ID NO: 25222 - protein, 23 aa, Mycobacterium avium
SSVIGLLLPFSPSLGVLLFGRAA

SEQ ID NO: 25223 - protein, 18 aa, Mycobacterium avium
SSWWPYAALFAVAAAALL

SEQ ID NO: 25224 - protein, 25 aa, Mycobacterium avium
STAWLLALGLAMIAAGVWPASASGV

SEQ ID NO: 25225 - protein, 19 aa, Mycobacterium avium
STEFYALAARALAPGGLLV

SEQ ID NO: 25226 - protein, 18 aa, Mycobacterium avium
STEFYTLAARALAPGGLL

SEQ ID NO: 25227 - protein, 26 aa, Mycobacterium avium
STGPGYPPAPAPWSYGGPVPGPPGQR

SEQ ID NO: 25228 - protein, 24 aa, Mycobacterium avium
STGVPWLLVSGPLNRTDESDTALL

SEQ ID NO: 25229 - protein, 23 aa, Mycobacterium avium
STIMHGFWVLVFAVPFAGLVEKI

SEQ ID NO: 25230 - protein, 24 aa, Mycobacterium avium
STLAAGILVWLLPAGRDLDAFHGI

SEQ ID NO: 25231 - protein, 28 aa, Mycobacterium avium
STLALVARRWALAWIALAGTAIAGAAGM

SEQ ID NO: 25232 - protein, 24 aa, Mycobacterium avium
STLGAGILVWLLPAGRDLDAFHGI

SEQ ID NO: 25233 - protein, 18 aa, Mycobacterium avium
STTTRVRPIPPIFQPPFG

SEQ ID NO: 25234 - protein, 26 aa, Mycobacterium avium
STVLRHALLSYLLGAVILAVTINLIA

SEQ ID NO: 25235 - protein, 26 aa, Mycobacterium avium
SVAALMGRWFWWPQQVRTRPASQMLR

SEQ ID NO: 25236 - protein, 26 aa, Mycobacterium avium
SVADFWRFWVVHLWVEDFLELFTTVM

SEQ ID NO: 25237 - protein, 23 aa, Mycobacterium avium
SVDPVAALTWQLPAGDQPGPAAK

SEQ ID NO: 25238 - protein, 24 aa, Mycobacterium avium
SVDPVAALTWQLPAGDQPGPAAKP

SEQ ID NO: 25239 - protein, 17 aa, Mycobacterium avium
SVGGIFYALRWPDPWPS

SEQ ID NO: 25240 - protein, 23 aa, Mycobacterium avium
SVLILLYGIIALGAVALAFAPFR

SEQ ID NO: 25241 - protein, 24 aa, Mycobacterium avium
SVLILLYGIIALGAVALAFASFRR

SEQ ID NO: 25242 - protein, 20 aa, Mycobacterium avium
SVLIRRPLVGYAWSWAGGRG

SEQ ID NO: 25243 - protein, 35 aa, Mycobacterium avium
SVLSRLSVWLRPDWTRTVLARRIAAGTLVVLAAIA

SEQ ID NO: 25244 - protein, 24 aa, Mycobacterium avium
SVLTVLTVLAMMLSISALLAGITL

SEQ ID NO: 25245 - protein, 25 aa, Mycobacterium avium
SVLTVLTVLAMMLSISPLLAGITLL

SEQ ID NO: 25246 - protein, 26 aa, Mycobacterium avium
SVLTVLTVLAMMLSISPLLAGITLLT

SEQ ID NO: 25247 - protein, 17 aa, Mycobacterium avium
SVLVVLPPLLAVCGRRL

SEQ ID NO: 25248 - protein, 32 aa, Mycobacterium avium
SVLVWQDIIGFKLHWMVLAMSVILMLAVGSDY

SEQ ID NO: 25249 - protein, 17 aa, Mycobacterium avium
SVNFVWITDFQPYQPQL

SEQ ID NO: 25250 - protein, 18 aa, Mycobacterium avium
SVNFVWITDFQPYQPQLG

SEQ ID NO: 25251 - protein, 20 aa, Mycobacterium avium
SVPSDLSVYALYRAARDDGA

SEQ ID NO: 25252 - protein, 28 aa, Mycobacterium avium
SVPVMALTNYWVMSHMLPLFRRMQALID

SEQ ID NO: 25253 - protein, 21 aa, Mycobacterium avium
SWAILGVIKYRGITTAGPVLE

SEQ ID NO: 25254 - protein, 21 aa, Mycobacterium avium
SWLRFGIFYYSEAVGPTLRIG

SEQ ID NO: 25255 - protein, 29 aa, Mycobacterium avium
SWPAPLSILLALWAIRAVAHWLQARLGQR

SEQ ID NO: 25256 - protein, 22 aa, Mycobacterium avium
SWTHHWVWLVPLMIWAIHGPVR

SEQ ID NO: 25257 - protein, 23 aa, Mycobacterium avium
SWTHHWVWLVPLMIWAIHGPVRA

SEQ ID NO: 25258 - protein, 17 aa, Mycobacterium avium
SWVAIGLVLFVAGSVVA

SEQ ID NO: 25259 - protein, 22 aa, Mycobacterium avium
SYGVYLWHWPIFLALNGERSGW

SEQ ID NO: 25260 - protein, 24 aa, Mycobacterium avium
SYPPKPPVGAALWKLMERARQIGL

SEQ ID NO: 25261 - protein, 25 aa, Mycobacterium avium
SYPPKPPVGAALWKLMERARQIGLH

SEQ ID NO: 25262 - protein, 18 aa, Mycobacterium avium
SYVWGVRVGGLFTALGVT

SEQ ID NO: 25263 - protein, 28 aa, Mycobacterium avium
TAALGLSLLALWLLTRATGQPLTVALLG

SEQ ID NO: 25264 - protein, 26 aa, Mycobacterium avium
TAALLAHIAVMLAFLIIVLHSKHMHI

SEQ ID NO: 25265 - protein, 27 aa, Mycobacterium avium
TAALLAHIAVMLAFLIIVLHSKHMHIF

SEQ ID NO: 25266 - protein, 18 aa, Mycobacterium avium
TAALWAVALLVAGTGIGM

SEQ ID NO: 25267 - protein, 29 aa, Mycobacterium avium
TAAMLAEIVGLLRAGVLTPLPLKTFDVRC

SEQ ID NO: 25268 - protein, 22 aa, Mycobacterium avium
TAASAFLWPRSLQARATRRALL

SEQ ID NO: 25269 - protein, 18 aa, Mycobacterium avium
TAAVAVLIIACPCALGLA

SEQ ID NO: 25270 - protein, 17 aa, Mycobacterium avium
TADFDFTLRRGLPDDAV

SEQ ID NO: 25271 - protein, 26 aa, Mycobacterium avium
TADYSFLSFYPYWGFQGLTSHYANPL

SEQ ID NO: 25272 - protein, 20 aa, Mycobacterium avium
TAFGLLVLVLLLSGLNATVF

SEQ ID NO: 25273 - protein, 25 aa, Mycobacterium avium
TAGAYLAAHAPYLAWLVRASTDSAA

SEQ ID NO: 25274 - protein, 39 aa, Mycobacterium avium
TAGLIALILLIVYRSVFTALLPLLVIGISLAVGRGVLSA

SEQ ID NO: 25275 - protein, 25 aa, Mycobacterium avium
TALCLFTAVFIMLRRKRIPGVARGP

SEQ ID NO: 25276 - protein, 21 aa, Mycobacterium avium
TALIVLIAVLFLGSPISMTKV

SEQ ID NO: 25277 - protein, 33 aa, Mycobacterium avium
TANGKLPLDSFIAFLVFGTVITAGLMTVMMSIH

SEQ ID NO: 25278 - protein, 22 aa, Mycobacterium avium
TAPDRFIPVAMLPFWDIEESVK

SEQ ID NO: 25279 - protein, 18 aa, Mycobacterium avium
TARLLLRSMGYRDALIGA

SEQ ID NO: 25280 - protein, 29 aa, Mycobacterium avium
TASALVFKPLFFPNISPSAGTLASFATYA

SEQ ID NO: 25281 - protein, 20 aa, Mycobacterium avium
TATLIMRPVGALLFGLWADR

SEQ ID NO: 25282 - protein, 18 aa, Mycobacterium avium
TAVAVLVLGWRTARRWRR

SEQ ID NO: 25283 - protein, 26 aa, Mycobacterium avium
TAVQYRLPMTFVLFNNNAHAMCVTRE

SEQ ID NO: 25284 - protein, 27 aa, Mycobacterium avium
TDAYRSQALLYTSMLVQAYQSANIHVQ

SEQ ID NO: 25285 - protein, 17 aa, Mycobacterium avium
TELRRLLGPNLFVLPHT

SEQ ID NO: 25286 - protein, 24 aa, Mycobacterium avium
TENLRYYYLILPTVDGSLSRRFGF

SEQ ID NO: 25287 - protein, 24 aa, Mycobacterium avium
TEPGLPRYFAAYVLGLSAACALAA

SEQ ID NO: 25288 - protein, 29 aa, Mycobacterium avium
TEPLVLGFVALIAFVMLLVSIHSVFLALK

SEQ ID NO: 25289 - protein, 21 aa, Mycobacterium avium
TFAVNLLVLLAIAAGTDYAIF

SEQ ID NO: 25290 - protein, 31 aa, Mycobacterium avium
TFGLGSRYFRFLPRRLVERIVPKPGTGPSPA

SEQ ID NO: 25291 - protein, 18 aa, Mycobacterium avium
TFLTVEAWAFLQLGARQQ

SEQ ID NO: 25292 - protein, 18 aa, Mycobacterium avium
TFLTVEAWAFLQLGSRQQ

SEQ ID NO: 25293 - protein, 18 aa, Mycobacterium avium
TFLVPSPLAHIGGSIYAF

SEQ ID NO: 25294 - protein, 19 aa, Mycobacterium avium
TFRRIAATLRRPVLRLGRP

SEQ ID NO: 25295 - protein, 30 aa, Mycobacterium avium
TFSSGQRALLWAAGVLGALAIIIAVLIVIN

SEQ ID NO: 25296 - protein, 17 aa, Mycobacterium avium
TFTAIPPYWQQTADWLT

SEQ ID NO: 25297 - protein, 20 aa, Mycobacterium avium
TFTFALVAFAWRRPRFDPLK

SEQ ID NO: 25298 - protein, 17 aa, Mycobacterium avium
TFTVNIVGAFLVGYFTT

SEQ ID NO: 25299 - protein, 24 aa, Mycobacterium avium
TFVALLYLVELIDQLTRHALDVHG

SEQ ID NO: 25300 - protein, 28 aa, Mycobacterium avium
TFVVRTLVIPALFTLVGDRIWWPNNPSR

SEQ ID NO: 25301 - protein, 28 aa, Mycobacterium avium
TGFWIRRARRLLPALVLMVLTVAAARQL

SEQ ID NO: 25302 - protein, 18 aa, Mycobacterium avium
TGGLLLKSTGRLNDYVRV

SEQ ID NO: 25303 - protein, 25 aa, Mycobacterium avium
TGISPCILPVLPVILLSSMDGDRRG

SEQ ID NO: 25304 - protein, 26 aa, Mycobacterium avium
TGKRGFLPPFVTWFAALLFAVIPIRN

SEQ ID NO: 25305 - protein, 17 aa, Mycobacterium avium
TGKVVVLLFIDQTVTNT

SEQ ID NO: 25306 - protein, 23 aa, Mycobacterium avium
TGPAMLPALFPTNVRYGALAISY

SEQ ID NO: 25307 - protein, 26 aa, Mycobacterium avium
TGPAVNFLPNNPPPPGPPGPPGPPGP

SEQ ID NO: 25308 - protein, 26 aa, Mycobacterium avium
TGRVVALIVLLLVVAAALRGYLPAQH

SEQ ID NO: 25309 - protein, 21 aa, Mycobacterium avium
TGSVHLYLAYGMLGVLIVLVV

SEQ ID NO: 25310 - protein, 22 aa, Mycobacterium avium
THALWCWIVAIAVAVVAHHGLL

SEQ ID NO: 25311 - protein, 27 aa, Mycobacterium avium
THQEAALTWLLLISVPVMAVTNYWVMS

SEQ ID NO: 25312 - protein, 19 aa, Mycobacterium avium
THSWRWMLGLACVPAVLLL

SEQ ID NO: 25313 - protein, 35 aa, Mycobacterium avium
TIAGGYLLVLAMLYGWWCMHRGVPYFPNLVLPIVV

SEQ ID NO: 25314 - protein, 22 aa, Mycobacterium avium
TIEWYDFYLYATASALVFKPLF

SEQ ID NO: 25315 - protein, 25 aa, Mycobacterium avium
TIGWGSTLLVLLATFLLGWGVVAPM

SEQ ID NO: 25316 - protein, 29 aa, Mycobacterium avium
TILDLVVVFLVTWPLVYLASKSPTLAKPA

SEQ ID NO: 25317 - protein, 19 aa, Mycobacterium avium
TINVSSVALIWFGGLRIDH

SEQ ID NO: 25318 - protein, 25 aa, Mycobacterium avium
TIRGAWALIGFFGTVQLVVTAIIAL

SEQ ID NO: 25319 - protein, 17 aa, Mycobacterium avium
TITITFAYIGLTCPRWR

SEQ ID NO: 25320 - protein, 17 aa, Mycobacterium avium
TIYLPQSPSTAESDTAI

SEQ ID NO: 25321 - protein, 26 aa, Mycobacterium avium
TKAAARWIRPLAPPLVARMMDTTTHR

SEQ ID NO: 25322 - protein, 26 aa, Mycobacterium avium
TKTAPPLSQLRPGAFPPALDRVIAKG

SEQ ID NO: 25323 - protein, 22 aa, Mycobacterium avium
TLADVAVIFGFVLWHVIGANSS

SEQ ID NO: 25324 - protein, 22 aa, Mycobacterium avium
TLALLTAVGFAGPLLASAKRFR

SEQ ID NO: 25325 - protein, 27 aa, Mycobacterium avium
TLALVTRRWALAWIALAGTAIAGAAGM

SEQ ID NO: 25326 - protein, 27 aa, Mycobacterium avium
TLAPVAIALAMLFAPFAGADGYTDQLV

SEQ ID NO: 25327 - protein, 26 aa, Mycobacterium avium
TLASKVPFVVLVIGALGVGLGLTLWL

SEQ ID NO: 25328 - protein, 21 aa, Mycobacterium avium
TLCAVVLRRLRAALALALACA

SEQ ID NO: 25329 - protein, 19 aa, Mycobacterium avium
TLDRWLLFNWMRYGRALEY

SEQ ID NO: 25330 - protein, 18 aa, Mycobacterium avium
TLIFEIFCYVAIAVAGVA

SEQ ID NO: 25331 - protein, 22 aa, Mycobacterium avium
TLLVAIPFTVLVSFTLNILLRE

SEQ ID NO: 25332 - protein, 32 aa, Mycobacterium avium
TLLYASVMGVAWLLDVPALIRKRFPVAPRSRM

SEQ ID NO: 25333 - protein, 31 aa, Mycobacterium avium
TLNALPPRPEVRLLWALIAAAAIIEGALPIP

SEQ ID NO: 25334 - protein, 18 aa, Mycobacterium avium
TLQMDPWIRFQNSAKVAQ

SEQ ID NO: 25335 - protein, 19 aa, Mycobacterium avium
TLQMDPWIRFQNSAKVAQL

SEQ ID NO: 25336 - protein, 24 aa, Mycobacterium avium
TLRLKGYLLMCRNSRRDYADFADM

SEQ ID NO: 25337 - protein, 19 aa, Mycobacterium avium
TLSAPLPLPASGGVRLQLV

SEQ ID NO: 25338 - protein, 19 aa, Mycobacterium avium
TLSVLGVALLMLGAARLYA

SEQ ID NO: 25339 - protein, 24 aa, Mycobacterium avium
TLTRILFDWRFDLIFGTAAIVLAG

SEQ ID NO: 25340 - protein, 19 aa, Mycobacterium avium
TMFCSFLAGLLATMADFTL

SEQ ID NO: 25341 - protein, 25 aa, Mycobacterium avium
TMIIGSYVLDWRVGLAFTAGALLCA

SEQ ID NO: 25342 - protein, 17 aa, Mycobacterium avium
TMLALVCLLVIAVLATC

SEQ ID NO: 25343 - protein, 17 aa, Mycobacterium avium
TMLFTIAAAMTLGPALL

SEQ ID NO: 25344 - protein, 17 aa, Mycobacterium avium
TMPISRLADPPGPAAPP

SEQ ID NO: 25345 - protein, 26 aa, Mycobacterium avium
TNAGEPIFWVVRALELLEDFEQFGYY

SEQ ID NO: 25346 - protein, 25 aa, Mycobacterium avium
TNLVWAFGYNLAAIPLAALGMLNPM

SEQ ID NO: 25347 - protein, 17 aa, Mycobacterium avium
TNNTVVAYFPAANALYP

SEQ ID NO: 25348 - protein, 25 aa, Mycobacterium avium
TNRLPPAATLQLLFSVGVDGFFAIS

SEQ ID NO: 25349 - protein, 20 aa, Mycobacterium avium
TPDFPLPFTYPPFAAIVFYP

SEQ ID NO: 25350 - protein, 22 aa, Mycobacterium avium
TPEAPFGWYYDLLALWAHVSTT

SEQ ID NO: 25351 - protein, 20 aa, Mycobacterium avium
TPGPLWATWTASTALTLFVT

SEQ ID NO: 25352 - protein, 17 aa, Mycobacterium avium
TPLWRAAQVFRLLSCLY

SEQ ID NO: 25353 - protein, 21 aa, Mycobacterium avium
TPPPLVMVLGWLVLAGVLAVS

SEQ ID NO: 25354 - protein, 17 aa, Mycobacterium avium
TQERLLRRDMGVGELLG

SEQ ID NO: 25355 - protein, 28 aa, Mycobacterium avium
TQPALDLDALIGGFRPLFQALDPNKVDS

SEQ ID NO: 25356 - protein, 28 aa, Mycobacterium avium
TQPALDLDALIGGFRPLFQALDPNKVNS

SEQ ID NO: 25357 - protein, 36 aa, Mycobacterium avium
TQPKFWNRWIGWVMRRPWMSALAASLVLLVMAAPAA

SEQ ID NO: 25358 - protein, 19 aa, Mycobacterium avium
TQRFSWVAIGLVLFVAGSV

SEQ ID NO: 25359 - protein, 31 aa, Mycobacterium avium
TRAPQALFVWIALAGMAIAILLLGWRGARWW

SEQ ID NO: 25360 - protein, 61 aa, Mycobacterium avium
TRAPQALFVWIALAGMAIAILLLGWRGARWWRRGLSILAVPLCLLCSLLVLNQWVGYFQTV

SEQ ID NO: 25361 - protein, 21 aa, Mycobacterium avium
TRGGYLKDIKGFDSEFFAVAK

SEQ ID NO: 25362 - protein, 27 aa, Mycobacterium avium
TRGKDFLFDDLIRTLAQRPLKWRLMLT

SEQ ID NO: 25363 - protein, 21 aa, Mycobacterium avium
TRILFDWRFDLIFGTAAIVLA

SEQ ID NO: 25364 - protein, 33 aa, Mycobacterium avium
TRKVRWHIAILAVVVALIVALLAQLRDDAATPG

SEQ ID NO: 25365 - protein, 27 aa, Mycobacterium avium
TRLVRLLRPLILVPLVLPPVVGGIALL

SEQ ID NO: 25366 - protein, 26 aa, Mycobacterium avium
TRSFQLVRRGFWRVLGIRALAFLVTA

SEQ ID NO: 25367 - protein, 25 aa, Mycobacterium avium
TSKYYPAWLPSRRFIAAVIAIGGMQ

SEQ ID NO: 25368 - protein, 22 aa, Mycobacterium avium
TSLMHGWVPMTVQVLAGVVLTL

SEQ ID NO: 25369 - protein, 23 aa, Mycobacterium avium
TSNVVIFAIQIALGELLRHHGAK

SEQ ID NO: 25370 - protein, 21 aa, Mycobacterium avium
TSPAGWVAILLYAVCVVLRLA

SEQ ID NO: 25371 - protein, 29 aa, Mycobacterium avium
TSTFVLIVAFLLVWWVYDTYRPEPAPKPP

SEQ ID NO: 25372 - protein, 18 aa, Mycobacterium avium
TSVAFAVGVVRLGQRRCL

SEQ ID NO: 25373 - protein, 21 aa, Mycobacterium avium
TSVLVIWFLLGVVSVRLFGFT

SEQ ID NO: 25374 - protein, 22 aa, Mycobacterium avium
TTATLIMRPVGALLFGLWADRV

SEQ ID NO: 25375 - protein, 23 aa, Mycobacterium avium
TTATTLTYALWALGRHPEYQARV

SEQ ID NO: 25376 - protein, 23 aa, Mycobacterium avium
TTAVLMDRWDPARAVALMTAHRC

SEQ ID NO: 25377 - protein, 24 aa, Mycobacterium avium
TTDPSWVSLMFLSAALVVDIGGLM

SEQ ID NO: 25378 - protein, 25 aa, Mycobacterium avium
TTIEWYDFYLYATASALVFKPLFFP

SEQ ID NO: 25379 - protein, 26 aa, Mycobacterium avium
TTTAMVFVICVAALLVPRCSCGPSAG

SEQ ID NO: 25380 - protein, 18 aa, Mycobacterium avium
TVAGPWVGVAAPGERIVS

SEQ ID NO: 25381 - protein, 19 aa, Mycobacterium avium
TVAGPWVGVAAPGERIVSI

SEQ ID NO: 25382 - protein, 28 aa, Mycobacterium avium
TVDMTLTKPWLYNWQYQPLDAADATALE

SEQ ID NO: 25383 - protein, 17 aa, Mycobacterium avium
TVFLVDIVIMVVASHCP

SEQ ID NO: 25384 - protein, 24 aa, Mycobacterium avium
TVGCYTLLAMAFNTFGIQLEHAEQ

SEQ ID NO: 25385 - protein, 23 aa, Mycobacterium avium
TVGVLFAIILLDASLIGANAVGL

SEQ ID NO: 25386 - protein, 20 aa, Mycobacterium avium
TVGYAALLLAISCAILMLGP

SEQ ID NO: 25387 - protein, 20 aa, Mycobacterium avium
TVLARWYITSLGVAGDPAPT

SEQ ID NO: 25388 - protein, 29 aa, Mycobacterium avium
TVPGGWLTATVLFLLLAIAAVVAVHTLRR

SEQ ID NO: 25389 - protein, 22 aa, Mycobacterium avium
TVPIILFVLIFQRRIVAGLTSG

SEQ ID NO: 25390 - protein, 28 aa, Mycobacterium avium
TVPSLAWVPLLLLWFGIDETPKILMVAV

SEQ ID NO: 25391 - protein, 24 aa, Mycobacterium avium
TVRQFNDLLRVLPPLPEETPQEAP

SEQ ID NO: 25392 - protein, 35 aa, Mycobacterium avium
TVSGMFTRYVKPGLLPWLAASAIALIALALMAIIG

SEQ ID NO: 25393 - protein, 24 aa, Mycobacterium avium
TVVFSFMALFFINILTTALGVKVT

SEQ ID NO: 25394 - protein, 27 aa, Mycobacterium avium
TVVRKIVKLSFPNAWIPGAAKPADREP

SEQ ID NO: 25395 - protein, 23 aa, Mycobacterium avium
TWKYVIICSVGIAIAFLGTVLLY

SEQ ID NO: 25396 - protein, 28 aa, Mycobacterium avium
TWTHYSGWWVFDMVMLVLFGVAAAGVTL

SEQ ID NO: 25397 - protein, 17 aa, Mycobacterium avium
TYEFWLKAGIVALGSRF

SEQ ID NO: 25398 - protein, 25 aa, Mycobacterium avium
VAAGALAIALIRPATRLPAATTLPK

SEQ ID NO: 25399 - protein, 23 aa, Mycobacterium avium
VAAHAPYHAWLLESAAKSSTAAS

SEQ ID NO: 25400 - protein, 24 aa, Mycobacterium avium
VAATGWLGYLLGPPLIGHLSEWVG

SEQ ID NO: 25401 - protein, 20 aa, Mycobacterium avium
VAAWSAPLPGPWVAATTATL

SEQ ID NO: 25402 - protein, 25 aa, Mycobacterium avium
VADFWRFWVVHLWVEDFLELFTTVM

SEQ ID NO: 25403 - protein, 37 aa, Mycobacterium avium
VADPEYLAYYPFVYAGLLLLMRARLKRLPIAVQLDSV

SEQ ID NO: 25404 - protein, 20 aa, Mycobacterium avium
VAEPIYYPRYLIFTAPAMAI

SEQ ID NO: 25405 - protein, 39 aa, Mycobacterium avium
VAFAIPTYAFIIGVLTMIGWGLFRIFVLGNPLRAESAGF

SEQ ID NO: 25406 - protein, 18 aa, Mycobacterium avium
VAGLYFWTGVSRVTLFWV

SEQ ID NO: 25407 - protein, 27 aa, Mycobacterium avium
VAGRMDPVNLLPFLLLGTTFGARLLGI

SEQ ID NO: 25408 - protein, 28 aa, Mycobacterium avium
VAGRRVVLNFWAYWCAPCAAELPAMAEY

SEQ ID NO: 25409 - protein, 19 aa, Mycobacterium avium
VAGTALMALAFLLMSRMQP

SEQ ID NO: 25410 - protein, 25 aa, Mycobacterium avium
VAGVILAYPWFFVPVLVVVCALLVN

SEQ ID NO: 25411 - protein, 22 aa, Mycobacterium avium
VAGVQLYRKLTTTAVVAYFSET

SEQ ID NO: 25412 - protein, 26 aa, Mycobacterium avium
VAHNWPITWIGFDVLLVGFMLATAVL

SEQ ID NO: 25413 - protein, 26 aa, Mycobacterium avium
VAIASWIIFGWLAWALARVIMRPVPG

SEQ ID NO: 25414 - protein, 25 aa, Mycobacterium avium
VAILIAWYLLLRLFGYTLSSVAAPA

SEQ ID NO: 25415 - protein, 26 aa, Mycobacterium avium
VALAGSLLFGLWHVATSFGLTSGNVG

SEQ ID NO: 25416 - protein, 23 aa, Mycobacterium avium
VALIVLLLVVAALRGYLPAQHDA

SEQ ID NO: 25417 - protein, 21 aa, Mycobacterium avium
VALLSLIAGVLWGAGWVAVLA

SEQ ID NO: 25418 - protein, 17 aa, Mycobacterium avium
VALPLAGAAILLFGGRR

SEQ ID NO: 25419 - protein, 38 aa, Mycobacterium avium
VALTASALLLTAGLTVWVVGYTLRPLRRLAAIAAHVAA

SEQ ID NO: 25420 - protein, 35 aa, Mycobacterium avium
VALTGITCFVGFLASYLFNVYFQRGAPGSFVATFS

SEQ ID NO: 25421 - protein, 36 aa, Mycobacterium avium
VALTGITCFVGFLASYLFNVYFQRGAPGSFVATFSS

SEQ ID NO: 25422 - protein, 20 aa, Mycobacterium avium
VALYLIGSLAGFSQWLLDLE

SEQ ID NO: 25423 - protein, 21 aa, Mycobacterium avium
VALYLIGSLAGFSQWLLDLEP

SEQ ID NO: 25424 - protein, 22 aa, Mycobacterium avium
VAMLFAVIPAVAAALSWIILGQ

SEQ ID NO: 25425 - protein, 26 aa, Mycobacterium avium
VAMLGVALVLFLGLRNSALAAPRPPT

SEQ ID NO: 25426 - protein, 27 aa, Mycobacterium avium
VAMVVVLMAFAVYAVISAALYSDIDNQ

SEQ ID NO: 25427 - protein, 19 aa, Mycobacterium avium
VAPAAPIALPEREPRNIWV

SEQ ID NO: 25428 - protein, 18 aa, Mycobacterium avium
VAPLLLAAAGGVPAVLAY

SEQ ID NO: 25429 - protein, 17 aa, Mycobacterium avium
VAPLTFLGAAYVTVFVS

SEQ ID NO: 25430 - protein, 29 aa, Mycobacterium avium
VAPRNTVCVSWLPFYHDMGLVQGVIAPIL

SEQ ID NO: 25431 - protein, 25 aa, Mycobacterium avium
VAPTTLAVLMLLPLSAFEAMTPLPA

SEQ ID NO: 25432 - protein, 24 aa, Mycobacterium avium
VAPVAVLVYLFAVDWRVALVLFVP

SEQ ID NO: 25433 - protein, 23 aa, Mycobacterium avium
VARVLALPPLVWLGTISYGVYLW

SEQ ID NO: 25434 - protein, 30 aa, Mycobacterium avium
VARWPGPILVAALGLTLLVALPLAGMRIGF

SEQ ID NO: 25435 - protein, 31 aa, Mycobacterium avium
VARWPGPILVAALGLTLLVALPLAGMRIGFN

SEQ ID NO: 25436 - protein, 34 aa, Mycobacterium avium
VASVISWVSVVIIGIWVMLQIASILQFSVGGLVA

SEQ ID NO: 25437 - protein, 28 aa, Mycobacterium avium
VASVLPVWLLLAPHDYLSTFMKVGAIAL

SEQ ID NO: 25438 - protein, 19 aa, Mycobacterium avium
VAVHRPLRFPALTAAGAGL

SEQ ID NO: 25439 - protein, 31 aa, Mycobacterium avium
VAVLGAALGLRYALGARRWARLGMAGSAGGL

SEQ ID NO: 25440 - protein, 17 aa, Mycobacterium avium
VAVLVVIAVLVVITALV

SEQ ID NO: 25441 - protein, 26 aa, Mycobacterium avium
VAVPAVLVLAPFWLIPTALDVHLSMT

SEQ ID NO: 25442 - protein, 33 aa, Mycobacterium avium
VAVPGRYFYVKWWKLVLVLLAVWAASAVIGLGL

SEQ ID NO: 25443 - protein, 32 aa, Mycobacterium avium
VAVQALLFPAFLLIVYKLLIGKAVLAVTGHDS

SEQ ID NO: 25444 - protein, 31 aa, Mycobacterium avium
VAVQALLFPTLLLVIYKLLVGKSVLAVTGHD

SEQ ID NO: 25445 - protein, 28 aa, Mycobacterium avium
VAVSVCWWLLLRVYRRLNTAKFTVINQI

SEQ ID NO: 25446 - protein, 18 aa, Mycobacterium avium
VAWVLVSGLLQALYWIRQ

SEQ ID NO: 25447 - protein, 18 aa, Mycobacterium avium
VAYRLYATAPIPRVAPLS

SEQ ID NO: 25448 - protein, 20 aa, Mycobacterium avium
VCDQILLIAPGGKTAFCGPP

SEQ ID NO: 25449 - protein, 21 aa, Mycobacterium avium
VCDQILLIAPGGKTAFCGPPD

SEQ ID NO: 25450 - protein, 22 aa, Mycobacterium avium
VCDQILLIAPGGKTAFCGPPDQ

SEQ ID NO: 25451 - protein, 18 aa, Mycobacterium avium
VCMRMTLSGFYSHPWAWN

SEQ ID NO: 25452 - protein, 24 aa, Mycobacterium avium
VCTADLMTMFKRAGLAAAGMVGAA

SEQ ID NO: 25453 - protein, 25 aa, Mycobacterium avium
VDLVRGTLRILLPISIVGAVLLVAG

SEQ ID NO: 25454 - protein, 20 aa, Mycobacterium avium
VDQALVLWVLIALVASMVLF

SEQ ID NO: 25455 - protein, 23 aa, Mycobacterium avium
VDQVLKFYAPLVAGDKLYCDVYV

SEQ ID NO: 25456 - protein, 18 aa, Mycobacterium avium
VDQYSLPDYLYVPVDPEP

SEQ ID NO: 25457 - protein, 21 aa, Mycobacterium avium
VEAAYFINLAFMALFVFATPV

SEQ ID NO: 25458 - protein, 25 aa, Mycobacterium avium
VEIGDLHWFYVYSGVMWACVFMRTG

SEQ ID NO: 25459 - protein, 22 aa, Mycobacterium avium
VERIVPIVFGLLYIVLLVGRLL

SEQ ID NO: 25460 - protein, 20 aa, Mycobacterium avium
VESMISAMAQLYVYGHDLDI

SEQ ID NO: 25461 - protein, 18 aa, Mycobacterium avium
VEVPPPVAPPPPPPPVTI

SEQ ID NO: 25462 - protein, 17 aa, Mycobacterium avium
VEWYDFFLYATAAGLVF

SEQ ID NO: 25463 - protein, 22 aa, Mycobacterium avium
VFAIGLFVLPWAGTPGPFRVGA

SEQ ID NO: 25464 - protein, 26 aa, Mycobacterium avium
VFANCYAVWVLIAALGAFVISAVLGL

SEQ ID NO: 25465 - protein, 20 aa, Mycobacterium avium
VFFIAALVVLFYSTFFFFFF

SEQ ID NO: 25466 - protein, 18 aa, Mycobacterium avium
VFHGGTLARRDQTAAATR

SEQ ID NO: 25467 - protein, 27 aa, Mycobacterium avium
VFTRINAILGVLLLIVLATGSVINGMF

SEQ ID NO: 25468 - protein, 24 aa, Mycobacterium avium
VGAIAGLVLALSSAPWLIAVGAAC

SEQ ID NO: 25469 - protein, 28 aa, Mycobacterium avium
VGAVGMVLMAIWFHVWQDKVRDLMGVAH

SEQ ID NO: 25470 - protein, 20 aa, Mycobacterium avium
VGAVMVAALAGLSGWLGYRA

SEQ ID NO: 25471 - protein, 17 aa, Mycobacterium avium
VGCRAFDGLKQRCSWSP

SEQ ID NO: 25472 - protein, 26 aa, Mycobacterium avium
VGENHFYLYYFILTGVHLFHVCVGMG

SEQ ID NO: 25473 - protein, 27 aa, Mycobacterium avium
VGFAAIVFLVVRYVVPPVRRLMAARQE

SEQ ID NO: 25474 - protein, 21 aa, Mycobacterium avium
VGFLVAWQRPLAGKKTFMDLV

SEQ ID NO: 25475 - protein, 22 aa, Mycobacterium avium
VGGWLLLVGATLACAGLLWADR

SEQ ID NO: 25476 - protein, 25 aa, Mycobacterium avium
VGHLALFGMLLRDTRWWLGGLGDIG

SEQ ID NO: 25477 - protein, 20 aa, Mycobacterium avium
VGKPPWVFTIRDGQARWTPA

SEQ ID NO: 25478 - protein, 17 aa, Mycobacterium avium
VGKTVFVFPGQGSQWPG

SEQ ID NO: 25479 - protein, 17 aa, Mycobacterium avium
VGLLLDTLVVRAFIVPS

SEQ ID NO: 25480 - protein, 19 aa, Mycobacterium avium
VGLMALWLAGLRWRRHGVR

SEQ ID NO: 25481 - protein, 17 aa, Mycobacterium avium
VGLVILMRYRGLGWADL

SEQ ID NO: 25482 - protein, 17 aa, Mycobacterium avium
VGMLISVFIALTLVPAV

SEQ ID NO: 25483 - protein, 28 aa, Mycobacterium avium
VGPFKKGPFRIAMAAGIPIVPIVIRNAE

SEQ ID NO: 25484 - protein, 42 aa, Mycobacterium avium
VGPIFLVVYFTLGLGSLLQWMFYVGLLITVADVLIALALANY

SEQ ID NO: 25485 - protein, 33 aa, Mycobacterium avium
VGPLMWLYALFNVAAWIFVFFRMPDLTGKTLEE

SEQ ID NO: 25486 - protein, 27 aa, Mycobacterium avium
VGPRDLEPFRCFYLSAPFVVPKTKEVA

SEQ ID NO: 25487 - protein, 24 aa, Mycobacterium avium
VGQPATPPLPMPFPRTGQGGEPRM

SEQ ID NO: 25488 - protein, 26 aa, Mycobacterium avium
VGQRPWTPLIGLLSQAADLGLRVIVT

SEQ ID NO: 25489 - protein, 28 aa, Mycobacterium avium
VGRRPPYLFGALASVVALVLFFVAAGTG

SEQ ID NO: 25490 - protein, 38 aa, Mycobacterium avium
VGSRPPSYPWQPARRPRPWLAIALAVTAAVAAGALAIA

SEQ ID NO: 25491 - protein, 19 aa, Mycobacterium avium
VGTLLLFALVVTPAATAIM

SEQ ID NO: 25492 - protein, 18 aa, Mycobacterium avium
VGTLLLLSGILMATTLFP

SEQ ID NO: 25493 - protein, 36 aa, Mycobacterium avium
VGTTIGLGLLFDTLIVRSFMMPSVAALMGRWFWWPQ

SEQ ID NO: 25494 - protein, 18 aa, Mycobacterium avium
VGTWPLVAPMLAAGTVIL

SEQ ID NO: 25495 - protein, 26 aa, Mycobacterium avium
VGVTVSLYFVLYRPDQRVGDAAAHRA

SEQ ID NO: 25496 - protein, 22 aa, Mycobacterium avium
VGVVLLILDALRERQQRDLGGD

SEQ ID NO: 25497 - protein, 18 aa, Mycobacterium avium
VGVVYLKDLVQQALLPGG

SEQ ID NO: 25498 - protein, 17 aa, Mycobacterium avium
VHGWLPVAIQAVAGITL

SEQ ID NO: 25499 - protein, 17 aa, Mycobacterium avium
VHLRLSLVPVLIGLAIA

SEQ ID NO: 25500 - protein, 25 aa, Mycobacterium avium
VHPVAMLGFMVLISGAFVAATQAIN

SEQ ID NO: 25501 - protein, 19 aa, Mycobacterium avium
VIAAVTHRFSPQTRWAAAL

SEQ ID NO: 25502 - protein, 30 aa, Mycobacterium avium
VIAVVVVVVLLLVLYRARRRRRAARGVGPG

SEQ ID NO: 25503 - protein, 17 aa, Mycobacterium avium
VIFLLLGMMIIVSVLRQ

SEQ ID NO: 25504 - protein, 22 aa, Mycobacterium avium
VIGLGLFSWWYHSIDKTPALFA

SEQ ID NO: 25505 - protein, 17 aa, Mycobacterium avium
VIMEFGLTMPIAREVDA

SEQ ID NO: 25506 - protein, 28 aa, Mycobacterium avium
VITLIQLAPFVLLVELARRLVAGAPAAR

SEQ ID NO: 25507 - protein, 29 aa, Mycobacterium avium
VITLIQLAPFVLLVELVRRLVAGAPAARL

SEQ ID NO: 25508 - protein, 24 aa, Mycobacterium avium
VIVAPMFHAWGFGQLVFAAMMACT

SEQ ID NO: 25509 - protein, 20 aa, Mycobacterium avium
VIVLALVVGYVGWRLYEKLT

SEQ ID NO: 25510 - protein, 21 aa, Mycobacterium avium
VIVLALVVGYVGWRLYEKLTN

SEQ ID NO: 25511 - protein, 26 aa, Mycobacterium avium
VIWSIRVMIAILWFSAGMAIVSSLYS

SEQ ID NO: 25512 - protein, 21 aa, Mycobacterium avium
VKAFGIGFLARPRSQPAADAR

SEQ ID NO: 25513 - protein, 37 aa, Mycobacterium avium
VKFGVFAAVMLMLTTSLFFIFGQFRNGPTHSYSAVFI

SEQ ID NO: 25514 - protein, 26 aa, Mycobacterium avium
VKVDWPHFWWLITSPSSRTALLLSLR

SEQ ID NO: 25515 - protein, 22 aa, Mycobacterium avium
VLAALLTVGLSAGLLAPPAGAQ

SEQ ID NO: 25516 - protein, 22 aa, Mycobacterium avium
VLAIWLRRRLANLAARLVTSLC

SEQ ID NO: 25517 - protein, 19 aa, Mycobacterium avium
VLAKIVVFCVFAVAQAAVA

SEQ ID NO: 25518 - protein, 18 aa, Mycobacterium avium
VLALLTVLLVVLGVTIDV

SEQ ID NO: 25519 - protein, 20 aa, Mycobacterium avium
VLAVVPFFSTVIGTVGMDLA

SEQ ID NO: 25520 - protein, 21 aa, Mycobacterium avium
VLDQHLYFTLNAPAAQTGGTA

SEQ ID NO: 25521 - protein, 17 aa, Mycobacterium avium
VLGFWSLVVLREYERGV

SEQ ID NO: 25522 - protein, 26 aa, Mycobacterium avium
VLGVAQLLGRIPLPGSAPKSLWLSAF

SEQ ID NO: 25523 - protein, 22 aa, Mycobacterium avium
VLLAALIWLRVYPVSMIGVPGQ

SEQ ID NO: 25524 - protein, 18 aa, Mycobacterium avium
VLLALLALADKWLDRRGK

SEQ ID NO: 25525 - protein, 24 aa, Mycobacterium avium
VLLALLVGLECLFAKALKADPLLY

SEQ ID NO: 25526 - protein, 25 aa, Mycobacterium avium
VLLALLVGLECLFAKALKADPLLYP

SEQ ID NO: 25527 - protein, 23 aa, Mycobacterium avium
VLLGPLLSLLGRPKVEGLEHVPS

SEQ ID NO: 25528 - protein, 22 aa, Mycobacterium avium
VLLPFFSFMTYLIAVPTGIKFF

SEQ ID NO: 25529 - protein, 18 aa, Mycobacterium avium
VLNRAFPPLPPGRSPEVS

SEQ ID NO: 25530 - protein, 17 aa, Mycobacterium avium
VLPPVVGGIALLYAFGR

SEQ ID NO: 25531 - protein, 25 aa, Mycobacterium avium
VLQGAWVHLLPSRKEGWGLAVVEAA

SEQ ID NO: 25532 - protein, 29 aa, Mycobacterium avium
VLRAMGAGRRFILRMVLAEAAGIGCVGGG

SEQ ID NO: 25533 - protein, 32 aa, Mycobacterium avium
VLRENVVALTVLWLLNIGEYLQDLTLRRTRRA

SEQ ID NO: 25534 - protein, 34 aa, Mycobacterium avium
VLRGGRSRFGFGTLAVLLCLLLGIAIVTQVRQTE

SEQ ID NO: 25535 - protein, 18 aa, Mycobacterium avium
VLRRAPWVDVVFGTHNIG

SEQ ID NO: 25536 - protein, 29 aa, Mycobacterium avium
VLSLPAAVRALIATLAILVKAAADRQAQP

SEQ ID NO: 25537 - protein, 24 aa, Mycobacterium avium
VLVAIPFFLLLLTLEWTAARKLEH

SEQ ID NO: 25538 - protein, 24 aa, Mycobacterium avium
VLVALLLSALLVPVVDWLDRHGLP

SEQ ID NO: 25539 - protein, 24 aa, Mycobacterium avium
VLVALPIGVTLSIQFALLANQVGA

SEQ ID NO: 25540 - protein, 17 aa, Mycobacterium avium
VLVITLMFFMFENAPHR

SEQ ID NO: 25541 - protein, 18 aa, Mycobacterium avium
VLVLVGLYVAYYGGYEVR

SEQ ID NO: 25542 - protein, 29 aa, Mycobacterium avium
VLVPANVLWGATPFFPGLTLTVSVLAGMV

SEQ ID NO: 25543 - protein, 18 aa, Mycobacterium avium
VLWQQLPALIWPVFGRDT

SEQ ID NO: 25544 - protein, 19 aa, Mycobacterium avium
VLWQQLPALIWPVFGRDTK

SEQ ID NO: 25545 - protein, 23 aa, Mycobacterium avium
VMFAVLGWFYLSVLPGWLGLDQT

SEQ ID NO: 25546 - protein, 18 aa, Mycobacterium avium
VMFLVAVGFWNFLGAGIF

SEQ ID NO: 25547 - protein, 17 aa, Mycobacterium avium
VMLLPFLLTVAGQAHQI

SEQ ID NO: 25548 - protein, 23 aa, Mycobacterium avium
VMVSLLVCLIPTTIGALLSAIGI

SEQ ID NO: 25549 - protein, 26 aa, Mycobacterium avium
VNGKPWLVFGPYAGWSPKFLKHGHFT

SEQ ID NO: 25550 - protein, 17 aa, Mycobacterium avium
VNIVIWFATVIYLLIVE

SEQ ID NO: 25551 - protein, 19 aa, Mycobacterium avium
VNLAAAGVLVFFFLAAILA

SEQ ID NO: 25552 - protein, 18 aa, Mycobacterium avium
VNPYLAVAAIVAGGLYGI

SEQ ID NO: 25553 - protein, 24 aa, Mycobacterium avium
VNQSIPEYILIRSPHDLRTPQALA

SEQ ID NO: 25554 - protein, 27 aa, Mycobacterium avium
VNQSLISAILIMAFPHTGLGVERLYDA

SEQ ID NO: 25555 - protein, 22 aa, Mycobacterium avium
VPAFLLIRFGGVYPVIFIGVLL

SEQ ID NO: 25556 - protein, 51 aa, Mycobacterium avium
VPAKRPPAWSLSNWPVRWKVLAIVLVPLMLATVFGVLRIHGAMANAAGLRL

SEQ ID NO: 25557 - protein, 26 aa, Mycobacterium avium
VPGQLRVLPPFLSRKHLPSRLARLRE

SEQ ID NO: 25558 - protein, 19 aa, Mycobacterium avium
VPIKWLLAIPHVLVCWSME

SEQ ID NO: 25559 - protein, 25 aa, Mycobacterium avium
VPLSIQIVVRALWLDLLRANRDPLT

SEQ ID NO: 25560 - protein, 27 aa, Mycobacterium avium
VPLSNFLGWLLTGWLIFQLVALVEPRF

SEQ ID NO: 25561 - protein, 35 aa, Mycobacterium avium
VPPGLPAWIGWTHFFNLFMMMFIIRTGIQILCDHP

SEQ ID NO: 25562 - protein, 17 aa, Mycobacterium avium
VPPLTYPGQWTVAQLAV

SEQ ID NO: 25563 - protein, 32 aa, Mycobacterium avium
VPPPRRKRLFTRSRLFPTAAVVIAAAALLLVG

SEQ ID NO: 25564 - protein, 31 aa, Mycobacterium avium
VPPPRRKRLFTRSRLFPTAAVVIAAAALLPV

SEQ ID NO: 25565 - protein, 39 aa, Mycobacterium avium
VPSALTCWAVTAGGIWWPIGRELAWCCVGLLAIAGALRW

SEQ ID NO: 25566 - protein, 24 aa, Mycobacterium avium
VPSPTVLMIGLPTGLRLVIDNAIA

SEQ ID NO: 25567 - protein, 17 aa, Mycobacterium avium
VPVLLVAALVLVVTGPR

SEQ ID NO: 25568 - protein, 29 aa, Mycobacterium avium
VQGQFYVSFLVLIAGLAYLFGRPLGARLR

SEQ ID NO: 25569 - protein, 30 aa, Mycobacterium avium
VQGQFYVSFLVLIAGLAYLFGRPLGARLRT

SEQ ID NO: 25570 - protein, 21 aa, Mycobacterium avium
VRARLVLRLARNYIPLRGTGK

SEQ ID NO: 25571 - protein, 25 aa, Mycobacterium avium
VRARVFHNIAFPGAFLLLALAANGY

SEQ ID NO: 25572 - protein, 25 aa, Mycobacterium avium
VRARVFHNIAFPGAFLLLALAATGY

SEQ ID NO: 25573 - protein, 17 aa, Mycobacterium avium
VRDGLLAATLPLLWSRG

SEQ ID NO: 25574 - protein, 30 aa, Mycobacterium avium
VRDVRYLGSQPWPFPRSLMVGFHAVADPAQ

SEQ ID NO: 25575 - protein, 24 aa, Mycobacterium avium
VRFAVLSRAPRFPIAVPRPQFADY

SEQ ID NO: 25576 - protein, 18 aa, Mycobacterium avium
VRLGANGATIPYYLCMLE

SEQ ID NO: 25577 - protein, 18 aa, Mycobacterium avium
VRRHRVVGTWPLVAPMLA

SEQ ID NO: 25578 - protein, 18 aa, Mycobacterium avium
VRRVRVRRWRRSRSGSAS

SEQ ID NO: 25579 - protein, 26 aa, Mycobacterium avium
VRTVRFWAAPLVITLALMSALCALYL

SEQ ID NO: 25580 - protein, 36 aa, Mycobacterium avium
VRWPWLVIGFWAALAVALPLAFPSLAEMAQKHPLAI

SEQ ID NO: 25581 - protein, 18 aa, Mycobacterium avium
VRYLNLVGDRYLELIIGP

SEQ ID NO: 25582 - protein, 30 aa, Mycobacterium avium
VRYRERLWVPWWWWPPAFALAGIIAFEFNM

SEQ ID NO: 25583 - protein, 22 aa, Mycobacterium avium
VSALTMLPVFETPPAHAVSPPA

SEQ ID NO: 25584 - protein, 29 aa, Mycobacterium avium
VSARVLVIAALAAVFVFIAAVAGVQLYRK

SEQ ID NO: 25585 - protein, 31 aa, Mycobacterium avium
VSDRGYTIFLAVLPFLIGALSLTVKGPHPGL

SEQ ID NO: 25586 - protein, 26 aa, Mycobacterium avium
VSFTVPARGVWWWVGVCVLGVVTLLA

SEQ ID NO: 25587 - protein, 31 aa, Mycobacterium avium
VSFTVPARGVWWWVGVCVLGVVTLLVLVNRL

SEQ ID NO: 25588 - protein, 33 aa, Mycobacterium avium
VSGVRSLSTGFFPLMGIGAFSMLAFSGRFGRAR

SEQ ID NO: 25589 - protein, 32 aa, Mycobacterium avium
VSLAGFQHAWFFLALLAVLLVIGLYVVQQFAR

SEQ ID NO: 25590 - protein, 34 aa, Mycobacterium avium
VSLAGFQHAWFFLFLLAVLLVIGLYVVQQFARRR

SEQ ID NO: 25591 - protein, 20 aa, Mycobacterium avium
VSLPAAALFAAARAALDRRR

SEQ ID NO: 25592 - protein, 17 aa, Mycobacterium avium
VSLPFLVISLEGAARTA

SEQ ID NO: 25593 - protein, 17 aa, Mycobacterium avium
VSTWILPGVVLTAGMTW

SEQ ID NO: 25594 - protein, 18 aa, Mycobacterium avium
VSWLLFTWMIARLPREKV

SEQ ID NO: 25595 - protein, 23 aa, Mycobacterium avium
VTAAIVAMLAFGAGLAWLAMDRR

SEQ ID NO: 25596 - protein, 37 aa, Mycobacterium avium
VTDRLPLVLGLMAAITFVLLFLLTGSVLLPAKALACN

SEQ ID NO: 25597 - protein, 17 aa, Mycobacterium avium
VTDVLLEIIMIVGALHF

SEQ ID NO: 25598 - protein, 17 aa, Mycobacterium avium
VTFFCIGGATLAQAASL

SEQ ID NO: 25599 - protein, 18 aa, Mycobacterium avium
VTFFCIGGATLAQAASLP

SEQ ID NO: 25600 - protein, 17 aa, Mycobacterium avium
VTGFICHVGWEVTADIA

SEQ ID NO: 25601 - protein, 23 aa, Mycobacterium avium
VTGTAQFLIPRNAPQRVTAGPAG

SEQ ID NO: 25602 - protein, 23 aa, Mycobacterium avium
VTGWLLVYAVLMAAGAWLCGQRW

SEQ ID NO: 25603 - protein, 23 aa, Mycobacterium avium
VTGWLLVYAVLMAGGAWLCGQRW

SEQ ID NO: 25604 - protein, 28 aa, Mycobacterium avium
VTRTRTYWLLPCLFWLSTTTQIFTSLIH

SEQ ID NO: 25605 - protein, 20 aa, Mycobacterium avium
VTSLIRHGLFLDAPEARERG

SEQ ID NO: 25606 - protein, 18 aa, Mycobacterium avium
VTSLTLLVLLFVGCYTLP

SEQ ID NO: 25607 - protein, 24 aa, Mycobacterium avium
VTTFLLAWELMATASLVLVLAQHT

SEQ ID NO: 25608 - protein, 28 aa, Mycobacterium avium
VTYHPALEQLLVLLPPSVAAYGSYGVTN

SEQ ID NO: 25609 - protein, 31 aa, Mycobacterium avium
VVDAGPLYFWLPFLTCLLALAELHLRTIRLV

SEQ ID NO: 25610 - protein, 20 aa, Mycobacterium avium
VVFIIASWSVARFAAPVVAV

SEQ ID NO: 25611 - protein, 20 aa, Mycobacterium avium
VVFPLPVDILTPFLQRSVTP

SEQ ID NO: 25612 - protein, 18 aa, Mycobacterium avium
VVFQHPYLFHGSIRDNVL

SEQ ID NO: 25613 - protein, 18 aa, Mycobacterium avium
VVFVWIASTIQCYYGYYA

SEQ ID NO: 25614 - protein, 26 aa, Mycobacterium avium
VVGAAIGGYLWWRSRRTYLLTVAGDR

SEQ ID NO: 25615 - protein, 19 aa, Mycobacterium avium
VVGTWPLVAPMLAAGTVIL

SEQ ID NO: 25616 - protein, 23 aa, Mycobacterium avium
VVHGWVYFVYVLTAFNLAVKVRW

SEQ ID NO: 25617 - protein, 19 aa, Mycobacterium avium
VVHLRLALVPVLIGLAIAL

SEQ ID NO: 25618 - protein, 18 aa, Mycobacterium avium
VVIPAAAVLLVGTALMIG

SEQ ID NO: 25619 - protein, 30 aa, Mycobacterium avium
VVLAKLWSVIPRLFAWPPARSIAQLLERVS

SEQ ID NO: 25620 - protein, 18 aa, Mycobacterium avium
VVLASYLPAAAIALFQAV

SEQ ID NO: 25621 - protein, 48 aa, Mycobacterium avium
VVLQSILAVAFGAGLFVAFDQLWRWNSIVALVLSVLVILGLVVGVRVV

SEQ ID NO: 25622 - protein, 29 aa, Mycobacterium avium
VVLTVIGLGLIFPPLQQLIERPFAYLPQR

SEQ ID NO: 25623 - protein, 18 aa, Mycobacterium avium
VVLVAVAGAVIALAARRR

SEQ ID NO: 25624 - protein, 25 aa, Mycobacterium avium
VVNLFPGQFVQPFIDAAFSDLGLDP

SEQ ID NO: 25625 - protein, 27 aa, Mycobacterium avium
VVNLLTPLISAVLLPAAIAVAIVPVSW

SEQ ID NO: 25626 - protein, 18 aa, Mycobacterium avium
VVPTVALAVPWLTELERL

SEQ ID NO: 25627 - protein, 17 aa, Mycobacterium avium
VVPVFLTGYDWTRWLTV

SEQ ID NO: 25628 - protein, 18 aa, Mycobacterium avium
VVTGFICHVGWEVTADIA

SEQ ID NO: 25629 - protein, 31 aa, Mycobacterium avium
VVTLLVLVNRLLLPVITGWSLGRALAGIAVT

SEQ ID NO: 25630 - protein, 31 aa, Mycobacterium avium
VVVGWVISLIMVNPFLLLAQQARAINAQSSP

SEQ ID NO: 25631 - protein, 20 aa, Mycobacterium avium
VVVPIVHFYGPKELRYILSS

SEQ ID NO: 25632 - protein, 17 aa, Mycobacterium avium
VVVVLKGKVWTGLLGMF

SEQ ID NO: 25633 - protein, 18 aa, Mycobacterium avium
VVVVLKGKVWTGLLGMFL

SEQ ID NO: 25634 - protein, 28 aa, Mycobacterium avium
VVYTGAVMMLFLFVLMLIGVDSAESLRE

SEQ ID NO: 25635 - protein, 21 aa, Mycobacterium avium
VWITDFQPYQPQLGQPTAWLV

SEQ ID NO: 25636 - protein, 21 aa, Mycobacterium avium
VWLCTVIVGMLLRKASSAGVA

SEQ ID NO: 25637 - protein, 20 aa, Mycobacterium avium
VYGSLLIPPSFSSKLRDFAT

SEQ ID NO: 25638 - protein, 17 aa, Mycobacterium avium
VYIYAWPMQQLLAICGL

SEQ ID NO: 25639 - protein, 18 aa, Mycobacterium avium
WAAAGGVPAVLAYRGINT

SEQ ID NO: 25640 - protein, 27 aa, Mycobacterium avium
WAADNQTWPTTLWASNPTISAAIQFGP

SEQ ID NO: 25641 - protein, 38 aa, Mycobacterium avium
WACHRPNRLWWRYTGWWLVALVLATLWWVVGLVMLRAI

SEQ ID NO: 25642 - protein, 20 aa, Mycobacterium avium
WAFAVMLVGTWWDNTRPARE

SEQ ID NO: 25643 - protein, 26 aa, Mycobacterium avium
WAGCVVPLANLLWAPVFVIELALLEE

SEQ ID NO: 25644 - protein, 25 aa, Mycobacterium avium
WAGRCAARWRSIVATALVAGAVGVT

SEQ ID NO: 25645 - protein, 17 aa, Mycobacterium avium
WALPRWGSHRLIPVTVA

SEQ ID NO: 25646 - protein, 17 aa, Mycobacterium avium
WAMAFATLVSRLTGFAR

SEQ ID NO: 25647 - protein, 17 aa, Mycobacterium avium
WARTALLLVEPTSATLA

SEQ ID NO: 25648 - protein, 27 aa, Mycobacterium avium
WASPFWQLWDLALLWLAQLHGGNGLRT

SEQ ID NO: 25649 - protein, 26 aa, Mycobacterium avium
WAVAPIAFIALIAIGADYNLLLALRI

SEQ ID NO: 25650 - protein, 21 aa, Mycobacterium avium
WCATLDGLGGRRVDLPTYGFV

SEQ ID NO: 25651 - protein, 23 aa, Mycobacterium avium
WDRHLRPMLARRYAIATGQRQAK

SEQ ID NO: 25652 - protein, 19 aa, Mycobacterium avium
WELPVLRWVDGGRGNRRVI

SEQ ID NO: 25653 - protein, 17 aa, Mycobacterium avium
WGGLYFTTLLRRRLAII

SEQ ID NO: 25654 - protein, 28 aa, Mycobacterium avium
WGTLAAAFVVSVLLGIGIGWGLYGNTSS

SEQ ID NO: 25655 - protein, 22 aa, Mycobacterium avium
WHQVKVVSAPSWFSDYVLSVGA

SEQ ID NO: 25656 - protein, 20 aa, Mycobacterium avium
WIDRAMNLNIWAGAALLVID

SEQ ID NO: 25657 - protein, 19 aa, Mycobacterium avium
WIDRAMNLNIWAGAALLVL

SEQ ID NO: 25658 - protein, 27 aa, Mycobacterium avium
WIEYLCLMPIFPLALWLMNVYAAIRYR

SEQ ID NO: 25659 - protein, 17 aa, Mycobacterium avium
WIFAIVSVLFLAQTLMG

SEQ ID NO: 25660 - protein, 18 aa, Mycobacterium avium
WKTRLLTLLAIVGPGIIV

SEQ ID NO: 25661 - protein, 18 aa, Mycobacterium avium
WKWNVIGLLAIALAGAVV

SEQ ID NO: 25662 - protein, 17 aa, Mycobacterium avium
WLAGLRWRRHGIRAALE

SEQ ID NO: 25663 - protein, 19 aa, Mycobacterium avium
WLAVAVLITIGVPSLEQVE

SEQ ID NO: 25664 - protein, 19 aa, Mycobacterium avium
WLCTVIVGMLLRKASSAGV

SEQ ID NO: 25665 - protein, 20 aa, Mycobacterium avium
WLGAAVLLALLALADKWLDR

SEQ ID NO: 25666 - protein, 29 aa, Mycobacterium avium
WLIDTSSWRWIFLINVPIGLVTVALAAVV

SEQ ID NO: 25667 - protein, 18 aa, Mycobacterium avium
WLIVGYFAVLAAITVGAA

SEQ ID NO: 25668 - protein, 18 aa, Mycobacterium avium
WLLAIPHVLVCWSMEPLL

SEQ ID NO: 25669 - protein, 18 aa, Mycobacterium avium
WLLLVCAVAAAIGVAVGA

SEQ ID NO: 25670 - protein, 20 aa, Mycobacterium avium
WLLVSGPLNRTDESDTALLF

SEQ ID NO: 25671 - protein, 17 aa, Mycobacterium avium
WLSAFAHPERDKWVATA

SEQ ID NO: 25672 - protein, 17 aa, Mycobacterium avium
WLVAGYALALVATAWGV

SEQ ID NO: 25673 - protein, 17 aa, Mycobacterium avium
WLVAPIGAPGRAAGVLA

SEQ ID NO: 25674 - protein, 27 aa, Mycobacterium avium
WLVPTSAALLTWRLLRPSWGEWRTAGA

SEQ ID NO: 25675 - protein, 17 aa, Mycobacterium avium
WMLFGSPAVICSILSPK

SEQ ID NO: 25676 - protein, 27 aa, Mycobacterium avium
WNFTAAKNMFAWIGPVLAALQGNPVCD

SEQ ID NO: 25677 - protein, 17 aa, Mycobacterium avium
WNGSLWSLVWEVACYLA

SEQ ID NO: 25678 - protein, 26 aa, Mycobacterium avium
WPDAFKILNRQGLYGDFFSFYLCDIV

SEQ ID NO: 25679 - protein, 19 aa, Mycobacterium avium
WPLEITVAWAVVLVAVFIP

SEQ ID NO: 25680 - protein, 20 aa, Mycobacterium avium
WPVPLLAFIILVAVGADYNM

SEQ ID NO: 25681 - protein, 17 aa, Mycobacterium avium
WRIDPAGLHLYADPARQ

SEQ ID NO: 25682 - protein, 17 aa, Mycobacterium avium
WRIGFLLSVLLVAIGIV

SEQ ID NO: 25683 - protein, 35 aa, Mycobacterium avium
WRKQTWLGRFVSTYGWRAYALPALVVLTAVVIYQT

SEQ ID NO: 25684 - protein, 18 aa, Mycobacterium avium
WRRLRFSQLIIGMSAAVA

SEQ ID NO: 25685 - protein, 17 aa, Mycobacterium avium
WRRSGVPARVGWLLAGG

SEQ ID NO: 25686 - protein, 22 aa, Mycobacterium avium
WSAACALAYLRGFGRKPAWVLA

SEQ ID NO: 25687 - protein, 17 aa, Mycobacterium avium
WSFVGPRLPAGARMVLQ

SEQ ID NO: 25688 - protein, 24 aa, Mycobacterium avium
WSTALLPLALLLLAAAVAAIAVRG

SEQ ID NO: 25689 - protein, 27 aa, Mycobacterium avium
WTHYSGWWVFDMVMLVLFGLAAAGVTL

SEQ ID NO: 25690 - protein, 27 aa, Mycobacterium avium
WTHYSGWWVFDMVMLVLFGVAAAGVTL

SEQ ID NO: 25691 - protein, 26 aa, Mycobacterium avium
WTRTSPSWAFFSLPTRAWELAAGGLV

SEQ ID NO: 25692 - protein, 26 aa, Mycobacterium avium
WVALVISLCSALLSWRVLRWEKQSAK

SEQ ID NO: 25693 - protein, 18 aa, Mycobacterium avium
WVARATGMKVRRYFVGFG

SEQ ID NO: 25694 - protein, 17 aa, Mycobacterium avium
WVFTIRDGQARWTPAVD

SEQ ID NO: 25695 - protein, 21 aa, Mycobacterium avium
WVLAELVVVVLLMWSNHLVAS

SEQ ID NO: 25696 - protein, 26 aa, Mycobacterium avium
WVLAELVVVVLLMWSNNLVASPHWAA

SEQ ID NO: 25697 - protein, 29 aa, Mycobacterium avium
WVLTFNATYWLFLITPTIVVRLAFGEPSA

SEQ ID NO: 25698 - protein, 18 aa, Mycobacterium avium
WVTDVLLEIIMIVGALHF

SEQ ID NO: 25699 - protein, 25 aa, Mycobacterium avium
WVTGWLLIYTVLMAAGAWLCGQRWL

SEQ ID NO: 25700 - protein, 20 aa, Mycobacterium avium
WVVHLLPVLPIATVVLVLLP

SEQ ID NO: 25701 - protein, 19 aa, Mycobacterium avium
WWFVVVLLVRDGLLAATLP

SEQ ID NO: 25702 - protein, 20 aa, Mycobacterium avium
WWFVVVLLVRDGLLAATLPL

SEQ ID NO: 25703 - protein, 17 aa, Mycobacterium avium
WWTPDTLGDLLARGLKD

SEQ ID NO: 25704 - protein, 18 aa, Mycobacterium avium
WYDFFLYATAAGLVFNKV

SEQ ID NO: 25705 - protein, 17 aa, Mycobacterium avium
WYFRQILGSANLIGGKL

SEQ ID NO: 25706 - protein, 25 aa, Mycobacterium avium
YAAGILAYELLTGRTPFTGDSTLAI

SEQ ID NO: 25707 - protein, 25 aa, Mycobacterium avium
YAAVSLPFLLLFRLTCYYYRGAYYR

SEQ ID NO: 25708 - protein, 21 aa, Mycobacterium avium
YARTAMLFVEPYSATMAVVDT

SEQ ID NO: 25709 - protein, 18 aa, Mycobacterium avium
YDFYLYATASALVFKPLF

SEQ ID NO: 25710 - protein, 24 aa, Mycobacterium avium
YDRPLWVQYFAQLNQVLHGHFGFS

SEQ ID NO: 25711 - protein, 25 aa, Mycobacterium avium
YDWTRWLTVVAFDIAIVFLLFASRR

SEQ ID NO: 25712 - protein, 21 aa, Mycobacterium avium
YEHYFRTFLRPEDVGWAVFEV

SEQ ID NO: 25713 - protein, 26 aa, Mycobacterium avium
YFAATLSLRWLSTLIYLGGLATVAGV

SEQ ID NO: 25714 - protein, 17 aa, Mycobacterium avium
YFGFLINLLIVFGVSFE

SEQ ID NO: 25715 - protein, 17 aa, Mycobacterium avium
YFTLNAPAAQTGGTAAT

SEQ ID NO: 25716 - protein, 20 aa, Mycobacterium avium
YFTYSDVLGFIYAQAKFQVL

SEQ ID NO: 25717 - protein, 25 aa, Mycobacterium avium
YGALYLWAFWDPFGHTNKMPVALVN

SEQ ID NO: 25718 - protein, 36 aa, Mycobacterium avium
YGIVRFDLQLLGPGPRWWAITLLVVGGVSAVYGVLQ

SEQ ID NO: 25719 - protein, 24 aa, Mycobacterium avium
YGLAALAMRLGWFSASALATSVLV

SEQ ID NO: 25720 - protein, 34 aa, Mycobacterium avium
YGPKELRYILSSVRPRVFITAEGFGRMTYVPEVC

SEQ ID NO: 25721 - protein, 30 aa, Mycobacterium avium
YGRSALSRIPRRWVIAALGVLVVAAGLAVA

SEQ ID NO: 25722 - protein, 30 aa, Mycobacterium avium
YGVQPYKFLNFPYWWGFINGGSFVTVGAVL

SEQ ID NO: 25723 - protein, 28 aa, Mycobacterium avium
YGWGFFISGVVLLIAAVGWVMAPETRTA

SEQ ID NO: 25724 - protein, 18 aa, Mycobacterium avium
YIWGVRIGGLFTALGITS

SEQ ID NO: 25725 - protein, 18 aa, Mycobacterium avium
YLINRRWTFQAAPSTARF

SEQ ID NO: 25726 - protein, 21 aa, Mycobacterium avium
YLRRQLLVLAAFTTGVLLICD

SEQ ID NO: 25727 - protein, 32 aa, Mycobacterium avium
YLVHNPALAFQYLVQLMLFDWPTHILEIFMSQ

SEQ ID NO: 25728 - protein, 20 aa, Mycobacterium avium
YLVWAILCTVLCCLPLGIVS

SEQ ID NO: 25729 - protein, 21 aa, Mycobacterium avium
YLVWAILCTVLCCLPLGIVSM

SEQ ID NO: 25730 - protein, 18 aa, Mycobacterium avium
YNAFVPNLAIPELIQPFF

SEQ ID NO: 25731 - protein, 19 aa, Mycobacterium avium
YPSVFAQGMFSAALLAGFA

SEQ ID NO: 25732 - protein, 18 aa, Mycobacterium avium
YQAWLLESAAKSSTAASL

SEQ ID NO: 25733 - protein, 17 aa, Mycobacterium avium
YQSLTLPSAWTGQPEPL

SEQ ID NO: 25734 - protein, 26 aa, Mycobacterium avium
YRAGLAVGLALLPVLALLACWRTRKR

SEQ ID NO: 25735 - protein, 27 aa, Mycobacterium avium
YRAGLAVGLALLPVLALLACWRTRKRG

SEQ ID NO: 25736 - protein, 32 aa, Mycobacterium avium
YRGANLIRPGFIGTVLILLVVAVGLAPDRLVT

SEQ ID NO: 25737 - protein, 18 aa, Mycobacterium avium
YRYARAMARWSPTSRSEI

SEQ ID NO: 25738 - protein, 19 aa, Mycobacterium avium
YRYARAMARWSPTSRSEID

SEQ ID NO: 25739 - protein, 37 aa, Mycobacterium avium
YSAFVPNFLAPQLFQPFLDYLWGFRTFDTALGPGHPS

SEQ ID NO: 25740 - protein, 25 aa, Mycobacterium avium
YSGVMWACVFMRTGARRCISARPKN

SEQ ID NO: 25741 - protein, 26 aa, Mycobacterium avium
YSHRAFVFLGPGFFPGSPSGGAGGTP

SEQ ID NO: 25742 - protein, 19 aa, Mycobacterium avium
YSLFKAVVFVWIASTIQCY

SEQ ID NO: 25743 - protein, 22 aa, Mycobacterium avium
YSMILFNWFGVCLVPILALIVL

SEQ ID NO: 25744 - protein, 17 aa, Mycobacterium avium
YVAIWSAKRARGSPLRV

SEQ ID NO: 25745 - protein, 27 aa, Mycobacterium avium
YVGQRPWTPLIGLLSQAADLGLRVIVT

SEQ ID NO: 25746 - protein, 18 aa, Mycobacterium avium
YVILPLLAYLLLVLICRR

SEQ ID NO: 25747 - protein, 19 aa, Mycobacterium avium
YVILPLLAYLLLVLICRRQ

SEQ ID NO: 25748 - protein, 25 aa, Mycobacterium avium
YVILPLLAYLLLVLVCRRQWQPKLV

SEQ ID NO: 25749 - protein, 20 aa, Mycobacterium avium
YWAAAVVLGLPLLLIVFTEW

SEQ ID NO: 25750 - protein, 18 aa, Mycobacterium avium
YWAIGIAIGLPIGMIALT

SEQ ID NO: 25751 - protein, 39 aa, Mycobacterium avium
YYLVHNPALAFQYLVQLMLFDWPTHILEIFMSQPELLAP

SEQ ID NO: 25752 - protein, 19 aa, Mycobacterium avium
VALTFVWLGMVLAISFLEA

SEQ ID NO: 25753 - protein, 25 aa, Mycobacterium avium
AAFVLIFLIMLFITRSLVAALVIPG

SEQ ID NO: 25754 - protein, 19 aa, Mycobacterium avium
AAGMFLAVWLPLDNGLRPE

SEQ ID NO: 25755 - protein, 22 aa, Mycobacterium avium
AAIMLWLLLRLPESPRWLVKKD

SEQ ID NO: 25756 - protein, 24 aa, Mycobacterium avium
AALLGRWFWWPQLVRRRPASQLLR

SEQ ID NO: 25757 - protein, 17 aa, Mycobacterium avium
AAPWLAAVATLYAVFRG

SEQ ID NO: 25758 - protein, 20 aa, Mycobacterium avium
AAVVYFLVVLPYTTLRKRGE

SEQ ID NO: 25759 - protein, 25 aa, Mycobacterium avium
AEPAHPRWWFISTTPGRILTIGIVL

SEQ ID NO: 25760 - protein, 30 aa, Mycobacterium avium
AGHHSDLDWLWWFGAGWLAVAVVGAGVILW

SEQ ID NO: 25761 - protein, 26 aa, Mycobacterium avium
AHWEFYMALAYFKLAIIAAGIDFRRR

SEQ ID NO: 25762 - protein, 31 aa, Mycobacterium avium
AIVGPTWFAWLTVIWLWLTVLFANLAEAVAE

SEQ ID NO: 25763 - protein, 21 aa, Mycobacterium avium
ALAILVMVVWVGTALTISTTA

SEQ ID NO: 25764 - protein, 19 aa, Mycobacterium avium
ALAVLWRRLVRSRAELDEL

SEQ ID NO: 25765 - protein, 24 aa, Mycobacterium avium
ALCLIFIIMLILTRSFIAALVIVG

SEQ ID NO: 25766 - protein, 17 aa, Mycobacterium avium
ALFFVGVLLVGLLGGIA

SEQ ID NO: 25767 - protein, 24 aa, Mycobacterium avium
ALTLFMIVSLTLTWLVYVSLRRDV

SEQ ID NO: 25768 - protein, 23 aa, Mycobacterium avium
APGAALYILAFAAGALAPAHPDR

SEQ ID NO: 25769 - protein, 18 aa, Mycobacterium avium
APLWPFHRWLPDAAVEAT

SEQ ID NO: 25770 - protein, 17 aa, Mycobacterium avium
APRWLGVPLYLLLGWVA

SEQ ID NO: 25771 - protein, 23 aa, Mycobacterium avium
APTLWGWRRTPVLRWFVLGAGVG

SEQ ID NO: 25772 - protein, 24 aa, Mycobacterium avium
APVAPKAPWIPQSSFRPSFGGNVG

SEQ ID NO: 25773 - protein, 26 aa, Mycobacterium avium
APVGTRQLLLVNLLTDMFPALAVAVT

SEQ ID NO: 25774 - protein, 19 aa, Mycobacterium avium
APWRIALVDLVLWGAGTLL

SEQ ID NO: 25775 - protein, 21 aa, Mycobacterium avium
ARAFTVLFLPYSLLGPFAGAL

SEQ ID NO: 25776 - protein, 19 aa, Mycobacterium avium
ARNHRWFLIANYGAARVGA

SEQ ID NO: 25777 - protein, 19 aa, Mycobacterium avium
ARPPYPPYPPYPPPGQPAP

SEQ ID NO: 25778 - protein, 36 aa, Mycobacterium avium
ASLHWYTWIAFSGWVLLALIFYFVWGRHHSALNDAA

SEQ ID NO: 25779 - protein, 24 aa, Mycobacterium avium
ATAFAFAPWYFFLTRFFTGAGIGG

SEQ ID NO: 25780 - protein, 24 aa, Mycobacterium avium
ATMSQLLYLRVPALNALFPDYRGS

SEQ ID NO: 25781 - protein, 18 aa, Mycobacterium avium
ATSWLVRRPPLHGLTPSA

SEQ ID NO: 25782 - protein, 24 aa, Mycobacterium avium
AVAIPLTVLIIFTLNILLAEFGAA

SEQ ID NO: 25783 - protein, 24 aa, Mycobacterium avium
AYDIGLFYRYAWQNPTFADIVATR

SEQ ID NO: 25784 - protein, 29 aa, Mycobacterium avium
CIDADSRLYLPMPFFWVGGFGSGILSALL

SEQ ID NO: 25785 - protein, 24 aa, Mycobacterium avium
DEAAQILALLLPAAAFMGTALTIR

SEQ ID NO: 25786 - protein, 18 aa, Mycobacterium avium
DFDDFWRPIRSYFYWEKH

SEQ ID NO: 25787 - protein, 27 aa, Mycobacterium avium
DGEIVLLLFLPAILYWEGLNISFREIR

SEQ ID NO: 25788 - protein, 24 aa, Mycobacterium avium
DHGLWVAFWFFLAQLNLILGAINL

SEQ ID NO: 25789 - protein, 24 aa, Mycobacterium avium
DTASIVGWLWPLWDSRRRTFADML

SEQ ID NO: 25790 - protein, 24 aa, Mycobacterium avium
DYADILYISPWLFVLGVSIAGLTA

SEQ ID NO: 25791 - protein, 20 aa, Mycobacterium avium
EATPPLFRWLAEFEPMHQVF

SEQ ID NO: 25792 - protein, 24 aa, Mycobacterium avium
EEQLFRFSRILDVQPRLAILLGDY

SEQ ID NO: 25793 - protein, 23 aa, Mycobacterium avium
EGFFSPLFFVWLGASLQVRELGA

SEQ ID NO: 25794 - protein, 21 aa, Mycobacterium avium
EGQLWNVWLPLVIAGFAVACA

SEQ ID NO: 25795 - protein, 26 aa, Mycobacterium avium
ELARPPLWLFLLFLLTATAAHGLKVL

SEQ ID NO: 25796 - protein, 23 aa, Mycobacterium avium
ELVYLPPEWFATTPPPALPTVMM

SEQ ID NO: 25797 - protein, 22 aa, Mycobacterium avium
EQFYLVWPLLIIAVAASVRRVR

SEQ ID NO: 25798 - protein, 25 aa, Mycobacterium avium
ERDRLALWSRVLPITFTAVGLIALV

SEQ ID NO: 25799 - protein, 23 aa, Mycobacterium avium
ERTAMLLVPPYLAYVRAARPFIA

SEQ ID NO: 25800 - protein, 20 aa, Mycobacterium avium
FDWVRDLLSYLPPNNATDPP

SEQ ID NO: 25801 - protein, 19 aa, Mycobacterium avium
FFVGVLLVGLLGGIAPAAL

SEQ ID NO: 25802 - protein, 18 aa, Mycobacterium avium
FGLIIFFTYFYVSITFNP

SEQ ID NO: 25803 - protein, 18 aa, Mycobacterium avium
FLIWGLYAYLWAFAQYAV

SEQ ID NO: 25804 - protein, 17 aa, Mycobacterium avium
FLRIAPELYLKRLCVGG

SEQ ID NO: 25805 - protein, 18 aa, Mycobacterium avium
FNIPIIMLVDVPGFLPGT

SEQ ID NO: 25806 - protein, 26 aa, Mycobacterium avium
FSSFWFTAIYVLLFVSLVGCLTPRMI

SEQ ID NO: 25807 - protein, 25 aa, Mycobacterium avium
FSVAWLYWYFWVIVVGFEAVAGGKV

SEQ ID NO: 25808 - protein, 23 aa, Mycobacterium avium
FTRFTLLMAAPWLAAVATLYAVF

SEQ ID NO: 25809 - protein, 24 aa, Mycobacterium avium
FVSTYGWRAYALPALVVLTAVVIY

SEQ ID NO: 25810 - protein, 26 aa, Mycobacterium avium
FVVFDWLFWIFSILIATLVSWLLFTW

SEQ ID NO: 25811 - protein, 19 aa, Mycobacterium avium
FVVIIVMLLVVYRSIITVA

SEQ ID NO: 25812 - protein, 17 aa, Mycobacterium avium
GAYPLYLDAYPLPQFAI

SEQ ID NO: 25813 - protein, 17 aa, Mycobacterium avium
GELPWWITVLILAREFG

SEQ ID NO: 25814 - protein, 27 aa, Mycobacterium avium
GFGLALLLIFLFWPWEYKPKEAAGSFL

SEQ ID NO: 25815 - protein, 32 aa, Mycobacterium avium
GFYAFELPFYRLLLSYLFVAVFLAFVANLLAH

SEQ ID NO: 25816 - protein, 24 aa, Mycobacterium avium
GGGLGLIILLGALFLGVDPGRVMP

SEQ ID NO: 25817 - protein, 25 aa, Mycobacterium avium
GGRALLFLPPAWLLGTTMLGLSKIL

SEQ ID NO: 25818 - protein, 30 aa, Mycobacterium avium
GIALLLIAVVLVLGFWQPGFFVTTKLDVNK

SEQ ID NO: 25819 - protein, 18 aa, Mycobacterium avium
GLPPFYPPGWFWIGGRAA

SEQ ID NO: 25820 - protein, 26 aa, Mycobacterium avium
GLSILFWQHLIGLHLHWLVLPLTFII

SEQ ID NO: 25821 - protein, 17 aa, Mycobacterium avium
GLTVLVLLLAAWFHFVA

SEQ ID NO: 25822 - protein, 31 aa, Mycobacterium avium
GNQRNGIDPIWWAPTLFIVIGGLVALTAASF

SEQ ID NO: 25823 - protein, 25 aa, Mycobacterium avium
GPGWLLFQWRWSIVALWFTAVFLLI

SEQ ID NO: 25824 - protein, 30 aa, Mycobacterium avium
GPLEFSGLFAWFAWLVLHLVYLVGFKTKVS

SEQ ID NO: 25825 - protein, 29 aa, Mycobacterium avium
GPVARLWRGLLLFFSRWWQLETLYRSNMK

SEQ ID NO: 25826 - protein, 25 aa, Mycobacterium avium
GRYSVYIWALLAMAVARLGLGPLRT

SEQ ID NO: 25827 - protein, 21 aa, Mycobacterium avium
GSFLWLWWTTNLLSGLLALAT

SEQ ID NO: 25828 - protein, 24 aa, Mycobacterium avium
GTKPRIPPLLWAGLIFGAVVLVAF

SEQ ID NO: 25829 - protein, 22 aa, Mycobacterium avium
HGLGLGMLMLTIALGGTVLTHR

SEQ ID NO: 25830 - protein, 27 aa, Mycobacterium avium
HNLFKPLLLFFYFGFLIPILKVRFEFP

SEQ ID NO: 25831 - protein, 23 aa, Mycobacterium avium
HNRRMVLVWLALVLAVTGMVATA

SEQ ID NO: 25832 - protein, 25 aa, Mycobacterium avium
HTGGAWLVLFMIFNVIWTYVLVRGS

SEQ ID NO: 25833 - protein, 23 aa, Mycobacterium avium
HTTWVLYAVIIVSALIIAGAIPI

SEQ ID NO: 25834 - protein, 25 aa, Mycobacterium avium
IAAALGHWFWWPINTIRMTRRTHHD

SEQ ID NO: 25835 - protein, 24 aa, Mycobacterium avium
IDATLIRMLVIFGIVTVIALAAAT

SEQ ID NO: 25836 - protein, 26 aa, Mycobacterium avium
IGAYGWKWIFLINLPIGLTAFALAAL

SEQ ID NO: 25837 - protein, 24 aa, Mycobacterium avium
IGGTAFVVIFAVALVFYIVTSHHK

SEQ ID NO: 25838 - protein, 21 aa, Mycobacterium avium
IGLILLLLLVVYRSPVAAAIP

SEQ ID NO: 25839 - protein, 19 aa, Mycobacterium avium
IGLVLLLLSSLIVGAGWPL

SEQ ID NO: 25840 - protein, 28 aa, Mycobacterium avium
IGRISYSWYLWHWPVLLLMPALLGEPAG

SEQ ID NO: 25841 - protein, 18 aa, Mycobacterium avium
IIGWNLLLELAIGAAVVA

SEQ ID NO: 25842 - protein, 18 aa, Mycobacterium avium
IIMLVDVPGFLPGTGQEY

SEQ ID NO: 25843 - protein, 25 aa, Mycobacterium avium
IKRQQLFLSSLLRSLISADTLLDLN

SEQ ID NO: 25844 - protein, 17 aa, Mycobacterium avium
ILWLVPLAGSVLIILMP

SEQ ID NO: 25845 - protein, 17 aa, Mycobacterium avium
INTAWRAAGGPGGPLGA

SEQ ID NO: 25846 - protein, 20 aa, Mycobacterium avium
ISLPMFMEELFWGCAGIGLA

SEQ ID NO: 25847 - protein, 24 aa, Mycobacterium avium
ITGLAYPLLVWVVAQFPGLRDHAE

SEQ ID NO: 25848 - protein, 20 aa, Mycobacterium avium
ITRRLAIALVVLFAAAVIVY

SEQ ID NO: 25849 - protein, 18 aa, Mycobacterium avium
IVFLFHDWRYVFWINVPL

SEQ ID NO: 25850 - protein, 24 aa, Mycobacterium avium
IVRRSNALLDWAYGRSLRYSESMS

SEQ ID NO: 25851 - protein, 23 aa, Mycobacterium avium
IVVMLLLVYRTPSTLLVPLLGVL

SEQ ID NO: 25852 - protein, 24 aa, Mycobacterium avium
IYNYTWLVLMLPFGMIGVTVLTVV

SEQ ID NO: 25853 - protein, 25 aa, Mycobacterium avium
KAAVIALICAFVAASGYMMWERHQT

SEQ ID NO: 25854 - protein, 25 aa, Mycobacterium avium
KGYSTVLVFWFGWPASEVPGIYFSA

SEQ ID NO: 25855 - protein, 17 aa, Mycobacterium avium
KILITMLLSSILGVAVI

SEQ ID NO: 25856 - protein, 20 aa, Mycobacterium avium
KLFAALFLILALVVIGEVAG

SEQ ID NO: 25857 - protein, 23 aa, Mycobacterium avium
LAAFLLLLPITGVILLILVLVAA

SEQ ID NO: 25858 - protein, 25 aa, Mycobacterium avium
LAALGVVVLLLIFAKSWAFDPEKAA

SEQ ID NO: 25859 - protein, 24 aa, Mycobacterium avium
LAIKPDICFLWDEAWYAFATAVPW

SEQ ID NO: 25860 - protein, 17 aa, Mycobacterium avium
LALAYLGLLWWMMVCWA

SEQ ID NO: 25861 - protein, 23 aa, Mycobacterium avium
LATLLGRWFWWPQHVRPRPASTM

SEQ ID NO: 25862 - protein, 22 aa, Mycobacterium avium
LCLIFIIMLIITRGVVASAVIV

SEQ ID NO: 25863 - protein, 18 aa, Mycobacterium avium
LDGDYWFRSIRQTVQFER

SEQ ID NO: 25864 - protein, 26 aa, Mycobacterium avium
LFCNSPFFWIGGFAFGLLATLVAGST

SEQ ID NO: 25865 - protein, 32 aa, Mycobacterium avium
LFGGKVSYLALLVLLLIALVIGLIGGVVGRKT

SEQ ID NO: 25866 - protein, 17 aa, Mycobacterium avium
LFLACRWAQAQPGVGAW

SEQ ID NO: 25867 - protein, 20 aa, Mycobacterium avium
LGFVALIAFVMLLVSIHSVF

SEQ ID NO: 25868 - protein, 22 aa, Mycobacterium avium
LGLLIPVMLWPPSAPLLLLPVL

SEQ ID NO: 25869 - protein, 26 aa, Mycobacterium avium
LGLLVIAILVAWRWVPARLAIVPGPL

SEQ ID NO: 25870 - protein, 19 aa, Mycobacterium avium
LGVLVIVILVAWRWVPAKV

SEQ ID NO: 25871 - protein, 18 aa, Mycobacterium avium
LHSLLQVSPIFFREAANL

SEQ ID NO: 25872 - protein, 18 aa, Mycobacterium avium
LHWAALRALLVLTVITGL

SEQ ID NO: 25873 - protein, 25 aa, Mycobacterium avium
LIFGCLLMWILAWLTATPVRVVRAA

SEQ ID NO: 25874 - protein, 20 aa, Mycobacterium avium
LIFSRYLWAFELTSALLITA

SEQ ID NO: 25875 - protein, 20 aa, Mycobacterium avium
LIGATGLFLACRWAQAQPGV

SEQ ID NO: 25876 - protein, 21 aa, Mycobacterium avium
LIPPFLPRMIHRLALPIVLVW

SEQ ID NO: 25877 - protein, 25 aa, Mycobacterium avium
LIVVLFVPAALPWYYSWPLAVLAPL

SEQ ID NO: 25878 - protein, 20 aa, Mycobacterium avium
LLAALPLSLIAVAAAAVMIF

SEQ ID NO: 25879 - protein, 17 aa, Mycobacterium avium
LLFVGVGLLWFGWFGFN

SEQ ID NO: 25880 - protein, 17 aa, Mycobacterium avium
LLGLFMPSTLFLMFIMF

SEQ ID NO: 25881 - protein, 20 aa, Mycobacterium avium
LLIMAMLPVLLGLDVSSRRA

SEQ ID NO: 25882 - protein, 18 aa, Mycobacterium avium
LLLPLVFRMPDTARWYLL

SEQ ID NO: 25883 - protein, 20 aa, Mycobacterium avium
LLVFFWRDWVRILAGFFSSL

SEQ ID NO: 25884 - protein, 20 aa, Mycobacterium avium
LLVLGLFTPLAAAGALAFLI

SEQ ID NO: 25885 - protein, 24 aa, Mycobacterium avium
LNGAVFYVLLFATGQWRHIVPTSW

SEQ ID NO: 25886 - protein, 23 aa, Mycobacterium avium
LPFVMLGAGLLWFGWYGFNAGSA

SEQ ID NO: 25887 - protein, 19 aa, Mycobacterium avium
LPLFVLFWFVLPLLLRTRG

SEQ ID NO: 25888 - protein, 28 aa, Mycobacterium avium
LQHWPLLIFPYMILLVVVVSFISWSALS

SEQ ID NO: 25889 - protein, 19 aa, Mycobacterium avium
LRVMFLIALVFLALGWSTK

SEQ ID NO: 25890 - protein, 21 aa, Mycobacterium avium
LSLVFAFLFAPAGAVLGHLGL

SEQ ID NO: 25891 - protein, 17 aa, Mycobacterium avium
LSVLLLSVGLAGFCVHA

SEQ ID NO: 25892 - protein, 24 aa, Mycobacterium avium
LSYGWRIPLLLGLPFGLVALYLRL

SEQ ID NO: 25893 - protein, 23 aa, Mycobacterium avium
LTQWFLLMMAFGSLFMAAGKRYA

SEQ ID NO: 25894 - protein, 25 aa, Mycobacterium avium
LTVISLLVLGIYYLQIPSLVGIGRY

SEQ ID NO: 25895 - protein, 18 aa, Mycobacterium avium
LVFALWRMLVRRDWRYAA

SEQ ID NO: 25896 - protein, 18 aa, Mycobacterium avium
LVINIRGLLRDRALLDRW

SEQ ID NO: 25897 - protein, 24 aa, Mycobacterium avium
LYDNFGLRWGLFGAAAIMVVTSFV

SEQ ID NO: 25898 - protein, 19 aa, Mycobacterium avium
MHGVWILLFTIPFAGLVDE

SEQ ID NO: 25899 - protein, 24 aa, Mycobacterium avium
MPSTLFLMFIMFGVPQLQLYISPA

SEQ ID NO: 25900 - protein, 17 aa, Mycobacterium avium
MVIGFIAGLLLAIAVAL

SEQ ID NO: 25901 - protein, 20 aa, Mycobacterium avium
NPGLPLWLFVLCAALTGLGG

SEQ ID NO: 25902 - protein, 17 aa, Mycobacterium avium
NRRPRVSGWLWQALAAL

SEQ ID NO: 25903 - protein, 25 aa, Mycobacterium avium
NYGYSLLWVLLLLVPVLIVNQEMVV

SEQ ID NO: 25904 - protein, 25 aa, Mycobacterium avium
PEGKPWWLVVVGVLVVGLLIGMVGM

SEQ ID NO: 25905 - protein, 20 aa, Mycobacterium avium
PGNPLAILVPLTAAALDLVA

SEQ ID NO: 25906 - protein, 21 aa, Mycobacterium avium
PGRYFYVKWWKLVLVLLAVWA

SEQ ID NO: 25907 - protein, 19 aa, Mycobacterium avium
PHLGLIPLFILWFGIGELP

SEQ ID NO: 25908 - protein, 18 aa, Mycobacterium avium
PIPVWFGAASDRAFERAG

SEQ ID NO: 25909 - protein, 20 aa, Mycobacterium avium
PIVLVWLGIVFITNTVAPQL

SEQ ID NO: 25910 - protein, 19 aa, Mycobacterium avium
PLIVAVAVSLLAILLIRQL

SEQ ID NO: 25911 - protein, 20 aa, Mycobacterium avium
PLRSRFRFGIQSKILITMLL

SEQ ID NO: 25912 - protein, 22 aa, Mycobacterium avium
PLSFLVLIWVFGGLLAAALPMA

SEQ ID NO: 25913 - protein, 17 aa, Mycobacterium avium
PLYLNIAVVALGFAAYL

SEQ ID NO: 25914 - protein, 19 aa, Mycobacterium avium
PPRGWLLPLAGTAAALLMV

SEQ ID NO: 25915 - protein, 19 aa, Mycobacterium avium
PPRWAWKILIPVGAVGMVL

SEQ ID NO: 25916 - protein, 19 aa, Mycobacterium avium
PRMYALHILLLPGIILALI

SEQ ID NO: 25917 - protein, 25 aa, Mycobacterium avium
PRVSGWLWQALAALLIATVFAAAVA

SEQ ID NO: 25918 - protein, 19 aa, Mycobacterium avium
PTYGFVRQHFWLPGGSTGS

SEQ ID NO: 25919 - protein, 20 aa, Mycobacterium avium
PWEFYFWHHTIPAVVWVALI

SEQ ID NO: 25920 - protein, 30 aa, Mycobacterium avium
QGSILGELLVYVLPLLLLVGLFVMFSRMQG

SEQ ID NO: 25921 - protein, 25 aa, Mycobacterium avium
QLRTADWWWALLGLLVSALTYVGAA

SEQ ID NO: 25922 - protein, 25 aa, Mycobacterium avium
QPHRTLVAWISFAAAVLAVGALAGG

SEQ ID NO: 25923 - protein, 23 aa, Mycobacterium avium
QVANLELYLIFPLKNEQATIQLV

SEQ ID NO: 25924 - protein, 17 aa, Mycobacterium avium
QWWITWVCSYAVSVSAI

SEQ ID NO: 25925 - protein, 18 aa, Mycobacterium avium
QYLAPILDAIKFNYPPFG

SEQ ID NO: 25926 - protein, 19 aa, Mycobacterium avium
RFFRVTGVFLVLIAAGLVL

SEQ ID NO: 25927 - protein, 20 aa, Mycobacterium avium
RFGIQSKILITMLLSSILGV

SEQ ID NO: 25928 - protein, 18 aa, Mycobacterium avium
RFLIPLLDKMIRVDQRLV

SEQ ID NO: 25929 - protein, 19 aa, Mycobacterium avium
RGLLRDRALLDRWAGDATA

SEQ ID NO: 25930 - protein, 24 aa, Mycobacterium avium
RGYTIFLAVLPFLIGALSLTVKGP

SEQ ID NO: 25931 - protein, 18 aa, Mycobacterium avium
RLLPYMIGAFLLVVGVSV

SEQ ID NO: 25932 - protein, 18 aa, Mycobacterium avium
RLPYFSSLAFPCAVGLLV

SEQ ID NO: 25933 - protein, 17 aa, Mycobacterium avium
RLSIFSVVLLIFTVMII

SEQ ID NO: 25934 - protein, 26 aa, Mycobacterium avium
RNPEVWSWIVWLPHNLHDELFDACGW

SEQ ID NO: 25935 - protein, 26 aa, Mycobacterium avium
RPEFLAVLLAIWRLAATAVLISPAWK

SEQ ID NO: 25936 - protein, 23 aa, Mycobacterium avium
RPLYGPGLRFLIPLLDKMIRVDQ

SEQ ID NO: 25937 - protein, 26 aa, Mycobacterium avium
RPQYRPLWVFLLLPVLILLTVSGRWL

SEQ ID NO: 25938 - protein, 23 aa, Mycobacterium avium
RSQRWWWGAVLLLASIGLQAAAL

SEQ ID NO: 25939 - protein, 18 aa, Mycobacterium avium
RTLLLWVLPLLIAPPMYS

SEQ ID NO: 25940 - protein, 24 aa, Mycobacterium avium
RVHLDLDPLLPFPRWHEYAPAVEE

SEQ ID NO: 25941 - protein, 20 aa, Mycobacterium avium
RYLATAWWLSTLPGAVVLSV

SEQ ID NO: 25942 - protein, 18 aa, Mycobacterium avium
RYLWAKPSSPPPPRWAWK

SEQ ID NO: 25943 - protein, 23 aa, Mycobacterium avium
SATTFPWVFLFPAGVLVLILVCA

SEQ ID NO: 25944 - protein, 25 aa, Mycobacterium avium
SGGVSLWWMIGLLAAAGVLGLMVVL

SEQ ID NO: 25945 - protein, 18 aa, Mycobacterium avium
SLLLLIFPHLALAPYMRG

SEQ ID NO: 25946 - protein, 18 aa, Mycobacterium avium
SLRLRLLVGQIVVLALVC

SEQ ID NO: 25947 - protein, 19 aa, Mycobacterium avium
SMVLFYIQAPTLLGIGRMT

SEQ ID NO: 25948 - protein, 20 aa, Mycobacterium avium
STFFFFFFVAELLDTWLWRW

SEQ ID NO: 25949 - protein, 32 aa, Mycobacterium avium
SVLVWQDILGIKLYWICLALSVIILLAVGSDY

SEQ ID NO: 25950 - protein, 24 aa, Mycobacterium avium
SVYARLVLLWFLCSAFPIAVIAAL

SEQ ID NO: 25951 - protein, 24 aa, Mycobacterium avium
TARKRIAWLLLLGNMILAAALNVA

SEQ ID NO: 25952 - protein, 22 aa, Mycobacterium avium
TAVPLLWLLAIDIGLTILGAMA

SEQ ID NO: 25953 - protein, 26 aa, Mycobacterium avium
TEGAWLVVVVFPLLVFVLTRLNREYR

SEQ ID NO: 25954 - protein, 24 aa, Mycobacterium avium
TFHEPFVLFGYLAAITSLELVTGV

SEQ ID NO: 25955 - protein, 23 aa, Mycobacterium avium
TPEFPWTGLTIFLLIAVFAAAVG

SEQ ID NO: 25956 - protein, 26 aa, Mycobacterium avium
TSMGTALVLLFLLALGAIPGALLPQR

SEQ ID NO: 25957 - protein, 24 aa, Mycobacterium avium
TTVGLVFIWFSLTPSLLPRGAIFQ

SEQ ID NO: 25958 - protein, 18 aa, Mycobacterium avium
TVLLIFTLNVLLAQFGAA

SEQ ID NO: 25959 - protein, 21 aa, Mycobacterium avium
TYDMDLFLRIAPELYLKRLCV

SEQ ID NO: 25960 - protein, 23 aa, Mycobacterium avium
VAALLGRWFWWPQRVRPRPASTM

SEQ ID NO: 25961 - protein, 19 aa, Mycobacterium avium
VALYLLITIAPFAVIAPLI

SEQ ID NO: 25962 - protein, 23 aa, Mycobacterium avium
VAVFGMRLLFPLLIVWATAGLDP

SEQ ID NO: 25963 - protein, 24 aa, Mycobacterium avium
VCLIAPMFLAMYLRAFYSPRRGAA

SEQ ID NO: 25964 - protein, 25 aa, Mycobacterium avium
VDAGPLYFWLPFLTCLLALAELHLR

SEQ ID NO: 25965 - protein, 18 aa, Mycobacterium avium
VEDLLLLARLDSGRPLER

SEQ ID NO: 25966 - protein, 23 aa, Mycobacterium avium
VERIWLPFTIWLTAAAALLPVRT

SEQ ID NO: 25967 - protein, 27 aa, Mycobacterium avium
VFGLAFYLPLLPWVGLLVGAVPWLVLA

SEQ ID NO: 25968 - protein, 22 aa, Mycobacterium avium
VFGYAGIFWLAAGFAVATIAAV

SEQ ID NO: 25969 - protein, 37 aa, Mycobacterium avium
VGRVEFAGFIAWLAWLLLHLYYLIGHRNRLAAMFAWG

SEQ ID NO: 25970 - protein, 21 aa, Mycobacterium avium
VGSVILWRFFGDALSKRSHTA

SEQ ID NO: 25971 - protein, 17 aa, Mycobacterium avium
VIGCVVLAGLLGMCSLQ

SEQ ID NO: 25972 - protein, 23 aa, Mycobacterium avium
VIIGMLLLVYRSVITVLLTLVMV

SEQ ID NO: 25973 - protein, 22 aa, Mycobacterium avium
VILAMLLWVYRSVTAVFVLVTV

SEQ ID NO: 25974 - protein, 25 aa, Mycobacterium avium
VIVLLFLIAWWLLDALWHPVRGRLA

SEQ ID NO: 25975 - protein, 22 aa, Mycobacterium avium
VLGWRLVGFLWATVAGAVAWLI

SEQ ID NO: 25976 - protein, 19 aa, Mycobacterium avium
VLIFIIMVIVTRALVAAGV

SEQ ID NO: 25977 - protein, 17 aa, Mycobacterium avium
VLILVVATAYLLIGALR

SEQ ID NO: 25978 - protein, 25 aa, Mycobacterium avium
VLLVLLIWVLFVWRRRRPGPEATGY

SEQ ID NO: 25979 - protein, 24 aa, Mycobacterium avium
VLSGAWLGLFIGLVLGFFSPNPWG

SEQ ID NO: 25980 - protein, 17 aa, Mycobacterium avium
VMLPLVWALNRLGWHAA

SEQ ID NO: 25981 - protein, 22 aa, Mycobacterium avium
VMNKLRWVLLIVGGVGVAVAAV

SEQ ID NO: 25982 - protein, 21 aa, Mycobacterium avium
VMVGFLFLYPAFVAKAHQANG

SEQ ID NO: 25983 - protein, 19 aa, Mycobacterium avium
VRANWVLRALLREYGRRLT

SEQ ID NO: 25984 - protein, 23 aa, Mycobacterium avium
VSMPYFPNYLSLASPFAFSGLSF

SEQ ID NO: 25985 - protein, 18 aa, Mycobacterium avium
VTLVWLYIEILRLLSYLQ

SEQ ID NO: 25986 - protein, 22 aa, Mycobacterium avium
VVAAAVGIGWWLLRPDDDTITV

SEQ ID NO: 25987 - protein, 25 aa, Mycobacterium avium
VVAAQLLFSALLTPAIRLTNGAANW

SEQ ID NO: 25988 - protein, 30 aa, Mycobacterium avium
VVADRAYFVFLALLPFILGSLSLTVPGHNG

SEQ ID NO: 25989 - protein, 24 aa, Mycobacterium avium
VVALLLLLGVPFLGVKWGFPDERV

SEQ ID NO: 25990 - protein, 19 aa, Mycobacterium avium
VVLFLLRRVLLGSSYFTVP

SEQ ID NO: 25991 - protein, 26 aa, Mycobacterium avium
VVMAMLTAFLFFIFGQYRTGATNGYS

SEQ ID NO: 25992 - protein, 20 aa, Mycobacterium avium
WFGPYRLVRLLRQGGMGEVY

SEQ ID NO: 25993 - protein, 24 aa, Mycobacterium avium
WSNAFPAWHYAFATALLGLTVLVL

SEQ ID NO: 25994 - protein, 23 aa, Mycobacterium avium
WVRALQVLLLLYVVPFFLAQATP

SEQ ID NO: 25995 - protein, 19 aa, Mycobacterium avium
WWLAVPVLVFALWRMLVRR

SEQ ID NO: 25996 - protein, 25 aa, Mycobacterium avium
YFTDYLSWRWAFWVNVPVSVIVIFV

SEQ ID NO: 25997 - protein, 30 aa, Mycobacterium avium
YHNGIFFQPGFYPYPFWGPGWGWALGDVLL

SEQ ID NO: 25998 - protein, 21 aa, Mycobacterium avium
YIVSFALFIYGLMGLTGPKTA

SEQ ID NO: 25999 - protein, 17 aa, Mycobacterium avium
YLLMHGWFRLVPPTEFW

SEQ ID NO: 26000 - protein, 20 aa, Mycobacterium avium
YPLYLDAYPLPQFAIYGAVS

SEQ ID NO: 26001 - protein, 19 aa, Mycobacterium avium
AAFLLLAGLSLGALIIWVT

SEQ ID NO: 26002 - protein, 18 aa, Mycobacterium avium
AAHLPYLAWLQQASADSA

SEQ ID NO: 26003 - protein, 23 aa, Mycobacterium avium
AAITFVLLFLLTGSVLLPAKALA

SEQ ID NO: 26004 - protein, 18 aa, Mycobacterium avium
AALLVAQMFVRPIRRLQA

SEQ ID NO: 26005 - protein, 19 aa, Mycobacterium avium
AAVLVLLAGRRLWHRFRGQ

SEQ ID NO: 26006 - protein, 21 aa, Mycobacterium avium
AAWTIVWCLVLLSLALTATTF

SEQ ID NO: 26007 - protein, 18 aa, Mycobacterium avium
AEPILPVRLFASPVFTVC

SEQ ID NO: 26008 - protein, 29 aa, Mycobacterium avium
AEPTPWYRRPAMLIAWVVSVVVLIGLIVF

SEQ ID NO: 26009 - protein, 24 aa, Mycobacterium avium
AETALLRYLLYGLLPAWFIPALLD

SEQ ID NO: 26010 - protein, 26 aa, Mycobacterium avium
AGRNYLPPLLGLATILIIGLIFAVAV

SEQ ID NO: 26011 - protein, 28 aa, Mycobacterium avium
AIAYSLYLWHWPLLIFWLSYSGHKHAGF

SEQ ID NO: 26012 - protein, 25 aa, Mycobacterium avium
AIGVVLGWPLWWVSACSVLVLLIVE

SEQ ID NO: 26013 - protein, 24 aa, Mycobacterium avium
AKMWTFLFIYFWLRASLPRLRYDQ

SEQ ID NO: 26014 - protein, 22 aa, Mycobacterium avium
ALAARRVLWLFKLITSGKPAPG

SEQ ID NO: 26015 - protein, 22 aa, Mycobacterium avium
ALALLGVRRYVFARPPLLGPSG

SEQ ID NO: 26016 - protein, 32 aa, Mycobacterium avium
ALGVPGWITQRLWWALLLTVGFWGLLRVAEAL

SEQ ID NO: 26017 - protein, 32 aa, Mycobacterium avium
ALSFAIGALLPLIAILLPPPTWRIPVTVVAVL

SEQ ID NO: 26018 - protein, 23 aa, Mycobacterium avium
APLLATMFDFFYQPGKMPASLAD

SEQ ID NO: 26019 - protein, 17 aa, Mycobacterium avium
AQMFVRPIRRLQAGARE

SEQ ID NO: 26020 - protein, 17 aa, Mycobacterium avium
ARDFVYLIDFGLARAQA

SEQ ID NO: 26021 - protein, 24 aa, Mycobacterium avium
ARKKGFLGRFWLVLTIAAVVALSG

SEQ ID NO: 26022 - protein, 26 aa, Mycobacterium avium
ARLVHTLIFTALRIAFLAVLVGTTLE

SEQ ID NO: 26023 - protein, 18 aa, Mycobacterium avium
ARPILLRLGVLLVLLCAQ

SEQ ID NO: 26024 - protein, 21 aa, Mycobacterium avium
ARYLSVFLLLLVGVYLLVFLT

SEQ ID NO: 26025 - protein, 19 aa, Mycobacterium avium
ASIVGLFYLIWNYGYRQGT

SEQ ID NO: 26026 - protein, 18 aa, Mycobacterium avium
ASYLLIGFWYHKPTAATA

SEQ ID NO: 26027 - protein, 23 aa, Mycobacterium avium
ATLLGRWFWWPMVVHPRGDNARR

SEQ ID NO: 26028 - protein, 18 aa, Mycobacterium avium
AVALPLAFPSLAEMAQKH

SEQ ID NO: 26029 - protein, 17 aa, Mycobacterium avium
AVFAWLLAAFAVRPFKR

SEQ ID NO: 26030 - protein, 24 aa, Mycobacterium avium
AVGWPTWGAILTAPFLLPLLLGIG

SEQ ID NO: 26031 - protein, 19 aa, Mycobacterium avium
AVLLYYVMLTFVARPYLIP

SEQ ID NO: 26032 - protein, 17 aa, Mycobacterium avium
AVLSSLVLLIPTLAAIV

SEQ ID NO: 26033 - protein, 19 aa, Mycobacterium avium
AVPIIIGWIALIAVLNVVV

SEQ ID NO: 26034 - protein, 18 aa, Mycobacterium avium
AVTALFRHPLGIPIPHTA

SEQ ID NO: 26035 - protein, 22 aa, Mycobacterium avium
AYSHNFYLWWLAKAGAVGMAAF

SEQ ID NO: 26036 - protein, 24 aa, Mycobacterium avium
AYYPFVYAGLLLLMRARLKRLPIA

SEQ ID NO: 26037 - protein, 31 aa, Mycobacterium avium
DGLTPWIAAPLLFIGFMFGLLLLTGTTIREL

SEQ ID NO: 26038 - protein, 23 aa, Mycobacterium avium
DRWFNLLWLIPIGFALLIAGVAV

SEQ ID NO: 26039 - protein, 23 aa, Mycobacterium avium
DVNPMLFPAILLALTLLLVSTVI

SEQ ID NO: 26040 - protein, 23 aa, Mycobacterium avium
EPKSPRWLWIAAGAAVLLVVALV

SEQ ID NO: 26041 - protein, 22 aa, Mycobacterium avium
EQYYFVWPLLLIAVALALAARA

SEQ ID NO: 26042 - protein, 17 aa, Mycobacterium avium
EVFFWAAPVALVGFVLA

SEQ ID NO: 26043 - protein, 17 aa, Mycobacterium avium
EVMLWHCWPITNRLPPA

SEQ ID NO: 26044 - protein, 19 aa, Mycobacterium avium
FAMLLLVVPLATGCLRVRA

SEQ ID NO: 26045 - protein, 24 aa, Mycobacterium avium
FDKAPLMLVLLLGATLLLMFLAFG

SEQ ID NO: 26046 - protein, 24 aa, Mycobacterium avium
FGLSVLLWQYILGLKLHWMVLAMA

SEQ ID NO: 26047 - protein, 18 aa, Mycobacterium avium
FHGMWSLGTLAGALIGAA

SEQ ID NO: 26048 - protein, 19 aa, Mycobacterium avium
FIVLLFVYRSVTTVVLLLL

SEQ ID NO: 26049 - protein, 18 aa, Mycobacterium avium
FLCYWIIPFALLGLAAVV

SEQ ID NO: 26050 - protein, 17 aa, Mycobacterium avium
FLPPFVTWFAALLFAVI

SEQ ID NO: 26051 - protein, 20 aa, Mycobacterium avium
FPPMGSILYWLRPGTIRLPP

SEQ ID NO: 26052 - protein, 17 aa, Mycobacterium avium
FRFLPRRLVERIVPKPG

SEQ ID NO: 26053 - protein, 28 aa, Mycobacterium avium
FVGGIVALAWALAFIRPHADKRPEVGTQ

SEQ ID NO: 26054 - protein, 28 aa, Mycobacterium avium
FVIHRTLYLIWLILYNPAGLLSFFLSNP

SEQ ID NO: 26055 - protein, 21 aa, Mycobacterium avium
FVLIVAFLLVWWVYDTYRPEP

SEQ ID NO: 26056 - protein, 18 aa, Mycobacterium avium
FVLTWAVALLIWRYGRIE

SEQ ID NO: 26057 - protein, 25 aa, Mycobacterium avium
FVTLLLVYRSVITVILLLLIVGLEL

SEQ ID NO: 26058 - protein, 17 aa, Mycobacterium avium
FVVIALAVMLVLAGLTV

SEQ ID NO: 26059 - protein, 19 aa, Mycobacterium avium
FWQFWDLALLWLAQLHGGN

SEQ ID NO: 26060 - protein, 22 aa, Mycobacterium avium
GACIGFLWWNAAPAKIFMGDTG

SEQ ID NO: 26061 - protein, 25 aa, Mycobacterium avium
GALVPRIRWPMWLRTLLATVALGAV

SEQ ID NO: 26062 - protein, 18 aa, Mycobacterium avium
GEFLAWIIGWNLLLELAI

SEQ ID NO: 26063 - protein, 23 aa, Mycobacterium avium
GGALHRAGLLAALPLSLIAVAAA

SEQ ID NO: 26064 - protein, 27 aa, Mycobacterium avium
GGFPRWFPSSLRRQLLFGVLAVVSVVL

SEQ ID NO: 26065 - protein, 26 aa, Mycobacterium avium
GGLQFMLIIWLQGIWLPLHGYRFEST

SEQ ID NO: 26066 - protein, 17 aa, Mycobacterium avium
GLFYLIWNYGYRQGTTG

SEQ ID NO: 26067 - protein, 23 aa, Mycobacterium avium
GLGVFAVWLYRYLWAKPSSPPPP

SEQ ID NO: 26068 - protein, 18 aa, Mycobacterium avium
GLILFRRAGAPAALADSV

SEQ ID NO: 26069 - protein, 25 aa, Mycobacterium avium
GLVGPIFLVVYFTLGLGSLLQWMFY

SEQ ID NO: 26070 - protein, 17 aa, Mycobacterium avium
GMAVRRRKFGRRGHVVV

SEQ ID NO: 26071 - protein, 18 aa, Mycobacterium avium
GPPPWGRPPPKRRVWPIV

SEQ ID NO: 26072 - protein, 17 aa, Mycobacterium avium
GRLGWPLWTAYIGVFAL

SEQ ID NO: 26073 - protein, 22 aa, Mycobacterium avium
GRSRFGFGTLAVLLCLLLGIAI

SEQ ID NO: 26074 - protein, 19 aa, Mycobacterium avium
GTARWPWVVGVAAIVAAIA

SEQ ID NO: 26075 - protein, 17 aa, Mycobacterium avium
GTWLLDMGMLAALALCY

SEQ ID NO: 26076 - protein, 25 aa, Mycobacterium avium
GVAAPFIWLAWLLRIPAVFVESVTR

SEQ ID NO: 26077 - protein, 17 aa, Mycobacterium avium
GWRMWYGGPWFSTRIVT

SEQ ID NO: 26078 - protein, 20 aa, Mycobacterium avium
HAIRIFAVPIILGWLFVTVL

SEQ ID NO: 26079 - protein, 20 aa, Mycobacterium avium
HPGLPLWPYLVCAALTGLGG

SEQ ID NO: 26080 - protein, 17 aa, Mycobacterium avium
HVRPLYGPGLRFLIPLL

SEQ ID NO: 26081 - protein, 20 aa, Mycobacterium avium
IAGMFMWIAIIWRGIRGRLK

SEQ ID NO: 26082 - protein, 26 aa, Mycobacterium avium
IDTSSWRWIFLINVPIGLLTVALAAV

SEQ ID NO: 26083 - protein, 22 aa, Mycobacterium avium
IFNAIIIVLLIPLSLRGVRYTP

SEQ ID NO: 26084 - protein, 26 aa, Mycobacterium avium
IGGCVLLYLTPLILGLWRGETSHDRR

SEQ ID NO: 26085 - protein, 19 aa, Mycobacterium avium
IHVPLLPVPIPVPVPQKQA

SEQ ID NO: 26086 - protein, 18 aa, Mycobacterium avium
IILFVYWLIALSQIVLRR

SEQ ID NO: 26087 - protein, 24 aa, Mycobacterium avium
IIQPPLILFCAVPGAYWLFHDAKV

SEQ ID NO: 26088 - protein, 18 aa, Mycobacterium avium
IKFNYPPFGLNLFSTAET

SEQ ID NO: 26089 - protein, 18 aa, Mycobacterium avium
ILALWAAVAGAFVSVLYR

SEQ ID NO: 26090 - protein, 23 aa, Mycobacterium avium
IPATLLLLRYRWLRAEPLPAPRP

SEQ ID NO: 26091 - protein, 19 aa, Mycobacterium avium
IRWALLVAGLVLFAVADGA

SEQ ID NO: 26092 - protein, 18 aa, Mycobacterium avium
ISGWALMTWILMAFGSTL

SEQ ID NO: 26093 - protein, 19 aa, Mycobacterium avium
ISLPLWVLLLSVPLSTVYV

SEQ ID NO: 26094 - protein, 22 aa, Mycobacterium avium
ITMLWPLADRPRLAPGVPGGTI

SEQ ID NO: 26095 - protein, 20 aa, Mycobacterium avium
IVLLAVFSLVFWGVSILPAD

SEQ ID NO: 26096 - protein, 18 aa, Mycobacterium avium
IYPLLIMAMLPVLLGLDV

SEQ ID NO: 26097 - protein, 23 aa, Mycobacterium avium
KRQRFWVSLYYPLTMRLLCNAIT

SEQ ID NO: 26098 - protein, 29 aa, Mycobacterium avium
KWSIPGLAHFFTMWGFFILLTVYIEAYGL

SEQ ID NO: 26099 - protein, 18 aa, Mycobacterium avium
LAAVLLPWNLYFGVGIPD

SEQ ID NO: 26100 - protein, 27 aa, Mycobacterium avium
LADPNPPLPWWPWQIGPAPRVPGTADP

SEQ ID NO: 26101 - protein, 18 aa, Mycobacterium avium
LAGPWRWSSGPPIWVAAV

SEQ ID NO: 26102 - protein, 20 aa, Mycobacterium avium
LAGRPLSLYTLPISGFGKDP

SEQ ID NO: 26103 - protein, 17 aa, Mycobacterium avium
LAIFLIAGTIGVISMVL

SEQ ID NO: 26104 - protein, 17 aa, Mycobacterium avium
LAYLGLLWWMMVCWAQP

SEQ ID NO: 26105 - protein, 27 aa, Mycobacterium avium
LFPVVQPWYLLWAIIPLAAWATRTGFR

SEQ ID NO: 26106 - protein, 19 aa, Mycobacterium avium
LFTPILLLAVAALGIGLVS

SEQ ID NO: 26107 - protein, 24 aa, Mycobacterium avium
LGATLLLMFLAFGSVVLPIKAVLM

SEQ ID NO: 26108 - protein, 21 aa, Mycobacterium avium
LGWPLWTAYIGVFALTVLVGA

SEQ ID NO: 26109 - protein, 18 aa, Mycobacterium avium
LIERFPLMLGTAGAVLAI

SEQ ID NO: 26110 - protein, 20 aa, Mycobacterium avium
LLAFRFLTPWGRQFWRITRG

SEQ ID NO: 26111 - protein, 24 aa, Mycobacterium avium
LLAQKFAAPLLDRYLGRTGYDSQQ

SEQ ID NO: 26112 - protein, 26 aa, Mycobacterium avium
LLGGLVWPFLLLPQLGMIRGAAATGM

SEQ ID NO: 26113 - protein, 20 aa, Mycobacterium avium
LLIAALLLIAVSRAALRPLD

SEQ ID NO: 26114 - protein, 19 aa, Mycobacterium avium
LLLGLPFFSVKWGFPDDRV

SEQ ID NO: 26115 - protein, 24 aa, Mycobacterium avium
LLSQDRFWLHTPGTWLLDMGMLAA

SEQ ID NO: 26116 - protein, 25 aa, Mycobacterium avium
LLSVALFFVWMIAVAFLYLVLGGMG

SEQ ID NO: 26117 - protein, 17 aa, Mycobacterium avium
LLVAVWRGRRPGPLVAE

SEQ ID NO: 26118 - protein, 23 aa, Mycobacterium avium
LLVLLYSLLYYRVLGLLTALSLA

SEQ ID NO: 26119 - protein, 18 aa, Mycobacterium avium
LMGLGWPVVVLVSIVVAR

SEQ ID NO: 26120 - protein, 30 aa, Mycobacterium avium; identical to SEQ ID NO: 13827

SEQ ID NO: 26121 - protein, 20 aa, Mycobacterium avium
LPGMPIGQLFRRIPPVDSRP

SEQ ID NO: 26122 - protein, 23 aa, Mycobacterium avium
LQFQHWHWAALALTAPVVGWCGR

SEQ ID NO: 26123 - protein, 17 aa, Mycobacterium avium
LRALLREYGRRLTHAGV

SEQ ID NO: 26124 - protein, 27 aa, Mycobacterium avium
LSGFEHSWFFLFLLVVAGLAALYILMQ

SEQ ID NO: 26125 - protein, 25 aa, Mycobacterium avium
LSVLIWQYIFGIQLYWMVLPMSVIV

SEQ ID NO: 26126 - protein, 20 aa, Mycobacterium avium
LTALRELALLWLADQVDTAL

SEQ ID NO: 26127 - protein, 21 aa, Mycobacterium avium
LTRWGPWLSLGSAALCGVGAL

SEQ ID NO: 26128 - protein, 22 aa, Mycobacterium avium
LTVWVVGYTLRPLRRLAAIAAH

SEQ ID NO: 26129 - protein, 19 aa, Mycobacterium avium
LVGLFVFPNFANPIHFLCS

SEQ ID NO: 26130 - protein, 25 aa, Mycobacterium avium
LVGVALVFVRWWGQPAWSWAVLWRR

SEQ ID NO: 26131 - protein, 27 aa, Mycobacterium avium
LVPNGTFFFVLAIFLIVLAVIGTFVVP

SEQ ID NO: 26132 - protein, 17 aa, Mycobacterium avium
MDPVNLLPFLLLGTTFG

SEQ ID NO: 26133 - protein, 19 aa, Mycobacterium avium
MLLTMLWQNLIGNAIKFRH

SEQ ID NO: 26134 - protein, 17 aa, Mycobacterium avium
MLTFVARPYLIPSESME

SEQ ID NO: 26135 - protein, 19 aa, Mycobacterium avium
MNFHFMPELNWTWGYPAVM

SEQ ID NO: 26136 - protein, 25 aa, Mycobacterium avium
MVLVPAFIHLLGRWTWWAPRPMVWL

SEQ ID NO: 26137 - protein, 17 aa, Mycobacterium avium
MVPLLPRLVFLVVGPAV

SEQ ID NO: 26138 - protein, 18 aa, Mycobacterium avium
NSLLPRWLPGAPEHRGWV

SEQ ID NO: 26139 - protein, 21 aa, Mycobacterium avium
PAAHRVWLPPLGRPPELRTLL

SEQ ID NO: 26140 - protein, 23 aa, Mycobacterium avium
PAHPLPPRRVAAPAIPPIPGLNE

SEQ ID NO: 26141 - protein, 17 aa, Mycobacterium avium
PAKPGLILFRRAGAPAA

SEQ ID NO: 26142 - protein, 21 aa, Mycobacterium avium
PAPDWLLLRIPVGTVWSEEAA

SEQ ID NO: 26143 - protein, 25 aa, Mycobacterium avium
PARWRHWWWALLLAFVPIHLVVSAI

SEQ ID NO: 26144 - protein, 19 aa, Mycobacterium avium
PFLLIMGGFMYFASRRQRR

SEQ ID NO: 26145 - protein, 20 aa, Mycobacterium avium
PGMLLFGLVPLALLALYLVV

SEQ ID NO: 26146 - protein, 17 aa, Mycobacterium avium
PGPSLLAYWIGGLTVCV

SEQ ID NO: 26147 - protein, 17 aa, Mycobacterium avium
PIPWSVLSLFAKGPTLS

SEQ ID NO: 26148 - protein, 21 aa, Mycobacterium avium
PKTAARQWKRYGRAALVVAVY

SEQ ID NO: 26149 - protein, 17 aa, Mycobacterium avium
PLVFRMPDTARWYLLKG

SEQ ID NO: 26150 - protein, 24 aa, Mycobacterium avium
PPEPPTPWYRRPAALVAFGALGVL

SEQ ID NO: 26151 - protein, 24 aa, Mycobacterium avium
PPGTSFYVLLPGRPLPPAGHSTPA

SEQ ID NO: 26152 - protein, 19 aa, Mycobacterium avium
PPLSQLRPGGFPPALDRVI

SEQ ID NO: 26153 - protein, 21 aa, Mycobacterium avium
PRPEVRLLWALIAAAAMIEGA

SEQ ID NO: 26154 - protein, 18 aa, Mycobacterium avium
PRRWVLLKGRLVASVASA

SEQ ID NO: 26155 - protein, 28 aa, Mycobacterium avium
PRSVQLLLTPLILAPFAAALALVRPSLK

SEQ ID NO: 26156 - protein, 21 aa, Mycobacterium avium
PRWSRRRLFVVIALAVMLVLA

SEQ ID NO: 26157 - protein, 22 aa, Mycobacterium avium
PSVPRWLWIFLGVVGVTAALAG

SEQ ID NO: 26158 - protein, 24 aa, Mycobacterium avium
PVGLLIVVLLLISTLFLLRSMNRQ

SEQ ID NO: 26159 - protein, 21 aa, Mycobacterium avium
PVLAPLALRLTLSIPALRRNA

SEQ ID NO: 26160 - protein, 19 aa, Mycobacterium avium
PVPIPGWNPPYNPPYTPPY

SEQ ID NO: 26161 - protein, 25 aa, Mycobacterium avium
PVTMYLHFPFVTVPIPITPPAPPPG

SEQ ID NO: 26162 - protein, 18 aa, Mycobacterium avium
QAEFLWRDYFPRGISDDG

SEQ ID NO: 26163 - protein, 22 aa, Mycobacterium avium
QATLLRWLWYGARREGLRLDGA

SEQ ID NO: 26164 - protein, 21 aa, Mycobacterium avium
QLAVVVLLVAVWRGRRPGPLV

SEQ ID NO: 26165 - protein, 30 aa, Mycobacterium avium
QLDLLLDGRKLLWWTLSRFTTLRNLPFRYE

SEQ ID NO: 26166 - protein, 19 aa, Mycobacterium avium
QTLLLKWAMMVLLGLLTSA

SEQ ID NO: 26167 - protein, 24 aa, Mycobacterium avium
RAADLLEWLALAALVPLTCWIAGL

SEQ ID NO: 26168 - protein, 17 aa, Mycobacterium avium
RATLLYPRGTVVMATEG

SEQ ID NO: 26169 - protein, 23 aa, Mycobacterium avium
RCTRLFRPVFYYLAFWAVTLTVL

SEQ ID NO: 26170 - protein, 27 aa, Mycobacterium avium
RDPVSVLLIFIIVFALIIAGFIGAELY

SEQ ID NO: 26171 - protein, 23 aa, Mycobacterium avium
RENVVALTVLWLLNIGEYLQDLT

SEQ ID NO: 26172 - protein, 24 aa, Mycobacterium avium
RETYDAMFDLWFPAALGARAVVTD

SEQ ID NO: 26173 - protein, 20 aa, Mycobacterium avium
RFIRTFAVPIIIGWIALIAV

SEQ ID NO: 26174 - protein, 24 aa, Mycobacterium avium
RGLKMLMVTILLVIVGIGLALVLY

SEQ ID NO: 26175 - protein, 18 aa, Mycobacterium avium
RGVRWWRRGLAVLSIPLC

SEQ ID NO: 26176 - protein, 26 aa, Mycobacterium avium
RKRPWRRYLRRSVLPLLLVASLAVSG

SEQ ID NO: 26177 - protein, 24 aa, Mycobacterium avium
RKYRWLVFAGWLLALVPAVYLALT

SEQ ID NO: 26178 - protein, 20 aa, Mycobacterium avium
RLRLALNVPYLLLVLAFVGF

SEQ ID NO: 26179 - protein, 27 aa, Mycobacterium avium
RLRRRLSGGLLLLIALTIAGGLAAILT

SEQ ID NO: 26180 - protein, 17 aa, Mycobacterium avium
RLSWLDALYFTAETITT

SEQ ID NO: 26181 - protein, 18 aa, Mycobacterium avium
RQLLAEYLLPLCPPPRAT

SEQ ID NO: 26182 - protein, 28 aa, Mycobacterium avium
RRNVKVVPIVLISLLLISGAGTAWLYFK

SEQ ID NO: 26183 - protein, 24 aa, Mycobacterium avium
RRQETWLMILLGVGFGLGVALTLS

SEQ ID NO: 26184 - protein, 27 aa, Mycobacterium avium
RRRLRLPSWSVAWKAAVIALICAFVAA

SEQ ID NO: 26185 - protein, 24 aa, Mycobacterium avium
RSGLVWLLVLPVLVLMFVAPPALR

SEQ ID NO: 26186 - protein, 23 aa, Mycobacterium avium
RTPWPLFWLSMMQADIIGALFVL

SEQ ID NO: 26187 - protein, 24 aa, Mycobacterium avium
RWHAIGLIAFLWLVGIYSVKARLG

SEQ ID NO: 26188 - protein, 20 aa, Mycobacterium avium
SAMLIYRLISWLLIAAVGWV

SEQ ID NO: 26189 - protein, 29 aa, Mycobacterium avium
SHWRHAPGTWWFDVGMLILISTVYLGFVR

SEQ ID NO: 26190 - protein, 19 aa, Mycobacterium avium
SLHFLVLVYFLFFILVHVT

SEQ ID NO: 26191 - protein, 21 aa, Mycobacterium avium
SLILLIMVLITRSLVAAIVIV

SEQ ID NO: 26192 - protein, 17 aa, Mycobacterium avium
SPLFRKFVEWIEYLCLM

SEQ ID NO: 26193 - protein, 24 aa, Mycobacterium avium
SPQTLFFPFVLLLAATAMYRGNDN

SEQ ID NO: 26194 - protein, 20 aa, Mycobacterium avium
TAVIWTVALTRPAKMHEAAV

SEQ ID NO: 26195 - protein, 17 aa, Mycobacterium avium
TCWLPVFVGWPVMRWLT

SEQ ID NO: 26196 - protein, 36 aa, Mycobacterium avium
TGMAPFFLTLALFFGALVLWMVLRPLQYRAIAAEVI

SEQ ID NO: 26197 - protein, 18 aa, Mycobacterium avium
THRVFLDQLSWLVPSRWG

SEQ ID NO: 26198 - protein, 29 aa, Mycobacterium avium
TLALALLLYLVSALLIWVQARLLNRTVQR

SEQ ID NO: 26199 - protein, 18 aa, Mycobacterium avium
TLALLRRASLRQAVADGV

SEQ ID NO: 26200 - protein, 20 aa, Mycobacterium avium
TLIFMIMLLLTRSVVAALVI

SEQ ID NO: 26201 - protein, 19 aa, Mycobacterium avium
TMGILTWIFVDGHLSGVLN

SEQ ID NO: 26202 - protein, 22 aa, Mycobacterium avium
TNWLEIFLILVIGFSLPRTFGR

SEQ ID NO: 26203 - protein, 25 aa, Mycobacterium avium
TVLPLQVISWLLMPISRLLVVLGNA

SEQ ID NO: 26204 - protein, 22 aa, Mycobacterium avium
TVWVGLAYPWCDLMLLALAAGM

SEQ ID NO: 26205 - protein, 18 aa, Mycobacterium avium
TWRHLPAILLVASLVLFT

SEQ ID NO: 26206 - protein, 24 aa, Mycobacterium avium
VAFGALGVLLLGAVVFAAVKLATS

SEQ ID NO: 26207 - protein, 23 aa, Mycobacterium avium
VAGCLPAVIWWACHRPNRLWWRY

SEQ ID NO: 26208 - protein, 18 aa, Mycobacterium avium
VAPLLWAAAGGVPAVLAY

SEQ ID NO: 26209 - protein, 24 aa, Mycobacterium avium
VAVMALLLVMRYRGRRRRAAALAA

SEQ ID NO: 26210 - protein, 26 aa, Mycobacterium avium
VAVVLLVRPLWLLLTQALPRSLHTRL

SEQ ID NO: 26211 - protein, 17 aa, Mycobacterium avium
VFALLSPFLLVAAVIFV

SEQ ID NO: 26212 - protein, 24 aa, Mycobacterium avium
VFAVRALLLMAFPHAFMAAADAAV

SEQ ID NO: 26213 - protein, 19 aa, Mycobacterium avium
VGLLLLLGLPFFSVKWGFP

SEQ ID NO: 26214 - protein, 17 aa, Mycobacterium avium
VGMILLVIPLGNLSFGG

SEQ ID NO: 26215 - protein, 18 aa, Mycobacterium avium
VIAALVLGLARYRRRRIS

SEQ ID NO: 26216 - protein, 26 aa, Mycobacterium avium
VIADRAYFLFLAVLPFVMGALSLTVP

SEQ ID NO: 26217 - protein, 32 aa, Mycobacterium avium
VIPPSFLRRAMPYVLVILIVGMIVALFATGMR

SEQ ID NO: 26218 - protein, 22 aa, Mycobacterium avium
VISLIMVNPFLLLAQQARAINA

SEQ ID NO: 26219 - protein, 18 aa, Mycobacterium avium
VIVRRAIRRLLLRGDSPE

SEQ ID NO: 26220 - protein, 21 aa, Mycobacterium avium
VKTLLLLGLWLAGWGAARLVA

SEQ ID NO: 26221 - protein, 18 aa, Mycobacterium avium
VLGWLLYAVPVLVVFLRP

SEQ ID NO: 26222 - protein, 20 aa, Mycobacterium avium
VLIMALLMLQLVSAGGMYPV

SEQ ID NO: 26223 - protein, 17 aa, Mycobacterium avium
VLLAGRRLWHRFRGQPD

SEQ ID NO: 26224 - protein, 26 aa, Mycobacterium avium
VLLVKKIWWPLAVWLLLVVVNVDAGN

SEQ ID NO: 26225 - protein, 26 aa, Mycobacterium avium
VMTLFSVLFALLWLSALAVFQTRSTR

SEQ ID NO: 26226 - protein, 22 aa, Mycobacterium avium
VPELLIPVLLLNFTPMFGHPSH

SEQ ID NO: 26227 - protein, 17 aa, Mycobacterium avium
VPIPLPIPGLGGPGFGG

SEQ ID NO: 26228 - protein, 23 aa, Mycobacterium avium
VPPQLPYPKWLPPPAPPEGINPP

SEQ ID NO: 26229 - protein, 30 aa, Mycobacterium avium
VPSIVALLGRWFWWPSPLPRRGVARVVKTV

SEQ ID NO: 26230 - protein, 20 aa, Mycobacterium avium
VQAPWPLLRTFAAGPALSRE

SEQ ID NO: 26231 - protein, 28 aa, Mycobacterium avium
VQPTFLYELLWNLLIFVALLYADRRLTL

SEQ ID NO: 26232 - protein, 23 aa, Mycobacterium avium
VRKYLTLMAFRIPALILAAVAYG

SEQ ID NO: 26233 - protein, 19 aa, Mycobacterium avium
VSLFPLLLLLTTGLGVILA

SEQ ID NO: 26234 - protein, 26 aa, Mycobacterium avium
VSLGIILLALLWYAGLPLRVFITSLL

SEQ ID NO: 26235 - protein, 39 aa, Mycobacterium avium
WACHRPNRLWWRYTGWWLVALVLATLWWVVGLVMLRAIS

SEQ ID NO: 26236 - protein, 19 aa, Mycobacterium avium
WALMTWILMAFGSTLSRLA

SEQ ID NO: 26237 - protein, 18 aa, Mycobacterium avium
WEDSPLYFKEIALVGSNA

SEQ ID NO: 26238 - protein, 21 aa, Mycobacterium avium
WGILSWILILLLPAGTLHYWQ

SEQ ID NO: 26239 - protein, 20 aa, Mycobacterium avium
WGQPAWSWAVLWRRGRRPID

SEQ ID NO: 26240 - protein, 17 aa, Mycobacterium avium
WGRPPPKRRVWPIVAAV

SEQ ID NO: 26241 - protein, 23 aa, Mycobacterium avium
WLVIVGWLTLWPFFGWLTTHFVV

SEQ ID NO: 26242 - protein, 28 aa, Mycobacterium avium
WSLSNWPVRWKVLAIVLVPLMLATVFGV

SEQ ID NO: 26243 - protein, 18 aa, Mycobacterium avium
WVFDMVMLVLFGVAAAGV

SEQ ID NO: 26244 - protein, 17 aa, Mycobacterium avium
WVLLKGRLVASVASAFV

SEQ ID NO: 26245 - protein, 20 aa, Mycobacterium avium
YAGLPFWPQGKIYDAYFTDA

SEQ ID NO: 26246 - protein, 17 aa, Mycobacterium avium
YFQLLVKSLLQPGLLEL

SEQ ID NO: 26247 - protein, 22 aa, Mycobacterium avium
YGSFFNIYFCSVTIKINGPAGS

SEQ ID NO: 26248 - protein, 20 aa, Mycobacterium avium
YLDLPRLWQILLIAGMFMWI

SEQ ID NO: 26249 - protein, 17 aa, Mycobacterium avium
YLGLLWWMMVCWAQPVR

SEQ ID NO: 26250 - protein, 18 aa, Mycobacterium avium
YLLWMLMGYLVVTAVLVV

SEQ ID NO: 26251 - protein, 17 aa, Mycobacterium avium
YPRTGSVVIWYSPRRCD

SEQ ID NO: 26252 - protein, 17 aa, Mycobacterium avium
YSYWFEPNPGWSRLFAP

SEQ ID NO: 26253 - protein, 25 aa, Mycobacterium avium
AAALQHWQWLVLGYALVAIVGASLV

SEQ ID NO: 26254 - protein, 21 aa, Mycobacterium avium
AAARWIRPLVPPLVARMMDTT

SEQ ID NO: 26255 - protein, 19 aa, Mycobacterium avium
AAAVFAWLLAAFAVRPFKR

SEQ ID NO: 26256 - protein, 18 aa, Mycobacterium avium
AAAVLIVLFGWWGGLYFT

SEQ ID NO: 26257 - protein, 19 aa, Mycobacterium avium
AAFLLLAGLSLGALIIWVA

SEQ ID NO: 26258 - protein, 27 aa, Mycobacterium avium
AAGRWPLPALVPATLVFGLLLGAIVRG

SEQ ID NO: 26259 - protein, 26 aa, Mycobacterium avium
AAGRWPLPALVPATLVFGLLVGAIVR

SEQ ID NO: 26260 - protein, 23 aa, Mycobacterium avium
AALAARRVLWLFKLITSGKPAPG

SEQ ID NO: 26261 - protein, 23 aa, Mycobacterium avium
AALALLGVRRYVFARPPLLGPSG

SEQ ID NO: 26262 - protein, 22 aa, Mycobacterium avium
AALLGRWFWWPQLVRPRPASTM

SEQ ID NO: 26263 - protein, 23 aa, Mycobacterium avium
AALLGRWFWWPQLVRPRPASTML

SEQ ID NO: 26264 - protein, 21 aa, Mycobacterium avium
AALQHWQWLVLGYALVAIVGA

SEQ ID NO: 26265 - protein, 18 aa, Mycobacterium avium
AASLLIFRFGPPAAKPAA

SEQ ID NO: 26266 - protein, 19 aa, Mycobacterium avium
AASLLIFRFGPPAAKPAAA

SEQ ID NO: 26267 - protein, 18 aa, Mycobacterium avium
AAVLVLLPIVTFAMAYFI

SEQ ID NO: 26268 - protein, 22 aa, Mycobacterium avium
AAWLHAAVWWKALLALVVAVAM

SEQ ID NO: 26269 - protein, 26 aa, Mycobacterium avium
ADPNPPLPWWPWQIGPAPRVPGTADP

SEQ ID NO: 26270 - protein, 19 aa, Mycobacterium avium
AEPILPVRLFASPVFTVCC

SEQ ID NO: 26271 - protein, 23 aa, Mycobacterium avium
AETALLRYLLYGLLPAWFIPALL

SEQ ID NO: 26272 - protein, 23 aa, Mycobacterium avium
AEVMLWHCWPITNRLPPAATLQL

SEQ ID NO: 26273 - protein, 18 aa, Mycobacterium avium
AFAHFFLDWAKSTSVAAV

SEQ ID NO: 26274 - protein, 19 aa, Mycobacterium avium
AFGLLVLVLLLSGLNATVF

SEQ ID NO: 26275 - protein, 20 aa, Mycobacterium avium
AFLGFGWRIPFLLSIFLVAV

SEQ ID NO: 26276 - protein, 23 aa, Mycobacterium avium
AGACIGFLWWNAAPAKIFMGDTG

SEQ ID NO: 26277 - protein, 20 aa, Mycobacterium avium
AGAITLWLGLVANVGQVLNG

SEQ ID NO: 26278 - protein, 21 aa, Mycobacterium avium
AGAITLWLGLVANVGQVLNGD

SEQ ID NO: 26279 - protein, 18 aa, Mycobacterium avium
AGLAVGLALLPVLALLAC

SEQ ID NO: 26280 - protein, 18 aa, Mycobacterium avium
AGLPLIPFTPRWLVRRAE

SEQ ID NO: 26281 - protein, 17 aa, Mycobacterium avium
AGPWRWSSGPPIWVAAV

SEQ ID NO: 26282 - protein, 21 aa, Mycobacterium avium
AGRLLAPLRWALIPSGVLQAV

SEQ ID NO: 26283 - protein, 27 aa, Mycobacterium avium
AGRNYLPPLLGLATILIIGLIFAVAVG

SEQ ID NO: 26284 - protein, 24 aa, Mycobacterium avium
AGWRSWRWRLLWLPSAAVLGVTTA

SEQ ID NO: 26285 - protein, 36 aa, Mycobacterium avium
AIATLVIVGLILIALLRALIAPLYLLGTVVLNYLAS

SEQ ID NO: 26286 - protein, 25 aa, Mycobacterium avium
AKGRRTVWIPWALGPAAAVLRMLPQ

SEQ ID NO: 26287 - protein, 19 aa, Mycobacterium avium
ALACWCLILATAALAGVLS

SEQ ID NO: 26288 - protein, 19 aa, Mycobacterium avium
ALEQLLVLLPPSVAAYGSY

SEQ ID NO: 26289 - protein, 21 aa, Mycobacterium avium
ALLGRWFWWPQLVRPRPASTM

SEQ ID NO: 26290 - protein, 34 aa, Mycobacterium avium
ALTLRLLTIGGCVLLYLTPLILGLWRGETSHDRR

SEQ ID NO: 26291 - protein, 24 aa, Mycobacterium avium
APTPVQIPRFLRKLLRELAPAPDT

SEQ ID NO: 26292 - protein, 25 aa, Mycobacterium avium
ARKKGFLGRFWLVLTIAAVVALSGF

SEQ ID NO: 26293 - protein, 18 aa, Mycobacterium avium
ARPILLRLGVLLVLLCTQ

SEQ ID NO: 26294 - protein, 35 aa, Mycobacterium avium
ARREIRLLLANRLYFAFLALLPFVLAGLTLLIPGD

SEQ ID NO: 26295 - protein, 23 aa, Mycobacterium avium
ASGPFFKVVLHNLALYQISQPWV

SEQ ID NO: 26296 - protein, 23 aa, Mycobacterium avium
ASIVGLFYLIWNYGYRQGTTGSS

SEQ ID NO: 26297 - protein, 23 aa, Mycobacterium avium
ASLILIIMLIITRSLVAAIVIVG

SEQ ID NO: 26298 - protein, 18 aa, Mycobacterium avium
AVALLIWRYGRIEERWAG

SEQ ID NO: 26299 - protein, 24 aa, Mycobacterium avium
AVDDKWLPKPARPAPPWPTAQREV

SEQ ID NO: 26300 - protein, 20 aa, Mycobacterium avium
AVGLALLPVLALLACWRTRK

SEQ ID NO: 26301 - protein, 21 aa, Mycobacterium avium
AVLLYYVMLTFVARPYLIPSE

SEQ ID NO: 26302 - protein, 18 aa, Mycobacterium avium
AVPVWPFVAAAAALIAGG

SEQ ID NO: 26303 - protein, 18 aa, Mycobacterium avium
AVVAWRWRRFRAAAAAAL

SEQ ID NO: 26304 - protein, 18 aa, Mycobacterium avium
AWLALFALPLLFVAHRLT

SEQ ID NO: 26305 - protein, 20 aa, Mycobacterium avium
AWPWRLVFLVGVSALFAQQA

SEQ ID NO: 26306 - protein, 19 aa, Mycobacterium avium
AWTIVWCLVLLSLALTATT

SEQ ID NO: 26307 - protein, 25 aa, Mycobacterium avium
CWAVTAGGIWWPIGRELAWCCVGLL

SEQ ID NO: 26308 - protein, 17 aa, Mycobacterium avium
CWWLLLRVYRRLNTAKF

SEQ ID NO: 26309 - protein, 17 aa, Mycobacterium avium
DDRLHRWRPDAAALEPV

SEQ ID NO: 26310 - protein, 26 aa, Mycobacterium avium
DGRDMFWSLIPLVIGCVVLAGLLGMC

SEQ ID NO: 26311 - protein, 23 aa, Mycobacterium avium
DLLRPVLGWVLFAGLIGWSAACA

SEQ ID NO: 26312 - protein, 21 aa, Mycobacterium avium
DRKIHLVIARRPLAALGAGVA

SEQ ID NO: 26313 - protein, 24 aa, Mycobacterium avium
DRRRWAAVYLLLGGLVLGFVGNVV

SEQ ID NO: 26314 - protein, 21 aa, Mycobacterium avium
DVNPMLFPAILLALTLLLVST

SEQ ID NO: 26315 - protein, 18 aa, Mycobacterium avium
DYLRPRAVIYHRGLGPKF

SEQ ID NO: 26316 - protein, 17 aa, Mycobacterium avium
EDSPLYFKEIALVGSNA

SEQ ID NO: 26317 - protein, 23 aa, Mycobacterium avium
EFRTRLWLPYLPLILAAAVGWGH

SEQ ID NO: 26318 - protein, 21 aa, Mycobacterium avium
EKLFTPILLLAVAALGIGLVS

SEQ ID NO: 26319 - protein, 25 aa, Mycobacterium avium
EQPWTPIMIILVITAVKILGSVLAP

SEQ ID NO: 26320 - protein, 25 aa, Mycobacterium avium
ETLPMMLAPWVLLPTILALRATGPR

SEQ ID NO: 26321 - protein, 24 aa, Mycobacterium avium
EVLQSYLNIIYFGRGAYGISAAAK

SEQ ID NO: 26322 - protein, 17 aa, Mycobacterium avium
EVTFYCLDYGGGKLRAL

SEQ ID NO: 26323 - protein, 28 aa, Mycobacterium avium
FAIGALLPLIAILLPPPTWRIPVTVVAV

SEQ ID NO: 26324 - protein, 19 aa, Mycobacterium avium
FAVTALFRHPLGIPIPHTA

SEQ ID NO: 26325 - protein, 19 aa, Mycobacterium avium
FGEFLAWIIGWNLLLELAI

SEQ ID NO: 26326 - protein, 19 aa, Mycobacterium avium
FGNKWMWSPIVVTPPVVVA

SEQ ID NO: 26327 - protein, 18 aa, Mycobacterium avium
FIAFLVFGTVITAGLMTV

SEQ ID NO: 26328 - protein, 18 aa, Mycobacterium avium
FIVLLFVYRSVTTVVLLL

SEQ ID NO: 26329 - protein, 26 aa, Mycobacterium avium
FLAPQLFQPFLDYLWGFRTFDTALGP

SEQ ID NO: 26330 - protein, 17 aa, Mycobacterium avium
FLAPWRIALVDLVLWGA

SEQ ID NO: 26331 - protein, 19 aa, Mycobacterium avium
FLGFGWRIPFLLSIFLVAV

SEQ ID NO: 26332 - protein, 19 aa, Mycobacterium avium
FLLLVCALVLALVYLQFRG

SEQ ID NO: 26333 - protein, 20 aa, Mycobacterium avium
FLPFLLIMGGFMYFASRRQR

SEQ ID NO: 26334 - protein, 17 aa, Mycobacterium avium
FNAIIIVLLIPLSLRGV

SEQ ID NO: 26335 - protein, 17 aa, Mycobacterium avium
FNYLFSKPVPYARAGLD

SEQ ID NO: 26336 - protein, 17 aa, Mycobacterium avium
FPAILLALTLLLVSTVI

SEQ ID NO: 26337 - protein, 26 aa, Mycobacterium avium
FPVVQPWYLLWAIIPLAAWATRTGFR

SEQ ID NO: 26338 - protein, 27 aa, Mycobacterium avium
FRSPHYLVVIVLWIAHTWTVGAFYVTP

SEQ ID NO: 26339 - protein, 23 aa, Mycobacterium avium
FVAFDQLWRWNSIVALVLSVLVI

SEQ ID NO: 26340 - protein, 24 aa, Mycobacterium avium
FVAFDQLWRWNSIVALVLSVLVIL

SEQ ID NO: 26341 - protein, 17 aa, Mycobacterium avium
FVFLLLPSFVIYLISMV

SEQ ID NO: 26342 - protein, 22 aa, Mycobacterium avium
FVLIVAFLLVWWVYDTYRPEPA

SEQ ID NO: 26343 - protein, 20 aa, Mycobacterium avium
FWANLPAFLAANGPLLFFVA

SEQ ID NO: 26344 - protein, 18 aa, Mycobacterium avium
FWQLWDLALLWLAQLHGG

SEQ ID NO: 26345 - protein, 19 aa, Mycobacterium avium
FYSGFYLPMYWSSRAKLTN

SEQ ID NO: 26346 - protein, 19 aa, Mycobacterium avium
FYWAIGIAIGLPIGMIALT

SEQ ID NO: 26347 - protein, 19 aa, Mycobacterium avium
FYYALLLLLAGFTGSIVVS

SEQ ID NO: 26348 - protein, 20 aa, Mycobacterium avium
FYYALLLLLAGFTGSIVVST

SEQ ID NO: 26349 - protein, 19 aa, Mycobacterium avium
GAHAPYLAWLTKASADSAA

SEQ ID NO: 26350 - protein, 21 aa, Mycobacterium avium
GDFYNFYLCDISIKVNGLQPG

SEQ ID NO: 26351 - protein, 23 aa, Mycobacterium avium
GGALRRAGLLAALPLSLIAVAAA

SEQ ID NO: 26352 - protein, 24 aa, Mycobacterium avium
GGLVWPFLLLPHLGMIRGAAATGM

SEQ ID NO: 26353 - protein, 24 aa, Mycobacterium avium
GGRSRFGFGTLAVLLCLLLGIAIV

SEQ ID NO: 26354 - protein, 17 aa, Mycobacterium avium
GGYFFNYLFSKPVPYAR

SEQ ID NO: 26355 - protein, 18 aa, Mycobacterium avium
GHARPLYGPGLRFLIPLL

SEQ ID NO: 26356 - protein, 25 aa, Mycobacterium avium
GHARPLYGPGLRWLIPLVDKMIRVD

SEQ ID NO: 26357 - protein, 18 aa, Mycobacterium avium
GHGPAAHRVWLPPLGRPP

SEQ ID NO: 26358 - protein, 17 aa, Mycobacterium avium
GHLALFGMLLRDTRWWL

SEQ ID NO: 26359 - protein, 18 aa, Mycobacterium avium
GIFVCLFCAFYFMTVTYS

SEQ ID NO: 26360 - protein, 19 aa, Mycobacterium avium
GIFVCLFCAFYFMTVTYSL

SEQ ID NO: 26361 - protein, 17 aa, Mycobacterium avium
GINLPPVPALSGGATST

SEQ ID NO: 26362 - protein, 24 aa, Mycobacterium avium
GLGVFAVWLYRYLWAKPSSPPPPR

SEQ ID NO: 26363 - protein, 18 aa, Mycobacterium avium
GLIAFLWLVGIYSVKARL

SEQ ID NO: 26364 - protein, 24 aa, Mycobacterium avium
GLQFMLIIWLQGIWLPLHGYRFES

SEQ ID NO: 26365 - protein, 24 aa, Mycobacterium avium
GLTVWVVGYTLRPLRRLAAIAAHV

SEQ ID NO: 26366 - protein, 17 aa, Mycobacterium avium
GMRLTVLLALLANLFLP

SEQ ID NO: 26367 - protein, 18 aa, Mycobacterium avium
GPAAPPVVPLPPGGPGGG

SEQ ID NO: 26368 - protein, 17 aa, Mycobacterium avium
GPWALYGLLFTIVILFA

SEQ ID NO: 26369 - protein, 17 aa, Mycobacterium avium
GPWRDWSWTQQINWLWV

SEQ ID NO: 26370 - protein, 18 aa, Mycobacterium avium
GRWFWWPMVVHPRGDNAR

SEQ ID NO: 26371 - protein, 23 aa, Mycobacterium avium
GSLLRLLVLALIMVPITAAVMLR

SEQ ID NO: 26372 - protein, 24 aa, Mycobacterium avium
GSLLRLLVLALIMVPITAAVMLRA

SEQ ID NO: 26373 - protein, 24 aa, Mycobacterium avium
GVIVAWLLIVMLLARLFASHGLAP

SEQ ID NO: 26374 - protein, 24 aa, Mycobacterium avium
GVIVAWLLIVMLLARLFASHGLSP

SEQ ID NO: 26375 - protein, 17 aa, Mycobacterium avium
GVTLLAVVAWRWRRFRA

SEQ ID NO: 26376 - protein, 23 aa, Mycobacterium avium
GVTLLAVVAWRWRRFRAAAAAAL

SEQ ID NO: 26377 - protein, 27 aa, Mycobacterium avium
GWAIFHTLMIFWPFMQAAIQMAVVLAP

SEQ ID NO: 26378 - protein, 19 aa, Mycobacterium avium
GWLAAIAAVLVLCAAGIGA

SEQ ID NO: 26379 - protein, 22 aa, Mycobacterium avium
GWRSWRWRLLWLPSAAVLGVTT

SEQ ID NO: 26380 - protein, 23 aa, Mycobacterium avium
HGLWPWALALLALAAVPFGHAWR

SEQ ID NO: 26381 - protein, 17 aa, Mycobacterium avium
HGPAAHRVWLPPLGRPP

SEQ ID NO: 26382 - protein, 24 aa, Mycobacterium avium
HRQRTWLSGLALLVALVVGAAYLA

SEQ ID NO: 26383 - protein, 25 aa, Mycobacterium avium
HRQRTWLSGLALLVTLVVGGAYLAL

SEQ ID NO: 26384 - protein, 18 aa, Mycobacterium avium
HYSGWWVFDMVMLVLFGV

SEQ ID NO: 26385 - protein, 20 aa, Mycobacterium avium
HYSGWWVFDMVMLVLFGVAA

SEQ ID NO: 26386 - protein, 34 aa, Mycobacterium avium
IADFVVRWPWLVIGFWAALAVALPLAFPSLAEMA

SEQ ID NO: 26387 - protein, 19 aa, Mycobacterium avium
IAHLAWLVLLLGSGAGVLL

SEQ ID NO: 26388 - protein, 20 aa, Mycobacterium avium
IAHLAWLVLLLGSGAGVLVG

SEQ ID NO: 26389 - protein, 24 aa, Mycobacterium avium
IASGPFFKVVLHNLALYQISQPWV

SEQ ID NO: 26390 - protein, 17 aa, Mycobacterium avium
ICFIGFLFPLWDSKRQT

SEQ ID NO: 26391 - protein, 17 aa, Mycobacterium avium
ICVPPIALSPWPATVFT

SEQ ID NO: 26392 - protein, 24 aa, Mycobacterium avium
IDTSSWRWIFLINVPIGLVTVALA

SEQ ID NO: 26393 - protein, 25 aa, Mycobacterium avium
IEFRTRLWLPYLPLILAAAVGWGHA

SEQ ID NO: 26394 - protein, 23 aa, Mycobacterium avium
IFQVTFFVFLIIPLVVLRTVTGA

SEQ ID NO: 26395 - protein, 17 aa, Mycobacterium avium
IFVCLFCAFYFMTVTYS

SEQ ID NO: 26396 - protein, 29 aa, Mycobacterium avium
IFVGGIVALAWALAFIRPHADQRPEVGTQ

SEQ ID NO: 26397 - protein, 26 aa, Mycobacterium avium
IFVTLLLVYRSVITVILLLLIVGLEL

SEQ ID NO: 26398 - protein, 25 aa, Mycobacterium avium
IGTLAAFLWSLYALVLGAADRPGMR

SEQ ID NO: 26399 - protein, 21 aa, Mycobacterium avium
ILVTLKFLLEQPLLYVVGLGM

SEQ ID NO: 26400 - protein, 23 aa, Mycobacterium avium
IPATLLLLRYRWLRAEPLPAPRT

SEQ ID NO: 26401 - protein, 18 aa, Mycobacterium avium
IPLLTPRLSGRFGVPVHS

SEQ ID NO: 26402 - protein, 23 aa, Mycobacterium avium
IPVLAPLVLRLTLSIPALRRNAV

SEQ ID NO: 26403 - protein, 22 aa, Mycobacterium avium
ISAMLIYRLISWLLIAAVGWVV

SEQ ID NO: 26404 - protein, 19 aa, Mycobacterium avium
ISLIMVNPFLLLAQQARAI

SEQ ID NO: 26405 - protein, 29 aa, Mycobacterium avium
ISRFQTLLLKWAMMLLLGLLTSAVYLAIA

SEQ ID NO: 26406 - protein, 27 aa, Mycobacterium avium
IVFDRGYFVFLALLPFIMGSLSMSVPG

SEQ ID NO: 26407 - protein, 31 aa, Mycobacterium avium
IVPSIVALLGRWFWWPSPLPRRGVARVVKTV

SEQ ID NO: 26408 - protein, 27 aa, Mycobacterium avium
IVSDRGYFVFLALLPFIMGSLSMSVPG

SEQ ID NO: 26409 - protein, 28 aa, Mycobacterium avium
IVSDRGYFVFLALLPFIMGSLSMSVPGD

SEQ ID NO: 26410 - protein, 19 aa, Mycobacterium avium
IVVLLLISTLFLLRSMNRQ

SEQ ID NO: 26411 - protein, 30 aa, Mycobacterium avium
KARSRRLRLPSWSVAWKAAVIALICAFVAA

SEQ ID NO: 26412 - protein, 17 aa, Mycobacterium avium
KFNYPPFGLNLFSTAET

SEQ ID NO: 26413 - protein, 17 aa, Mycobacterium avium
KPGLILFRRAGAPAALA

SEQ ID NO: 26414 - protein, 22 aa, Mycobacterium avium
KQWGFFILLFLLLAPGLNRWFF

SEQ ID NO: 26415 - protein, 19 aa, Mycobacterium avium
KQWGFFTLLFLLLAPGLNR

SEQ ID NO: 26416 - protein, 20 aa, Mycobacterium avium
KTAARQWKRYGRAALVVAVY

SEQ ID NO: 26417 - protein, 31 aa, Mycobacterium avium
KWSIPGLAHFFTMWGFFILLTVYIEAYGLLF

SEQ ID NO: 26418 - protein, 27 aa, Mycobacterium avium
LALALLLYLVSALFIWMQARLLNRTVQ

SEQ ID NO: 26419 - protein, 24 aa, Mycobacterium avium
LARPAFLLRSYLIPLGALLVLLVN

SEQ ID NO: 26420 - protein, 19 aa, Mycobacterium avium
LASYLFNVYFQRGAPGSFV

SEQ ID NO: 26421 - protein, 20 aa, Mycobacterium avium
LASYLFNVYFQRGAPGSFVA

SEQ ID NO: 26422 - protein, 19 aa, Mycobacterium avium
LASYLLIGFWYHKPTAATA

SEQ ID NO: 26423 - protein, 17 aa, Mycobacterium avium
LDLDLLLGGLKPVIQGL

SEQ ID NO: 26424 - protein, 19 aa, Mycobacterium avium
LFFPFVLLLAATAMYRGND

SEQ ID NO: 26425 - protein, 18 aa, Mycobacterium avium
LFGMLLRDTRWWLGGLGD

SEQ ID NO: 26426 - protein, 18 aa, Mycobacterium avium
LFYVVKILLYILGGWLFA

SEQ ID NO: 26427 - protein, 21 aa, Mycobacterium avium
LGAALGLRYALGARRWARLGM

SEQ ID NO: 26428 - protein, 17 aa, Mycobacterium avium
LGAFLMLVLDGAPIDLT

SEQ ID NO: 26429 - protein, 22 aa, Mycobacterium avium
LGALWAWIVPPVRAVVALTRSG

SEQ ID NO: 26430 - protein, 26 aa, Mycobacterium avium
LGLGSLLQWMFYVGLLITVADVLIAL

SEQ ID NO: 26431 - protein, 27 aa, Mycobacterium avium
LGLGSLLQWMFYVGLLITVADVLIALA

SEQ ID NO: 26432 - protein, 17 aa, Mycobacterium avium
LGLLFDTLIVRSFMMPS

SEQ ID NO: 26433 - protein, 21 aa, Mycobacterium avium
LGSALAWLVAGLAAAGRWPLP

SEQ ID NO: 26434 - protein, 28 aa, Mycobacterium avium
LGWAIFHTLMIFWPFMQAAIQMAVVLAP

SEQ ID NO: 26435 - protein, 17 aa, Mycobacterium avium
LGWLLYAVPVLVVFLRP

SEQ ID NO: 26436 - protein, 18 aa, Mycobacterium avium
LGWRMWYGGPWFSTRIVT

SEQ ID NO: 26437 - protein, 17 aa, Mycobacterium avium
LHWLVLPLTFIILVAVG

SEQ ID NO: 26438 - protein, 29 aa, Mycobacterium avium
LIALILLIVYRSVFTALLPLLVIGISLAV

SEQ ID NO: 26439 - protein, 23 aa, Mycobacterium avium
LLFPTLLLVIYKLLVGKSVLAVT

SEQ ID NO: 26440 - protein, 26 aa, Mycobacterium avium
LLGSALAWLLAGLAAAGRWPLPALVP

SEQ ID NO: 26441 - protein, 26 aa, Mycobacterium avium
LLLSVALFFVWMIAVAFLYLVLGGMG

SEQ ID NO: 26442 - protein, 20 aa, Mycobacterium avium
LLLVCALVLALVYLQFRGDF

SEQ ID NO: 26443 - protein, 24 aa, Mycobacterium avium
LLRNYLLPLGALLLFLVQASGIPA

SEQ ID NO: 26444 - protein, 22 aa, Mycobacterium avium
LLRPVLGWVLFAGLIGWRAASA

SEQ ID NO: 26445 - protein, 28 aa, Mycobacterium avium
LMAMFAQWNWWLPPWLSRVLPSVDFDRP

SEQ ID NO: 26446 - protein, 26 aa, Mycobacterium avium
LPARWRRWWWALLLAFVPIHLVVSAI

SEQ ID NO: 26447 - protein, 20 aa, Mycobacterium avium
LPPVLRKLTIYLPQSPSTAE

SEQ ID NO: 26448 - protein, 29 aa, Mycobacterium avium
LPRLWQILLTVGLFLWIAIIWRGIRGKLK

SEQ ID NO: 26449 - protein, 26 aa, Mycobacterium avium
LPRRPGRSRWLRLPGRRAIAAGAGIL

SEQ ID NO: 26450 - protein, 17 aa, Mycobacterium avium
LPWEVPLIELGLDSLMA

SEQ ID NO: 26451 - protein, 19 aa, Mycobacterium avium
LPWMFFFTGLAIPAFYAVG

SEQ ID NO: 26452 - protein, 18 aa, Mycobacterium avium
LQHWQWMVLGYALVAIVG

SEQ ID NO: 26453 - protein, 28 aa, Mycobacterium avium
LRDPVSVLLIFIIVFALLIAGFIGAELY

SEQ ID NO: 26454 - protein, 28 aa, Mycobacterium avium
LRIPRRPGRPRWLRLPGRRAIAAGAGIL

SEQ ID NO: 26455 - protein, 19 aa, Mycobacterium avium
LRLLTIGGCVLLYLTPLIL

SEQ ID NO: 26456 - protein, 17 aa, Mycobacterium avium
LSFAIGALLPLIAILLP

SEQ ID NO: 26457 - protein, 18 aa, Mycobacterium avium
LSFLLRPGWVVLALVVVA

SEQ ID NO: 26458 - protein, 28 aa, Mycobacterium avium
LSGFEHSWFFLFLLVVAGLAALYILMQL

SEQ ID NO: 26459 - protein, 21 aa, Mycobacterium avium
LSIPSWWQPYVLSVASLTPDG

SEQ ID NO: 26460 - protein, 22 aa, Mycobacterium avium
LSLILLIMVLITRSLVAAIVIV

SEQ ID NO: 26461 - protein, 22 aa, Mycobacterium avium
LSQDRFWLHTPGTWLLDMGMLA

SEQ ID NO: 26462 - protein, 18 aa, Mycobacterium avium
LSYMILLSIPVLAPLVLR

SEQ ID NO: 26463 - protein, 17 aa, Mycobacterium avium
LTIMLAAWGWFALLLEI

SEQ ID NO: 26464 - protein, 19 aa, Mycobacterium avium
LVFGLLLGAIVRGTAAPAA

SEQ ID NO: 26465 - protein, 21 aa, Mycobacterium avium
LVFKPLFFPNISPSAGTLASF

SEQ ID NO: 26466 - protein, 22 aa, Mycobacterium avium
LVHTLIFTALRIAFLAVLVGTT

SEQ ID NO: 26467 - protein, 22 aa, Mycobacterium avium
LVLLPIVTFAMAYFIVDIPKPG

SEQ ID NO: 26468 - protein, 19 aa, Mycobacterium avium
LVLLYSLLYYRVLGLLTAL

SEQ ID NO: 26469 - protein, 26 aa, Mycobacterium avium
LVPNGTFFFVLAIFLIVLAVIGTFVV

SEQ ID NO: 26470 - protein, 24 aa, Mycobacterium avium
LVSPARWYWAVIAAFVIFAGTNSW

SEQ ID NO: 26471 - protein, 25 aa, Mycobacterium avium
LVSPARWYWAVIAAFVIFAGTNSWG

SEQ ID NO: 26472 - protein, 19 aa, Mycobacterium avium
LVVAVLVLMFVAPPALRPS

SEQ ID NO: 26473 - protein, 18 aa, Mycobacterium avium
LVYFLFFILVHVTMVLTT

SEQ ID NO: 26474 - protein, 17 aa, Mycobacterium avium
LWQHLFWFFGHPEVYII

SEQ ID NO: 26475 - protein, 17 aa, Mycobacterium avium
LWTLFWLGWVIALAATF

SEQ ID NO: 26476 - protein, 24 aa, Mycobacterium avium
MAAITFVLLFLLTGSVLLPAKALA

SEQ ID NO: 26477 - protein, 26 aa, Mycobacterium avium
MAMFAQWNWWLPPWLSRVLPSVDFDR

SEQ ID NO: 26478 - protein, 27 aa, Mycobacterium avium
MAMFAQWNWWLPPWLSRVLPSVDFDRP

SEQ ID NO: 26479 - protein, 20 aa, Mycobacterium avium
MAVFYLRLPATFGIGTYGVS

SEQ ID NO: 26480 - protein, 33 aa, Mycobacterium avium
MPAHPKKFSWHWWWLMAAIPVAVLLVLLIWVLF

SEQ ID NO: 26481 - protein, 32 aa, Mycobacterium avium
MPAHPKKFSWHWWWLMAAVPVAVLLVLLIWVL

SEQ ID NO: 26482 - protein, 17 aa, Mycobacterium avium
MPWLFFFSGLAIPAFYT

SEQ ID NO: 26483 - protein, 32 aa, Mycobacterium avium
MSKSHHHRSVWWSWLVGVLTVVGLGLGLGSGV

SEQ ID NO: 26484 - protein, 23 aa, Mycobacterium avium
MTVTYSLMTFWITTMLALLYGLL

SEQ ID NO: 26485 - protein, 17 aa, Mycobacterium avium
NFHFMPELNWTWGYPAV

SEQ ID NO: 26486 - protein, 25 aa, Mycobacterium avium
NFLAPQLFQPFLDYLWGFRTFDTAR

SEQ ID NO: 26487 - protein, 26 aa, Mycobacterium avium
NFLAPQLFQPFLDYLWGFRTFDTARG

SEQ ID NO: 26488 - protein, 20 aa, Mycobacterium avium
NPFVLVGWSLGGALAYACAI

SEQ ID NO: 26489 - protein, 18 aa, Mycobacterium avium
NRVWWVVGTLIAVGVLAL

SEQ ID NO: 26490 - protein, 20 aa, Mycobacterium avium
NSALPRWLWTRGSALVSAMW

SEQ ID NO: 26491 - protein, 21 aa, Mycobacterium avium
NSALPRWLWTRGSALVSAMWG

SEQ ID NO: 26492 - protein, 21 aa, Mycobacterium avium
NTSYYRLMLKLKGGPQAVADA

SEQ ID NO: 26493 - protein, 17 aa, Mycobacterium avium
NVFMIFGVLWLFLAHAP

SEQ ID NO: 26494 - protein, 32 aa, Mycobacterium avium
PAHPKKFSWHWWWLMAAIPVAVLLVLLIWVLF

SEQ ID NO: 26495 - protein, 18 aa, Mycobacterium avium
PALAFQYLVQLMLFDWPT

SEQ ID NO: 26496 - protein, 18 aa, Mycobacterium avium
PDGRPPIHLPLDDPYQAP

SEQ ID NO: 26497 - protein, 29 aa, Mycobacterium avium
PEDLKRFGAFGWAVPWIPGTAFGNLVTRD

SEQ ID NO: 26498 - protein, 18 aa, Mycobacterium avium
PEDLPWEVPLIELGLDSL

SEQ ID NO: 26499 - protein, 18 aa, Mycobacterium avium
PFLLVAAVIFVPMLDLLL

SEQ ID NO: 26500 - protein, 21 aa, Mycobacterium avium
PHAIRIFAVPIILGWLFVTVL

SEQ ID NO: 26501 - protein, 17 aa, Mycobacterium avium
PHRALVWLGWLTAATAI

SEQ ID NO: 26502 - protein, 17 aa, Mycobacterium avium
PLGPVWVALLIIGASSG

SEQ ID NO: 26503 - protein, 19 aa, Mycobacterium avium
PLSLPVAAPLPAAPPPAAP

SEQ ID NO: 26504 - protein, 18 aa, Mycobacterium avium
PLSQLRPGAFPPALDRVI

SEQ ID NO: 26505 - protein, 20 aa, Mycobacterium avium
PMLLTMLWQNLIGNAIKFRH

SEQ ID NO: 26506 - protein, 23 aa, Mycobacterium avium
PPGTSFYVLLPGRSLPPAGHSTP

SEQ ID NO: 26507 - protein, 18 aa, Mycobacterium avium
PPMGSILYWLRPGTIRLP

SEQ ID NO: 26508 - protein, 27 aa, Mycobacterium avium
PPPPYPPPLPPPYPPPAYPPPYPPPYP

SEQ ID NO: 26509 - protein, 19 aa, Mycobacterium avium
PPVLRKLTIYLPQSPSTAE

SEQ ID NO: 26510 - protein, 20 aa, Mycobacterium avium
PPYKLLTFITVVVLAVIFTL

SEQ ID NO: 26511 - protein, 21 aa, Mycobacterium avium
PRFIRAFAVPIIIGWIALIAV

SEQ ID NO: 26512 - protein, 23 aa, Mycobacterium avium
PRGRYWWVRWVILGVVAIVLAVE

SEQ ID NO: 26513 - protein, 17 aa, Mycobacterium avium
PRIPLQAKLIAALTARQ

SEQ ID NO: 26514 - protein, 18 aa, Mycobacterium avium
PRLSWLDALYFTAETITT

SEQ ID NO: 26515 - protein, 23 aa, Mycobacterium avium
PRTLRLFIVLVIAFALIPVGAVP

SEQ ID NO: 26516 - protein, 26 aa, Mycobacterium avium
PRWSRRRLFIVIALAVMLVLAGLTVG

SEQ ID NO: 26517 - protein, 25 aa, Mycobacterium avium
PSLAWVPLLLLWFGIDETPKILMVA

SEQ ID NO: 26518 - protein, 26 aa, Mycobacterium avium
PSVLFSWPTLLWVLDFIAGRIFDILV

SEQ ID NO: 26519 - protein, 23 aa, Mycobacterium avium
PTALWLWIALSGLAAAVFLVGWR

SEQ ID NO: 26520 - protein, 20 aa, Mycobacterium avium
PVGLLIVVLLLISTLFLLRS

SEQ ID NO: 26521 - protein, 17 aa, Mycobacterium avium
PVILIVLLAVFGSLAAA

SEQ ID NO: 26522 - protein, 21 aa, Mycobacterium avium
PWTPIVIILVITAVKILGSML

SEQ ID NO: 26523 - protein, 22 aa, Mycobacterium avium
PWTPIVIILVITAVKILGSVLA

SEQ ID NO: 26524 - protein, 17 aa, Mycobacterium avium
QAEFLWRDYFPRGISDD

SEQ ID NO: 26525 - protein, 30 aa, Mycobacterium avium
QAEPTPWYRRPAMLIAWVVSVVVLIGLIVF

SEQ ID NO: 26526 - protein, 27 aa, Mycobacterium avium
QDGRDMFWSLIPLVIGCVVLAGLLGMC

SEQ ID NO: 26527 - protein, 28 aa, Mycobacterium avium
QDGRDMFWSLIPLVIGCVVLAGLLGMCS

SEQ ID NO: 26528 - protein, 19 aa, Mycobacterium avium
QEAALTWLLLISVPVMAVT

SEQ ID NO: 26529 - protein, 20 aa, Mycobacterium avium
QEAALTWLLLISVPVMAVTN

SEQ ID NO: 26530 - protein, 26 aa, Mycobacterium avium
QLDLLLDGRKLLWWTLSRFTTLGNLP

SEQ ID NO: 26531 - protein, 26 aa, Mycobacterium avium
QLTVRGWLALVLWIMGTTVLIGALVG

SEQ ID NO: 26532 - protein, 26 aa, Mycobacterium avium
QLTVRGWLALVLWIMGTTVLVGAVLL

SEQ ID NO: 26533 - protein, 17 aa, Mycobacterium avium
QNLIGNAIKFRHKDRRP

SEQ ID NO: 26534 - protein, 18 aa, Mycobacterium avium
QPFFDYYFGFRRNDPNMP

SEQ ID NO: 26535 - protein, 22 aa, Mycobacterium avium
QPLTSLSLQCKLPISIPQALGM

SEQ ID NO: 26536 - protein, 27 aa, Mycobacterium avium
QPTFLYELLWNLLIFVALLYADRRLTL

SEQ ID NO: 26537 - protein, 17 aa, Mycobacterium avium
QSLPGMPIGQLFRRIPP

SEQ ID NO: 26538 - protein, 17 aa, Mycobacterium avium
QVGSWFGPYRLVRLLRQ

SEQ ID NO: 26539 - protein, 23 aa, Mycobacterium avium
RAMPYVLVILIVGMIVALFATGM

SEQ ID NO: 26540 - protein, 24 aa, Mycobacterium avium
RENVVALTVLWLLNIGEYLQDLTL

SEQ ID NO: 26541 - protein, 19 aa, Mycobacterium avium
RGANLIRPGFIGTVLILLV

SEQ ID NO: 26542 - protein, 17 aa, Mycobacterium avium
RGFLPPFVTWFAALLFA

SEQ ID NO: 26543 - protein, 19 aa, Mycobacterium avium
RGFVVSILVFVLLGSFILP

SEQ ID NO: 26544 - protein, 31 aa, Mycobacterium avium
RGRLRLPRRPGRPRWLRLPGRRAIAAGAGIL

SEQ ID NO: 26545 - protein, 18 aa, Mycobacterium avium
RGRWLRWGLLSVWGPGLV

SEQ ID NO: 26546 - protein, 24 aa, Mycobacterium avium
RHGLWPWALALLALAAVRFGRARR

SEQ ID NO: 26547 - protein, 39 aa, Mycobacterium avium
RIADFVVRWPWLVIGFWAALAVALPLAFPSLAEMAQKHP

SEQ ID NO: 26548 - protein, 17 aa, Mycobacterium avium
RILQFITYLLVPAGLLT

SEQ ID NO: 26549 - protein, 20 aa, Mycobacterium avium
RKIHLVIARRPLAALGAGVA

SEQ ID NO: 26550 - protein, 25 aa, Mycobacterium avium
RKRPWRRYLRRSVLPLLLAASLAVS

SEQ ID NO: 26551 - protein, 17 aa, Mycobacterium avium
RLPMTFVLFNNNAHAMC

SEQ ID NO: 26552 - protein, 20 aa, Mycobacterium avium
RLTVLLALLANLFLPWGIAG

SEQ ID NO: 26553 - protein, 19 aa, Mycobacterium avium
RPEVRLLWALIAAAAIIEG

SEQ ID NO: 26554 - protein, 19 aa, Mycobacterium avium
RPGFIGTVLILLVVAVGLA

SEQ ID NO: 26555 - protein, 20 aa, Mycobacterium avium
RPPIHLPLDDPYQAPEGYPI

SEQ ID NO: 26556 - protein, 25 aa, Mycobacterium avium
RPSARRLPFILARYPRTFAGIGRRI

SEQ ID NO: 26557 - protein, 20 aa, Mycobacterium avium
RPVPLLVISLTILVALSAAA

SEQ ID NO: 26558 - protein, 17 aa, Mycobacterium avium
RQLLAEYLLPLCPPPRA

SEQ ID NO: 26559 - protein, 34 aa, Mycobacterium avium
RREIRLLLANRLYFAFLALLPFVLAGLTLLIPGD

SEQ ID NO: 26560 - protein, 17 aa, Mycobacterium avium
RRMLPFVDRISGAVLVL

SEQ ID NO: 26561 - protein, 19 aa, Mycobacterium avium
RRPRPWLAIALAVTAAVAA

SEQ ID NO: 26562 - protein, 24 aa, Mycobacterium avium
RRQETWLMILFGVGFGLGVALTLS

SEQ ID NO: 26563 - protein, 17 aa, Mycobacterium avium
RRRLKLVRAIAAGILAA

SEQ ID NO: 26564 - protein, 23 aa, Mycobacterium avium
RRRYGWLALTTALLGWAVGEVIW

SEQ ID NO: 26565 - protein, 23 aa, Mycobacterium avium
RTRTYWLLPCLFWLSTTTQIFTS

SEQ ID NO: 26566 - protein, 29 aa, Mycobacterium avium
RTSRQFNWGWILALVVIVLALAAIAILGT

SEQ ID NO: 26567 - protein, 18 aa, Mycobacterium avium
RTVLARRIAAGTLVVLAA

SEQ ID NO: 26568 - protein, 18 aa, Mycobacterium avium
RVLPPFLSRKHLPSRLAR

SEQ ID NO: 26569 - protein, 19 aa, Mycobacterium avium
RVSLPLWVLLLSVPLSTVY

SEQ ID NO: 26570 - protein, 22 aa, Mycobacterium avium
RVVLNFWAYWCAPCAAELPAMA

SEQ ID NO: 26571 - protein, 17 aa, Mycobacterium avium
RVWWVVGTLIAVGVLAL

SEQ ID NO: 26572 - protein, 20 aa, Mycobacterium avium
RYLSVFLLLLVGVYLLVFLT

SEQ ID NO: 26573 - protein, 19 aa, Mycobacterium avium
SALPRWLWTRGSALVSAMW

SEQ ID NO: 26574 - protein, 32 aa, Mycobacterium avium
SDGLTPWIAAPLLFIGFMFGLLLLTGTTIREL

SEQ ID NO: 26575 - protein, 26 aa, Mycobacterium avium
SETLPMMLAPWVLLPTILALRATGPR

SEQ ID NO: 26576 - protein, 23 aa, Mycobacterium avium
SFGLSVLLWQYLLGLKLHWMVLA

SEQ ID NO: 26577 - protein, 20 aa, Mycobacterium avium
SFLCYWIIPFALLGLAAVVS

SEQ ID NO: 26578 - protein, 17 aa, Mycobacterium avium
SFLLRPGWVVLALVVVA

SEQ ID NO: 26579 - protein, 18 aa, Mycobacterium avium
SFNLNLNWPPPCTTGFLP

SEQ ID NO: 26580 - protein, 21 aa, Mycobacterium avium
SFPLQLPWLPLLAPLGALAIY

SEQ ID NO: 26581 - protein, 18 aa, Mycobacterium avium
SHFLPPVLRKLTIYLPQS

SEQ ID NO: 26582 - protein, 26 aa, Mycobacterium avium
SIGTLAAFLWSLYALVLGAADRPGMR

SEQ ID NO: 26583 - protein, 18 aa, Mycobacterium avium
SIPSWWQPYVLSVASLTP

SEQ ID NO: 26584 - protein, 30 aa, Mycobacterium avium
SLAGFQHAWFFLFLLAVLLVIGLYVVQQFA

SEQ ID NO: 26585 - protein, 24 aa, Mycobacterium avium
SLAWVPLLLLWFGIDETPKILMVA

SEQ ID NO: 26586 - protein, 17 aa, Mycobacterium avium
SLFPLLLLLTTGLGVIL

SEQ ID NO: 26587 - protein, 20 aa, Mycobacterium avium
SLHFLVLVYFLFFILVHVTM

SEQ ID NO: 26588 - protein, 20 aa, Mycobacterium avium
SLLSLQRPLRQLVPAAPFVA

SEQ ID NO: 26589 - protein, 17 aa, Mycobacterium avium
SLRPLILLPLVLPPVVG

SEQ ID NO: 26590 - protein, 18 aa, Mycobacterium avium
SLRPLILLPLVLPPVVGG

SEQ ID NO: 26591 - protein, 19 aa, Mycobacterium avium
SPFLLVAAVIFVPMLDLLL

SEQ ID NO: 26592 - protein, 20 aa, Mycobacterium avium
SPFLLVAAVIFVPMLDLLLA

SEQ ID NO: 26593 - protein, 24 aa, Mycobacterium avium
SPLARPVFLLRSYLIPLGALLVLL

SEQ ID NO: 26594 - protein, 25 aa, Mycobacterium avium
SPLARPVFLLRSYLIPLGALLVLLV

SEQ ID NO: 26595 - protein, 23 aa, Mycobacterium avium
SQPELLAPALLLAAAPFAAVGGF

SEQ ID NO: 26596 - protein, 24 aa, Mycobacterium avium
SQPELLAPALLLAAAPFAAVGGFA

SEQ ID NO: 26597 - protein, 17 aa, Mycobacterium avium
SRAFAHFFLDWAKSTSV

SEQ ID NO: 26598 - protein, 23 aa, Mycobacterium avium
SRGRYWWVRWVILGVVAIVLAVE

SEQ ID NO: 26599 - protein, 27 aa, Mycobacterium avium
SRQINWGWILALVVIVLALAAIAILGT

SEQ ID NO: 26600 - protein, 24 aa, Mycobacterium avium
SSLLRLLVLALIMVPITAAVMLRA

SEQ ID NO: 26601 - protein, 18 aa, Mycobacterium avium
STGFFPLMGIGAFSMLAF

SEQ ID NO: 26602 - protein, 19 aa, Mycobacterium avium
STLALLRRASLRQAVADGV

SEQ ID NO: 26603 - protein, 23 aa, Mycobacterium avium
SVLIWQYIFGIQLYWMVLPMSVI

SEQ ID NO: 26604 - protein, 30 aa, Mycobacterium avium
SVLSRLSVWLRPDWTRTVLARRIAAGTLVV

SEQ ID NO: 26605 - protein, 24 aa, Mycobacterium avium
SVQLLLTPLILAPFAAVLALVRPS

SEQ ID NO: 26606 - protein, 21 aa, Mycobacterium avium
SWAMPLAPWVFASATLGFVTI

SEQ ID NO: 26607 - protein, 27 aa, Mycobacterium avium
TAAGYLLWWAVLFPAISVPIIASLTLG

SEQ ID NO: 26608 - protein, 25 aa, Mycobacterium avium
TAKMWTFLFIYFWLRASLPRLRYDQ

SEQ ID NO: 26609 - protein, 17 aa, Mycobacterium avium
TALLPLALLLLAAAVAA

SEQ ID NO: 26610 - protein, 20 aa, Mycobacterium avium
TALWFWIALSGLAAAVFLVG

SEQ ID NO: 26611 - protein, 20 aa, Mycobacterium avium
TALWLWIALSGLAAAVFLVG

SEQ ID NO: 26612 - protein, 18 aa, Mycobacterium avium
TARDFVYLIDFGLARAQA

SEQ ID NO: 26613 - protein, 23 aa, Mycobacterium avium
TAVIWTVALTRPAKVHEAAVCNP

SEQ ID NO: 26614 - protein, 18 aa, Mycobacterium avium
TEVFFWAAPVALVGFVLA

SEQ ID NO: 26615 - protein, 37 aa, Mycobacterium avium
TGMAPFFLTLALFFGALVLWMVLRPLQYRAIAAEVIA

SEQ ID NO: 26616 - protein, 34 aa, Mycobacterium avium
TGPAAFLGFGWRIPFLLSIFLVAVGLFVRLRLTD

SEQ ID NO: 26617 - protein, 18 aa, Mycobacterium avium
TKPWLYNWQYQPLDAADA

SEQ ID NO: 26618 - protein, 27 aa, Mycobacterium avium
TLALVTRRWALAWIALAGTAIAGAAGM

SEQ ID NO: 26619 - protein, 28 aa, Mycobacterium avium
TLGLGSLLQWMFYVGLLITVADVLIALA

SEQ ID NO: 26620 - protein, 21 aa, Mycobacterium avium
TLLESFLFYSGFYLPMYWSSR

SEQ ID NO: 26621 - protein, 18 aa, Mycobacterium avium
TLLGRWFWWPMVVHPRGD

SEQ ID NO: 26622 - protein, 18 aa, Mycobacterium avium
TRRVFLDQLSWLVPSRWG

SEQ ID NO: 26623 - protein, 17 aa, Mycobacterium avium
TRRWALAWIALAGTAIA

SEQ ID NO: 26624 - protein, 22 aa, Mycobacterium avium
TSFPLQLPWLPLLAPLGALAIY

SEQ ID NO: 26625 - protein, 29 aa, Mycobacterium avium
TSRQINWGWILALVVIVLALAAIAILGTV

SEQ ID NO: 26626 - protein, 21 aa, Mycobacterium avium
TTSLFFIFGQFRNGPTHSYSA

SEQ ID NO: 26627 - protein, 26 aa, Mycobacterium avium
TTVLPLQVISWLLMPISRLLVVLGNA

SEQ ID NO: 26628 - protein, 22 aa, Mycobacterium avium
TVTYSLMTFWITTMLALLYGLL

SEQ ID NO: 26629 - protein, 25 aa, Mycobacterium avium
VADRAYFLFLAVLPFVMGALSLTVP

SEQ ID NO: 26630 - protein, 21 aa, Mycobacterium avium
VAFDQLWRWNSIVALVLSVLV

SEQ ID NO: 26631 - protein, 19 aa, Mycobacterium avium
VALIVLLLVVAALRGYLPA

SEQ ID NO: 26632 - protein, 17 aa, Mycobacterium avium
VALLIWRYGRIEERWAG

SEQ ID NO: 26633 - protein, 24 aa, Mycobacterium avium
VAVMGLLLVMRYRGRRRRAAALAA

SEQ ID NO: 26634 - protein, 27 aa, Mycobacterium avium
VAVVLLVRPLWLLLTQSLPRSLHTRLG

SEQ ID NO: 26635 - protein, 17 aa, Mycobacterium avium
VCALVLALVYLQFRGDF

SEQ ID NO: 26636 - protein, 23 aa, Mycobacterium avium
VDDKWLPKPARPAPPWPTAQREV

SEQ ID NO: 26637 - protein, 22 aa, Mycobacterium avium
VDNWVRRVLALPAFPGGSVDRP

SEQ ID NO: 26638 - protein, 19 aa, Mycobacterium avium
VDNWVRRVLALPAFPGGTV

SEQ ID NO: 26639 - protein, 20 aa, Mycobacterium avium
VDNWVRRVLALPAFPGGTVD

SEQ ID NO: 26640 - protein, 20 aa, Mycobacterium avium
VDWPHFWWLITSPSSRTALL

SEQ ID NO: 26641 - protein, 23 aa, Mycobacterium avium
VEDKWLPKPARPAPPWPTAQREV

SEQ ID NO: 26642 - protein, 28 aa, Mycobacterium avium
VEPPPPYPPPLPPPAYPPPYPPPYPPPP

SEQ ID NO: 26643 - protein, 24 aa, Mycobacterium avium
VFAVRAFLLMAFPHAFMAAADAAV

SEQ ID NO: 26644 - protein, 18 aa, Mycobacterium avium
VFLTALYGLSVLAGLRPG

SEQ ID NO: 26645 - protein, 19 aa, Mycobacterium avium
VFLTALYGLSVLAGLRPGE

SEQ ID NO: 26646 - protein, 18 aa, Mycobacterium avium
VFLTALYGLSVLSGLRPG

SEQ ID NO: 26647 - protein, 17 aa, Mycobacterium avium
VFYLRLPATFGIGTYGV

SEQ ID NO: 26648 - protein, 18 aa, Mycobacterium avium
VGDRYLELIIGPGSMRVL

SEQ ID NO: 26649 - protein, 17 aa, Mycobacterium avium
VGLFVFPNFANPIHFLC

SEQ ID NO: 26650 - protein, 23 aa, Mycobacterium avium
VGLLLLLGLPFFSVKWGFPDDRV

SEQ ID NO: 26651 - protein, 23 aa, Mycobacterium avium
VGPIFLVVYFTLGLGSLLQWMFY

SEQ ID NO: 26652 - protein, 17 aa, Mycobacterium avium
VGVFFWFAVVGGATVVM

SEQ ID NO: 26653 - protein, 23 aa, Mycobacterium avium
VIIVMLLWVYRSIVTVLITLMMV

SEQ ID NO: 26654 - protein, 19 aa, Mycobacterium avium
VIVRRAIRRLLLRGDSPET

SEQ ID NO: 26655 - protein, 17 aa, Mycobacterium avium
VLAALLTVGLSAGLLAP

SEQ ID NO: 26656 - protein, 21 aa, Mycobacterium avium
VLIMALLMLQLVSAGGMYPVE

SEQ ID NO: 26657 - protein, 20 aa, Mycobacterium avium
VLIVLFGWWGGLYFTTLLRR

SEQ ID NO: 26658 - protein, 27 aa, Mycobacterium avium
VLLVKKIWWPLAVWLLLVVVNVDAGNP

SEQ ID NO: 26659 - protein, 18 aa, Mycobacterium avium
VLPFAWQGVALHASGAAR

SEQ ID NO: 26660 - protein, 24 aa, Mycobacterium avium
VLVPAFIHLLGRWTWWAPRPMVWL

SEQ ID NO: 26661 - protein, 18 aa, Mycobacterium avium
VMLTFVARPYLIPSESME

SEQ ID NO: 26662 - protein, 17 aa, Mycobacterium avium
VNWIYPVSWHYAFDIIL

SEQ ID NO: 26663 - protein, 28 aa, Mycobacterium avium
VPAGLLILIFGFPWYWFSPRSSAPAPSV

SEQ ID NO: 26664 - protein, 18 aa, Mycobacterium avium
VPIIIGWIALIAVLNVVV

SEQ ID NO: 26665 - protein, 17 aa, Mycobacterium avium
VPRWLWIFLGVVGVTAA

SEQ ID NO: 26666 - protein, 17 aa, Mycobacterium avium
VPVVLLLAVATLAGWLA

SEQ ID NO: 26667 - protein, 26 aa, Mycobacterium avium
VQALLFPAFLLIVYKLLIGKAVLAVT

SEQ ID NO: 26668 - protein, 29 aa, Mycobacterium avium
VRWPWLVIGFWAALAVALPLAFPSLAEMA

SEQ ID NO: 26669 - protein, 30 aa, Mycobacterium avium
VSLAGFQHAWFFLALLAVLLVIGLYVVQQF

SEQ ID NO: 26670 - protein, 25 aa, Mycobacterium avium
VSLGIILLALLWYAGLPLRVFITSL

SEQ ID NO: 26671 - protein, 30 aa, Mycobacterium avium
VSVTGFQNPWFFLALLAVLLVIGLYVVQQF

SEQ ID NO: 26672 - protein, 17 aa, Mycobacterium avium
VTYSLMTFWITTMLALL

SEQ ID NO: 26673 - protein, 25 aa, Mycobacterium avium
VVAMAFMFFQYMQVPTLLGIGKLTV

SEQ ID NO: 26674 - protein, 23 aa, Mycobacterium avium
VVGSGIDIPLIKPALEAATTLPL

SEQ ID NO: 26675 - protein, 25 aa, Mycobacterium avium
VVRGLKMLMVTILLVVVGIGLALVL

SEQ ID NO: 26676 - protein, 23 aa, Mycobacterium avium
VVYEPLLKRLPPDTPMYGFERVE

SEQ ID NO: 26677 - protein, 19 aa, Mycobacterium avium
VWVGLAYPWCDLMLLALAA

SEQ ID NO: 26678 - protein, 19 aa, Mycobacterium avium
WAMPLAPWVFASATLGFVT

SEQ ID NO: 26679 - protein, 20 aa, Mycobacterium avium
WAMPLAPWVFASATLGFVTI

SEQ ID NO: 26680 - protein, 19 aa, Mycobacterium avium
WANLPAFLAANGPLLFFVA

SEQ ID NO: 26681 - protein, 20 aa, Mycobacterium avium
WGFFILLFLLLAPGLNRWFF

SEQ ID NO: 26682 - protein, 22 aa, Mycobacterium avium
WGLIVAWITVLVLIYQWARVVW

SEQ ID NO: 26683 - protein, 19 aa, Mycobacterium avium
WITQRLWWALLLTVGFWGL

SEQ ID NO: 26684 - protein, 18 aa, Mycobacterium avium
WLAAIAAVLVLCAAGIGA

SEQ ID NO: 26685 - protein, 19 aa, Mycobacterium avium
WLEVFLILVIGFSLPRTFG

SEQ ID NO: 26686 - protein, 20 aa, Mycobacterium avium
WLHAAVWWKALLALVVAVAM

SEQ ID NO: 26687 - protein, 19 aa, Mycobacterium avium
WLVAGLAAAGRWPLPALVP

SEQ ID NO: 26688 - protein, 24 aa, Mycobacterium avium
WLVIVGWLTLWPFFGWLTTHFVVT

SEQ ID NO: 26689 - protein, 18 aa, Mycobacterium avium
WQNLIGNAIKFRHKDRRP

SEQ ID NO: 26690 - protein, 19 aa, Mycobacterium avium
WRGVRWWRRGLAVLSIPLC

SEQ ID NO: 26691 - protein, 18 aa, Mycobacterium avium
WRIPFLLSIFLVAVGLFV

SEQ ID NO: 26692 - protein, 19 aa, Mycobacterium avium
WRIPFLLSIFLVAVGLFVR

SEQ ID NO: 26693 - protein, 27 aa, Mycobacterium avium
WSLSNWPVRWKVLAIVLVPLMLATVFG

SEQ ID NO: 26694 - protein, 26 aa, Mycobacterium avium
WSWTQQINWLWVRRAAYLCAAVLVLL

SEQ ID NO: 26695 - protein, 17 aa, Mycobacterium avium
YALLLLLAGFTGSIVVS

SEQ ID NO: 26696 - protein, 19 aa, Mycobacterium avium
YAMAFLFIALLLCLAVTLG

SEQ ID NO: 26697 - protein, 17 aa, Mycobacterium avium
YAYLAPWHLPATRWYTW

SEQ ID NO: 26698 - protein, 18 aa, Mycobacterium avium
YAYLLFWVRALQVLLLLY

SEQ ID NO: 26699 - protein, 17 aa, Mycobacterium avium
YFVLYRPDQRVGDAAAH

SEQ ID NO: 26700 - protein, 23 aa, Mycobacterium avium
YGALYLWAFWDPFGHTNKMPVAL

SEQ ID NO: 26701 - protein, 22 aa, Mycobacterium avium
YGDFYNFYLCDISIKVNGLQPG

SEQ ID NO: 26702 - protein, 18 aa, Mycobacterium avium
YLGLLWWMMVCWAQPVRN

SEQ ID NO: 26703 - protein, 17 aa, Mycobacterium avium
YPLLIMAMLPVLLGLDV

SEQ ID NO: 26704 - protein, 18 aa, Mycobacterium avium
YPPPAYPPPYPPPYPPPP

SEQ ID NO: 26705 - protein, 18 aa, Mycobacterium avium
YPRTGSVVIWYSPRRCDR

SEQ ID NO: 26706 - protein, 25 aa, Mycobacterium avium
YRERLWVPWWWWPPAFALAGIIAFE

SEQ ID NO: 26707 - protein, 21 aa, Mycobacterium avium
YSHNFYLWWLAKAGAVGMAAF

SEQ ID NO: 26708 - protein, 19 aa, Mycobacterium avium
YSLMTFWITTMLALLYGLL

SEQ ID NO: 26709 - protein, 23 aa, Mycobacterium avium
YYPFVYAGLLLLMRARLKRLPIA

SEQ ID NO: 26710 - protein, 7 aa, Mycobacterium avium
GDSEDGA

SEQ ID NO: 26711 - protein, 7 aa, Mycobacterium avium
GTSTRKV

SEQ ID NO: 26712 - protein, 6 aa, Mycobacterium avium
AADGRR

SEQ ID NO: 26713 - protein, 5 aa, Mycobacterium avium
IKRRT

SEQ ID NO: 26714 - protein, 7 aa, Mycobacterium avium
VPKGSAE

SEQ ID NO: 26715 - protein, 4 aa, Mycobacterium avium
SRGL

SEQ ID NO: 26716 - protein, 14 aa, Mycobacterium avium
DQSAETIAPTAALT

SEQ ID NO: 26717 - protein, 11 aa, Mycobacterium avium
TADAGERITQA

SEQ ID NO: 26718 - protein, 4 aa, Mycobacterium avium
YLSE

SEQ ID NO: 26719 - protein, 7 aa, Mycobacterium avium
DRPLGDQ

SEQ ID NO: 26720 - protein, 11 aa, Mycobacterium avium
GTDTGISKSEV

SEQ ID NO: 26721 - protein, 6 aa, Mycobacterium avium
PDAEHV

SEQ ID NO: 26722 - protein, 22 aa, Mycobacterium avium
SPHERTETRSNQRNGSRPRTLS

SEQ ID NO: 26723 - protein, 4 aa, Mycobacterium avium
LRAG

SEQ ID NO: 26724 - protein, 15 aa, Mycobacterium avium
AGSYRGEGKTDAKDA

SEQ ID NO: 26725 - protein, 13 aa, Mycobacterium avium
APVPRDSGRISGN

SEQ ID NO: 26726 - protein, 6 aa, Mycobacterium avium
EIGDTD

SEQ ID NO: 26727 - protein, 9 aa, Mycobacterium avium
KARNADTVA

SEQ ID NO: 26728 - protein, 6 aa, Mycobacterium avium
LADGGE

SEQ ID NO: 26729 - protein, 7 aa, Mycobacterium avium
LKRPRRY

SEQ ID NO: 26730 - protein, 6 aa, Mycobacterium avium
QAANAQ

SEQ ID NO: 26731 - protein, 13 aa, Mycobacterium avium
QTPDALRSAGGAR

SEQ ID NO: 26732 - protein, 21 aa, Mycobacterium avium
RTDPSSRTYYDRKRTEGKRHT

SEQ ID NO: 26733 - protein, 4 aa, Mycobacterium avium
TGGD

SEQ ID NO: 26734 - protein, 5 aa, Mycobacterium avium
VANDE

SEQ ID NO: 26735 - protein, 4 aa, Mycobacterium avium
YNKS

SEQ ID NO: 26736 - protein, 9 aa, Mycobacterium avium
AARGQGRSH

SEQ ID NO: 26737 - protein, 4 aa, Mycobacterium avium
PPAE

SEQ ID NO: 26738 - protein, 9 aa, Mycobacterium avium
REDRPGDKR

SEQ ID NO: 26739 - protein, 9 aa, Mycobacterium avium
SIGTVGDSF

SEQ ID NO: 26740 - protein, 4 aa, Mycobacterium avium
AAGA

SEQ ID NO: 26741 - protein, 10 aa, Mycobacterium avium
ADAGISKSEV

SEQ ID NO: 26742 - protein, 5 aa, Mycobacterium avium
ADEQV

SEQ ID NO: 26743 - protein, 5 aa, Mycobacterium avium
DAEHV

SEQ ID NO: 26744 - protein, 8 aa, Mycobacterium avium
GTTGVPKG

SEQ ID NO: 26745 - protein, 4 aa, Mycobacterium avium
TGLR

SEQ ID NO: 26746 - protein, 5 aa, Mycobacterium avium
TRGLS

SEQ ID NO: 26747 - protein, 5 aa, Mycobacterium avium
DEASN

SEQ ID NO: 26748 - protein, 6 aa, Mycobacterium avium
DLGPRV

SEQ ID NO: 26749 - protein, 9 aa, Mycobacterium avium
DRNQPRTNT

SEQ ID NO: 26750 - protein, 6 aa, Mycobacterium avium
EAARRV

SEQ ID NO: 26751 - protein, 13 aa, Mycobacterium avium
GLYRDEDRARRRS

SEQ ID NO: 26752 - protein, 9 aa, Mycobacterium avium
GNLGQHNGL

SEQ ID NO: 26753 - protein, 4 aa, Mycobacterium avium
RPGG

SEQ ID NO: 26754 - protein, 16 aa, Mycobacterium avium
RSDSADQSVAVPAAIT

SEQ ID NO: 26755 - protein, 9 aa, Mycobacterium avium
TDPDAPKHK

SEQ ID NO: 26756 - protein, 6 aa, Mycobacterium avium
TGEPLP

SEQ ID NO: 26757 - protein, 7 aa, Mycobacterium avium
GRRDPAL

SEQ ID NO: 26758 - protein, 4 aa, Mycobacterium avium
LPDD

SEQ ID NO: 26759 - protein, 4 aa, Mycobacterium avium
REHP

SEQ ID NO: 26760 - protein, 13 aa, Mycobacterium avium
RTRPYRPQTNGKV

SEQ ID NO: 26761 - protein, 9 aa, Mycobacterium avium
SGTTGVPKG

SEQ ID NO: 26762 - protein, 4 aa, Mycobacterium avium
AADP

SEQ ID NO: 26763 - protein, 4 aa, Mycobacterium avium
AAEL

SEQ ID NO: 26764 - protein, 4 aa, Mycobacterium avium
AGAG

SEQ ID NO: 26765 - protein, 4 aa, Mycobacterium avium
AGAP

SEQ ID NO: 26766 - protein, 5 aa, Mycobacterium avium
AGRAG

SEQ ID NO: 26767 - protein, 5 aa, Mycobacterium avium
DNGSC

SEQ ID NO: 26768 - protein, 4 aa, Mycobacterium avium
DRPD

SEQ ID NO: 26769 - protein, 4 aa, Mycobacterium avium
GDPA

SEQ ID NO: 26770 - protein, 4 aa, Mycobacterium avium
GEPV

SEQ ID NO: 26771 - protein, 6 aa, Mycobacterium avium
LASPGQ

SEQ ID NO: 26772 - protein, 5 aa, Mycobacterium avium
NPTRS

SEQ ID NO: 26773 - protein, 4 aa, Mycobacterium avium
RAGR

SEQ ID NO: 26774 - protein, 7 aa, Mycobacterium avium
RGCTAPG

SEQ ID NO: 26775 - protein, 9 aa, Mycobacterium avium
RRAGHDIGR

SEQ ID NO: 26776 - protein, 4 aa, Mycobacterium avium
RRTA

SEQ ID NO: 26777 - protein, 4 aa, Mycobacterium avium
SAGL

SEQ ID NO: 26778 - protein, 4 aa, Mycobacterium avium
TDEH

SEQ ID NO: 26779 - protein, 4 aa, Mycobacterium avium
VGAT

SEQ ID NO: 26780 - protein, 4 aa, Mycobacterium avium
VSGD

SEQ ID NO: 26781 - protein, 4 aa, Mycobacterium avium
AAAA

SEQ ID NO: 26782 - protein, 5 aa, Mycobacterium avium
AAPAG

SEQ ID NO: 26783 - protein, 5 aa, Mycobacterium avium
AAPTV

SEQ ID NO: 26784 - protein, 4 aa, Mycobacterium avium
ADPA

SEQ ID NO: 26785 - protein, 14 aa, Mycobacterium avium
ANKTRTPSARAQRD

SEQ ID NO: 26786 - protein, 4 aa, Mycobacterium avium
APDA

SEQ ID NO: 26787 - protein, 4 aa, Mycobacterium avium
APGP

SEQ ID NO: 26788 - protein, 6 aa, Mycobacterium avium
APSTYY

SEQ ID NO: 26789 - protein, 6 aa, Mycobacterium avium
ARHRRD

SEQ ID NO: 26790 - protein, 4 aa, Mycobacterium avium
DDDG

SEQ ID NO: 26791 - protein, 4 aa, Mycobacterium avium
EPAL

SEQ ID NO: 26792 - protein, 19 aa, Mycobacterium avium
GLAPGVTTSESKKVKELEQ

SEQ ID NO: 26793 - protein, 5 aa, Mycobacterium avium
GTEHG

SEQ ID NO: 26794 - protein, 8 aa, Mycobacterium avium
GTEQGTVQ

SEQ ID NO: 26795 - protein, 22 aa, Mycobacterium avium
GVRRGKRVRTTKPGPGAPRHPD

SEQ ID NO: 26796 - protein, 5 aa, Mycobacterium avium
HEGAG

SEQ ID NO: 26797 - protein, 29 aa, Mycobacterium avium
IDDGYAPGVSTAESKRIKDLEQENRELKR

SEQ ID NO: 26798 - protein, 6 aa, Mycobacterium avium
IPNEQA

SEQ ID NO: 26799 - protein, 14 aa, Mycobacterium avium
ITPPEPAESAETEV

SEQ ID NO: 26800 - protein, 8 aa, Mycobacterium avium
KIEGPSRA

SEQ ID NO: 26801 - protein, 4 aa, Mycobacterium avium
KSTH

SEQ ID NO: 26802 - protein, 5 aa, Mycobacterium avium
LAAAA

SEQ ID NO: 26803 - protein, 5 aa, Mycobacterium avium
LASPA

SEQ ID NO: 26804 - protein, 13 aa, Mycobacterium avium
NADAADRIKQAAE

SEQ ID NO: 26805 - protein, 8 aa, Mycobacterium avium
PARPGPWK

SEQ ID NO: 26806 - protein, 4 aa, Mycobacterium avium
PESA

SEQ ID NO: 26807 - protein, 7 aa, Mycobacterium avium
PGEAGTA

SEQ ID NO: 26808 - protein, 10 aa, Mycobacterium avium
PGEIRSAKRA

SEQ ID NO: 26809 - protein, 5 aa, Mycobacterium avium
PKRYN

SEQ ID NO: 26810 - protein, 5 aa, Mycobacterium avium
RAWPN

SEQ ID NO: 26811 - protein, 4 aa, Mycobacterium avium
RDPE

SEQ ID NO: 26812 - protein, 12 aa, Mycobacterium avium
RGEGKTDAKDAR

SEQ ID NO: 26813 - protein, 8 aa, Mycobacterium avium
RKRSENHI

SEQ ID NO: 26814 - protein, 12 aa, Mycobacterium avium
RTWQPQQPTVAA

SEQ ID NO: 26815 - protein, 6 aa, Mycobacterium avium
SAVRDG

SEQ ID NO: 26816 - protein, 8 aa, Mycobacterium avium
SDAGSQFT

SEQ ID NO: 26817 - protein, 6 aa, Mycobacterium avium
TASAPN

SEQ ID NO: 26818 - protein, 5 aa, Mycobacterium avium
TNPGR

SEQ ID NO: 26819 - protein, 6 aa, Mycobacterium avium
TNPIES

SEQ ID NO: 26820 - protein, 5 aa, Mycobacterium avium
TSPPA

SEQ ID NO: 26821 - protein, 10 aa, Mycobacterium avium
VPRDSGRITG

SEQ ID NO: 26822 - protein, 11 aa, Mycobacterium avium
VTKGPGSRAAG

SEQ ID NO: 26823 - protein, 6 aa, Mycobacterium avium
YGPTET

SEQ ID NO: 26824 - protein, 4 aa, Mycobacterium avium
AAEA

SEQ ID NO: 26825 - protein, 8 aa, Mycobacterium avium
AGEVDENG

SEQ ID NO: 26826 - protein, 23 aa, Mycobacterium avium
AGPHERSASRTNQRNGSRPRTLS

SEQ ID NO: 26827 - protein, 4 aa, Mycobacterium avium
AGPR

SEQ ID NO: 26828 - protein, 12 aa, Mycobacterium avium
AKAFGERDLSGT

SEQ ID NO: 26829 - protein, 6 aa, Mycobacterium avium
AKYPKA

SEQ ID NO: 26830 - protein, 4 aa, Mycobacterium avium
ANRT

SEQ ID NO: 26831 - protein, 4 aa, Mycobacterium avium
ATGD

SEQ ID NO: 26832 - protein, 4 aa, Mycobacterium avium
DDDA

SEQ ID NO: 26833 - protein, 4 aa, Mycobacterium avium
DGRP

SEQ ID NO: 26834 - protein, 13 aa, Mycobacterium avium
DKRIDADTAERRR

SEQ ID NO: 26835 - protein, 4 aa, Mycobacterium avium
DPAA

SEQ ID NO: 26836 - protein, 4 aa, Mycobacterium avium
EAQD

SEQ ID NO: 26837 - protein, 4 aa, Mycobacterium avium
EEQH

SEQ ID NO: 26838 - protein, 4 aa, Mycobacterium avium
GGES

SEQ ID NO: 26839 - protein, 5 aa, Mycobacterium avium
GGLAG

SEQ ID NO: 26840 - protein, 7 aa, Mycobacterium avium
GGVDSPE

SEQ ID NO: 26841 - protein, 5 aa, Mycobacterium avium
GISGT

SEQ ID NO: 26842 - protein, 9 aa, Mycobacterium avium
GYRESTESW

SEQ ID NO: 26843 - protein, 4 aa, Mycobacterium avium
IDPD

SEQ ID NO: 26844 - protein, 7 aa, Mycobacterium avium
KSAHPGA

SEQ ID NO: 26845 - protein, 5 aa, Mycobacterium avium
KSPQM

SEQ ID NO: 26846 - protein, 4 aa, Mycobacterium avium
LPPG

SEQ ID NO: 26847 - protein, 7 aa, Mycobacterium avium
LSAPGSR

SEQ ID NO: 26848 - protein, 12 aa, Mycobacterium avium
LVGSPGQGAYAA

SEQ ID NO: 26849 - protein, 8 aa, Mycobacterium avium
NEDACGSR

SEQ ID NO: 26850 - protein, 8 aa, Mycobacterium avium
NQHADGMS

SEQ ID NO: 26851 - protein, 4 aa, Mycobacterium avium
PERA

SEQ ID NO: 26852 - protein, 4 aa, Mycobacterium avium
PGAP

SEQ ID NO: 26853 - protein, 4 aa, Mycobacterium avium
PGEL

SEQ ID NO: 26854 - protein, 6 aa, Mycobacterium avium
PTDRPY

SEQ ID NO: 26855 - protein, 6 aa, Mycobacterium avium
RAVRDG

SEQ ID NO: 26856 - protein, 4 aa, Mycobacterium avium
RPEQ

SEQ ID NO: 26857 - protein, 6 aa, Mycobacterium avium
RPVPPG

SEQ ID NO: 26858 - protein, 6 aa, Mycobacterium avium
SDGRKE

SEQ ID NO: 26859 - protein, 9 aa, Mycobacterium avium
SGAGLSATT

SEQ ID NO: 26860 - protein, 6 aa, Mycobacterium avium
SVGATA

SEQ ID NO: 26861 - protein, 4 aa, Mycobacterium avium
TACS

SEQ ID NO: 26862 - protein, 4 aa, Mycobacterium avium
TGFT

SEQ ID NO: 26863 - protein, 11 aa, Mycobacterium avium
THKNAKGETEW

SEQ ID NO: 26864 - protein, 4 aa, Mycobacterium avium
TPAA

SEQ ID NO: 26865 - protein, 4 aa, Mycobacterium avium
TREQ

SEQ ID NO: 26866 - protein, 6 aa, Mycobacterium avium
TSDFGP

SEQ ID NO: 26867 - protein, 5 aa, Mycobacterium avium
VPPPV

SEQ ID NO: 26868 - protein, 4 aa, Mycobacterium avium
AAAG

SEQ ID NO: 26869 - protein, 4 aa, Mycobacterium avium
AAAL

SEQ ID NO: 26870 - protein, 4 aa, Mycobacterium avium
AAAP

SEQ ID NO: 26871 - protein, 6 aa, Mycobacterium avium
AAAPGA

SEQ ID NO: 26872 - protein, 4 aa, Mycobacterium avium
AAGR

SEQ ID NO: 26873 - protein, 6 aa, Mycobacterium avium
AALGGG

SEQ ID NO: 26874 - protein, 8 aa, Mycobacterium avium
AARGQGRA

SEQ ID NO: 26875 - protein, 4 aa, Mycobacterium avium
ADAG

SEQ ID NO: 26876 - protein, 4 aa, Mycobacterium avium
ADEI

SEQ ID NO: 26877 - protein, 7 aa, Mycobacterium avium
ADLSGEE

SEQ ID NO: 26878 - protein, 5 aa, Mycobacterium avium
ADPME

SEQ ID NO: 26879 - protein, 6 aa, Mycobacterium avium
ADTRHA

SEQ ID NO: 26880 - protein, 7 aa, Mycobacterium avium
AEQAEAA

SEQ ID NO: 26881 - protein, 4 aa, Mycobacterium avium
AGAA

SEQ ID NO: 26882 - protein, 4 aa, Mycobacterium avium
AGDG

SEQ ID NO: 26883 - protein, 4 aa, Mycobacterium avium
AGGE

SEQ ID NO: 26884 - protein, 5 aa, Mycobacterium avium
AGHTG

SEQ ID NO: 26885 - protein, 4 aa, Mycobacterium avium
AGPA

SEQ ID NO: 26886 - protein, 4 aa, Mycobacterium avium
AGRA

SEQ ID NO: 26887 - protein, 4 aa, Mycobacterium avium
AGRS

SEQ ID NO: 26888 - protein, 15 aa, Mycobacterium avium
AGWSGQAQATSYDTM

SEQ ID NO: 26889 - protein, 4 aa, Mycobacterium avium
AKAG

SEQ ID NO: 26890 - protein, 4 aa, Mycobacterium avium
ALAD

SEQ ID NO: 26891 - protein, 4 aa, Mycobacterium avium
APAD

SEQ ID NO: 26892 - protein, 4 aa, Mycobacterium avium
APAE

SEQ ID NO: 26893 - protein, 4 aa, Mycobacterium avium
APAI

SEQ ID NO: 26894 - protein, 4 aa, Mycobacterium avium
AQRR

SEQ ID NO: 26895 - protein, 4 aa, Mycobacterium avium
ARQQ

SEQ ID NO: 26896 - protein, 4 aa, Mycobacterium avium
ARRG

SEQ ID NO: 26897 - protein, 4 aa, Mycobacterium avium
ARVP

SEQ ID NO: 26898 - protein, 4 aa, Mycobacterium avium
ASGR

SEQ ID NO: 26899 - protein, 4 aa, Mycobacterium avium
ASGV

SEQ ID NO: 26900 - protein, 5 aa, Mycobacterium avium
ASLEA

SEQ ID NO: 26901 - protein, 5 aa, Mycobacterium avium
ASPGY

SEQ ID NO: 26902 - protein, 4 aa, Mycobacterium avium
ASRG

SEQ ID NO: 26903 - protein, 7 aa, Mycobacterium avium
ASRGKWD

SEQ ID NO: 26904 - protein, 4 aa, Mycobacterium avium
ATAA

SEQ ID NO: 26905 - protein, 5 aa, Mycobacterium avium
ATGEV

SEQ ID NO: 26906 - protein, 4 aa, Mycobacterium avium
ATRH

SEQ ID NO: 26907 - protein, 4 aa, Mycobacterium avium
ATRQ

SEQ ID NO: 26908 - protein, 8 aa, Mycobacterium avium
AVDSGVEQ

SEQ ID NO: 26909 - protein, 5 aa, Mycobacterium avium
CGRTD

SEQ ID NO: 26910 - protein, 7 aa, Mycobacterium avium
DAGSQFT

SEQ ID NO: 26911 - protein, 4 aa, Mycobacterium avium
DEGA

SEQ ID NO: 26912 - protein, 4 aa, Mycobacterium avium
DEIS

SEQ ID NO: 26913 - protein, 4 aa, Mycobacterium avium
DELG

SEQ ID NO: 26914 - protein, 7 aa, Mycobacterium avium
DERKETA

SEQ ID NO: 26915 - protein, 4 aa, Mycobacterium avium
DETA

SEQ ID NO: 26916 - protein, 4 aa, Mycobacterium avium
DGGA

SEQ ID NO: 26917 - protein, 8 aa, Mycobacterium avium
DGQPRTLD

SEQ ID NO: 26918 - protein, 8 aa, Mycobacterium avium
DGTGGYRS

SEQ ID NO: 26919 - protein, 4 aa, Mycobacterium avium
DNPD

SEQ ID NO: 26920 - protein, 4 aa, Mycobacterium avium
DPAE

SEQ ID NO: 26921 - protein, 5 aa, Mycobacterium avium
DPARS

SEQ ID NO: 26922 - protein, 4 aa, Mycobacterium avium
DPDA

SEQ ID NO: 26923 - protein, 5 aa, Mycobacterium avium
DPTAY

SEQ ID NO: 26924 - protein, 4 aa, Mycobacterium avium
DRVD

SEQ ID NO: 26925 - protein, 14 aa, Mycobacterium avium
DVEPVEGSDGTDGH

SEQ ID NO: 26926 - protein, 4 aa, Mycobacterium avium
EAEN

SEQ ID NO: 26927 - protein, 4 aa, Mycobacterium avium
EAER

SEQ ID NO: 26928 - protein, 6 aa, Mycobacterium avium
EANREQ

SEQ ID NO: 26929 - protein, 7 aa, Mycobacterium avium
ELAPRAA

SEQ ID NO: 26930 - protein, 5 aa, Mycobacterium avium
EPAGA

SEQ ID NO: 26931 - protein, 4 aa, Mycobacterium avium
EPAT

SEQ ID NO: 26932 - protein, 5 aa, Mycobacterium avium
EPDTG

SEQ ID NO: 26933 - protein, 5 aa, Mycobacterium avium
EPGGR

SEQ ID NO: 26934 - protein, 4 aa, Mycobacterium avium
ERSS

SEQ ID NO: 26935 - protein, 4 aa, Mycobacterium avium
ETGA

SEQ ID NO: 26936 - protein, 8 aa, Mycobacterium avium
ETTYRSSG

SEQ ID NO: 26937 - protein, 5 aa, Mycobacterium avium
FDPRR

SEQ ID NO: 26938 - protein, 6 aa, Mycobacterium avium
FDTTTA

SEQ ID NO: 26939 - protein, 4 aa, Mycobacterium avium
FGAA

SEQ ID NO: 26940 - protein, 4 aa, Mycobacterium avium
GAAA

SEQ ID NO: 26941 - protein, 5 aa, Mycobacterium avium
GAAGV

SEQ ID NO: 26942 - protein, 4 aa, Mycobacterium avium
GAEG

SEQ ID NO: 26943 - protein, 4 aa, Mycobacterium avium
GATI

SEQ ID NO: 26944 - protein, 6 aa, Mycobacterium avium
GDGVGG

SEQ ID NO: 26945 - protein, 4 aa, Mycobacterium avium
GDID

SEQ ID NO: 26946 - protein, 11 aa, Mycobacterium avium
GEHTPGAGPGR

SEQ ID NO: 26947 - protein, 4 aa, Mycobacterium avium
GEIE

SEQ ID NO: 26948 - protein, 4 aa, Mycobacterium avium
GERR

SEQ ID NO: 26949 - protein, 5 aa, Mycobacterium avium
GEVGP

SEQ ID NO: 26950 - protein, 4 aa, Mycobacterium avium
GGPD

SEQ ID NO: 26951 - protein, 4 aa, Mycobacterium avium
GIGS

SEQ ID NO: 26952 - protein, 8 aa, Mycobacterium avium
GKIPAGGG

SEQ ID NO: 26953 - protein, 7 aa, Mycobacterium avium
GLTPEGE

SEQ ID NO: 26954 - protein, 4 aa, Mycobacterium avium
GPAR

SEQ ID NO: 26955 - protein, 8 aa, Mycobacterium avium
GPSGCGKT

SEQ ID NO: 26956 - protein, 5 aa, Mycobacterium avium
GPSPV

SEQ ID NO: 26957 - protein, 7 aa, Mycobacterium avium
GPTETTV

SEQ ID NO: 26958 - protein, 4 aa, Mycobacterium avium
GQSE

SEQ ID NO: 26959 - protein, 4 aa, Mycobacterium avium
GRAE

SEQ ID NO: 26960 - protein, 4 aa, Mycobacterium avium
GRAP

SEQ ID NO: 26961 - protein, 4 aa, Mycobacterium avium
GRPV

SEQ ID NO: 26962 - protein, 4 aa, Mycobacterium avium
GTPE

SEQ ID NO: 26963 - protein, 5 aa, Mycobacterium avium
GTPED

SEQ ID NO: 26964 - protein, 4 aa, Mycobacterium avium
GTYT

SEQ ID NO: 26965 - protein, 4 aa, Mycobacterium avium
GVAA

SEQ ID NO: 26966 - protein, 4 aa, Mycobacterium avium
GVPE

SEQ ID NO: 26967 - protein, 11 aa, Mycobacterium avium
HARTQTHPSYP

SEQ ID NO: 26968 - protein, 11 aa, Mycobacterium avium
HDYDDPGKPAI

SEQ ID NO: 26969 - protein, 4 aa, Mycobacterium avium
HRPG

SEQ ID NO: 26970 - protein, 6 aa, Mycobacterium avium
HRRQDG

SEQ ID NO: 26971 - protein, 39 aa, Mycobacterium avium
HSRQPQGPLPRNRQKQPLAAPPRRSTEPTSAAHHGPDPH

SEQ ID NO: 26972 - protein, 8 aa, Mycobacterium avium
IGGGTTEM

SEQ ID NO: 26973 - protein, 6 aa, Mycobacterium avium
KAARDR

SEQ ID NO: 26974 - protein, 9 aa, Mycobacterium avium
KASGADNHE

SEQ ID NO: 26975 - protein, 5 aa, Mycobacterium avium
KKPGI

SEQ ID NO: 26976 - protein, 4 aa, Mycobacterium avium
KPLA

SEQ ID NO: 26977 - protein, 5 aa, Mycobacterium avium
LAGAP

SEQ ID NO: 26978 - protein, 5 aa, Mycobacterium avium
LAGTT

SEQ ID NO: 26979 - protein, 5 aa, Mycobacterium avium
LAPNS

SEQ ID NO: 26980 - protein, 4 aa, Mycobacterium avium
LDES

SEQ ID NO: 26981 - protein, 4 aa, Mycobacterium avium
LDPA

SEQ ID NO: 26982 - protein, 4 aa, Mycobacterium avium
LGGK

SEQ ID NO: 26983 - protein, 4 aa, Mycobacterium avium
LGPR

SEQ ID NO: 26984 - protein, 17 aa, Mycobacterium avium
LGRSEAANRRRQYVNVV

SEQ ID NO: 26985 - protein, 4 aa, Mycobacterium avium
LPAG

SEQ ID NO: 26986 - protein, 4 aa, Mycobacterium avium
LPGP

SEQ ID NO: 26987 - protein, 4 aa, Mycobacterium avium
LPGW

SEQ ID NO: 26988 - protein, 4 aa, Mycobacterium avium
LPRP

SEQ ID NO: 26989 - protein, 7 aa, Mycobacterium avium
LSSEERE

SEQ ID NO: 26990 - protein, 5 aa, Mycobacterium avium
LSTNP

SEQ ID NO: 26991 - protein, 25 aa, Mycobacterium avium
NAHGQKVQTAGSNMASTDSAVGSSW

SEQ ID NO: 26992 - protein, 5 aa, Mycobacterium avium
NATEA

SEQ ID NO: 26993 - protein, 9 aa, Mycobacterium avium
NGEPIGASG

SEQ ID NO: 26994 - protein, 4 aa, Mycobacterium avium
NGQL

SEQ ID NO: 26995 - protein, 4 aa, Mycobacterium avium
NLPS

SEQ ID NO: 26996 - protein, 15 aa, Mycobacterium avium
NNYEQQEQASQQILS

SEQ ID NO: 26997 - protein, 4 aa, Mycobacterium avium
NSGA

SEQ ID NO: 26998 - protein, 7 aa, Mycobacterium avium
NTPVSAT

SEQ ID NO: 26999 - protein, 4 aa, Mycobacterium avium
PAAV

SEQ ID NO: 27000 - protein, 5 aa, Mycobacterium avium
PAEAA

SEQ ID NO: 27001 - protein, 4 aa, Mycobacterium avium
PAGP

SEQ ID NO: 27002 - protein, 4 aa, Mycobacterium avium
PASG

SEQ ID NO: 27003 - protein, 4 aa, Mycobacterium avium
PDAG

SEQ ID NO: 27004 - protein, 4 aa, Mycobacterium avium
PDAT

SEQ ID NO: 27005 - protein, 4 aa, Mycobacterium avium
PDDI

SEQ ID NO: 27006 - protein, 4 aa, Mycobacterium avium
PDEP

SEQ ID NO: 27007 - protein, 4 aa, Mycobacterium avium
PDGT

SEQ ID NO: 27008 - protein, 4 aa, Mycobacterium avium
PDHP

SEQ ID NO: 27009 - protein, 10 aa, Mycobacterium avium
PEGAGPGTKG

SEQ ID NO: 27010 - protein, 6 aa, Mycobacterium avium
PEHGPG

SEQ ID NO: 27011 - protein, 7 aa, Mycobacterium avium
PEHPYPA

SEQ ID NO: 27012 - protein, 8 aa, Mycobacterium avium
PELGGQGF

SEQ ID NO: 27013 - protein, 4 aa, Mycobacterium avium
PELP

SEQ ID NO: 27014 - protein, 5 aa, Mycobacterium avium
PGAVT

SEQ ID NO: 27015 - protein, 7 aa, Mycobacterium avium
PGGETTD

SEQ ID NO: 27016 - protein, 4 aa, Mycobacterium avium
PGGV

SEQ ID NO: 27017 - protein, 4 aa, Mycobacterium avium
PGLG

SEQ ID NO: 27018 - protein, 4 aa, Mycobacterium avium
PGLT

SEQ ID NO: 27019 - protein, 5 aa, Mycobacterium avium
PLPDG

SEQ ID NO: 27020 - protein, 5 aa, Mycobacterium avium
PPEAQ

SEQ ID NO: 27021 - protein, 6 aa, Mycobacterium avium
PPEAQD

SEQ ID NO: 27022 - protein, 5 aa, Mycobacterium avium
PPGCG

SEQ ID NO: 27023 - protein, 5 aa, Mycobacterium avium
PQEDR

SEQ ID NO: 27024 - protein, 4 aa, Mycobacterium avium
PQHT

SEQ ID NO: 27025 - protein, 5 aa, Mycobacterium avium
PRLPD

SEQ ID NO: 27026 - protein, 4 aa, Mycobacterium avium
PTGV

SEQ ID NO: 27027 - protein, 4 aa, Mycobacterium avium
PTLR

SEQ ID NO: 27028 - protein, 4 aa, Mycobacterium avium
PTTV

SEQ ID NO: 27029 - protein, 4 aa, Mycobacterium avium
PTVT

SEQ ID NO: 27030 - protein, 4 aa, Mycobacterium avium
PVTG

SEQ ID NO: 27031 - protein, 4 aa, Mycobacterium avium
QEGA

SEQ ID NO: 27032 - protein, 4 aa, Mycobacterium avium
QLPD

SEQ ID NO: 27033 - protein, 4 aa, Mycobacterium avium
QSRL

SEQ ID NO: 27034 - protein, 12 aa, Mycobacterium avium
RAAETESENPLI

SEQ ID NO: 27035 - protein, 4 aa, Mycobacterium avium
RAGE

SEQ ID NO: 27036 - protein, 4 aa, Mycobacterium avium
RAPA

SEQ ID NO: 27037 - protein, 4 aa, Mycobacterium avium
RDER

SEQ ID NO: 27038 - protein, 4 aa, Mycobacterium avium
RDSA

SEQ ID NO: 27039 - protein, 5 aa, Mycobacterium avium
REPEL

SEQ ID NO: 27040 - protein, 4 aa, Mycobacterium avium
RERL

SEQ ID NO: 27041 - protein, 5 aa, Mycobacterium avium
REVPG

SEQ ID NO: 27042 - protein, 4 aa, Mycobacterium avium
RGFQ

SEQ ID NO: 27043 - protein, 7 aa, Mycobacterium avium
RGSDGRV

SEQ ID NO: 27044 - protein, 12 aa, Mycobacterium avium
RIPPTPAHGGTL

SEQ ID NO: 27045 - protein, 5 aa, Mycobacterium avium
RPGET

SEQ ID NO: 27046 - protein, 4 aa, Mycobacterium avium
RPGT

SEQ ID NO: 27047 - protein, 29 aa, Mycobacterium avium
RPHTKALPQPPTAATLNNGGAISFLSTHR

SEQ ID NO: 27048 - protein, 8 aa, Mycobacterium avium
RPLPFSGR

SEQ ID NO: 27049 - protein, 4 aa, Mycobacterium avium
RPRR

SEQ ID NO: 27050 - protein, 4 aa, Mycobacterium avium
RRGI

SEQ ID NO: 27051 - protein, 4 aa, Mycobacterium avium
RRRR

SEQ ID NO: 27052 - protein, 4 aa, Mycobacterium avium
RSPF

SEQ ID NO: 27053 - protein, 4 aa, Mycobacterium avium
RSPG

SEQ ID NO: 27054 - protein, 4 aa, Mycobacterium avium
RSRY

SEQ ID NO: 27055 - protein, 4 aa, Mycobacterium avium
RTDA

SEQ ID NO: 27056 - protein, 4 aa, Mycobacterium avium
RVDP

SEQ ID NO: 27057 - protein, 22 aa, Mycobacterium avium
SAGTLGRPRCDGNKSANISSGN

SEQ ID NO: 27058 - protein, 6 aa, Mycobacterium avium
SASSDV

SEQ ID NO: 27059 - protein, 5 aa, Mycobacterium avium
SDAER

SEQ ID NO: 27060 - protein, 4 aa, Mycobacterium avium
SDGR

SEQ ID NO: 27061 - protein, 4 aa, Mycobacterium avium
SETS

SEQ ID NO: 27062 - protein, 4 aa, Mycobacterium avium
SGAT

SEQ ID NO: 27063 - protein, 5 aa, Mycobacterium avium
SGESY

SEQ ID NO: 27064 - protein, 4 aa, Mycobacterium avium
SGGV

SEQ ID NO: 27065 - protein, 4 aa, Mycobacterium avium
SGLP

SEQ ID NO: 27066 - protein, 4 aa, Mycobacterium avium
SGPI

SEQ ID NO: 27067 - protein, 15 aa, Mycobacterium avium
SKVTASTVSLSEKPC

SEQ ID NO: 27068 - protein, 5 aa, Mycobacterium avium
SNREI

SEQ ID NO: 27069 - protein, 9 aa, Mycobacterium avium
SRRGPRPRL

SEQ ID NO: 27070 - protein, 4 aa, Mycobacterium avium
TAEP

SEQ ID NO: 27071 - protein, 4 aa, Mycobacterium avium
TAFP

SEQ ID NO: 27072 - protein, 5 aa, Mycobacterium avium
TAHPD

SEQ ID NO: 27073 - protein, 19 aa, Mycobacterium avium
TALGGQPPATRVPNLSGQY

SEQ ID NO: 27074 - protein, 5 aa, Mycobacterium avium
TDEQK

SEQ ID NO: 27075 - protein, 4 aa, Mycobacterium avium
TDPH

SEQ ID NO: 27076 - protein, 11 aa, Mycobacterium avium
TEPEGGSDVAT

SEQ ID NO: 27077 - protein, 6 aa, Mycobacterium avium
TGEPSY

SEQ ID NO: 27078 - protein, 5 aa, Mycobacterium avium
TPDQL

SEQ ID NO: 27079 - protein, 5 aa, Mycobacterium avium
TPTYA

SEQ ID NO: 27080 - protein, 6 aa, Mycobacterium avium
TSGAHD

SEQ ID NO: 27081 - protein, 4 aa, Mycobacterium avium
TTPG

SEQ ID NO: 27082 - protein, 6 aa, Mycobacterium avium
TVEDEA

SEQ ID NO: 27083 - protein, 6 aa, Mycobacterium avium
TVPPPV

SEQ ID NO: 27084 - protein, 6 aa, Mycobacterium avium
VDGDRT

SEQ ID NO: 27085 - protein, 21 aa, Mycobacterium avium
VGNRNAQADKTSGERSKHRHP

SEQ ID NO: 27086 - protein, 4 aa, Mycobacterium avium
VPAD

SEQ ID NO: 27087 - protein, 4 aa, Mycobacterium avium
VPPG

SEQ ID NO: 27088 - protein, 5 aa, Mycobacterium avium
VRGGD

SEQ ID NO: 27089 - protein, 4 aa, Mycobacterium avium
VRGR

SEQ ID NO: 27090 - protein, 4 aa, Mycobacterium avium
VRPG

SEQ ID NO: 27091 - protein, 10 aa, Mycobacterium avium
WTRNADPSQW

SEQ ID NO: 27092 - protein, 4 aa, Mycobacterium avium
YSQG

SEQ ID NO: 27093 - protein, 4 aa, Mycobacterium avium
AAEG

SEQ ID NO: 27094 - protein, 4 aa, Mycobacterium avium
AAER

SEQ ID NO: 27095 - protein, 6 aa, Mycobacterium avium
AAGGLG

SEQ ID NO: 27096 - protein, 4 aa, Mycobacterium avium
AAGV

SEQ ID NO: 27097 - protein, 5 aa, Mycobacterium avium
AAGVD

SEQ ID NO: 27098 - protein, 5 aa, Mycobacterium avium
AAPAA

SEQ ID NO: 27099 - protein, 4 aa, Mycobacterium avium
AAPN

SEQ ID NO: 27100 - protein, 5 aa, Mycobacterium avium
ADDPV

SEQ ID NO: 27101 - protein, 4 aa, Mycobacterium avium
ADPD

SEQ ID NO: 27102 - protein, 5 aa, Mycobacterium avium
ADQLG

SEQ ID NO: 27103 - protein, 7 aa, Mycobacterium avium
AEADPRV

SEQ ID NO: 27104 - protein, 5 aa, Mycobacterium avium
AEAPG

SEQ ID NO: 27105 - protein, 5 aa, Mycobacterium avium
AEGAP

SEQ ID NO: 27106 - protein, 4 aa, Mycobacterium avium
AEGV

SEQ ID NO: 27107 - protein, 6 aa, Mycobacterium avium
AGNGGS

SEQ ID NO: 27108 - protein, 4 aa, Mycobacterium avium
AGRT

SEQ ID NO: 27109 - protein, 5 aa, Mycobacterium avium
AHGEQ

SEQ ID NO: 27110 - protein, 4 aa, Mycobacterium avium
ALPA

SEQ ID NO: 27111 - protein, 4 aa, Mycobacterium avium
ANPR

SEQ ID NO: 27112 - protein, 4 aa, Mycobacterium avium
APGA

SEQ ID NO: 27113 - protein, 4 aa, Mycobacterium avium
APGE

SEQ ID NO: 27114 - protein, 4 aa, Mycobacterium avium
APLR

SEQ ID NO: 27115 - protein, 4 aa, Mycobacterium avium
APPE

SEQ ID NO: 27116 - protein, 4 aa, Mycobacterium avium
AQRE

SEQ ID NO: 27117 - protein, 7 aa, Mycobacterium avium
AQTEHPG

SEQ ID NO: 27118 - protein, 10 aa, Mycobacterium avium
ARDASNTANR

SEQ ID NO: 27119 - protein, 5 aa, Mycobacterium avium
ARPPV

SEQ ID NO: 27120 - protein, 4 aa, Mycobacterium avium
ARRS

SEQ ID NO: 27121 - protein, 5 aa, Mycobacterium avium
ARTPA

SEQ ID NO: 27122 - protein, 7 aa, Mycobacterium avium
ATGARSL

SEQ ID NO: 27123 - protein, 4 aa, Mycobacterium avium
ATPA

SEQ ID NO: 27124 - protein, 21 aa, Mycobacterium avium
AVNQDGASNGLTAPNGPSQQR

SEQ ID NO: 27125 - protein, 5 aa, Mycobacterium avium
DAAAV

SEQ ID NO: 27126 - protein, 4 aa, Mycobacterium avium
DAER

SEQ ID NO: 27127 - protein, 4 aa, Mycobacterium avium
DAGV

SEQ ID NO: 27128 - protein, 4 aa, Mycobacterium avium
DAPA

SEQ ID NO: 27129 - protein, 8 aa, Mycobacterium avium
DDARRDGD

SEQ ID NO: 27130 - protein, 4 aa, Mycobacterium avium
DERG

SEQ ID NO: 27131 - protein, 4 aa, Mycobacterium avium
DGAP

SEQ ID NO: 27132 - protein, 4 aa, Mycobacterium avium
DGGD

SEQ ID NO: 27133 - protein, 7 aa, Mycobacterium avium
DGGPTEL

SEQ ID NO: 27134 - protein, 12 aa, Mycobacterium avium
DGQPIGAGRSTR

SEQ ID NO: 27135 - protein, 4 aa, Mycobacterium avium
DGRE

SEQ ID NO: 27136 - protein, 4 aa, Mycobacterium avium
DGTL

SEQ ID NO: 27137 - protein, 4 aa, Mycobacterium avium
DNTV

SEQ ID NO: 27138 - protein, 4 aa, Mycobacterium avium
DPDR

SEQ ID NO: 27139 - protein, 4 aa, Mycobacterium avium
DPTR

SEQ ID NO: 27140 - protein, 4 aa, Mycobacterium avium
DSDL

SEQ ID NO: 27141 - protein, 4 aa, Mycobacterium avium
EAAD

SEQ ID NO: 27142 - protein, 4 aa, Mycobacterium avium
EALG

SEQ ID NO: 27143 - protein, 4 aa, Mycobacterium avium
EESG

SEQ ID NO: 27144 - protein, 5 aa, Mycobacterium avium
EGGPT

SEQ ID NO: 27145 - protein, 5 aa, Mycobacterium avium
EGVRR

SEQ ID NO: 27146 - protein, 4 aa, Mycobacterium avium
EIDR

SEQ ID NO: 27147 - protein, 23 aa, Mycobacterium avium
EPRPQPEAKPAPQPGLTKTSDEE

SEQ ID NO: 27148 - protein, 8 aa, Mycobacterium avium
EPSGGSDL

SEQ ID NO: 27149 - protein, 4 aa, Mycobacterium avium
EPTR

SEQ ID NO: 27150 - protein, 4 aa, Mycobacterium avium
EQGT

SEQ ID NO: 27151 - protein, 4 aa, Mycobacterium avium
ERTD

SEQ ID NO: 27152 - protein, 4 aa, Mycobacterium avium
ESQG

SEQ ID NO: 27153 - protein, 4 aa, Mycobacterium avium
ESRY

SEQ ID NO: 27154 - protein, 4 aa, Mycobacterium avium
ETDG

SEQ ID NO: 27155 - protein, 4 aa, Mycobacterium avium
ETGE

SEQ ID NO: 27156 - protein, 4 aa, Mycobacterium avium
ETRS

SEQ ID NO: 27157 - protein, 4 aa, Mycobacterium avium
GAAG

SEQ ID NO: 27158 - protein, 10 aa, Mycobacterium avium
GAARGQGRSH

SEQ ID NO: 27159 - protein, 4 aa, Mycobacterium avium
GAGD

SEQ ID NO: 27160 - protein, 12 aa, Mycobacterium avium
GAGTPQPRPAGD

SEQ ID NO: 27161 - protein, 4 aa, Mycobacterium avium
GATR

SEQ ID NO: 27162 - protein, 4 aa, Mycobacterium avium
GEPF

SEQ ID NO: 27163 - protein, 6 aa, Mycobacterium avium
GEPQPE

SEQ ID NO: 27164 - protein, 4 aa, Mycobacterium avium
GEQQ

SEQ ID NO: 27165 - protein, 5 aa, Mycobacterium avium
GGITG

SEQ ID NO: 27166 - protein, 5 aa, Mycobacterium avium
GGPGA

SEQ ID NO: 27167 - protein, 4 aa, Mycobacterium avium
GGPM

SEQ ID NO: 27168 - protein, 10 aa, Mycobacterium avium
GGSGTTAAGL

SEQ ID NO: 27169 - protein, 4 aa, Mycobacterium avium
GIDP

SEQ ID NO: 27170 - protein, 4 aa, Mycobacterium avium
GKPV

SEQ ID NO: 27171 - protein, 16 aa, Mycobacterium avium
GKRVRTTKADPAAARH

SEQ ID NO: 27172 - protein, 4 aa, Mycobacterium avium
GLEA

SEQ ID NO: 27173 - protein, 6 aa, Mycobacterium avium
GLGRTA

SEQ ID NO: 27174 - protein, 4 aa, Mycobacterium avium
GPDA

SEQ ID NO: 27175 - protein, 4 aa, Mycobacterium avium
GPID

SEQ ID NO: 27176 - protein, 8 aa, Mycobacterium avium
GPPGTGKS

SEQ ID NO: 27177 - protein, 4 aa, Mycobacterium avium
GPSA

SEQ ID NO: 27178 - protein, 7 aa, Mycobacterium avium
GPTGCGK

SEQ ID NO: 27179 - protein, 4 aa, Mycobacterium avium
GQPV

SEQ ID NO: 27180 - protein, 4 aa, Mycobacterium avium
GRLR

SEQ ID NO: 27181 - protein, 24 aa, Mycobacterium avium
GRPGGTGRRRPCRGDQTATATLAG

SEQ ID NO: 27182 - protein, 6 aa, Mycobacterium avium
GRPGLT

SEQ ID NO: 27183 - protein, 4 aa, Mycobacterium avium
GSEE

SEQ ID NO: 27184 - protein, 5 aa, Mycobacterium avium
GSGIT

SEQ ID NO: 27185 - protein, 6 aa, Mycobacterium avium
GTNEIQ

SEQ ID NO: 27186 - protein, 4 aa, Mycobacterium avium
GTRA

SEQ ID NO: 27187 - protein, 4 aa, Mycobacterium avium
GVAR

SEQ ID NO: 27188 - protein, 7 aa, Mycobacterium avium
IAATEAQ

SEQ ID NO: 27189 - protein, 7 aa, Mycobacterium avium
IAQPEDI

SEQ ID NO: 27190 - protein, 6 aa, Mycobacterium avium
IDPARP

SEQ ID NO: 27191 - protein, 6 aa, Mycobacterium avium
IGNTRL

SEQ ID NO: 27192 - protein, 8 aa, Mycobacterium avium
KLGQHNGL

SEQ ID NO: 27193 - protein, 7 aa, Mycobacterium avium
KSLGAQS

SEQ ID NO: 27194 - protein, 4 aa, Mycobacterium avium
LAPG

SEQ ID NO: 27195 - protein, 6 aa, Mycobacterium avium
LDDTGT

SEQ ID NO: 27196 - protein, 4 aa, Mycobacterium avium
LGPG

SEQ ID NO: 27197 - protein, 4 aa, Mycobacterium avium
LPQP

SEQ ID NO: 27198 - protein, 4 aa, Mycobacterium avium
LQPG

SEQ ID NO: 27199 - protein, 4 aa, Mycobacterium avium
LSAE

SEQ ID NO: 27200 - protein, 5 aa, Mycobacterium avium
NGPAV

SEQ ID NO: 27201 - protein, 6 aa, Mycobacterium avium
NHYPQD

SEQ ID NO: 27202 - protein, 4 aa, Mycobacterium avium
PADE

SEQ ID NO: 27203 - protein, 4 aa, Mycobacterium avium
PAES

SEQ ID NO: 27204 - protein, 4 aa, Mycobacterium avium
PARL

SEQ ID NO: 27205 - protein, 4 aa, Mycobacterium avium
PDAE

SEQ ID NO: 27206 - protein, 4 aa, Mycobacterium avium
PDAL

SEQ ID NO: 27207 - protein, 4 aa, Mycobacterium avium
PDET

SEQ ID NO: 27208 - protein, 4 aa, Mycobacterium avium
PEKA

SEQ ID NO: 27209 - protein, 4 aa, Mycobacterium avium
PGGD

SEQ ID NO: 27210 - protein, 4 aa, Mycobacterium avium
PGRP

SEQ ID NO: 27211 - protein, 4 aa, Mycobacterium avium
PGVG

SEQ ID NO: 27212 - protein, 4 aa, Mycobacterium avium
PNPH

SEQ ID NO: 27213 - protein, 6 aa, Mycobacterium avium
PRTGTT

SEQ ID NO: 27214 - protein, 4 aa, Mycobacterium avium
PTNV

SEQ ID NO: 27215 - protein, 4 aa, Mycobacterium avium
PWPA

SEQ ID NO: 27216 - protein, 4 aa, Mycobacterium avium
PYAE

SEQ ID NO: 27217 - protein, 6 aa, Mycobacterium avium
QNTPAI

SEQ ID NO: 27218 - protein, 8 aa, Mycobacterium avium
QNTPAIAA

SEQ ID NO: 27219 - protein, 5 aa, Mycobacterium avium
QRWTP

SEQ ID NO: 27220 - protein, 4 aa, Mycobacterium avium
QTAR

SEQ ID NO: 27221 - protein, 7 aa, Mycobacterium avium
RASERDF

SEQ ID NO: 27222 - protein, 6 aa, Mycobacterium avium
RAVGPG

SEQ ID NO: 27223 - protein, 10 aa, Mycobacterium avium
RDASPAELGG

SEQ ID NO: 27224 - protein, 4 aa, Mycobacterium avium
REEV

SEQ ID NO: 27225 - protein, 9 aa, Mycobacterium avium
RERTGEPSV

SEQ ID NO: 27226 - protein, 4 aa, Mycobacterium avium
RGAT

SEQ ID NO: 27227 - protein, 6 aa, Mycobacterium avium
RGGGLP

SEQ ID NO: 27228 - protein, 4 aa, Mycobacterium avium
RGKR

SEQ ID NO: 27229 - protein, 4 aa, Mycobacterium avium
RGTT

SEQ ID NO: 27230 - protein, 4 aa, Mycobacterium avium
RGYR

SEQ ID NO: 27231 - protein, 4 aa, Mycobacterium avium
RNPI

SEQ ID NO: 27232 - protein, 4 aa, Mycobacterium avium
RPDG

SEQ ID NO: 27233 - protein, 4 aa, Mycobacterium avium
RPEP

SEQ ID NO: 27234 - protein, 5 aa, Mycobacterium avium
RPEVS

SEQ ID NO: 27235 - protein, 8 aa, Mycobacterium avium
RPQARNAL

SEQ ID NO: 27236 - protein, 5 aa, Mycobacterium avium
RSRGS

SEQ ID NO: 27237 - protein, 4 aa, Mycobacterium avium
RTGT

SEQ ID NO: 27238 - protein, 7 aa, Mycobacterium avium
SAAPLAA

SEQ ID NO: 27239 - protein, 4 aa, Mycobacterium avium
SAAS

SEQ ID NO: 27240 - protein, 4 aa, Mycobacterium avium
SGAA

SEQ ID NO: 27241 - protein, 5 aa, Mycobacterium avium
SGAGL

SEQ ID NO: 27242 - protein, 5 aa, Mycobacterium avium
SGQPL

SEQ ID NO: 27243 - protein, 4 aa, Mycobacterium avium
SPGE

SEQ ID NO: 27244 - protein, 4 aa, Mycobacterium avium
SPGI

SEQ ID NO: 27245 - protein, 4 aa, Mycobacterium avium
SPLG

SEQ ID NO: 27246 - protein, 6 aa, Mycobacterium avium
SQTPSA

SEQ ID NO: 27247 - protein, 6 aa, Mycobacterium avium
SSGLRT

SEQ ID NO: 27248 - protein, 4 aa, Mycobacterium avium
TAAG

SEQ ID NO: 27249 - protein, 4 aa, Mycobacterium avium
TAAR

SEQ ID NO: 27250 - protein, 6 aa, Mycobacterium avium
TDAEAA

SEQ ID NO: 27251 - protein, 5 aa, Mycobacterium avium
TDIPA

SEQ ID NO: 27252 - protein, 5 aa, Mycobacterium avium
TDPAA

SEQ ID NO: 27253 - protein, 4 aa, Mycobacterium avium
TGEV

SEQ ID NO: 27254 - protein, 6 aa, Mycobacterium avium
TGSSIT

SEQ ID NO: 27255 - protein, 4 aa, Mycobacterium avium
TPDP

SEQ ID NO: 27256 - protein, 4 aa, Mycobacterium avium
TPTA

SEQ ID NO: 27257 - protein, 5 aa, Mycobacterium avium
TQTPS

SEQ ID NO: 27258 - protein, 4 aa, Mycobacterium avium
TRPG

SEQ ID NO: 27259 - protein, 4 aa, Mycobacterium avium
TRTV

SEQ ID NO: 27260 - protein, 4 aa, Mycobacterium avium
VDAA

SEQ ID NO: 27261 - protein, 7 aa, Mycobacterium avium
VESAGRT

SEQ ID NO: 27262 - protein, 7 aa, Mycobacterium avium
VTTPART

SEQ ID NO: 27263 - protein, 4 aa, Mycobacterium avium
AAAV

SEQ ID NO: 27264 - protein, 4 aa, Mycobacterium avium
AADA

SEQ ID NO: 27265 - protein, 4 aa, Mycobacterium avium
AADG

SEQ ID NO: 27266 - protein, 5 aa, Mycobacterium avium
AADPV

SEQ ID NO: 27267 - protein, 5 aa, Mycobacterium avium
AAGAP

SEQ ID NO: 27268 - protein, 4 aa, Mycobacterium avium
AAGE

SEQ ID NO: 27269 - protein, 4 aa, Mycobacterium avium
AARA

SEQ ID NO: 27270 - protein, 6 aa, Mycobacterium avium
AARRTG

SEQ ID NO: 27271 - protein, 7 aa, Mycobacterium avium
AARTPDA

SEQ ID NO: 27272 - protein, 5 aa, Mycobacterium avium
AAVAA

SEQ ID NO: 27273 - protein, 4 aa, Mycobacterium avium
ACPS

SEQ ID NO: 27274 - protein, 4 aa, Mycobacterium avium
ADEQ

SEQ ID NO: 27275 - protein, 4 aa, Mycobacterium avium
ADPE

SEQ ID NO: 27276 - protein, 4 aa, Mycobacterium avium
ADRG

SEQ ID NO: 27277 - protein, 7 aa, Mycobacterium avium
ADTAAAA

SEQ ID NO: 27278 - protein, 15 aa, Mycobacterium avium
AEAGGAPPREPRPRN

SEQ ID NO: 27279 - protein, 8 aa, Mycobacterium avium
AEEYGSHD

SEQ ID NO: 27280 - protein, 4 aa, Mycobacterium avium
AEQR

SEQ ID NO: 27281 - protein, 5 aa, Mycobacterium avium
AERRG

SEQ ID NO: 27282 - protein, 4 aa, Mycobacterium avium
AGAE

SEQ ID NO: 27283 - protein, 5 aa, Mycobacterium avium
AGDLD

SEQ ID NO: 27284 - protein, 4 aa, Mycobacterium avium
AGEQ

SEQ ID NO: 27285 - protein, 4 aa, Mycobacterium avium
AGGA

SEQ ID NO: 27286 - protein, 9 aa, Mycobacterium avium
AGLPAAPGK

SEQ ID NO: 27287 - protein, 22 aa, Mycobacterium avium
AGPHERSASRINQRNGSRPRTL

SEQ ID NO: 27288 - protein, 4 aa, Mycobacterium avium
AGRG

SEQ ID NO: 27289 - protein, 5 aa, Mycobacterium avium
AGRPI

SEQ ID NO: 27290 - protein, 5 aa, Mycobacterium avium
AGSGP

SEQ ID NO: 27291 - protein, 4 aa, Mycobacterium avium
AGVN

SEQ ID NO: 27292 - protein, 4 aa, Mycobacterium avium
AGYA

SEQ ID NO: 27293 - protein, 8 aa, Mycobacterium avium
AGYQGSAR

SEQ ID NO: 27294 - protein, 4 aa, Mycobacterium avium
AHPD

SEQ ID NO: 27295 - protein, 18 aa, Mycobacterium avium
ALGGQPPASRVPNLSGQY

SEQ ID NO: 27296 - protein, 4 aa, Mycobacterium avium
ANNT

SEQ ID NO: 27297 - protein, 4 aa, Mycobacterium avium
APAA

SEQ ID NO: 27298 - protein, 5 aa, Mycobacterium avium
APAAV

SEQ ID NO: 27299 - protein, 4 aa, Mycobacterium avium
APER

SEQ ID NO: 27300 - protein, 4 aa, Mycobacterium avium
APPR

SEQ ID NO: 27301 - protein, 4 aa, Mycobacterium avium
APRS

SEQ ID NO: 27302 - protein, 4 aa, Mycobacterium avium
AQIR

SEQ ID NO: 27303 - protein, 5 aa, Mycobacterium avium
AREAL

SEQ ID NO: 27304 - protein, 4 aa, Mycobacterium avium
ARER

SEQ ID NO: 27305 - protein, 4 aa, Mycobacterium avium
ARGP

SEQ ID NO: 27306 - protein, 4 aa, Mycobacterium avium
ARNG

SEQ ID NO: 27307 - protein, 5 aa, Mycobacterium avium
ARPHQ

SEQ ID NO: 27308 - protein, 11 aa, Mycobacterium avium
ARRDGHDVGRD

SEQ ID NO: 27309 - protein, 4 aa, Mycobacterium avium
ARSP

SEQ ID NO: 27310 - protein, 7 aa, Mycobacterium avium
ARTREQF

SEQ ID NO: 27311 - protein, 4 aa, Mycobacterium avium
ASGF

SEQ ID NO: 27312 - protein, 4 aa, Mycobacterium avium
ATAG

SEQ ID NO: 27313 - protein, 6 aa, Mycobacterium avium
ATEQAA

SEQ ID NO: 27314 - protein, 5 aa, Mycobacterium avium
ATGRR

SEQ ID NO: 27315 - protein, 5 aa, Mycobacterium avium
ATLAG

SEQ ID NO: 27316 - protein, 6 aa, Mycobacterium avium
ATPAGK

SEQ ID NO: 27317 - protein, 4 aa, Mycobacterium avium
ATPG

SEQ ID NO: 27318 - protein, 5 aa, Mycobacterium avium
ATSAA

SEQ ID NO: 27319 - protein, 5 aa, Mycobacterium avium
DAAAR

SEQ ID NO: 27320 - protein, 11 aa, Mycobacterium avium
DAADRIKQAAE

SEQ ID NO: 27321 - protein, 7 aa, Mycobacterium avium
DADGPTE

SEQ ID NO: 27322 - protein, 4 aa, Mycobacterium avium
DASQ

SEQ ID NO: 27323 - protein, 4 aa, Mycobacterium avium
DDDR

SEQ ID NO: 27324 - protein, 7 aa, Mycobacterium avium
DDGAGGW

SEQ ID NO: 27325 - protein, 4 aa, Mycobacterium avium
DDGI

SEQ ID NO: 27326 - protein, 4 aa, Mycobacterium avium
DDGN

SEQ ID NO: 27327 - protein, 5 aa, Mycobacterium avium
DDRGV

SEQ ID NO: 27328 - protein, 6 aa, Mycobacterium avium
DEASNR

SEQ ID NO: 27329 - protein, 7 aa, Mycobacterium avium
DEKASTT

SEQ ID NO: 27330 - protein, 6 aa, Mycobacterium avium
DEPSPH

SEQ ID NO: 27331 - protein, 4 aa, Mycobacterium avium
DFPA

SEQ ID NO: 27332 - protein, 6 aa, Mycobacterium avium
DGGRGG

SEQ ID NO: 27333 - protein, 4 aa, Mycobacterium avium
DKEA

SEQ ID NO: 27334 - protein, 4 aa, Mycobacterium avium
DLDD

SEQ ID NO: 27335 - protein, 4 aa, Mycobacterium avium
DPAL

SEQ ID NO: 27336 - protein, 4 aa, Mycobacterium avium
DPAV

SEQ ID NO: 27337 - protein, 5 aa, Mycobacterium avium
DPLPD

SEQ ID NO: 27338 - protein, 5 aa, Mycobacterium avium
DPLRD

SEQ ID NO: 27339 - protein, 4 aa, Mycobacterium avium
DPQG

SEQ ID NO: 27340 - protein, 19 aa, Mycobacterium avium
DPSIREQPVTAPPAPAPDN

SEQ ID NO: 27341 - protein, 4 aa, Mycobacterium avium
DSGP

SEQ ID NO: 27342 - protein, 4 aa, Mycobacterium avium
DTGG

SEQ ID NO: 27343 - protein, 4 aa, Mycobacterium avium
EAAR

SEQ ID NO: 27344 - protein, 4 aa, Mycobacterium avium
EAEQ

SEQ ID NO: 27345 - protein, 7 aa, Mycobacterium avium
EAGGDPW

SEQ ID NO: 27346 - protein, 7 aa, Mycobacterium avium
EASRRGV

SEQ ID NO: 27347 - protein, 8 aa, Mycobacterium avium
EDRPGGKR

SEQ ID NO: 27348 - protein, 8 aa, Mycobacterium avium
EEYGGSPV

SEQ ID NO: 27349 - protein, 4 aa, Mycobacterium avium
EGRG

SEQ ID NO: 27350 - protein, 4 aa, Mycobacterium avium
EGVP

SEQ ID NO: 27351 - protein, 5 aa, Mycobacterium avium
EIKET

SEQ ID NO: 27352 - protein, 4 aa, Mycobacterium avium
EIPE

SEQ ID NO: 27353 - protein, 4 aa, Mycobacterium avium
ELTP

SEQ ID NO: 27354 - protein, 9 aa, Mycobacterium avium
EPDSGLDPV

SEQ ID NO: 27355 - protein, 9 aa, Mycobacterium avium
EPGAGSDLA

SEQ ID NO: 27356 - protein, 4 aa, Mycobacterium avium
EPGK

SEQ ID NO: 27357 - protein, 4 aa, Mycobacterium avium
EQAA

SEQ ID NO: 27358 - protein, 4 aa, Mycobacterium avium
ERHG

SEQ ID NO: 27359 - protein, 4 aa, Mycobacterium avium
ESFP

SEQ ID NO: 27360 - protein, 12 aa, Mycobacterium avium
ETAAGRRLTGGG

SEQ ID NO: 27361 - protein, 10 aa, Mycobacterium avium
EYSEGAGPGI

SEQ ID NO: 27362 - protein, 24 aa, Mycobacterium avium
FTATASPVSPGDDVPASIDRDGQD

SEQ ID NO: 27363 - protein, 4 aa, Mycobacterium avium
FTEP

SEQ ID NO: 27364 - protein, 6 aa, Mycobacterium avium
FTGSTE

SEQ ID NO: 27365 - protein, 8 aa, Mycobacterium avium
GAAHASKA

SEQ ID NO: 27366 - protein, 4 aa, Mycobacterium avium
GAAP

SEQ ID NO: 27367 - protein, 9 aa, Mycobacterium avium
GADPQSKGI

SEQ ID NO: 27368 - protein, 7 aa, Mycobacterium avium
GAGAETV

SEQ ID NO: 27369 - protein, 5 aa, Mycobacterium avium
GAGKT

SEQ ID NO: 27370 - protein, 4 aa, Mycobacterium avium
GAHD

SEQ ID NO: 27371 - protein, 4 aa, Mycobacterium avium
GAQG

SEQ ID NO: 27372 - protein, 4 aa, Mycobacterium avium
GDSV

SEQ ID NO: 27373 - protein, 4 aa, Mycobacterium avium
GETI

SEQ ID NO: 27374 - protein, 8 aa, Mycobacterium avium
GGARGMGA

SEQ ID NO: 27375 - protein, 5 aa, Mycobacterium avium
GGDEA

SEQ ID NO: 27376 - protein, 19 aa, Mycobacterium avium
GGDEKKFPGEISGGMRKRA

SEQ ID NO: 27377 - protein, 14 aa, Mycobacterium avium
GGHNSNADKSSGVF

SEQ ID NO: 27378 - protein, 5 aa, Mycobacterium avium
GGKSA

SEQ ID NO: 27379 - protein, 4 aa, Mycobacterium avium
GGRV

SEQ ID NO: 27380 - protein, 10 aa, Mycobacterium avium
GGSGTTAASL

SEQ ID NO: 27381 - protein, 5 aa, Mycobacterium avium
GGTNE

SEQ ID NO: 27382 - protein, 4 aa, Mycobacterium avium
GGTT

SEQ ID NO: 27383 - protein, 6 aa, Mycobacterium avium
GGVVSN

SEQ ID NO: 27384 - protein, 5 aa, Mycobacterium avium
GHAPG

SEQ ID NO: 27385 - protein, 13 aa, Mycobacterium avium
GHGTGTTLGDPIE

SEQ ID NO: 27386 - protein, 4 aa, Mycobacterium avium
GITR

SEQ ID NO: 27387 - protein, 4 aa, Mycobacterium avium
GKSP

SEQ ID NO: 27388 - protein, 4 aa, Mycobacterium avium
GLPE

SEQ ID NO: 27389 - protein, 5 aa, Mycobacterium avium
GLPPA

SEQ ID NO: 27390 - protein, 4 aa, Mycobacterium avium
GNVA

SEQ ID NO: 27391 - protein, 4 aa, Mycobacterium avium
GPAA

SEQ ID NO: 27392 - protein, 4 aa, Mycobacterium avium
GPRE

SEQ ID NO: 27393 - protein, 8 aa, Mycobacterium avium
GPSGTGKS

SEQ ID NO: 27394 - protein, 6 aa, Mycobacterium avium
GPTEAT

SEQ ID NO: 27395 - protein, 4 aa, Mycobacterium avium
GQNR

SEQ ID NO: 27396 - protein, 4 aa, Mycobacterium avium
GQPL

SEQ ID NO: 27397 - protein, 4 aa, Mycobacterium avium
GQPR

SEQ ID NO: 27398 - protein, 4 aa, Mycobacterium avium
GQRP

SEQ ID NO: 27399 - protein, 4 aa, Mycobacterium avium
GRLD

SEQ ID NO: 27400 - protein, 4 aa, Mycobacterium avium
GRPD

SEQ ID NO: 27401 - protein, 9 aa, Mycobacterium avium
GRRGAAAGY

SEQ ID NO: 27402 - protein, 4 aa, Mycobacterium avium
GSAA

SEQ ID NO: 27403 - protein, 4 aa, Mycobacterium avium
GSTA

SEQ ID NO: 27404 - protein, 4 aa, Mycobacterium avium
GSTP

SEQ ID NO: 27405 - protein, 6 aa, Mycobacterium avium
GTAARA

SEQ ID NO: 27406 - protein, 4 aa, Mycobacterium avium
GTAV

SEQ ID NO: 27407 - protein, 6 aa, Mycobacterium avium
GTPPVA

SEQ ID NO: 27408 - protein, 4 aa, Mycobacterium avium
GTRD

SEQ ID NO: 27409 - protein, 4 aa, Mycobacterium avium
GTTH

SEQ ID NO: 27410 - protein, 4 aa, Mycobacterium avium
GVAT

SEQ ID NO: 27411 - protein, 5 aa, Mycobacterium avium
GVRPG

SEQ ID NO: 27412 - protein, 4 aa, Mycobacterium avium
GVTG

SEQ ID NO: 27413 - protein, 4 aa, Mycobacterium avium
GVTR

SEQ ID NO: 27414 - protein, 6 aa, Mycobacterium avium
GWSPAR

SEQ ID NO: 27415 - protein, 7 aa, Mycobacterium avium
GYGSAGE

SEQ ID NO: 27416 - protein, 5 aa, Mycobacterium avium
GYYRT

SEQ ID NO: 27417 - protein, 4 aa, Mycobacterium avium
HAVT

SEQ ID NO: 27418 - protein, 4 aa, Mycobacterium avium
HEPA

SEQ ID NO: 27419 - protein, 5 aa, Mycobacterium avium
HETTA

SEQ ID NO: 27420 - protein, 19 aa, Mycobacterium avium
HGDPAGNGSGNSRNGHGRK

SEQ ID NO: 27421 - protein, 14 aa, Mycobacterium avium
HGKTLADAKGDIQR

SEQ ID NO: 27422 - protein, 4 aa, Mycobacterium avium
HNGL

SEQ ID NO: 27423 - protein, 14 aa, Mycobacterium avium
HNHRAGESVPPLPG

SEQ ID NO: 27424 - protein, 9 aa, Mycobacterium avium
HTKKKESEI

SEQ ID NO: 27425 - protein, 4 aa, Mycobacterium avium
HVGA

SEQ ID NO: 27426 - protein, 5 aa, Mycobacterium avium
IDGPD

SEQ ID NO: 27427 - protein, 4 aa, Mycobacterium avium
INTD

SEQ ID NO: 27428 - protein, 5 aa, Mycobacterium avium
IPATQ

SEQ ID NO: 27429 - protein, 5 aa, Mycobacterium avium
IPPTE

SEQ ID NO: 27430 - protein, 4 aa, Mycobacterium avium
ITGP

SEQ ID NO: 27431 - protein, 8 aa, Mycobacterium avium
KAKSPGAV

SEQ ID NO: 27432 - protein, 10 aa, Mycobacterium avium
KARGSFPSDA

SEQ ID NO: 27433 - protein, 8 aa, Mycobacterium avium
KNGRGETE

SEQ ID NO: 27434 - protein, 5 aa, Mycobacterium avium
KRRLG

SEQ ID NO: 27435 - protein, 6 aa, Mycobacterium avium
KTWSTS

SEQ ID NO: 27436 - protein, 10 aa, Mycobacterium avium
LDPKADYGPL

SEQ ID NO: 27437 - protein, 14 aa, Mycobacterium avium
LESAAGKGLTGGGT

SEQ ID NO: 27438 - protein, 4 aa, Mycobacterium avium
LGAT

SEQ ID NO: 27439 - protein, 4 aa, Mycobacterium avium
LGRP

SEQ ID NO: 27440 - protein, 5 aa, Mycobacterium avium
LPPGV

SEQ ID NO: 27441 - protein, 4 aa, Mycobacterium avium
LQRG

SEQ ID NO: 27442 - protein, 4 aa, Mycobacterium avium
LTDD

SEQ ID NO: 27443 - protein, 6 aa, Mycobacterium avium
LTTPAR

SEQ ID NO: 27444 - protein, 4 aa, Mycobacterium avium
MPDD

SEQ ID NO: 27445 - protein, 5 aa, Mycobacterium avium
MSTRD

SEQ ID NO: 27446 - protein, 13 aa, Mycobacterium avium
MYETGAGGSAPKH

SEQ ID NO: 27447 - protein, 6 aa, Mycobacterium avium
NAGLSA

SEQ ID NO: 27448 - protein, 6 aa, Mycobacterium avium
NAPLAV

SEQ ID NO: 27449 - protein, 5 aa, Mycobacterium avium
NETTR

SEQ ID NO: 27450 - protein, 10 aa, Mycobacterium avium
NMGHTQAAAG

SEQ ID NO: 27451 - protein, 4 aa, Mycobacterium avium
NPAR

SEQ ID NO: 27452 - protein, 6 aa, Mycobacterium avium
NQHGPA

SEQ ID NO: 27453 - protein, 13 aa, Mycobacterium avium
NQKRGSAQGQGTY

SEQ ID NO: 27454 - protein, 6 aa, Mycobacterium avium
NRDPAV

SEQ ID NO: 27455 - protein, 9 aa, Mycobacterium avium
NRTPPKTQA

SEQ ID NO: 27456 - protein, 4 aa, Mycobacterium avium
PAAA

SEQ ID NO: 27457 - protein, 5 aa, Mycobacterium avium
PAAVA

SEQ ID NO: 27458 - protein, 5 aa, Mycobacterium avium
PAGGG

SEQ ID NO: 27459 - protein, 8 aa, Mycobacterium avium
PARSRPWK

SEQ ID NO: 27460 - protein, 4 aa, Mycobacterium avium
PCPP

SEQ ID NO: 27461 - protein, 25 aa, Mycobacterium avium
PCVDGTPTEQAIEGDTRSAAQRNHD

SEQ ID NO: 27462 - protein, 4 aa, Mycobacterium avium
PDGR

SEQ ID NO: 27463 - protein, 4 aa, Mycobacterium avium
PDRV

SEQ ID NO: 27464 - protein, 4 aa, Mycobacterium avium
PDTA

SEQ ID NO: 27465 - protein, 6 aa, Mycobacterium avium
PEGLDS

SEQ ID NO: 27466 - protein, 4 aa, Mycobacterium avium
PERL

SEQ ID NO: 27467 - protein, 4 aa, Mycobacterium avium
PERR

SEQ ID NO: 27468 - protein, 6 aa, Mycobacterium avium
PFAPPP

SEQ ID NO: 27469 - protein, 5 aa, Mycobacterium avium
PGAAL

SEQ ID NO: 27470 - protein, 5 aa, Mycobacterium avium
PGAVE

SEQ ID NO: 27471 - protein, 4 aa, Mycobacterium avium
PGIT

SEQ ID NO: 27472 - protein, 4 aa, Mycobacterium avium
PGTS

SEQ ID NO: 27473 - protein, 4 aa, Mycobacterium avium
PGVT

SEQ ID NO: 27474 - protein, 4 aa, Mycobacterium avium
PHGV

SEQ ID NO: 27475 - protein, 4 aa, Mycobacterium avium
PIPD

SEQ ID NO: 27476 - protein, 4 aa, Mycobacterium avium
PLRA

SEQ ID NO: 27477 - protein, 4 aa, Mycobacterium avium
PPLT

SEQ ID NO: 27478 - protein, 5 aa, Mycobacterium avium
PPRHR

SEQ ID NO: 27479 - protein, 4 aa, Mycobacterium avium
PQGL

SEQ ID NO: 27480 - protein, 4 aa, Mycobacterium avium
PQRA

SEQ ID NO: 27481 - protein, 8 aa, Mycobacterium avium
PRDRNGTF

SEQ ID NO: 27482 - protein, 4 aa, Mycobacterium avium
PRGA

SEQ ID NO: 27483 - protein, 9 aa, Mycobacterium avium
PSERDPSVP

SEQ ID NO: 27484 - protein, 5 aa, Mycobacterium avium
PSLPS

SEQ ID NO: 27485 - protein, 4 aa, Mycobacterium avium
PTIT

SEQ ID NO: 27486 - protein, 4 aa, Mycobacterium avium
PVPA

SEQ ID NO: 27487 - protein, 5 aa, Mycobacterium avium
PVPPG

SEQ ID NO: 27488 - protein, 6 aa, Mycobacterium avium
QAGSPF

SEQ ID NO: 27489 - protein, 4 aa, Mycobacterium avium
QARK

SEQ ID NO: 27490 - protein, 4 aa, Mycobacterium avium
QARQ

SEQ ID NO: 27491 - protein, 6 aa, Mycobacterium avium
QESDGG

SEQ ID NO: 27492 - protein, 4 aa, Mycobacterium avium
QPHL

SEQ ID NO: 27493 - protein, 10 aa, Mycobacterium avium
QPRSPTTTGK

SEQ ID NO: 27494 - protein, 13 aa, Mycobacterium avium
QPWPGERPRRAGV

SEQ ID NO: 27495 - protein, 4 aa, Mycobacterium avium
QQAG

SEQ ID NO: 27496 - protein, 7 aa, Mycobacterium avium
QQRESFG

SEQ ID NO: 27497 - protein, 4 aa, Mycobacterium avium
QRPG

SEQ ID NO: 27498 - protein, 6 aa, Mycobacterium avium
RADEQV

SEQ ID NO: 27499 - protein, 4 aa, Mycobacterium avium
RAGL

SEQ ID NO: 27500 - protein, 4 aa, Mycobacterium avium
RAGP

SEQ ID NO: 27501 - protein, 6 aa, Mycobacterium avium
RARNSG

SEQ ID NO: 27502 - protein, 5 aa, Mycobacterium avium
RDEGA

SEQ ID NO: 27503 - protein, 9 aa, Mycobacterium avium
REDNPGDKR

SEQ ID NO: 27504 - protein, 4 aa, Mycobacterium avium
RENP

SEQ ID NO: 27505 - protein, 4 aa, Mycobacterium avium
RGAL

SEQ ID NO: 27506 - protein, 7 aa, Mycobacterium avium
RGCSHPG

SEQ ID NO: 27507 - protein, 4 aa, Mycobacterium avium
RGPV

SEQ ID NO: 27508 - protein, 4 aa, Mycobacterium avium
RGQR

SEQ ID NO: 27509 - protein, 4 aa, Mycobacterium avium
RGSA

SEQ ID NO: 27510 - protein, 5 aa, Mycobacterium avium
RHQRR

SEQ ID NO: 27511 - protein, 4 aa, Mycobacterium avium
RPEA

SEQ ID NO: 27512 - protein, 4 aa, Mycobacterium avium
RPEL

SEQ ID NO: 27513 - protein, 4 aa, Mycobacterium avium
RPPA

SEQ ID NO: 27514 - protein, 4 aa, Mycobacterium avium
RPQT

SEQ ID NO: 27515 - protein, 12 aa, Mycobacterium avium
RPTIGSGSVRRK

SEQ ID NO: 27516 - protein, 4 aa, Mycobacterium avium
RRGG

SEQ ID NO: 27517 - protein, 5 aa, Mycobacterium avium
RRRHP

SEQ ID NO: 27518 - protein, 4 aa, Mycobacterium avium
RSGE

SEQ ID NO: 27519 - protein, 5 aa, Mycobacterium avium
RSGSP

SEQ ID NO: 27520 - protein, 4 aa, Mycobacterium avium
RSSV

SEQ ID NO: 27521 - protein, 4 aa, Mycobacterium avium
RTPM

SEQ ID NO: 27522 - protein, 4 aa, Mycobacterium avium
RTPT

SEQ ID NO: 27523 - protein, 12 aa, Mycobacterium avium
RVSACGSVVATM

SEQ ID NO: 27524 - protein, 4 aa, Mycobacterium avium
RYSV

SEQ ID NO: 27525 - protein, 8 aa, Mycobacterium avium
SAAALRAQ

SEQ ID NO: 27526 - protein, 4 aa, Mycobacterium avium
SAAG

SEQ ID NO: 27527 - protein, 6 aa, Mycobacterium avium
SAAGGR

SEQ ID NO: 27528 - protein, 5 aa, Mycobacterium avium
SAATV

SEQ ID NO: 27529 - protein, 4 aa, Mycobacterium avium
SAQP

SEQ ID NO: 27530 - protein, 4 aa, Mycobacterium avium
SATG

SEQ ID NO: 27531 - protein, 7 aa, Mycobacterium avium
SDTERCE

SEQ ID NO: 27532 - protein, 9 aa, Mycobacterium avium
SEPDAGSDL

SEQ ID NO: 27533 - protein, 4 aa, Mycobacterium avium
SGFG

SEQ ID NO: 27534 - protein, 4 aa, Mycobacterium avium
SGPG

SEQ ID NO: 27535 - protein, 10 aa, Mycobacterium avium
SGTTGEPKGV

SEQ ID NO: 27536 - protein, 9 aa, Mycobacterium avium
SGTTGRPKG

SEQ ID NO: 27537 - protein, 10 aa, Mycobacterium avium
SGTTGRPKGA

SEQ ID NO: 27538 - protein, 10 aa, Mycobacterium avium
SGTTGTPKGV

SEQ ID NO: 27539 - protein, 7 aa, Mycobacterium avium
SGYGGNA

SEQ ID NO: 27540 - protein, 11 aa, Mycobacterium avium
SLAAAKSKSAL

SEQ ID NO: 27541 - protein, 8 aa, Mycobacterium avium
SPGMPERK

SEQ ID NO: 27542 - protein, 4 aa, Mycobacterium avium
SRGG

SEQ ID NO: 27543 - protein, 5 aa, Mycobacterium avium
SRPVD

SEQ ID NO: 27544 - protein, 4 aa, Mycobacterium avium
SSTA

SEQ ID NO: 27545 - protein, 5 aa, Mycobacterium avium
SYAGQ

SEQ ID NO: 27546 - protein, 4 aa, Mycobacterium avium
SYRG

SEQ ID NO: 27547 - protein, 7 aa, Mycobacterium avium
SYTDRKK

SEQ ID NO: 27548 - protein, 4 aa, Mycobacterium avium
TAAE

SEQ ID NO: 27549 - protein, 10 aa, Mycobacterium avium
TAARTNHAEV

SEQ ID NO: 27550 - protein, 5 aa, Mycobacterium avium
TAATT

SEQ ID NO: 27551 - protein, 8 aa, Mycobacterium avium
TADPGRRL

SEQ ID NO: 27552 - protein, 4 aa, Mycobacterium avium
TADT

SEQ ID NO: 27553 - protein, 5 aa, Mycobacterium avium
TAQQA

SEQ ID NO: 27554 - protein, 5 aa, Mycobacterium avium
TAVRD

SEQ ID NO: 27555 - protein, 4 aa, Mycobacterium avium
TDGT

SEQ ID NO: 27556 - protein, 6 aa, Mycobacterium avium
TDIRDP

SEQ ID NO: 27557 - protein, 4 aa, Mycobacterium avium
TEAQ

SEQ ID NO: 27558 - protein, 6 aa, Mycobacterium avium
TGGVGQ

SEQ ID NO: 27559 - protein, 4 aa, Mycobacterium avium
THQT

SEQ ID NO: 27560 - protein, 5 aa, Mycobacterium avium
TPGCT

SEQ ID NO: 27561 - protein, 5 aa, Mycobacterium avium
TPGDL

SEQ ID NO: 27562 - protein, 4 aa, Mycobacterium avium
TPGT

SEQ ID NO: 27563 - protein, 4 aa, Mycobacterium avium
TPLG

SEQ ID NO: 27564 - protein, 9 aa, Mycobacterium avium
TPTADAADF

SEQ ID NO: 27565 - protein, 34 aa, Mycobacterium avium
TQETVGGVTTASGGYLSQEATSAAAMNDVTNVRV

SEQ ID NO: 27566 - protein, 5 aa, Mycobacterium avium
TSPGA

SEQ ID NO: 27567 - protein, 5 aa, Mycobacterium avium
TTAGP

SEQ ID NO: 27568 - protein, 6 aa, Mycobacterium avium
TTPAER

SEQ ID NO: 27569 - protein, 4 aa, Mycobacterium avium
TVPE

SEQ ID NO: 27570 - protein, 4 aa, Mycobacterium avium
TYQQ

SEQ ID NO: 27571 - protein, 4 aa, Mycobacterium avium
VADG

SEQ ID NO: 27572 - protein, 6 aa, Mycobacterium avium
VARRQA

SEQ ID NO: 27573 - protein, 5 aa, Mycobacterium avium
VDSPE

SEQ ID NO: 27574 - protein, 9 aa, Mycobacterium avium
VEKSHGKMS

SEQ ID NO: 27575 - protein, 4 aa, Mycobacterium avium
VEPG

SEQ ID NO: 27576 - protein, 4 aa, Mycobacterium avium
VGLP

SEQ ID NO: 27577 - protein, 4 aa, Mycobacterium avium
VPGD

SEQ ID NO: 27578 - protein, 4 aa, Mycobacterium avium
VPGL

SEQ ID NO: 27579 - protein, 4 aa, Mycobacterium avium
VRES

SEQ ID NO: 27580 - protein, 15 aa, Mycobacterium avium
VSGPGGSTAGAGGAW

SEQ ID NO: 27581 - protein, 25 aa, Mycobacterium avium
VSPAVSEEGSAVQAAAGGAPGGAAN

SEQ ID NO: 27582 - protein, 4 aa, Mycobacterium avium
VTAE

SEQ ID NO: 27583 - protein, 20 aa, Mycobacterium avium
YDGPRPAPSRGPRPKTQAEK

SEQ ID NO: 27584 - protein, 8 aa, Mycobacterium avium
YGQDRGQP

SEQ ID NO: 27585 - protein, 4 aa, Mycobacterium avium
YPQE

SEQ ID NO: 27586 - protein, 7 aa, Mycobacterium avium
AAAAAGA

SEQ ID NO: 27587 - protein, 9 aa, Mycobacterium avium
AAAAAPPPL

SEQ ID NO: 27588 - protein, 21 aa, Mycobacterium avium
AAAAARAALSADDADGSGLSA

SEQ ID NO: 27589 - protein, 10 aa, Mycobacterium avium
AAAAASDPLA

SEQ ID NO: 27590 - protein, 7 aa, Mycobacterium avium
AAAAATR

SEQ ID NO: 27591 - protein, 6 aa, Mycobacterium avium
AAAAGR

SEQ ID NO: 27592 - protein, 7 aa, Mycobacterium avium
AAAAGRP

SEQ ID NO: 27593 - protein, 7 aa, Mycobacterium avium
AAAAHRA

SEQ ID NO: 27594 - protein, 9 aa, Mycobacterium avium
AAAAKLADD

SEQ ID NO: 27595 - protein, 6 aa, Mycobacterium avium
AAAAPR

SEQ ID NO: 27596 - protein, 13 aa, Mycobacterium avium
AAAARGEEDVPAQ

SEQ ID NO: 27597 - protein, 8 aa, Mycobacterium avium
AAAARREY

SEQ ID NO: 27598 - protein, 6 aa, Mycobacterium avium
AAAATA

SEQ ID NO: 27599 - protein, 7 aa, Mycobacterium avium
AAAATDF

SEQ ID NO: 27600 - protein, 15 aa, Mycobacterium avium
AAAATKAAAAQAHSG

SEQ ID NO: 27601 - protein, 6 aa, Mycobacterium avium
AAADGT

SEQ ID NO: 27602 - protein, 8 aa, Mycobacterium avium
AAADPAGF

SEQ ID NO: 27603 - protein, 10 aa, Mycobacterium avium
AAADPRSRAT

SEQ ID NO: 27604 - protein, 6 aa, Mycobacterium avium
AAADRA

SEQ ID NO: 27605 - protein, 8 aa, Mycobacterium avium
AAADRPDV

SEQ ID NO: 27606 - protein, 17 aa, Mycobacterium avium
AAADRRGIGVSNTPDVL

SEQ ID NO: 27607 - protein, 7 aa, Mycobacterium avium
AAADTRT

SEQ ID NO: 27608 - protein, 15 aa, Mycobacterium avium
AAADWNKPATSAFKP

SEQ ID NO: 27609 - protein, 10 aa, Mycobacterium avium
AAAEAAGRNV

SEQ ID NO: 27610 - protein, 7 aa, Mycobacterium avium
AAAEAEY

SEQ ID NO: 27611 - protein, 7 aa, Mycobacterium avium
AAAEAGA

SEQ ID NO: 27612 - protein, 14 aa, Mycobacterium avium
AAAEAGGRPDEPTA

SEQ ID NO: 27613 - protein, 9 aa, Mycobacterium avium
AAAEAKRQN

SEQ ID NO: 27614 - protein, 7 aa, Mycobacterium avium
AAAEGRL

SEQ ID NO: 27615 - protein, 9 aa, Mycobacterium avium
AAAEGSGDF

SEQ ID NO: 27616 - protein, 5 aa, Mycobacterium avium
AAAEL

SEQ ID NO: 27617 - protein, 25 aa, Mycobacterium avium
AAAENATKITAREPAVAGDRPELTE

SEQ ID NO: 27618 - protein, 11 aa, Mycobacterium avium
AAAEPAPPPRR

SEQ ID NO: 27619 - protein, 7 aa, Mycobacterium avium
AAAEPAV

SEQ ID NO: 27620 - protein, 9 aa, Mycobacterium avium
AAAESAGAQ

SEQ ID NO: 27621 - protein, 6 aa, Mycobacterium avium
AAAGAL

SEQ ID NO: 27622 - protein, 8 aa, Mycobacterium avium
AAAGDDVA

SEQ ID NO: 27623 - protein, 14 aa, Mycobacterium avium
AAAGDTAGAQTQAM

SEQ ID NO: 27624 - protein, 18 aa, Mycobacterium avium
AAAGDTQAATTHATQAAE

SEQ ID NO: 27625 - protein, 8 aa, Mycobacterium avium
AAAGETLG

SEQ ID NO: 27626 - protein, 10 aa, Mycobacterium avium
AAAGGGPATQ

SEQ ID NO: 27627 - protein, 15 aa, Mycobacterium avium
AAAGGGTRLRWVAPL

SEQ ID NO: 27628 - protein, 11 aa, Mycobacterium avium
AAAGGRGGLGN

SEQ ID NO: 27629 - protein, 10 aa, Mycobacterium avium
AAAGGTTSLA

SEQ ID NO: 27630 - protein, 7 aa, Mycobacterium avium
AAAGGVG

SEQ ID NO: 27631 - protein, 5 aa, Mycobacterium avium
AAAGI

SEQ ID NO: 27632 - protein, 10 aa, Mycobacterium avium
AAAGPAGRPT

SEQ ID NO: 27633 - protein, 11 aa, Mycobacterium avium
AAAGPDSATDP

SEQ ID NO: 27634 - protein, 9 aa, Mycobacterium avium
AAAGPPGAT

SEQ ID NO: 27635 - protein, 10 aa, Mycobacterium avium
AAAGPSADRA

SEQ ID NO: 27636 - protein, 9 aa, Mycobacterium avium
AAAGRPDGA

SEQ ID NO: 27637 - protein, 7 aa, Mycobacterium avium
AAAGRRS

SEQ ID NO: 27638 - protein, 20 aa, Mycobacterium avium
AAAGSASGYPATAGTARLRD

SEQ ID NO: 27639 - protein, 11 aa, Mycobacterium avium
AAAGTGALDDP

SEQ ID NO: 27640 - protein, 20 aa, Mycobacterium avium
AAAGTMGSIKPGDPNDPGTV

SEQ ID NO: 27641 - protein, 4 aa, Mycobacterium avium
AAAI

SEQ ID NO: 27642 - protein, 11 aa, Mycobacterium avium
AAAIEAGANTR

SEQ ID NO: 27643 - protein, 7 aa, Mycobacterium avium
AAAKANG

SEQ ID NO: 27644 - protein, 9 aa, Mycobacterium avium
AAAKGGATF

SEQ ID NO: 27645 - protein, 6 aa, Mycobacterium avium
AAAKGK

SEQ ID NO: 27646 - protein, 9 aa, Mycobacterium avium
AAAKKGATL

SEQ ID NO: 27647 - protein, 12 aa, Mycobacterium avium
AAAKPGSAMRPL

SEQ ID NO: 27648 - protein, 11 aa, Mycobacterium avium
AAAKSGANAIH

SEQ ID NO: 27649 - protein, 8 aa, Mycobacterium avium
AAAKVPAG

SEQ ID NO: 27650 - protein, 5 aa, Mycobacterium avium
AAALG

SEQ ID NO: 27651 - protein, 14 aa, Mycobacterium avium
AAANAQNNNGLDPA

SEQ ID NO: 27652 - protein, 7 aa, Mycobacterium avium
AAANGLG

SEQ ID NO: 27653 - protein, 5 aa, Mycobacterium avium
AAAPA

SEQ ID NO: 27654 - protein, 9 aa, Mycobacterium avium
AAAPADATP

SEQ ID NO: 27655 - protein, 8 aa, Mycobacterium avium
AAAPDAKT

SEQ ID NO: 27656 - protein, 8 aa, Mycobacterium avium
AAAPDGLQ

SEQ ID NO: 27657 - protein, 19 aa, Mycobacterium avium
AAAPDLAQTAAAVQQRGVR

SEQ ID NO: 27658 - protein, 15 aa, Mycobacterium avium
AAAPDWEYPPDGHTG

SEQ ID NO: 27659 - protein, 9 aa, Mycobacterium avium
AAAPEHERE

SEQ ID NO: 27660 - protein, 6 aa, Mycobacterium avium
AAAPGG

SEQ ID NO: 27661 - protein, 7 aa, Mycobacterium avium
AAAPGNA

SEQ ID NO: 27662 - protein, 7 aa, Mycobacterium avium
AAAPGRS

SEQ ID NO: 27663 - protein, 6 aa, Mycobacterium avium
AAAPRL

SEQ ID NO: 27664 - protein, 15 aa, Mycobacterium avium
AAAPSNPVATPGAGT

SEQ ID NO: 27665 - protein, 5 aa, Mycobacterium avium
AAAPV

SEQ ID NO: 27666 - protein, 7 aa, Mycobacterium avium
AAAQAQP

SEQ ID NO: 27667 - protein, 7 aa, Mycobacterium avium
AAAQRAG

SEQ ID NO: 27668 - protein, 13 aa, Mycobacterium avium
AAAQRAGSLGPEQ

SEQ ID NO: 27669 - protein, 7 aa, Mycobacterium avium
AAAQSHD

SEQ ID NO: 27670 - protein, 9 aa, Mycobacterium avium
AAAQSQAIR

SEQ ID NO: 27671 - protein, 7 aa, Mycobacterium avium
AAARADY

SEQ ID NO: 27672 - protein, 5 aa, Mycobacterium avium
AAARE

SEQ ID NO: 27673 - protein, 7 aa, Mycobacterium avium
AAARGGG

SEQ ID NO: 27674 - protein, 7 aa, Mycobacterium avium
AAARGTA

SEQ ID NO: 27675 - protein, 5 aa, Mycobacterium avium
AAARH

SEQ ID NO: 27676 - protein, 6 aa, Mycobacterium avium
AAARPP

SEQ ID NO: 27677 - protein, 8 aa, Mycobacterium avium
AAARPRGK

SEQ ID NO: 27678 - protein, 11 aa, Mycobacterium avium
AAARTQARIDS

SEQ ID NO: 27679 - protein, 5 aa, Mycobacterium avium
AAASA

SEQ ID NO: 27680 - protein, 11 aa, Mycobacterium avium
AAASAGSPLGE

SEQ ID NO: 27681 - protein, 9 aa, Mycobacterium avium
AAASGSDVS

SEQ ID NO: 27682 - protein, 8 aa, Mycobacterium avium
AAASPADL

SEQ ID NO: 27683 - protein, 11 aa, Mycobacterium avium
AAASTENERTS

SEQ ID NO: 27684 - protein, 12 aa, Mycobacterium avium
AAATAATAALPY

SEQ ID NO: 27685 - protein, 5 aa, Mycobacterium avium
AAATG

SEQ ID NO: 27686 - protein, 17 aa, Mycobacterium avium
AAATGGYAEYATAPASL

SEQ ID NO: 27687 - protein, 8 aa, Mycobacterium avium
AAATGKGA

SEQ ID NO: 27688 - protein, 12 aa, Mycobacterium avium
AAATGKRSQCFG

SEQ ID NO: 27689 - protein, 14 aa, Mycobacterium avium
AAATGLEDIPGQSV

SEQ ID NO: 27690 - protein, 17 aa, Mycobacterium avium
AAATKAKSLLDQEGRDD

SEQ ID NO: 27691 - protein, 8 aa, Mycobacterium avium
AAATRNTQ

SEQ ID NO: 27692 - protein, 6 aa, Mycobacterium avium
AACGPP

SEQ ID NO: 27693 - protein, 12 aa, Mycobacterium avium
AADDDSATGGPD

SEQ ID NO: 27694 - protein, 7 aa, Mycobacterium avium
AADDEMR

SEQ ID NO: 27695 - protein, 8 aa, Mycobacterium avium
AADDKTAR

SEQ ID NO: 27696 - protein, 6 aa, Mycobacterium avium
AADDPA

SEQ ID NO: 27697 - protein, 8 aa, Mycobacterium avium
AADDPGVD

SEQ ID NO: 27698 - protein, 6 aa, Mycobacterium avium
AADDYP

SEQ ID NO: 27699 - protein, 7 aa, Mycobacterium avium
AADEAQA

SEQ ID NO: 27700 - protein, 9 aa, Mycobacterium avium
AADEKESEL

SEQ ID NO: 27701 - protein, 7 aa, Mycobacterium avium
AADESAA

SEQ ID NO: 27702 - protein, 5 aa, Mycobacterium avium
AADGA

SEQ ID NO: 27703 - protein, 11 aa, Mycobacterium avium
AADGDTPEDTA

SEQ ID NO: 27704 - protein, 16 aa, Mycobacterium avium
AADGFRKEHGGTGDVG

SEQ ID NO: 27705 - protein, 6 aa, Mycobacterium avium
AADGTP

SEQ ID NO: 27706 - protein, 5 aa, Mycobacterium avium
AADGV

SEQ ID NO: 27707 - protein, 7 aa, Mycobacterium avium
AADINAA

SEQ ID NO: 27708 - protein, 16 aa, Mycobacterium avium
AADLPSAIDGPTIGSN

SEQ ID NO: 27709 - protein, 6 aa, Mycobacterium avium
AADPAA

SEQ ID NO: 27710 - protein, 8 aa, Mycobacterium avium
AADPASLR

SEQ ID NO: 27711 - protein, 7 aa, Mycobacterium avium
AADPDAP

SEQ ID NO: 27712 - protein, 7 aa, Mycobacterium avium
AADPERF

SEQ ID NO: 27713 - protein, 8 aa, Mycobacterium avium
AADPGRPM

SEQ ID NO: 27714 - protein, 6 aa, Mycobacterium avium
AADPMD

SEQ ID NO: 27715 - protein, 5 aa, Mycobacterium avium
AADPN

SEQ ID NO: 27716 - protein, 7 aa, Mycobacterium avium
AADPNYA

SEQ ID NO: 27717 - protein, 25 aa, Mycobacterium avium
AADPSMPISGHKQSGWGGERGRKGI

SEQ ID NO: 27718 - protein, 7 aa, Mycobacterium avium
AADQTRR

SEQ ID NO: 27719 - protein, 8 aa, Mycobacterium avium
AADRASGQ

SEQ ID NO: 27720 - protein, 6 aa, Mycobacterium avium
AADRDE

SEQ ID NO: 27721 - protein, 11 aa, Mycobacterium avium
AADRGEIDPNR

SEQ ID NO: 27722 - protein, 9 aa, Mycobacterium avium
AADRLDAEG

SEQ ID NO: 27723 - protein, 6 aa, Mycobacterium avium
AADRVE

SEQ ID NO: 27724 - protein, 8 aa, Mycobacterium avium
AADSTLEQ

SEQ ID NO: 27725 - protein, 6 aa, Mycobacterium avium
AADTAG

SEQ ID NO: 27726 - protein, 9 aa, Mycobacterium avium
AADTDEYAR

SEQ ID NO: 27727 - protein, 6 aa, Mycobacterium avium
AAEAAG

SEQ ID NO: 27728 - protein, 10 aa, Mycobacterium avium
AAEAATRSVD

SEQ ID NO: 27729 - protein, 7 aa, Mycobacterium avium
AAEADQL

SEQ ID NO: 27730 - protein, 7 aa, Mycobacterium avium
AAEAGAE

SEQ ID NO: 27731 - protein, 9 aa, Mycobacterium avium
AAEAIPADT

SEQ ID NO: 27732 - protein, 6 aa, Mycobacterium avium
AAEALK

SEQ ID NO: 27733 - protein, 9 aa, Mycobacterium avium
AAEANRRRR

SEQ ID NO: 27734 - protein, 5 aa, Mycobacterium avium
AAEAR

SEQ ID NO: 27735 - protein, 16 aa, Mycobacterium avium
AAEARGQQFDEQADAA

SEQ ID NO: 27736 - protein, 4 aa, Mycobacterium avium
AAED

SEQ ID NO: 27737 - protein, 7 aa, Mycobacterium avium
AAEDPRV

SEQ ID NO: 27738 - protein, 7 aa, Mycobacterium avium
AAEDPTL

SEQ ID NO: 27739 - protein, 6 aa, Mycobacterium avium
AAEEAP

SEQ ID NO: 27740 - protein, 12 aa, Mycobacterium avium
AAEFESQGAPRD

SEQ ID NO: 27741 - protein, 5 aa, Mycobacterium avium
AAEGA

SEQ ID NO: 27742 - protein, 7 aa, Mycobacterium avium
AAEGETI

SEQ ID NO: 27743 - protein, 4 aa, Mycobacterium avium
AAEI

SEQ ID NO: 27744 - protein, 12 aa, Mycobacterium avium
AAEKADRANPDH

SEQ ID NO: 27745 - protein, 12 aa, Mycobacterium avium
AAENMPAARRRA

SEQ ID NO: 27746 - protein, 8 aa, Mycobacterium avium
AAEPDTAA

SEQ ID NO: 27747 - protein, 12 aa, Mycobacterium avium
AAEPGGKEYGVP

SEQ ID NO: 27748 - protein, 7 aa, Mycobacterium avium
AAEPSPL

SEQ ID NO: 27749 - protein, 5 aa, Mycobacterium avium
AAEQL

SEQ ID NO: 27750 - protein, 5 aa, Mycobacterium avium
AAEQT

SEQ ID NO: 27751 - protein, 13 aa, Mycobacterium avium
AAEQVAAAAAPGD

SEQ ID NO: 27752 - protein, 31 aa, Mycobacterium avium
AAERARSRAESDPGRARDSYERDDGLQQRTG

SEQ ID NO: 27753 - protein, 17 aa, Mycobacterium avium
AAERASGFDPRAGWAGN

SEQ ID NO: 27754 - protein, 8 aa, Mycobacterium avium
AAERATGL

SEQ ID NO: 27755 - protein, 8 aa, Mycobacterium avium
AAEREHAN

SEQ ID NO: 27756 - protein, 6 aa, Mycobacterium avium
AAERGE

SEQ ID NO: 27757 - protein, 10 aa, Mycobacterium avium
AAERRANRAA

SEQ ID NO: 27758 - protein, 10 aa, Mycobacterium avium
AAERSAQAAV

SEQ ID NO: 27759 - protein, 5 aa, Mycobacterium avium
AAESG

SEQ ID NO: 27760 - protein, 13 aa, Mycobacterium avium
AAESSRAPGHSGL

SEQ ID NO: 27761 - protein, 12 aa, Mycobacterium avium
AAETAQRAFGDA

SEQ ID NO: 27762 - protein, 17 aa, Mycobacterium avium
AAETDPAPKALAAGRAW

SEQ ID NO: 27763 - protein, 5 aa, Mycobacterium avium
AAETE

SEQ ID NO: 27764 - protein, 6 aa, Mycobacterium avium
AAETER

SEQ ID NO: 27765 - protein, 8 aa, Mycobacterium avium
AAETPLSA

SEQ ID NO: 27766 - protein, 5 aa, Mycobacterium avium
AAFGG

SEQ ID NO: 27767 - protein, 18 aa, Mycobacterium avium
AAFPGGAADPTDDGPVAT

SEQ ID NO: 27768 - protein, 13 aa, Mycobacterium avium
AAFPKRLGRPEEY

SEQ ID NO: 27769 - protein, 9 aa, Mycobacterium avium
AAGADDADI

SEQ ID NO: 27770 - protein, 6 aa, Mycobacterium avium
AAGADR

SEQ ID NO: 27771 - protein, 5 aa, Mycobacterium avium
AAGAG

SEQ ID NO: 27772 - protein, 11 aa, Mycobacterium avium
AAGAGGDDEAF

SEQ ID NO: 27773 - protein, 6 aa, Mycobacterium avium
AAGAGS

SEQ ID NO: 27774 - protein, 6 aa, Mycobacterium avium
AAGAGV

SEQ ID NO: 27775 - protein, 5 aa, Mycobacterium avium
AAGAL

SEQ ID NO: 27776 - protein, 12 aa, Mycobacterium avium
AAGANDGGGSIR

SEQ ID NO: 27777 - protein, 11 aa, Mycobacterium avium
AAGARDERGWE

SEQ ID NO: 27778 - protein, 8 aa, Mycobacterium avium
AAGARRVT

SEQ ID NO: 27779 - protein, 6 aa, Mycobacterium avium
AAGARS

SEQ ID NO: 27780 - protein, 9 aa, Mycobacterium avium
AAGATGSIA

SEQ ID NO: 27781 - protein, 7 aa, Mycobacterium avium
AAGAVGT

SEQ ID NO: 27782 - protein, 5 aa, Mycobacterium avium
AAGCG

SEQ ID NO: 27783 - protein, 9 aa, Mycobacterium avium
AAGDAGTAL

SEQ ID NO: 27784 - protein, 8 aa, Mycobacterium avium
AAGDGVDG

SEQ ID NO: 27785 - protein, 7 aa, Mycobacterium avium
AAGDPEL

SEQ ID NO: 27786 - protein, 10 aa, Mycobacterium avium
AAGDSGGLCG

SEQ ID NO: 27787 - protein, 5 aa, Mycobacterium avium
AAGDT

SEQ ID NO: 27788 - protein, 9 aa, Mycobacterium avium
AAGDYPAAE

SEQ ID NO: 27789 - protein, 8 aa, Mycobacterium avium
AAGEADGQ

SEQ ID NO: 27790 - protein, 11 aa, Mycobacterium avium
AAGEGESTTDL

SEQ ID NO: 27791 - protein, 23 aa, Mycobacterium avium
AAGEGGYARELTEEERAQQQKAL

SEQ ID NO: 27792 - protein, 6 aa, Mycobacterium avium
AAGEMR

SEQ ID NO: 27793 - protein, 10 aa, Mycobacterium avium
AAGEPAPPMP

SEQ ID NO: 27794 - protein, 7 aa, Mycobacterium avium
AAGERVR

SEQ ID NO: 27795 - protein, 6 aa, Mycobacterium avium
AAGFTK

SEQ ID NO: 27796 - protein, 4 aa, Mycobacterium avium
AAGG

SEQ ID NO: 27797 - protein, 11 aa, Mycobacterium avium
AAGGAGRPAPR

SEQ ID NO: 27798 - protein, 12 aa, Mycobacterium avium
AAGGCADDAARP

SEQ ID NO: 27799 - protein, 6 aa, Mycobacterium avium
AAGGDE

SEQ ID NO: 27800 - protein, 9 aa, Mycobacterium avium
AAGGGPFAA

SEQ ID NO: 27801 - protein, 6 aa, Mycobacterium avium
AAGGQG

SEQ ID NO: 27802 - protein, 7 aa, Mycobacterium avium
AAGGRPI

SEQ ID NO: 27803 - protein, 7 aa, Mycobacterium avium
AAGGRVR

SEQ ID NO: 27804 - protein, 5 aa, Mycobacterium avium
AAGGY

SEQ ID NO: 27805 - protein, 8 aa, Mycobacterium avium
AAGHDAEQ

SEQ ID NO: 27806 - protein, 4 aa, Mycobacterium avium
AAGI

SEQ ID NO: 27807 - protein, 7 aa, Mycobacterium avium
AAGIDGP

SEQ ID NO: 27808 - protein, 5 aa, Mycobacterium avium
AAGIS

SEQ ID NO: 27809 - protein, 5 aa, Mycobacterium avium
AAGKG

SEQ ID NO: 27810 - protein, 20 aa, Mycobacterium avium
AAGLAGANSAEFDPDTPDPV

SEQ ID NO: 27811 - protein, 10 aa, Mycobacterium avium
AAGLDLGGRE

SEQ ID NO: 27812 - protein, 7 aa, Mycobacterium avium
AAGLEPS

SEQ ID NO: 27813 - protein, 10 aa, Mycobacterium avium
AAGLHGDPGR

SEQ ID NO: 27814 - protein, 9 aa, Mycobacterium avium
AAGLPGVGG

SEQ ID NO: 27815 - protein, 5 aa, Mycobacterium avium
AAGLT

SEQ ID NO: 27816 - protein, 11 aa, Mycobacterium avium
AAGNARRGVPP

SEQ ID NO: 27817 - protein, 8 aa, Mycobacterium avium
AAGNPNRP

SEQ ID NO: 27818 - protein, 19 aa, Mycobacterium avium
AAGPAAGGAPAEAAEEQSE

SEQ ID NO: 27819 - protein, 6 aa, Mycobacterium avium
AAGPAT

SEQ ID NO: 27820 - protein, 6 aa, Mycobacterium avium
AAGPER

SEQ ID NO: 27821 - protein, 6 aa, Mycobacterium avium
AAGPLD

SEQ ID NO: 27822 - protein, 7 aa, Mycobacterium avium
AAGPPVY

SEQ ID NO: 27823 - protein, 7 aa, Mycobacterium avium
AAGPQRA

SEQ ID NO: 27824 - protein, 15 aa, Mycobacterium avium
AAGPRVTAARQAADR

SEQ ID NO: 27825 - protein, 7 aa, Mycobacterium avium
AAGPYET

SEQ ID NO: 27826 - protein, 11 aa, Mycobacterium avium
AAGQAESDTAE

SEQ ID NO: 27827 - protein, 11 aa, Mycobacterium avium
AAGQGRSDDVA

SEQ ID NO: 27828 - protein, 13 aa, Mycobacterium avium
AAGQMSAGTSWRA

SEQ ID NO: 27829 - protein, 12 aa, Mycobacterium avium
AAGQRGDDHDTV

SEQ ID NO: 27830 - protein, 10 aa, Mycobacterium avium
AAGQTDVVSP

SEQ ID NO: 27831 - protein, 11 aa, Mycobacterium avium
AAGRAKRAAEL

SEQ ID NO: 27832 - protein, 17 aa, Mycobacterium avium
AAGRDAGARGAARTPKI

SEQ ID NO: 27833 - protein, 9 aa, Mycobacterium avium
AAGRDGAPQ

SEQ ID NO: 27834 - protein, 7 aa, Mycobacterium avium
AAGRDIP

SEQ ID NO: 27835 - protein, 7 aa, Mycobacterium avium
AAGRGGR

SEQ ID NO: 27836 - protein, 5 aa, Mycobacterium avium
AAGRH

SEQ ID NO: 27837 - protein, 15 aa, Mycobacterium avium
AAGRKRAESDRRARE

SEQ ID NO: 27838 - protein, 6 aa, Mycobacterium avium
AAGRPR

SEQ ID NO: 27839 - protein, 5 aa, Mycobacterium avium
AAGRR

SEQ ID NO: 27840 - protein, 23 aa, Mycobacterium avium
AAGRRIAGTPPRAIAGVPPRRVC

SEQ ID NO: 27841 - protein, 14 aa, Mycobacterium avium
AAGRRSQISDPRGR

SEQ ID NO: 27842 - protein, 13 aa, Mycobacterium avium
AAGRTDAGVHATG

SEQ ID NO: 27843 - protein, 7 aa, Mycobacterium avium
AAGRTGR

SEQ ID NO: 27844 - protein, 8 aa, Mycobacterium avium
AAGRTPGL

SEQ ID NO: 27845 - protein, 8 aa, Mycobacterium avium
AAGSDDEI

SEQ ID NO: 27846 - protein, 5 aa, Mycobacterium avium
AAGSH

SEQ ID NO: 27847 - protein, 6 aa, Mycobacterium avium
AAGSPI

SEQ ID NO: 27848 - protein, 6 aa, Mycobacterium avium
AAGSPL

SEQ ID NO: 27849 - protein, 14 aa, Mycobacterium avium
AAGSSVGKGESLRD

SEQ ID NO: 27850 - protein, 11 aa, Mycobacterium avium
AAGTGDTSGYG

SEQ ID NO: 27851 - protein, 9 aa, Mycobacterium avium
AAGTGGTVA

SEQ ID NO: 27852 - protein, 9 aa, Mycobacterium avium
AAGTHPRDR

SEQ ID NO: 27853 - protein, 6 aa, Mycobacterium avium
AAGTPV

SEQ ID NO: 27854 - protein, 13 aa, Mycobacterium avium
AAGTSDDKARADL

SEQ ID NO: 27855 - protein, 6 aa, Mycobacterium avium
AAGTTT

SEQ ID NO: 27856 - protein, 5 aa, Mycobacterium avium
AAGVP

SEQ ID NO: 27857 - protein, 9 aa, Mycobacterium avium
AAGVPSETV

SEQ ID NO: 27858 - protein, 8 aa, Mycobacterium avium
AAGVTKPD

SEQ ID NO: 27859 - protein, 6 aa, Mycobacterium avium
AAGYGM

SEQ ID NO: 27860 - protein, 6 aa, Mycobacterium avium
AAGYSA

SEQ ID NO: 27861 - protein, 5 aa, Mycobacterium avium
AAGYT

SEQ ID NO: 27862 - protein, 13 aa, Mycobacterium avium
AAHDADEAATYPR

SEQ ID NO: 27863 - protein, 10 aa, Mycobacterium avium
AAHDDPLDTA

SEQ ID NO: 27864 - protein, 6 aa, Mycobacterium avium
AAHDGR

SEQ ID NO: 27865 - protein, 4 aa, Mycobacterium avium
AAHE

SEQ ID NO: 27866 - protein, 20 aa, Mycobacterium avium
AAHEPMPARTAYSASKAGMN

SEQ ID NO: 27867 - protein, 8 aa, Mycobacterium avium
AAHESDLP

SEQ ID NO: 27868 - protein, 9 aa, Mycobacterium avium
AAHGANRTG

SEQ ID NO: 27869 - protein, 4 aa, Mycobacterium avium
AAHP

SEQ ID NO: 27870 - protein, 15 aa, Mycobacterium avium
AAHPTTGDASLPDDR

SEQ ID NO: 27871 - protein, 5 aa, Mycobacterium avium
AAHQD

SEQ ID NO: 27872 - protein, 7 aa, Mycobacterium avium
AAHTTAH

SEQ ID NO: 27873 - protein, 8 aa, Mycobacterium avium
AAIPGTAT

SEQ ID NO: 27874 - protein, 6 aa, Mycobacterium avium
AAIQTG

SEQ ID NO: 27875 - protein, 4 aa, Mycobacterium avium
AAKA

SEQ ID NO: 27876 - protein, 5 aa, Mycobacterium avium
AAKAA

SEQ ID NO: 27877 - protein, 10 aa, Mycobacterium avium
AAKAGGGSIN

SEQ ID NO: 27878 - protein, 4 aa, Mycobacterium avium
AAKE

SEQ ID NO: 27879 - protein, 7 aa, Mycobacterium avium
AAKGGHC

SEQ ID NO: 27880 - protein, 7 aa, Mycobacterium avium
AAKHPDA

SEQ ID NO: 27881 - protein, 10 aa, Mycobacterium avium
AAKKDGDTLG

SEQ ID NO: 27882 - protein, 8 aa, Mycobacterium avium
AAKPGSPV

SEQ ID NO: 27883 - protein, 7 aa, Mycobacterium avium
AAKPKIA

SEQ ID NO: 27884 - protein, 11 aa, Mycobacterium avium
AAKPPTATAGT

SEQ ID NO: 27885 - protein, 5 aa, Mycobacterium avium
AAKPV

SEQ ID NO: 27886 - protein, 5 aa, Mycobacterium avium
AAKQH

SEQ ID NO: 27887 - protein, 8 aa, Mycobacterium avium
AAKRDSAK

SEQ ID NO: 27888 - protein, 7 aa, Mycobacterium avium
AAKRLAK

SEQ ID NO: 27889 - protein, 9 aa, Mycobacterium avium
AAKRRNTVD

SEQ ID NO: 27890 - protein, 7 aa, Mycobacterium avium
AAKRTSD

SEQ ID NO: 27891 - protein, 7 aa, Mycobacterium avium
AAKSGLN

SEQ ID NO: 27892 - protein, 5 aa, Mycobacterium avium
AAKSH

SEQ ID NO: 27893 - protein, 6 aa, Mycobacterium avium
AAKTAD

SEQ ID NO: 27894 - protein, 7 aa, Mycobacterium avium
AALADSA

SEQ ID NO: 27895 - protein, 24 aa, Mycobacterium avium
AALAGDREAPRPRADHSRGKRIRQ

SEQ ID NO: 27896 - protein, 14 aa, Mycobacterium avium
AALEAGQHAGGVEE

SEQ ID NO: 27897 - protein, 4 aa, Mycobacterium avium
AALG

SEQ ID NO: 27898 - protein, 14 aa, Mycobacterium avium
AALGGNERARERHV

SEQ ID NO: 27899 - protein, 7 aa, Mycobacterium avium
AALGSGA

SEQ ID NO: 27900 - protein, 7 aa, Mycobacterium avium
AALNADA

SEQ ID NO: 27901 - protein, 7 aa, Mycobacterium avium
AALPPEK

SEQ ID NO: 27902 - protein, 7 aa, Mycobacterium avium
AALPTDP

SEQ ID NO: 27903 - protein, 8 aa, Mycobacterium avium
AALRPGQI

SEQ ID NO: 27904 - protein, 18 aa, Mycobacterium avium
AALSRYQAASSQATSPLT

SEQ ID NO: 27905 - protein, 7 aa, Mycobacterium avium
AALSSPV

SEQ ID NO: 27906 - protein, 16 aa, Mycobacterium avium
AALSTGALNGARGNSG

SEQ ID NO: 27907 - protein, 6 aa, Mycobacterium avium
AANGAI

SEQ ID NO: 27908 - protein, 8 aa, Mycobacterium avium
AANGLQGS

SEQ ID NO: 27909 - protein, 7 aa, Mycobacterium avium
AANGPLA

SEQ ID NO: 27910 - protein, 8 aa, Mycobacterium avium
AANGSNAQ

SEQ ID NO: 27911 - protein, 8 aa, Mycobacterium avium
AANKARPI

SEQ ID NO: 27912 - protein, 9 aa, Mycobacterium avium
AANLAGGGR

SEQ ID NO: 27913 - protein, 7 aa, Mycobacterium avium
AANMSPA

SEQ ID NO: 27914 - protein, 15 aa, Mycobacterium avium
AANPDVAEKIRGGKI

SEQ ID NO: 27915 - protein, 7 aa, Mycobacterium avium
AANPEGA

SEQ ID NO: 27916 - protein, 5 aa, Mycobacterium avium
AANPN

SEQ ID NO: 27917 - protein, 6 aa, Mycobacterium avium
AANPPL

SEQ ID NO: 27918 - protein, 4 aa, Mycobacterium avium
AANR

SEQ ID NO: 27919 - protein, 12 aa, Mycobacterium avium
AANRDPRRFDEP

SEQ ID NO: 27920 - protein, 10 aa, Mycobacterium avium
AANRDPRRFE

SEQ ID NO: 27921 - protein, 7 aa, Mycobacterium avium
AANRKQA

SEQ ID NO: 27922 - protein, 6 aa, Mycobacterium avium
AANRPG

SEQ ID NO: 27923 - protein, 5 aa, Mycobacterium avium
AANSR

SEQ ID NO: 27924 - protein, 6 aa, Mycobacterium avium
AANTTV

SEQ ID NO: 27925 - protein, 12 aa, Mycobacterium avium
AAPAAGPPPRRG

SEQ ID NO: 27926 - protein, 21 aa, Mycobacterium avium
AAPAASTDAATGGAEAAITPR

SEQ ID NO: 27927 - protein, 9 aa, Mycobacterium avium
AAPAGAASL

SEQ ID NO: 27928 - protein, 9 aa, Mycobacterium avium
AAPATPFNG

SEQ ID NO: 27929 - protein, 6 aa, Mycobacterium avium
AAPDAI

SEQ ID NO: 27930 - protein, 9 aa, Mycobacterium avium
AAPDGQGGY

SEQ ID NO: 27931 - protein, 8 aa, Mycobacterium avium
AAPDSRAI

SEQ ID NO: 27932 - protein, 8 aa, Mycobacterium avium
AAPDTGNM

SEQ ID NO: 27933 - protein, 7 aa, Mycobacterium avium
AAPDVGG

SEQ ID NO: 27934 - protein, 12 aa, Mycobacterium avium
AAPDWPSGHDND

SEQ ID NO: 27935 - protein, 9 aa, Mycobacterium avium
AAPDYGRDE

SEQ ID NO: 27936 - protein, 13 aa, Mycobacterium avium
AAPEHTPEPFPAE

SEQ ID NO: 27937 - protein, 9 aa, Mycobacterium avium
AAPEMPEPW

SEQ ID NO: 27938 - protein, 13 aa, Mycobacterium avium
AAPGAPPKDTRPF

SEQ ID NO: 27939 - protein, 6 aa, Mycobacterium avium
AAPGIT

SEQ ID NO: 27940 - protein, 10 aa, Mycobacterium avium
AAPGNVPSLD

SEQ ID NO: 27941 - protein, 9 aa, Mycobacterium avium
AAPGSAEPI

SEQ ID NO: 27942 - protein, 6 aa, Mycobacterium avium
AAPGSR

SEQ ID NO: 27943 - protein, 7 aa, Mycobacterium avium
AAPIPKE

SEQ ID NO: 27944 - protein, 6 aa, Mycobacterium avium
AAPIPR

SEQ ID NO: 27945 - protein, 7 aa, Mycobacterium avium
AAPKTGG

SEQ ID NO: 27946 - protein, 8 aa, Mycobacterium avium
AAPKYEAA

SEQ ID NO: 27947 - protein, 10 aa, Mycobacterium avium
AAPLRPGKGP

SEQ ID NO: 27948 - protein, 5 aa, Mycobacterium avium
AAPPK

SEQ ID NO: 27949 - protein, 5 aa, Mycobacterium avium
AAPPL

SEQ ID NO: 27950 - protein, 9 aa, Mycobacterium avium
AAPPPETAR

SEQ ID NO: 27951 - protein, 9 aa, Mycobacterium avium
AAPPPGHGP

SEQ ID NO: 27952 - protein, 9 aa, Mycobacterium avium
AAPPPPDTA

SEQ ID NO: 27953 - protein, 6 aa, Mycobacterium avium
AAPPQR

SEQ ID NO: 27954 - protein, 8 aa, Mycobacterium avium
AAPPSPEL

SEQ ID NO: 27955 - protein, 7 aa, Mycobacterium avium
AAPPWAQ

SEQ ID NO: 27956 - protein, 6 aa, Mycobacterium avium
AAPQRR

SEQ ID NO: 27957 - protein, 7 aa, Mycobacterium avium
AAPRIDH

SEQ ID NO: 27958 - protein, 13 aa, Mycobacterium avium
AAPRLAASTRDAI

SEQ ID NO: 27959 - protein, 5 aa, Mycobacterium avium
AAPRV

SEQ ID NO: 27960 - protein, 4 aa, Mycobacterium avium
AAPS

SEQ ID NO: 27961 - protein, 10 aa, Mycobacterium avium
AAPSARGHQH

SEQ ID NO: 27962 - protein, 11 aa, Mycobacterium avium
AAPTGKAAARL

SEQ ID NO: 27963 - protein, 16 aa, Mycobacterium avium
AAPTHDVTAPQGLRDD

SEQ ID NO: 27964 - protein, 17 aa, Mycobacterium avium
AAPTLSERDAAAPSLEE

SEQ ID NO: 27965 - protein, 9 aa, Mycobacterium avium
AAPTPRTRA

SEQ ID NO: 27966 - protein, 9 aa, Mycobacterium avium
AAPTTAQAQ

SEQ ID NO: 27967 - protein, 5 aa, Mycobacterium avium
AAPVD

SEQ ID NO: 27968 - protein, 9 aa, Mycobacterium avium
AAPVDDPEA

SEQ ID NO: 27969 - protein, 9 aa, Mycobacterium avium
AAQADGHVD

SEQ ID NO: 27970 - protein, 15 aa, Mycobacterium avium
AAQARGGSHEAAAGK

SEQ ID NO: 27971 - protein, 8 aa, Mycobacterium avium
AAQATTLG

SEQ ID NO: 27972 - protein, 5 aa, Mycobacterium avium
AAQDP

SEQ ID NO: 27973 - protein, 12 aa, Mycobacterium avium
AAQGEKFDPSGD

SEQ ID NO: 27974 - protein, 7 aa, Mycobacterium avium
AAQGEKP

SEQ ID NO: 27975 - protein, 10 aa, Mycobacterium avium
AAQGRSPSTE

SEQ ID NO: 27976 - protein, 10 aa, Mycobacterium avium
AAQGSSPDQY

SEQ ID NO: 27977 - protein, 8 aa, Mycobacterium avium
AAQGVGKG

SEQ ID NO: 27978 - protein, 7 aa, Mycobacterium avium
AAQIGSG

SEQ ID NO: 27979 - protein, 5 aa, Mycobacterium avium
AAQLG

SEQ ID NO: 27980 - protein, 9 aa, Mycobacterium avium
AAQNDDDEL

SEQ ID NO: 27981 - protein, 6 aa, Mycobacterium avium
AAQPGA

SEQ ID NO: 27982 - protein, 8 aa, Mycobacterium avium
AAQQNSSP

SEQ ID NO: 27983 - protein, 19 aa, Mycobacterium avium
AAQQRQKYKDKVDATLRAA

SEQ ID NO: 27984 - protein, 5 aa, Mycobacterium avium
AAQRA

SEQ ID NO: 27985 - protein, 9 aa, Mycobacterium avium
AAQRGPETA

SEQ ID NO: 27986 - protein, 10 aa, Mycobacterium avium
AAQRYSGTAD

SEQ ID NO: 27987 - protein, 5 aa, Mycobacterium avium
AAQSL

SEQ ID NO: 27988 - protein, 8 aa, Mycobacterium avium
AAQTDTAG

SEQ ID NO: 27989 - protein, 12 aa, Mycobacterium avium
AAQTGANSAPMT

SEQ ID NO: 27990 - protein, 13 aa, Mycobacterium avium
AAQTPGSIHEGGE

SEQ ID NO: 27991 - protein, 6 aa, Mycobacterium avium
AAQVPD

SEQ ID NO: 27992 - protein, 8 aa, Mycobacterium avium
AARAAGVR

SEQ ID NO: 27993 - protein, 7 aa, Mycobacterium avium
AARANDI

SEQ ID NO: 27994 - protein, 7 aa, Mycobacterium avium
AARARDA

SEQ ID NO: 27995 - protein, 18 aa, Mycobacterium avium
AARARQTATQATAAAGAY

SEQ ID NO: 27996 - protein, 10 aa, Mycobacterium avium
AARDAEDNDI

SEQ ID NO: 27997 - protein, 9 aa, Mycobacterium avium
AARDAGAEV

SEQ ID NO: 27998 - protein, 6 aa, Mycobacterium avium
AARDEA

SEQ ID NO: 27999 - protein, 7 aa, Mycobacterium avium
AARDHDP

SEQ ID NO: 28000 - protein, 9 aa, Mycobacterium avium
AARDRGADR

SEQ ID NO: 28001 - protein, 7 aa, Mycobacterium avium
AARDRVG

SEQ ID NO: 28002 - protein, 7 aa, Mycobacterium avium
AARDVGN

SEQ ID NO: 28003 - protein, 7 aa, Mycobacterium avium
AAREAIA

SEQ ID NO: 28004 - protein, 7 aa, Mycobacterium avium
AAREELS

SEQ ID NO: 28005 - protein, 5 aa, Mycobacterium avium
AAREL

SEQ ID NO: 28006 - protein, 14 aa, Mycobacterium avium
AARENAKSAREVTS

SEQ ID NO: 28007 - protein, 24 aa, Mycobacterium avium
AARENVRPSLDPAQVASLRAFAEA

SEQ ID NO: 28008 - protein, 6 aa, Mycobacterium avium
AAREPD

SEQ ID NO: 28009 - protein, 10 aa, Mycobacterium avium
AARERQRQTM

SEQ ID NO: 28010 - protein, 7 aa, Mycobacterium avium
AARGAGV

SEQ ID NO: 28011 - protein, 6 aa, Mycobacterium avium
AARGDF

SEQ ID NO: 28012 - protein, 15 aa, Mycobacterium avium
AARGLTPAGAPNEAE

SEQ ID NO: 28013 - protein, 9 aa, Mycobacterium avium
AARGQGRAH

SEQ ID NO: 28014 - protein, 14 aa, Mycobacterium avium
AARKAPGASPVTAT

SEQ ID NO: 28015 - protein, 8 aa, Mycobacterium avium
AARNQRPD

SEQ ID NO: 28016 - protein, 5 aa, Mycobacterium avium
AARNS

SEQ ID NO: 28017 - protein, 5 aa, Mycobacterium avium
AARPD

SEQ ID NO: 28018 - protein, 15 aa, Mycobacterium avium
AARPDSEVADAPRPE

SEQ ID NO: 28019 - protein, 7 aa, Mycobacterium avium
AARPGDV

SEQ ID NO: 28020 - protein, 28 aa, Mycobacterium avium
AARPGEDWGGSEQFSGDNPFGMGEGTQA

SEQ ID NO: 28021 - protein, 12 aa, Mycobacterium avium
AARPGPTHRDNR

SEQ ID NO: 28022 - protein, 9 aa, Mycobacterium avium
AARQAARYR

SEQ ID NO: 28023 - protein, 9 aa, Mycobacterium avium
AARQREGSL

SEQ ID NO: 28024 - protein, 7 aa, Mycobacterium avium
AARRAGR

SEQ ID NO: 28025 - protein, 7 aa, Mycobacterium avium
AARRARV

SEQ ID NO: 28026 - protein, 10 aa, Mycobacterium avium
AARRGTSVPD

SEQ ID NO: 28027 - protein, 8 aa, Mycobacterium avium
AARRIDDA

SEQ ID NO: 28028 - protein, 15 aa, Mycobacterium avium
AARRVPKVAGDATRL

SEQ ID NO: 28029 - protein, 10 aa, Mycobacterium avium
AARSADPGER

SEQ ID NO: 28030 - protein, 6 aa, Mycobacterium avium
AARSGV

SEQ ID NO: 28031 - protein, 11 aa, Mycobacterium avium
AARSLDTAAQT

SEQ ID NO: 28032 - protein, 7 aa, Mycobacterium avium
AARSMQK

SEQ ID NO: 28033 - protein, 12 aa, Mycobacterium avium
AARSPQAGLSAS

SEQ ID NO: 28034 - protein, 4 aa, Mycobacterium avium
AART

SEQ ID NO: 28035 - protein, 5 aa, Mycobacterium avium
AARTL

SEQ ID NO: 28036 - protein, 9 aa, Mycobacterium avium
AARTPDEEL

SEQ ID NO: 28037 - protein, 5 aa, Mycobacterium avium
AARTQ

SEQ ID NO: 28038 - protein, 8 aa, Mycobacterium avium
AARTRPWQ

SEQ ID NO: 28039 - protein, 4 aa, Mycobacterium avium
AARW

SEQ ID NO: 28040 - protein, 4 aa, Mycobacterium avium
AARY

SEQ ID NO: 28041 - protein, 5 aa, Mycobacterium avium
AARYG

SEQ ID NO: 28042 - protein, 10 aa, Mycobacterium avium
AARYGQPGKT

SEQ ID NO: 28043 - protein, 4 aa, Mycobacterium avium
AASA

SEQ ID NO: 28044 - protein, 7 aa, Mycobacterium avium
AASAAAG

SEQ ID NO: 28045 - protein, 9 aa, Mycobacterium avium
AASAAGSRL

SEQ ID NO: 28046 - protein, 17 aa, Mycobacterium avium
AASAGWATDPPPALGQH

SEQ ID NO: 28047 - protein, 12 aa, Mycobacterium avium
AASALKEKGPRF

SEQ ID NO: 28048 - protein, 14 aa, Mycobacterium avium
AASAQGAADPPPVP

SEQ ID NO: 28049 - protein, 14 aa, Mycobacterium avium
AASARAVLRSFGER

SEQ ID NO: 28050 - protein, 6 aa, Mycobacterium avium
AASASL

SEQ ID NO: 28051 - protein, 8 aa, Mycobacterium avium
AASATAAE

SEQ ID NO: 28052 - protein, 11 aa, Mycobacterium avium
AASATGEVNQR

SEQ ID NO: 28053 - protein, 4 aa, Mycobacterium avium
AASD

SEQ ID NO: 28054 - protein, 9 aa, Mycobacterium avium
AASDELADT

SEQ ID NO: 28055 - protein, 6 aa, Mycobacterium avium
AASDGR

SEQ ID NO: 28056 - protein, 9 aa, Mycobacterium avium
AASDLSPDA

SEQ ID NO: 28057 - protein, 13 aa, Mycobacterium avium
AASDPRRDGQAAA

SEQ ID NO: 28058 - protein, 8 aa, Mycobacterium avium
AASEGLSK

SEQ ID NO: 28059 - protein, 8 aa, Mycobacterium avium
AASEHEHA

SEQ ID NO: 28060 - protein, 6 aa, Mycobacterium avium
AASEHL

SEQ ID NO: 28061 - protein, 21 aa, Mycobacterium avium
AASELASRQRAMKSATDNADD

SEQ ID NO: 28062 - protein, 10 aa, Mycobacterium avium
AASGAPGTRV

SEQ ID NO: 28063 - protein, 6 aa, Mycobacterium avium
AASGDV

SEQ ID NO: 28064 - protein, 6 aa, Mycobacterium avium
AASGGY

SEQ ID NO: 28065 - protein, 12 aa, Mycobacterium avium
AASGIDPRDSAP

SEQ ID NO: 28066 - protein, 9 aa, Mycobacterium avium
AASGKAREE

SEQ ID NO: 28067 - protein, 10 aa, Mycobacterium avium
AASGPAPEFR

SEQ ID NO: 28068 - protein, 7 aa, Mycobacterium avium
AASGQGG

SEQ ID NO: 28069 - protein, 5 aa, Mycobacterium avium
AASGR

SEQ ID NO: 28070 - protein, 4 aa, Mycobacterium avium
AASH

SEQ ID NO: 28071 - protein, 5 aa, Mycobacterium avium
AASHA

SEQ ID NO: 28072 - protein, 15 aa, Mycobacterium avium
AASHEKAARATKDGL

SEQ ID NO: 28073 - protein, 6 aa, Mycobacterium avium
AASKGG

SEQ ID NO: 28074 - protein, 8 aa, Mycobacterium avium
AASKGGIQ

SEQ ID NO: 28075 - protein, 5 aa, Mycobacterium avium
AASLS

SEQ ID NO: 28076 - protein, 9 aa, Mycobacterium avium
AASLSGAAE

SEQ ID NO: 28077 - protein, 4 aa, Mycobacterium avium
AASM

SEQ ID NO: 28078 - protein, 4 aa, Mycobacterium avium
AASN

SEQ ID NO: 28079 - protein, 11 aa, Mycobacterium avium
AASNGDDALTT

SEQ ID NO: 28080 - protein, 7 aa, Mycobacterium avium
AASPDHQ

SEQ ID NO: 28081 - protein, 6 aa, Mycobacterium avium
AASPDV

SEQ ID NO: 28082 - protein, 17 aa, Mycobacterium avium
AASPVLSGGQKGPHPIQ

SEQ ID NO: 28083 - protein, 6 aa, Mycobacterium avium
AASQPL

SEQ ID NO: 28084 - protein, 16 aa, Mycobacterium avium
AASQYSTVGTHDGSHA

SEQ ID NO: 28085 - protein, 14 aa, Mycobacterium avium
AASRASSDGRPPAL

SEQ ID NO: 28086 - protein, 11 aa, Mycobacterium avium
AASREAESAFG

SEQ ID NO: 28087 - protein, 6 aa, Mycobacterium avium
AASRPL

SEQ ID NO: 28088 - protein, 10 aa, Mycobacterium avium
AASSAATTLT

SEQ ID NO: 28089 - protein, 10 aa, Mycobacterium avium
AASSGAPEAS

SEQ ID NO: 28090 - protein, 9 aa, Mycobacterium avium
AASSGATRL

SEQ ID NO: 28091 - protein, 7 aa, Mycobacterium avium
AASSGLS

SEQ ID NO: 28092 - protein, 7 aa, Mycobacterium avium
AASSPEK

SEQ ID NO: 28093 - protein, 10 aa, Mycobacterium avium
AASSPYGGEI

SEQ ID NO: 28094 - protein, 25 aa, Mycobacterium avium
AASTSKPPAAPGRKRATTAGRRGAP

SEQ ID NO: 28095 - protein, 5 aa, Mycobacterium avium
AASYI

SEQ ID NO: 28096 - protein, 7 aa, Mycobacterium avium
AATADND

SEQ ID NO: 28097 - protein, 5 aa, Mycobacterium avium
AATAE

SEQ ID NO: 28098 - protein, 5 aa, Mycobacterium avium
AATAI

SEQ ID NO: 28099 - protein, 8 aa, Mycobacterium avium
AATAPGAS

SEQ ID NO: 28100 - protein, 7 aa, Mycobacterium avium
AATAREN

SEQ ID NO: 28101 - protein, 11 aa, Mycobacterium avium
AATDEDVDAGA

SEQ ID NO: 28102 - protein, 12 aa, Mycobacterium avium
AATDGADTGCGG

SEQ ID NO: 28103 - protein, 9 aa, Mycobacterium avium
AATDGDLDP

SEQ ID NO: 28104 - protein, 11 aa, Mycobacterium avium
AATDPAASLEP

SEQ ID NO: 28105 - protein, 10 aa, Mycobacterium avium
AATDPPWETR

SEQ ID NO: 28106 - protein, 10 aa, Mycobacterium avium
AATDTPGAMG

SEQ ID NO: 28107 - protein, 4 aa, Mycobacterium avium
AATE

SEQ ID NO: 28108 - protein, 9 aa, Mycobacterium avium
AATEAAPHE

SEQ ID NO: 28109 - protein, 9 aa, Mycobacterium avium
AATENQRGQ

SEQ ID NO: 28110 - protein, 7 aa, Mycobacterium avium
AATEQAA

SEQ ID NO: 28111 - protein, 18 aa, Mycobacterium avium
AATETALKERKESVEDAV

SEQ ID NO: 28112 - protein, 5 aa, Mycobacterium avium
AATGA

SEQ ID NO: 28113 - protein, 17 aa, Mycobacterium avium
AATGATPQVAGKPAPAL

SEQ ID NO: 28114 - protein, 7 aa, Mycobacterium avium
AATGDSD

SEQ ID NO: 28115 - protein, 8 aa, Mycobacterium avium
AATGGAEQ

SEQ ID NO: 28116 - protein, 9 aa, Mycobacterium avium
AATGGGVDH

SEQ ID NO: 28117 - protein, 7 aa, Mycobacterium avium
AATGNRD

SEQ ID NO: 28118 - protein, 8 aa, Mycobacterium avium
AATGSDAN

SEQ ID NO: 28119 - protein, 6 aa, Mycobacterium avium
AATIPA

SEQ ID NO: 28120 - protein, 20 aa, Mycobacterium avium
AATKKPPGESFKDGSYDPSR

SEQ ID NO: 28121 - protein, 8 aa, Mycobacterium avium
AATLGERA

SEQ ID NO: 28122 - protein, 11 aa, Mycobacterium avium
AATLSGGEAQR

SEQ ID NO: 28123 - protein, 8 aa, Mycobacterium avium
AATNHNTR

SEQ ID NO: 28124 - protein, 6 aa, Mycobacterium avium
AATPAG

SEQ ID NO: 28125 - protein, 11 aa, Mycobacterium avium
AATPGHSFTDE

SEQ ID NO: 28126 - protein, 19 aa, Mycobacterium avium
AATPTDAAKKVVPDTAAEQ

SEQ ID NO: 28127 - protein, 11 aa, Mycobacterium avium
AATQPGAKARE

SEQ ID NO: 28128 - protein, 6 aa, Mycobacterium avium
AATQQP

SEQ ID NO: 28129 - protein, 5 aa, Mycobacterium avium
AATQR

SEQ ID NO: 28130 - protein, 12 aa, Mycobacterium avium
AATRAAAERGLT

SEQ ID NO: 28131 - protein, 5 aa, Mycobacterium avium
AATRG

SEQ ID NO: 28132 - protein, 7 aa, Mycobacterium avium
AATRLPS

SEQ ID NO: 28133 - protein, 4 aa, Mycobacterium avium
AATS

SEQ ID NO: 28134 - protein, 11 aa, Mycobacterium avium
AATSDTRESPA

SEQ ID NO: 28135 - protein, 7 aa, Mycobacterium avium
AATSGAD

SEQ ID NO: 28136 - protein, 14 aa, Mycobacterium avium
AATSNTLPEQLGEG

SEQ ID NO: 28137 - protein, 8 aa, Mycobacterium avium
AATSPKVA

SEQ ID NO: 28138 - protein, 4 aa, Mycobacterium avium
AATT

SEQ ID NO: 28139 - protein, 6 aa, Mycobacterium avium
AATTAS

SEQ ID NO: 28140 - protein, 17 aa, Mycobacterium avium
AATTTDGLGLTGRGEGL

SEQ ID NO: 28141 - protein, 5 aa, Mycobacterium avium
AATWT

SEQ ID NO: 28142 - protein, 11 aa, Mycobacterium avium
AAVDDSDDPDL

SEQ ID NO: 28143 - protein, 7 aa, Mycobacterium avium
AAVEADG

SEQ ID NO: 28144 - protein, 12 aa, Mycobacterium avium
AAVEKAAKDAGY

SEQ ID NO: 28145 - protein, 4 aa, Mycobacterium avium
AAVG

SEQ ID NO: 28146 - protein, 9 aa, Mycobacterium avium
AAVGDAELG

SEQ ID NO: 28147 - protein, 5 aa, Mycobacterium avium
AAVKG

SEQ ID NO: 28148 - protein, 4 aa, Mycobacterium avium
AAVN

SEQ ID NO: 28149 - protein, 7 aa, Mycobacterium avium
AAVPAGG

SEQ ID NO: 28150 - protein, 6 aa, Mycobacterium avium
AAVPGF

SEQ ID NO: 28151 - protein, 6 aa, Mycobacterium avium
AAVPNR

SEQ ID NO: 28152 - protein, 6 aa, Mycobacterium avium
AAVRGA

SEQ ID NO: 28153 - protein, 6 aa, Mycobacterium avium
AAVSPG

SEQ ID NO: 28154 - protein, 7 aa, Mycobacterium avium
AAVSRGS

SEQ ID NO: 28155 - protein, 9 aa, Mycobacterium avium
AAVSVNDAA

SEQ ID NO: 28156 - protein, 14 aa, Mycobacterium avium
AAVTGNGAANKAQV

SEQ ID NO: 28157 - protein, 13 aa, Mycobacterium avium
AAYERGRPSYPPE

SEQ ID NO: 28158 - protein, 9 aa, Mycobacterium avium
AAYGNEAAV

SEQ ID NO: 28159 - protein, 10 aa, Mycobacterium avium
AAYQNSPRGR

SEQ ID NO: 28160 - protein, 7 aa, Mycobacterium avium
AAYRDAA

SEQ ID NO: 28161 - protein, 5 aa, Mycobacterium avium
ACAGG

SEQ ID NO: 28162 - protein, 6 aa, Mycobacterium avium
ACDDGR

SEQ ID NO: 28163 - protein, 6 aa, Mycobacterium avium
ACEPGR

SEQ ID NO: 28164 - protein, 9 aa, Mycobacterium avium
ACGPDPDRH

SEQ ID NO: 28165 - protein, 8 aa, Mycobacterium avium
ACGSSQQA

SEQ ID NO: 28166 - protein, 9 aa, Mycobacterium avium
ACRKGNSTI

SEQ ID NO: 28167 - protein, 12 aa, Mycobacterium avium
ACSDGENSAKKS

SEQ ID NO: 28168 - protein, 8 aa, Mycobacterium avium
ACSSGSEA

SEQ ID NO: 28169 - protein, 6 aa, Mycobacterium avium
ACSTND

SEQ ID NO: 28170 - protein, 6 aa, Mycobacterium avium
ACTDRR

SEQ ID NO: 28171 - protein, 6 aa, Mycobacterium avium
ADAAAR

SEQ ID NO: 28172 - protein, 8 aa, Mycobacterium avium
ADAAGLAE

SEQ ID NO: 28173 - protein, 5 aa, Mycobacterium avium
ADAAL

SEQ ID NO: 28174 - protein, 14 aa, Mycobacterium avium
ADAAPAADTPLGRR

SEQ ID NO: 28175 - protein, 14 aa, Mycobacterium avium
ADAAPQTVPADAIP

SEQ ID NO: 28176 - protein, 9 aa, Mycobacterium avium
ADAARNRAH

SEQ ID NO: 28177 - protein, 11 aa, Mycobacterium avium
ADAASALTDAS

SEQ ID NO: 28178 - protein, 9 aa, Mycobacterium avium
ADAASTKVF

SEQ ID NO: 28179 - protein, 8 aa, Mycobacterium avium
ADAATERA

SEQ ID NO: 28180 - protein, 6 aa, Mycobacterium avium
ADAAYD

SEQ ID NO: 28181 - protein, 6 aa, Mycobacterium avium
ADADAD

SEQ ID NO: 28182 - protein, 7 aa, Mycobacterium avium
ADADAEL

SEQ ID NO: 28183 - protein, 5 aa, Mycobacterium avium
ADADD

SEQ ID NO: 28184 - protein, 8 aa, Mycobacterium avium
ADADDAVQ

SEQ ID NO: 28185 - protein, 13 aa, Mycobacterium avium
ADADDDHSDHDMG

SEQ ID NO: 28186 - protein, 5 aa, Mycobacterium avium
ADADI

SEQ ID NO: 28187 - protein, 6 aa, Mycobacterium avium
ADADLR

SEQ ID NO: 28188 - protein, 7 aa, Mycobacterium avium
ADADMTE

SEQ ID NO: 28189 - protein, 9 aa, Mycobacterium avium
ADADRDTLE

SEQ ID NO: 28190 - protein, 7 aa, Mycobacterium avium
ADADRDY

SEQ ID NO: 28191 - protein, 4 aa, Mycobacterium avium
ADAE

SEQ ID NO: 28192 - protein, 7 aa, Mycobacterium avium
ADAEAEH

SEQ ID NO: 28193 - protein, 8 aa, Mycobacterium avium
ADAEGVTK

SEQ ID NO: 28194 - protein, 8 aa, Mycobacterium avium
ADAERESL

SEQ ID NO: 28195 - protein, 6 aa, Mycobacterium avium
ADAGAD

SEQ ID NO: 28196 - protein, 6 aa, Mycobacterium avium
ADAGFA

SEQ ID NO: 28197 - protein, 9 aa, Mycobacterium avium
ADAGHGDSI

SEQ ID NO: 28198 - protein, 7 aa, Mycobacterium avium
ADAGPTL

SEQ ID NO: 28199 - protein, 8 aa, Mycobacterium avium
ADAGSGMP

SEQ ID NO: 28200 - protein, 8 aa, Mycobacterium avium
ADAGTRSQ

SEQ ID NO: 28201 - protein, 7 aa, Mycobacterium avium
ADAHSAA

SEQ ID NO: 28202 - protein, 16 aa, Mycobacterium avium
ADAPASERKAAGDKRS

SEQ ID NO: 28203 - protein, 8 aa, Mycobacterium avium
ADAPNAVA

SEQ ID NO: 28204 - protein, 6 aa, Mycobacterium avium
ADAPQR

SEQ ID NO: 28205 - protein, 6 aa, Mycobacterium avium
ADAPRP

SEQ ID NO: 28206 - protein, 6 aa, Mycobacterium avium
ADARAR

SEQ ID NO: 28207 - protein, 8 aa, Mycobacterium avium
ADARGDAG

SEQ ID NO: 28208 - protein, 10 aa, Mycobacterium avium
ADARRGRTHP

SEQ ID NO: 28209 - protein, 8 aa, Mycobacterium avium
ADASRATY

SEQ ID NO: 28210 - protein, 9 aa, Mycobacterium avium
ADASTDEGI

SEQ ID NO: 28211 - protein, 7 aa, Mycobacterium avium
ADASVDD

SEQ ID NO: 28212 - protein, 8 aa, Mycobacterium avium
ADATGADV

SEQ ID NO: 28213 - protein, 19 aa, Mycobacterium avium
ADATQESESLRERYEEAAG

SEQ ID NO: 28214 - protein, 8 aa, Mycobacterium avium
ADATTGTI

SEQ ID NO: 28215 - protein, 4 aa, Mycobacterium avium
ADAV

SEQ ID NO: 28216 - protein, 4 aa, Mycobacterium avium
ADDA

SEQ ID NO: 28217 - protein, 6 aa, Mycobacterium avium
ADDAAD

SEQ ID NO: 28218 - protein, 7 aa, Mycobacterium avium
ADDAAGA

SEQ ID NO: 28219 - protein, 9 aa, Mycobacterium avium
ADDDARDRA

SEQ ID NO: 28220 - protein, 5 aa, Mycobacterium avium
ADDDE

SEQ ID NO: 28221 - protein, 6 aa, Mycobacterium avium
ADDDEH

SEQ ID NO: 28222 - protein, 11 aa, Mycobacterium avium
ADDDGSPIDPA

SEQ ID NO: 28223 - protein, 6 aa, Mycobacterium avium
ADDEGK

SEQ ID NO: 28224 - protein, 13 aa, Mycobacterium avium
ADDERIAAAVRRL

SEQ ID NO: 28225 - protein, 11 aa, Mycobacterium avium
ADDGGSSGRLR

SEQ ID NO: 28226 - protein, 8 aa, Mycobacterium avium
ADDGSDLA

SEQ ID NO: 28227 - protein, 15 aa, Mycobacterium avium
ADDKDAFSDFVVAER

SEQ ID NO: 28228 - protein, 16 aa, Mycobacterium avium
ADDNGPEWSLYAWEPD

SEQ ID NO: 28229 - protein, 4 aa, Mycobacterium avium
ADDP

SEQ ID NO: 28230 - protein, 8 aa, Mycobacterium avium
ADDPALPT

SEQ ID NO: 28231 - protein, 12 aa, Mycobacterium avium
ADDPDRARRETR

SEQ ID NO: 28232 - protein, 9 aa, Mycobacterium avium
ADDPDRDRR

SEQ ID NO: 28233 - protein, 7 aa, Mycobacterium avium
ADDPESY

SEQ ID NO: 28234 - protein, 9 aa, Mycobacterium avium
ADDPRFDTA

SEQ ID NO: 28235 - protein, 7 aa, Mycobacterium avium
ADDPRRR

SEQ ID NO: 28236 - protein, 5 aa, Mycobacterium avium
ADDSR

SEQ ID NO: 28237 - protein, 7 aa, Mycobacterium avium
ADDTGDE

SEQ ID NO: 28238 - protein, 8 aa, Mycobacterium avium
ADDYQDKA

SEQ ID NO: 28239 - protein, 7 aa, Mycobacterium avium
ADEAGAR

SEQ ID NO: 28240 - protein, 11 aa, Mycobacterium avium
ADEARAAGRDV

SEQ ID NO: 28241 - protein, 5 aa, Mycobacterium avium
ADEDA

SEQ ID NO: 28242 - protein, 9 aa, Mycobacterium avium
ADEEDGRCS

SEQ ID NO: 28243 - protein, 8 aa, Mycobacterium avium
ADEERGLG

SEQ ID NO: 28244 - protein, 6 aa, Mycobacterium avium
ADEETV

SEQ ID NO: 28245 - protein, 4 aa, Mycobacterium avium
ADEF

SEQ ID NO: 28246 - protein, 4 aa, Mycobacterium avium
ADEG

SEQ ID NO: 28247 - protein, 16 aa, Mycobacterium avium
ADEGPTAKRIRPRAQG

SEQ ID NO: 28248 - protein, 17 aa, Mycobacterium avium
ADEGRKDDIAFLREHTK

SEQ ID NO: 28249 - protein, 12 aa, Mycobacterium avium
ADEGVRRGSSVE

SEQ ID NO: 28250 - protein, 21 aa, Mycobacterium avium
ADEITAANNDDGVGRVLERWW

SEQ ID NO: 28251 - protein, 11 aa, Mycobacterium avium
ADENARARLAQ

SEQ ID NO: 28252 - protein, 7 aa, Mycobacterium avium
ADEPGTI

SEQ ID NO: 28253 - protein, 10 aa, Mycobacterium avium
ADEPPDYQTA

SEQ ID NO: 28254 - protein, 13 aa, Mycobacterium avium
ADESPVGDDPAVT

SEQ ID NO: 28255 - protein, 6 aa, Mycobacterium avium
ADETFD

SEQ ID NO: 28256 - protein, 7 aa, Mycobacterium avium
ADETTGT

SEQ ID NO: 28257 - protein, 8 aa, Mycobacterium avium
ADEWQSGQ

SEQ ID NO: 28258 - protein, 5 aa, Mycobacterium avium
ADEYR

SEQ ID NO: 28259 - protein, 6 aa, Mycobacterium avium
ADFGAR

SEQ ID NO: 28260 - protein, 5 aa, Mycobacterium avium
ADGAD

SEQ ID NO: 28261 - protein, 12 aa, Mycobacterium avium
ADGAEKRPATPI

SEQ ID NO: 28262 - protein, 9 aa, Mycobacterium avium
ADGANDARD

SEQ ID NO: 28263 - protein, 7 aa, Mycobacterium avium
ADGARVQ

SEQ ID NO: 28264 - protein, 5 aa, Mycobacterium avium
ADGAS

SEQ ID NO: 28265 - protein, 8 aa, Mycobacterium avium
ADGASLTE

SEQ ID NO: 28266 - protein, 14 aa, Mycobacterium avium
ADGAVSDVVLHRLT

SEQ ID NO: 28267 - protein, 5 aa, Mycobacterium avium
ADGDA

SEQ ID NO: 28268 - protein, 9 aa, Mycobacterium avium
ADGDGPLAG

SEQ ID NO: 28269 - protein, 17 aa, Mycobacterium avium
ADGDTPYPAAVGRGDRG

SEQ ID NO: 28270 - protein, 8 aa, Mycobacterium avium
ADGEGRYI

SEQ ID NO: 28271 - protein, 17 aa, Mycobacterium avium
ADGEHLAEARSAARELS

SEQ ID NO: 28272 - protein, 12 aa, Mycobacterium avium
ADGEKACAAAGR

SEQ ID NO: 28273 - protein, 9 aa, Mycobacterium avium
ADGEPTEDQ

SEQ ID NO: 28274 - protein, 7 aa, Mycobacterium avium
ADGEQEK

SEQ ID NO: 28275 - protein, 7 aa, Mycobacterium avium
ADGERGW

SEQ ID NO: 28276 - protein, 11 aa, Mycobacterium avium
ADGGAESPQET

SEQ ID NO: 28277 - protein, 8 aa, Mycobacterium avium
ADGGGGSI

SEQ ID NO: 28278 - protein, 6 aa, Mycobacterium avium
ADGGPL

SEQ ID NO: 28279 - protein, 6 aa, Mycobacterium avium
ADGGTA

SEQ ID NO: 28280 - protein, 9 aa, Mycobacterium avium
ADGGTRTAA

SEQ ID NO: 28281 - protein, 9 aa, Mycobacterium avium
ADGGVALPP

SEQ ID NO: 28282 - protein, 5 aa, Mycobacterium avium
ADGHQ

SEQ ID NO: 28283 - protein, 7 aa, Mycobacterium avium
ADGIAPG

SEQ ID NO: 28284 - protein, 5 aa, Mycobacterium avium
ADGKL

SEQ ID NO: 28285 - protein, 11 aa, Mycobacterium avium
ADGKTALERGD

SEQ ID NO: 28286 - protein, 4 aa, Mycobacterium avium
ADGL

SEQ ID NO: 28287 - protein, 5 aa, Mycobacterium avium
ADGLG

SEQ ID NO: 28288 - protein, 8 aa, Mycobacterium avium
ADGLRRGD

SEQ ID NO: 28289 - protein, 13 aa, Mycobacterium avium
ADGMYDDESPGAG

SEQ ID NO: 28290 - protein, 11 aa, Mycobacterium avium
ADGNPVPQGEV

SEQ ID NO: 28291 - protein, 6 aa, Mycobacterium avium
ADGPAL

SEQ ID NO: 28292 - protein, 10 aa, Mycobacterium avium
ADGPDKGKVR

SEQ ID NO: 28293 - protein, 7 aa, Mycobacterium avium
ADGPQPV

SEQ ID NO: 28294 - protein, 9 aa, Mycobacterium avium
ADGPSDALA

SEQ ID NO: 28295 - protein, 8 aa, Mycobacterium avium
ADGPTEAH

SEQ ID NO: 28296 - protein, 5 aa, Mycobacterium avium
ADGPV

SEQ ID NO: 28297 - protein, 7 aa, Mycobacterium avium
ADGQAFR

SEQ ID NO: 28298 - protein, 6 aa, Mycobacterium avium
ADGQPD

SEQ ID NO: 28299 - protein, 5 aa, Mycobacterium avium
ADGRA

SEQ ID NO: 28300 - protein, 8 aa, Mycobacterium avium
ADGRADEA

SEQ ID NO: 28301 - protein, 7 aa, Mycobacterium avium
ADGRATI

SEQ ID NO: 28302 - protein, 6 aa, Mycobacterium avium
ADGRFE

SEQ ID NO: 28303 - protein, 9 aa, Mycobacterium avium
ADGRPPLDK

SEQ ID NO: 28304 - protein, 9 aa, Mycobacterium avium
ADGRPPLER

SEQ ID NO: 28305 - protein, 5 aa, Mycobacterium avium
ADGRQ

SEQ ID NO: 28306 - protein, 7 aa, Mycobacterium avium
ADGRRSR

SEQ ID NO: 28307 - protein, 6 aa, Mycobacterium avium
ADGSAM

SEQ ID NO: 28308 - protein, 21 aa, Mycobacterium avium
ADGSEAGGLATAEAAETIDAT

SEQ ID NO: 28309 - protein, 9 aa, Mycobacterium avium
ADGSEYRGR

SEQ ID NO: 28310 - protein, 9 aa, Mycobacterium avium
ADGSHAPEQ

SEQ ID NO: 28311 - protein, 9 aa, Mycobacterium avium
ADGSLQPAS

SEQ ID NO: 28312 - protein, 9 aa, Mycobacterium avium
ADGSNADPV

SEQ ID NO: 28313 - protein, 6 aa, Mycobacterium avium
ADGSSV

SEQ ID NO: 28314 - protein, 8 aa, Mycobacterium avium
ADGTEAPA

SEQ ID NO: 28315 - protein, 7 aa, Mycobacterium avium
ADGTELA

SEQ ID NO: 28316 - protein, 7 aa, Mycobacterium avium
ADGTHRP

SEQ ID NO: 28317 - protein, 14 aa, Mycobacterium avium
ADGTKFGKSTGGGS

SEQ ID NO: 28318 - protein, 6 aa, Mycobacterium avium
ADGTPV

SEQ ID NO: 28319 - protein, 19 aa, Mycobacterium avium
ADGTPVTKAQLGDPGAFTG

SEQ ID NO: 28320 - protein, 13 aa, Mycobacterium avium
ADGTSAKALTGID

SEQ ID NO: 28321 - protein, 8 aa, Mycobacterium avium
ADHDQPHA

SEQ ID NO: 28322 - protein, 11 aa, Mycobacterium avium
ADHDRTNVHGS

SEQ ID NO: 28323 - protein, 14 aa, Mycobacterium avium
ADHGGYRSVVGASS

SEQ ID NO: 28324 - protein, 4 aa, Mycobacterium avium
ADHP

SEQ ID NO: 28325 - protein, 10 aa, Mycobacterium avium
ADHPARSEQD

SEQ ID NO: 28326 - protein, 6 aa, Mycobacterium avium
ADHPAT

SEQ ID NO: 28327 - protein, 6 aa, Mycobacterium avium
ADHPDV

SEQ ID NO: 28328 - protein, 12 aa, Mycobacterium avium
ADHSINRLRLRK

SEQ ID NO: 28329 - protein, 6 aa, Mycobacterium avium
ADIAAG

SEQ ID NO: 28330 - protein, 8 aa, Mycobacterium avium
ADIDDAAK

SEQ ID NO: 28331 - protein, 17 aa, Mycobacterium avium
ADIDPEDLEDSDPFEEG

SEQ ID NO: 28332 - protein, 12 aa, Mycobacterium avium
ADIERNPRQPRQ

SEQ ID NO: 28333 - protein, 7 aa, Mycobacterium avium
ADIRPGQ

SEQ ID NO: 28334 - protein, 5 aa, Mycobacterium avium
ADKDA

SEQ ID NO: 28335 - protein, 6 aa, Mycobacterium avium
ADKGVD

SEQ ID NO: 28336 - protein, 22 aa, Mycobacterium avium
ADKPEKAAAPAGDPTGGMGGMD

SEQ ID NO: 28337 - protein, 7 aa, Mycobacterium avium
ADKTAPR

SEQ ID NO: 28338 - protein, 12 aa, Mycobacterium avium
ADKVRGGYYTPA

SEQ ID NO: 28339 - protein, 8 aa, Mycobacterium avium
ADLAESNL

SEQ ID NO: 28340 - protein, 9 aa, Mycobacterium avium
ADLDTAREV

SEQ ID NO: 28341 - protein, 8 aa, Mycobacterium avium
ADLGDEDA

SEQ ID NO: 28342 - protein, 6 aa, Mycobacterium avium
ADLGGT

SEQ ID NO: 28343 - protein, 4 aa, Mycobacterium avium
ADLP

SEQ ID NO: 28344 - protein, 8 aa, Mycobacterium avium
ADLPGLDA

SEQ ID NO: 28345 - protein, 9 aa, Mycobacterium avium
ADLPGQNDV

SEQ ID NO: 28346 - protein, 5 aa, Mycobacterium avium
ADLPN

SEQ ID NO: 28347 - protein, 7 aa, Mycobacterium avium
ADLPPGA

SEQ ID NO: 28348 - protein, 6 aa, Mycobacterium avium
ADLRPG

SEQ ID NO: 28349 - protein, 7 aa, Mycobacterium avium
ADLSTPV

SEQ ID NO: 28350 - protein, 7 aa, Mycobacterium avium
ADLTNRS

SEQ ID NO: 28351 - protein, 6 aa, Mycobacterium avium
ADLYGR

SEQ ID NO: 28352 - protein, 6 aa, Mycobacterium avium
ADMKSG

SEQ ID NO: 28353 - protein, 8 aa, Mycobacterium avium
ADNASSAG

SEQ ID NO: 28354 - protein, 5 aa, Mycobacterium avium
ADNPG

SEQ ID NO: 28355 - protein, 6 aa, Mycobacterium avium
ADNPGR

SEQ ID NO: 28356 - protein, 20 aa, Mycobacterium avium
ADNRTRPGVARGECTDPPTT

SEQ ID NO: 28357 - protein, 6 aa, Mycobacterium avium
ADNSPH

SEQ ID NO: 28358 - protein, 5 aa, Mycobacterium avium
ADPAH

SEQ ID NO: 28359 - protein, 5 aa, Mycobacterium avium
ADPAL

SEQ ID NO: 28360 - protein, 16 aa, Mycobacterium avium
ADPAPPPQVNHGPDAV

SEQ ID NO: 28361 - protein, 7 aa, Mycobacterium avium
ADPAQGL

SEQ ID NO: 28362 - protein, 6 aa, Mycobacterium avium
ADPARR

SEQ ID NO: 28363 - protein, 7 aa, Mycobacterium avium
ADPASAH

SEQ ID NO: 28364 - protein, 5 aa, Mycobacterium avium
ADPDA

SEQ ID NO: 28365 - protein, 11 aa, Mycobacterium avium
ADPDADEARMR

SEQ ID NO: 28366 - protein, 6 aa, Mycobacterium avium
ADPDAI

SEQ ID NO: 28367 - protein, 9 aa, Mycobacterium avium
ADPDDLART

SEQ ID NO: 28368 - protein, 7 aa, Mycobacterium avium
ADPDPPG

SEQ ID NO: 28369 - protein, 7 aa, Mycobacterium avium
ADPDRGA

SEQ ID NO: 28370 - protein, 7 aa, Mycobacterium avium
ADPEAVD

SEQ ID NO: 28371 - protein, 15 aa, Mycobacterium avium
ADPEGSVYSGGTGRP

SEQ ID NO: 28372 - protein, 14 aa, Mycobacterium avium
ADPEQRLRGGERSF

SEQ ID NO: 28373 - protein, 5 aa, Mycobacterium avium
ADPER

SEQ ID NO: 28374 - protein, 5 aa, Mycobacterium avium
ADPEV

SEQ ID NO: 28375 - protein, 16 aa, Mycobacterium avium
ADPEVVAGRRNLANAL

SEQ ID NO: 28376 - protein, 7 aa, Mycobacterium avium
ADPEYPA

SEQ ID NO: 28377 - protein, 7 aa, Mycobacterium avium
ADPGGPV

SEQ ID NO: 28378 - protein, 5 aa, Mycobacterium avium
ADPGH

SEQ ID NO: 28379 - protein, 9 aa, Mycobacterium avium
ADPGPPKAL

SEQ ID NO: 28380 - protein, 10 aa, Mycobacterium avium
ADPHSDNPFG

SEQ ID NO: 28381 - protein, 5 aa, Mycobacterium avium
ADPHV

SEQ ID NO: 28382 - protein, 7 aa, Mycobacterium avium
ADPKTEL

SEQ ID NO: 28383 - protein, 4 aa, Mycobacterium avium
ADPL

SEQ ID NO: 28384 - protein, 5 aa, Mycobacterium avium
ADPLD

SEQ ID NO: 28385 - protein, 7 aa, Mycobacterium avium
ADPMAKD

SEQ ID NO: 28386 - protein, 6 aa, Mycobacterium avium
ADPNSW

SEQ ID NO: 28387 - protein, 11 aa, Mycobacterium avium
ADPPDEAGSLP

SEQ ID NO: 28388 - protein, 6 aa, Mycobacterium avium
ADPPHV

SEQ ID NO: 28389 - protein, 8 aa, Mycobacterium avium
ADPPMTKD

SEQ ID NO: 28390 - protein, 5 aa, Mycobacterium avium
ADPPV

SEQ ID NO: 28391 - protein, 10 aa, Mycobacterium avium
ADPQEYGKEI

SEQ ID NO: 28392 - protein, 6 aa, Mycobacterium avium
ADPQQW

SEQ ID NO: 28393 - protein, 5 aa, Mycobacterium avium
ADPQV

SEQ ID NO: 28394 - protein, 8 aa, Mycobacterium avium
ADPRVSTA

SEQ ID NO: 28395 - protein, 7 aa, Mycobacterium avium
ADPSDPF

SEQ ID NO: 28396 - protein, 14 aa, Mycobacterium avium
ADPSQQLPRLSGEE

SEQ ID NO: 28397 - protein, 10 aa, Mycobacterium avium
ADPSRSAGGI

SEQ ID NO: 28398 - protein, 9 aa, Mycobacterium avium
ADPSTSQGR

SEQ ID NO: 28399 - protein, 6 aa, Mycobacterium avium
ADPTEI

SEQ ID NO: 28400 - protein, 12 aa, Mycobacterium avium
ADPTPEGHPDPL

SEQ ID NO: 28401 - protein, 16 aa, Mycobacterium avium
ADPTSKMSKSASTDAG

SEQ ID NO: 28402 - protein, 6 aa, Mycobacterium avium
ADPTTA

SEQ ID NO: 28403 - protein, 4 aa, Mycobacterium avium
ADPV

SEQ ID NO: 28404 - protein, 5 aa, Mycobacterium avium
ADPVP

SEQ ID NO: 28405 - protein, 8 aa, Mycobacterium avium
ADPVRGPR

SEQ ID NO: 28406 - protein, 10 aa, Mycobacterium avium
ADQAAAESTD

SEQ ID NO: 28407 - protein, 5 aa, Mycobacterium avium
ADQAD

SEQ ID NO: 28408 - protein, 16 aa, Mycobacterium avium
ADQATAKLQAAISALA

SEQ ID NO: 28409 - protein, 5 aa, Mycobacterium avium
ADQIA

SEQ ID NO: 28410 - protein, 5 aa, Mycobacterium avium
ADQLE

SEQ ID NO: 28411 - protein, 8 aa, Mycobacterium avium
ADQPDRVR

SEQ ID NO: 28412 - protein, 14 aa, Mycobacterium avium
ADQRATLIGQDMDC

SEQ ID NO: 28413 - protein, 6 aa, Mycobacterium avium
ADQTVQ

SEQ ID NO: 28414 - protein, 4 aa, Mycobacterium avium
ADQV

SEQ ID NO: 28415 - protein, 8 aa, Mycobacterium avium
ADRAAAIQ

SEQ ID NO: 28416 - protein, 11 aa, Mycobacterium avium
ADRAGNGGAIR

SEQ ID NO: 28417 - protein, 6 aa, Mycobacterium avium
ADRAGR

SEQ ID NO: 28418 - protein, 5 aa, Mycobacterium avium
ADRAV

SEQ ID NO: 28419 - protein, 6 aa, Mycobacterium avium
ADRDEA

SEQ ID NO: 28420 - protein, 6 aa, Mycobacterium avium
ADRDKD

SEQ ID NO: 28421 - protein, 5 aa, Mycobacterium avium
ADREA

SEQ ID NO: 28422 - protein, 24 aa, Mycobacterium avium
ADREDQVREAAQSCPEQAIMITDD

SEQ ID NO: 28423 - protein, 7 aa, Mycobacterium avium
ADREGRK

SEQ ID NO: 28424 - protein, 5 aa, Mycobacterium avium
ADRGG

SEQ ID NO: 28425 - protein, 13 aa, Mycobacterium avium
ADRGIEEEGNPAQ

SEQ ID NO: 28426 - protein, 5 aa, Mycobacterium avium
ADRGS

SEQ ID NO: 28427 - protein, 5 aa, Mycobacterium avium
ADRGV

SEQ ID NO: 28428 - protein, 4 aa, Mycobacterium avium
ADRK

SEQ ID NO: 28429 - protein, 5 aa, Mycobacterium avium
ADRPA

SEQ ID NO: 28430 - protein, 7 aa, Mycobacterium avium
ADRPALG

SEQ ID NO: 28431 - protein, 8 aa, Mycobacterium avium
ADRPGARV

SEQ ID NO: 28432 - protein, 8 aa, Mycobacterium avium
ADRPPLPP

SEQ ID NO: 28433 - protein, 12 aa, Mycobacterium avium
ADRPYQAEVARQ

SEQ ID NO: 28434 - protein, 13 aa, Mycobacterium avium
ADRQAADPNLSGP

SEQ ID NO: 28435 - protein, 5 aa, Mycobacterium avium
ADRRA

SEQ ID NO: 28436 - protein, 6 aa, Mycobacterium avium
ADRRPG

SEQ ID NO: 28437 - protein, 16 aa, Mycobacterium avium
ADRSSLRQLHAAIKAA

SEQ ID NO: 28438 - protein, 8 aa, Mycobacterium avium
ADRTDAPV

SEQ ID NO: 28439 - protein, 13 aa, Mycobacterium avium
ADRTQAPSGAGYA

SEQ ID NO: 28440 - protein, 8 aa, Mycobacterium avium
ADSARSAH

SEQ ID NO: 28441 - protein, 5 aa, Mycobacterium avium
ADSAS

SEQ ID NO: 28442 - protein, 14 aa, Mycobacterium avium
ADSAVRKKGNDFAT

SEQ ID NO: 28443 - protein, 7 aa, Mycobacterium avium
ADSDPAV

SEQ ID NO: 28444 - protein, 13 aa, Mycobacterium avium
ADSFGPPSISTKE

SEQ ID NO: 28445 - protein, 4 aa, Mycobacterium avium
ADSG

SEQ ID NO: 28446 - protein, 5 aa, Mycobacterium avium
ADSGA

SEQ ID NO: 28447 - protein, 5 aa, Mycobacterium avium
ADSGL

SEQ ID NO: 28448 - protein, 7 aa, Mycobacterium avium
ADSIADG

SEQ ID NO: 28449 - protein, 10 aa, Mycobacterium avium
ADSPAADELD

SEQ ID NO: 28450 - protein, 8 aa, Mycobacterium avium
ADSPFGGF

SEQ ID NO: 28451 - protein, 6 aa, Mycobacterium avium
ADSPKL

SEQ ID NO: 28452 - protein, 5 aa, Mycobacterium avium
ADSPL

SEQ ID NO: 28453 - protein, 6 aa, Mycobacterium avium
ADSSGC

SEQ ID NO: 28454 - protein, 15 aa, Mycobacterium avium
ADSTLTPRPQPAEGV

SEQ ID NO: 28455 - protein, 12 aa, Mycobacterium avium
ADSTPPADWERP

SEQ ID NO: 28456 - protein, 8 aa, Mycobacterium avium
ADTAESYE

SEQ ID NO: 28457 - protein, 7 aa, Mycobacterium avium
ADTAETA

SEQ ID NO: 28458 - protein, 11 aa, Mycobacterium avium
ADTAGKPSLGW

SEQ ID NO: 28459 - protein, 6 aa, Mycobacterium avium
ADTARG

SEQ ID NO: 28460 - protein, 6 aa, Mycobacterium avium
ADTARQ

SEQ ID NO: 28461 - protein, 6 aa, Mycobacterium avium
ADTDRR

SEQ ID NO: 28462 - protein, 14 aa, Mycobacterium avium
ADTERQRAQGKLAP

SEQ ID NO: 28463 - protein, 6 aa, Mycobacterium avium
ADTESL

SEQ ID NO: 28464 - protein, 8 aa, Mycobacterium avium
ADTGTQSG

SEQ ID NO: 28465 - protein, 9 aa, Mycobacterium avium
ADTGYSDQA

SEQ ID NO: 28466 - protein, 8 aa, Mycobacterium avium
ADTIGETD

SEQ ID NO: 28467 - protein, 5 aa, Mycobacterium avium
ADTLT

SEQ ID NO: 28468 - protein, 7 aa, Mycobacterium avium
ADTPLKG

SEQ ID NO: 28469 - protein, 9 aa, Mycobacterium avium
ADTQPGDAK

SEQ ID NO: 28470 - protein, 7 aa, Mycobacterium avium
ADTTGAG

SEQ ID NO: 28471 - protein, 7 aa, Mycobacterium avium
ADTTPKG

SEQ ID NO: 28472 - protein, 7 aa, Mycobacterium avium
ADTVADA

SEQ ID NO: 28473 - protein, 7 aa, Mycobacterium avium
ADTVTTR

SEQ ID NO: 28474 - protein, 6 aa, Mycobacterium avium
ADTYSQ

SEQ ID NO: 28475 - protein, 12 aa, Mycobacterium avium
ADVDENSRFPQE

SEQ ID NO: 28476 - protein, 27 aa, Mycobacterium avium
ADVDGAARAVEASGGGIVKGPYDDAHE

SEQ ID NO: 28477 - protein, 9 aa, Mycobacterium avium
ADVEAAGGK

SEQ ID NO: 28478 - protein, 6 aa, Mycobacterium avium
ADVELG

SEQ ID NO: 28479 - protein, 7 aa, Mycobacterium avium
ADVRGGN

SEQ ID NO: 28480 - protein, 6 aa, Mycobacterium avium
ADVSPS

SEQ ID NO: 28481 - protein, 8 aa, Mycobacterium avium
ADVTEEPP

SEQ ID NO: 28482 - protein, 7 aa, Mycobacterium avium
ADYAATG

SEQ ID NO: 28483 - protein, 7 aa, Mycobacterium avium
ADYGGDP

SEQ ID NO: 28484 - protein, 8 aa, Mycobacterium avium
ADYPGASD

SEQ ID NO: 28485 - protein, 17 aa, Mycobacterium avium
AEAAADHARGLTQRDGD

SEQ ID NO: 28486 - protein, 12 aa, Mycobacterium avium
AEAADTDAYDDA

SEQ ID NO: 28487 - protein, 9 aa, Mycobacterium avium
AEAADTLSA

SEQ ID NO: 28488 - protein, 6 aa, Mycobacterium avium
AEAAEA

SEQ ID NO: 28489 - protein, 8 aa, Mycobacterium avium
AEAAGAAL

SEQ ID NO: 28490 - protein, 31 aa, Mycobacterium avium
AEAAGHAGGEQSPGNGAPAEKAGGSLASDAQ

SEQ ID NO: 28491 - protein, 5 aa, Mycobacterium avium
AEAAK

SEQ ID NO: 28492 - protein, 12 aa, Mycobacterium avium
AEAARAGLSPDE

SEQ ID NO: 28493 - protein, 6 aa, Mycobacterium avium
AEAAYR

SEQ ID NO: 28494 - protein, 8 aa, Mycobacterium avium
AEADAHEN

SEQ ID NO: 28495 - protein, 6 aa, Mycobacterium avium
AEADPA

SEQ ID NO: 28496 - protein, 4 aa, Mycobacterium avium
AEAE

SEQ ID NO: 28497 - protein, 8 aa, Mycobacterium avium
AEAEKTRK

SEQ ID NO: 28498 - protein, 10 aa, Mycobacterium avium
AEAEPDLKPR

SEQ ID NO: 28499 - protein, 6 aa, Mycobacterium avium
AEAERR

SEQ ID NO: 28500 - protein, 5 aa, Mycobacterium avium
AEAGA

SEQ ID NO: 28501 - protein, 13 aa, Mycobacterium avium
AEAGAGSEEPLPQ

SEQ ID NO: 28502 - protein, 9 aa, Mycobacterium avium
AEAGDEFGV

SEQ ID NO: 28503 - protein, 8 aa, Mycobacterium avium
AEAGESVT

SEQ ID NO: 28504 - protein, 8 aa, Mycobacterium avium
AEAGGDPW

SEQ ID NO: 28505 - protein, 7 aa, Mycobacterium avium
AEAGKQA

SEQ ID NO: 28506 - protein, 10 aa, Mycobacterium avium
AEAGNPPTRH

SEQ ID NO: 28507 - protein, 8 aa, Mycobacterium avium
AEAGRSAA

SEQ ID NO: 28508 - protein, 4 aa, Mycobacterium avium
AEAH

SEQ ID NO: 28509 - protein, 16 aa, Mycobacterium avium
AEAIPTKSYDNAEGFE

SEQ ID NO: 28510 - protein, 10 aa, Mycobacterium avium
AEANEGAGRF

SEQ ID NO: 28511 - protein, 13 aa, Mycobacterium avium
AEAPHSAATHDTT

SEQ ID NO: 28512 - protein, 6 aa, Mycobacterium avium
AEAQAE

SEQ ID NO: 28513 - protein, 9 aa, Mycobacterium avium
AEAQAEAES

SEQ ID NO: 28514 - protein, 10 aa, Mycobacterium avium
AEAQKAGAAR

SEQ ID NO: 28515 - protein, 11 aa, Mycobacterium avium
AEAQKAGAQEI

SEQ ID NO: 28516 - protein, 11 aa, Mycobacterium avium
AEAQRNADPVL

SEQ ID NO: 28517 - protein, 8 aa, Mycobacterium avium
AEARAEAD

SEQ ID NO: 28518 - protein, 10 aa, Mycobacterium avium
AEARAGREAI

SEQ ID NO: 28519 - protein, 6 aa, Mycobacterium avium
AEARQG

SEQ ID NO: 28520 - protein, 16 aa, Mycobacterium avium
AEARQGSQSLADGKAT

SEQ ID NO: 28521 - protein, 7 aa, Mycobacterium avium
AEARQRF

SEQ ID NO: 28522 - protein, 16 aa, Mycobacterium avium
AEARREKESAIDAQDF

SEQ ID NO: 28523 - protein, 8 aa, Mycobacterium avium
AEARSPEL

SEQ ID NO: 28524 - protein, 4 aa, Mycobacterium avium
AEAS

SEQ ID NO: 28525 - protein, 23 aa, Mycobacterium avium
AEASDLGYAEADPTADVEGYDAA

SEQ ID NO: 28526 - protein, 5 aa, Mycobacterium avium
AEASE

SEQ ID NO: 28527 - protein, 23 aa, Mycobacterium avium
AEASGALKPGGTIVEPTSGNTGV

SEQ ID NO: 28528 - protein, 11 aa, Mycobacterium avium
AEASRADRERY

SEQ ID NO: 28529 - protein, 8 aa, Mycobacterium avium
AEASRAEL

SEQ ID NO: 28530 - protein, 9 aa, Mycobacterium avium
AEATAETIT

SEQ ID NO: 28531 - protein, 6 aa, Mycobacterium avium
AEAVEN

SEQ ID NO: 28532 - protein, 7 aa, Mycobacterium avium
AEDAGAD

SEQ ID NO: 28533 - protein, 5 aa, Mycobacterium avium
AEDDD

SEQ ID NO: 28534 - protein, 7 aa, Mycobacterium avium
AEDDPTK

SEQ ID NO: 28535 - protein, 7 aa, Mycobacterium avium
AEDFPRS

SEQ ID NO: 28536 - protein, 15 aa, Mycobacterium avium
AEDGGWDGVAGNPPY

SEQ ID NO: 28537 - protein, 23 aa, Mycobacterium avium
AEDGNAGTGERSVTAAAAPVQPG

SEQ ID NO: 28538 - protein, 11 aa, Mycobacterium avium
AEDGTAESTGV

SEQ ID NO: 28539 - protein, 19 aa, Mycobacterium avium
AEDGTDERSAVDGAEAAAR

SEQ ID NO: 28540 - protein, 15 aa, Mycobacterium avium
AEDLETARAAGTPSA

SEQ ID NO: 28541 - protein, 5 aa, Mycobacterium avium
AEDPE

SEQ ID NO: 28542 - protein, 5 aa, Mycobacterium avium
AEDPH

SEQ ID NO: 28543 - protein, 6 aa, Mycobacterium avium
AEDPKV

SEQ ID NO: 28544 - protein, 9 aa, Mycobacterium avium
AEDPPAKAR

SEQ ID NO: 28545 - protein, 6 aa, Mycobacterium avium
AEDPRA

SEQ ID NO: 28546 - protein, 5 aa, Mycobacterium avium
AEDRR

SEQ ID NO: 28547 - protein, 7 aa, Mycobacterium avium
AEDRRAL

SEQ ID NO: 28548 - protein, 7 aa, Mycobacterium avium
AEDTPAG

SEQ ID NO: 28549 - protein, 6 aa, Mycobacterium avium
AEEAAA

SEQ ID NO: 28550 - protein, 6 aa, Mycobacterium avium
AEEDPT

SEQ ID NO: 28551 - protein, 5 aa, Mycobacterium avium
AEEGL

SEQ ID NO: 28552 - protein, 9 aa, Mycobacterium avium
AEEGVDPSP

SEQ ID NO: 28553 - protein, 9 aa, Mycobacterium avium
AEELAKSDD

SEQ ID NO: 28554 - protein, 6 aa, Mycobacterium avium
AEENRH

SEQ ID NO: 28555 - protein, 6 aa, Mycobacterium avium
AEEPRL

SEQ ID NO: 28556 - protein, 19 aa, Mycobacterium avium
AEEQASAEASADRASQIRT

SEQ ID NO: 28557 - protein, 4 aa, Mycobacterium avium
AEER

SEQ ID NO: 28558 - protein, 16 aa, Mycobacterium avium
AEERGYTATKHQREVG

SEQ ID NO: 28559 - protein, 14 aa, Mycobacterium avium
AEETAAAVGSTTGA

SEQ ID NO: 28560 - protein, 6 aa, Mycobacterium avium
AEETGF

SEQ ID NO: 28561 - protein, 8 aa, Mycobacterium avium
AEEYPAKS

SEQ ID NO: 28562 - protein, 4 aa, Mycobacterium avium
AEFD

SEQ ID NO: 28563 - protein, 4 aa, Mycobacterium avium
AEFP

SEQ ID NO: 28564 - protein, 37 aa, Mycobacterium avium
AEFSSEIDESAAREAAESDDPRVAARGRARLRAVGAI

SEQ ID NO: 28565 - protein, 4 aa, Mycobacterium avium
AEGA

SEQ ID NO: 28566 - protein, 5 aa, Mycobacterium avium
AEGAA

SEQ ID NO: 28567 - protein, 13 aa, Mycobacterium avium
AEGAAKAGRSPSD

SEQ ID NO: 28568 - protein, 5 aa, Mycobacterium avium
AEGAG

SEQ ID NO: 28569 - protein, 7 aa, Mycobacterium avium
AEGARLS

SEQ ID NO: 28570 - protein, 6 aa, Mycobacterium avium
AEGDAE

SEQ ID NO: 28571 - protein, 11 aa, Mycobacterium avium
AEGEHRDQESD

SEQ ID NO: 28572 - protein, 5 aa, Mycobacterium avium
AEGEP

SEQ ID NO: 28573 - protein, 6 aa, Mycobacterium avium
AEGGAL

SEQ ID NO: 28574 - protein, 8 aa, Mycobacterium avium
AEGGDGEA

SEQ ID NO: 28575 - protein, 9 aa, Mycobacterium avium
AEGGDTATV

SEQ ID NO: 28576 - protein, 10 aa, Mycobacterium avium
AEGGEPAAGR

SEQ ID NO: 28577 - protein, 7 aa, Mycobacterium avium
AEGGSGS

SEQ ID NO: 28578 - protein, 8 aa, Mycobacterium avium
AEGIPYED

SEQ ID NO: 28579 - protein, 6 aa, Mycobacterium avium
AEGIRP

SEQ ID NO: 28580 - protein, 4 aa, Mycobacterium avium
AEGL

SEQ ID NO: 28581 - protein, 8 aa, Mycobacterium avium
AEGLPGRR

SEQ ID NO: 28582 - protein, 5 aa, Mycobacterium avium
AEGPI

SEQ ID NO: 28583 - protein, 5 aa, Mycobacterium avium
AEGRD

SEQ ID NO: 28584 - protein, 6 aa, Mycobacterium avium
AEGRIG

SEQ ID NO: 28585 - protein, 5 aa, Mycobacterium avium
AEGRS

SEQ ID NO: 28586 - protein, 5 aa, Mycobacterium avium
AEGSA

SEQ ID NO: 28587 - protein, 9 aa, Mycobacterium avium
AEGSSGAYL

SEQ ID NO: 28588 - protein, 8 aa, Mycobacterium avium
AEGTDEWG

SEQ ID NO: 28589 - protein, 7 aa, Mycobacterium avium
AEGTTRE

SEQ ID NO: 28590 - protein, 7 aa, Mycobacterium avium
AEGVDTG

SEQ ID NO: 28591 - protein, 9 aa, Mycobacterium avium
AEGYDGAPL

SEQ ID NO: 28592 - protein, 6 aa, Mycobacterium avium
AEHDEM

SEQ ID NO: 28593 - protein, 6 aa, Mycobacterium avium
AEHEGK

SEQ ID NO: 28594 - protein, 5 aa, Mycobacterium avium
AEHGA

SEQ ID NO: 28595 - protein, 7 aa, Mycobacterium avium
AEHGPAF

SEQ ID NO: 28596 - protein, 11 aa, Mycobacterium avium
AEHGPRSRSAW

SEQ ID NO: 28597 - protein, 7 aa, Mycobacterium avium
AEHGSPA

SEQ ID NO: 28598 - protein, 5 aa, Mycobacterium avium
AEHGY

SEQ ID NO: 28599 - protein, 7 aa, Mycobacterium avium
AEHPRLG

SEQ ID NO: 28600 - protein, 7 aa, Mycobacterium avium
AEHPSSG

SEQ ID NO: 28601 - protein, 5 aa, Mycobacterium avium
AEHPT

SEQ ID NO: 28602 - protein, 6 aa, Mycobacterium avium
AEHQRA

SEQ ID NO: 28603 - protein, 5 aa, Mycobacterium avium
AEHSG

SEQ ID NO: 28604 - protein, 11 aa, Mycobacterium avium
AEHTEAGPSDV

SEQ ID NO: 28605 - protein, 11 aa, Mycobacterium avium
AEIDGEKLEDE

SEQ ID NO: 28606 - protein, 4 aa, Mycobacterium avium
AEIP

SEQ ID NO: 28607 - protein, 17 aa, Mycobacterium avium
AEKAGDLVTGGRRLGGE

SEQ ID NO: 28608 - protein, 7 aa, Mycobacterium avium
AEKATGR

SEQ ID NO: 28609 - protein, 5 aa, Mycobacterium avium
AEKEL

SEQ ID NO: 28610 - protein, 6 aa, Mycobacterium avium
AEKGGY

SEQ ID NO: 28611 - protein, 5 aa, Mycobacterium avium
AEKNR

SEQ ID NO: 28612 - protein, 8 aa, Mycobacterium avium
AEKNTEEM

SEQ ID NO: 28613 - protein, 7 aa, Mycobacterium avium
AEKPDSH

SEQ ID NO: 28614 - protein, 8 aa, Mycobacterium avium
AEKSDPLA

SEQ ID NO: 28615 - protein, 10 aa, Mycobacterium avium
AEKSGVSNPY

SEQ ID NO: 28616 - protein, 13 aa, Mycobacterium avium
AEKTGQADDPRVQ

SEQ ID NO: 28617 - protein, 10 aa, Mycobacterium avium
AEKTGTFTNA

SEQ ID NO: 28618 - protein, 7 aa, Mycobacterium avium
AEKVDRD

SEQ ID NO: 28619 - protein, 7 aa, Mycobacterium avium
AEKVGVD

SEQ ID NO: 28620 - protein, 7 aa, Mycobacterium avium
AELADGG

SEQ ID NO: 28621 - protein, 6 aa, Mycobacterium avium
AELAGD

SEQ ID NO: 28622 - protein, 5 aa, Mycobacterium avium
AELPA

SEQ ID NO: 28623 - protein, 12 aa, Mycobacterium avium
AELPGESATTDR

SEQ ID NO: 28624 - protein, 7 aa, Mycobacterium avium
AELQPPT

SEQ ID NO: 28625 - protein, 6 aa, Mycobacterium avium
AELSDG

SEQ ID NO: 28626 - protein, 13 aa, Mycobacterium avium
AELSRRAGVTPQA

SEQ ID NO: 28627 - protein, 10 aa, Mycobacterium avium
AEMTGDPGDL

SEQ ID NO: 28628 - protein, 9 aa, Mycobacterium avium
AEMTPTTDT

SEQ ID NO: 28629 - protein, 4 aa, Mycobacterium avium
AENA

SEQ ID NO: 28630 - protein, 13 aa, Mycobacterium avium
AENAARKAQEHGV

SEQ ID NO: 28631 - protein, 11 aa, Mycobacterium avium
AENAPTGRTPI

SEQ ID NO: 28632 - protein, 5 aa, Mycobacterium avium
AENGM

SEQ ID NO: 28633 - protein, 4 aa, Mycobacterium avium
AENN

SEQ ID NO: 28634 - protein, 8 aa, Mycobacterium avium
AENPDKLE

SEQ ID NO: 28635 - protein, 9 aa, Mycobacterium avium
AENPPKKYQ

SEQ ID NO: 28636 - protein, 7 aa, Mycobacterium avium
AENPRDL

SEQ ID NO: 28637 - protein, 7 aa, Mycobacterium avium
AENPTWE

SEQ ID NO: 28638 - protein, 4 aa, Mycobacterium avium
AENQ

SEQ ID NO: 28639 - protein, 6 aa, Mycobacterium avium
AENQRA

SEQ ID NO: 28640 - protein, 6 aa, Mycobacterium avium
AENQTL

SEQ ID NO: 28641 - protein, 4 aa, Mycobacterium avium
AENR

SEQ ID NO: 28642 - protein, 6 aa, Mycobacterium avium
AENTGF

SEQ ID NO: 28643 - protein, 5 aa, Mycobacterium avium
AENYG

SEQ ID NO: 28644 - protein, 4 aa, Mycobacterium avium
AEPA

SEQ ID NO: 28645 - protein, 7 aa, Mycobacterium avium
AEPAATA

SEQ ID NO: 28646 - protein, 14 aa, Mycobacterium avium
AEPAPSDAGVDTDE

SEQ ID NO: 28647 - protein, 6 aa, Mycobacterium avium
AEPASI

SEQ ID NO: 28648 - protein, 8 aa, Mycobacterium avium
AEPATVSE

SEQ ID NO: 28649 - protein, 6 aa, Mycobacterium avium
AEPAVR

SEQ ID NO: 28650 - protein, 9 aa, Mycobacterium avium
AEPDADAPH

SEQ ID NO: 28651 - protein, 6 aa, Mycobacterium avium
AEPDAL

SEQ ID NO: 28652 - protein, 6 aa, Mycobacterium avium
AEPDEI

SEQ ID NO: 28653 - protein, 7 aa, Mycobacterium avium
AEPDGDD

SEQ ID NO: 28654 - protein, 6 aa, Mycobacterium avium
AEPEER

SEQ ID NO: 28655 - protein, 21 aa, Mycobacterium avium
AEPEPVKAAPAAAVSNEEQAI

SEQ ID NO: 28656 - protein, 8 aa, Mycobacterium avium
AEPGHQHD

SEQ ID NO: 28657 - protein, 10 aa, Mycobacterium avium
AEPGPRSAKE

SEQ ID NO: 28658 - protein, 6 aa, Mycobacterium avium
AEPGPY

SEQ ID NO: 28659 - protein, 9 aa, Mycobacterium avium
AEPGRPHTV

SEQ ID NO: 28660 - protein, 5 aa, Mycobacterium avium
AEPGT

SEQ ID NO: 28661 - protein, 6 aa, Mycobacterium avium
AEPGTA

SEQ ID NO: 28662 - protein, 7 aa, Mycobacterium avium
AEPHRTE

SEQ ID NO: 28663 - protein, 10 aa, Mycobacterium avium
AEPPAGSGLK

SEQ ID NO: 28664 - protein, 13 aa, Mycobacterium avium
AEPQGPATLETDA

SEQ ID NO: 28665 - protein, 10 aa, Mycobacterium avium
AEPQHAAPRS

SEQ ID NO: 28666 - protein, 9 aa, Mycobacterium avium
AEPRAEHKK

SEQ ID NO: 28667 - protein, 11 aa, Mycobacterium avium
AEPSASLSEVK

SEQ ID NO: 28668 - protein, 5 aa, Mycobacterium avium
AEPTE

SEQ ID NO: 28669 - protein, 4 aa, Mycobacterium avium
AEPV

SEQ ID NO: 28670 - protein, 9 aa, Mycobacterium avium
AEPVDGPWA

SEQ ID NO: 28671 - protein, 9 aa, Mycobacterium avium
AEPVDSYGV

SEQ ID NO: 28672 - protein, 5 aa, Mycobacterium avium
AEPVP

SEQ ID NO: 28673 - protein, 9 aa, Mycobacterium avium
AEPYQADPE

SEQ ID NO: 28674 - protein, 6 aa, Mycobacterium avium
AEQAGQ

SEQ ID NO: 28675 - protein, 11 aa, Mycobacterium avium
AEQAKGEGDIN

SEQ ID NO: 28676 - protein, 6 aa, Mycobacterium avium
AEQAPT

SEQ ID NO: 28677 - protein, 7 aa, Mycobacterium avium
AEQGAIT

SEQ ID NO: 28678 - protein, 5 aa, Mycobacterium avium
AEQGV

SEQ ID NO: 28679 - protein, 12 aa, Mycobacterium avium
AEQKGPAVSTDD

SEQ ID NO: 28680 - protein, 9 aa, Mycobacterium avium
AEQKGTGRW

SEQ ID NO: 28681 - protein, 10 aa, Mycobacterium avium
AEQKHSIDDP

SEQ ID NO: 28682 - protein, 17 aa, Mycobacterium avium
AEQPDLQLPTEKQIGSA

SEQ ID NO: 28683 - protein, 7 aa, Mycobacterium avium
AEQPDRV

SEQ ID NO: 28684 - protein, 7 aa, Mycobacterium avium
AEQPTDI

SEQ ID NO: 28685 - protein, 11 aa, Mycobacterium avium
AEQSDDAQPGV

SEQ ID NO: 28686 - protein, 11 aa, Mycobacterium avium
AEQSDPTELGG

SEQ ID NO: 28687 - protein, 6 aa, Mycobacterium avium
AEQSFT

SEQ ID NO: 28688 - protein, 6 aa, Mycobacterium avium
AEQSVE

SEQ ID NO: 28689 - protein, 5 aa, Mycobacterium avium
AERAE

SEQ ID NO: 28690 - protein, 21 aa, Mycobacterium avium
AERAETSRQRDLDAHRRDEHR

SEQ ID NO: 28691 - protein, 17 aa, Mycobacterium avium
AERAGAGPLRPGPDDVR

SEQ ID NO: 28692 - protein, 11 aa, Mycobacterium avium
AERAGEAPPRL

SEQ ID NO: 28693 - protein, 10 aa, Mycobacterium avium
AERAGITSGV

SEQ ID NO: 28694 - protein, 9 aa, Mycobacterium avium
AERAGRDPM

SEQ ID NO: 28695 - protein, 12 aa, Mycobacterium avium
AERARRAEASGF

SEQ ID NO: 28696 - protein, 4 aa, Mycobacterium avium
AERD

SEQ ID NO: 28697 - protein, 9 aa, Mycobacterium avium
AERDGSHYV

SEQ ID NO: 28698 - protein, 6 aa, Mycobacterium avium
AERGAR

SEQ ID NO: 28699 - protein, 12 aa, Mycobacterium avium
AERGASELEGAS

SEQ ID NO: 28700 - protein, 12 aa, Mycobacterium avium
AERGEKLPAAQR

SEQ ID NO: 28701 - protein, 10 aa, Mycobacterium avium
AERGGETEFA

SEQ ID NO: 28702 - protein, 5 aa, Mycobacterium avium
AERGI

SEQ ID NO: 28703 - protein, 20 aa, Mycobacterium avium
AERGRELASTAAERGAPYAE

SEQ ID NO: 28704 - protein, 5 aa, Mycobacterium avium
AERHP

SEQ ID NO: 28705 - protein, 4 aa, Mycobacterium avium
AERI

SEQ ID NO: 28706 - protein, 7 aa, Mycobacterium avium
AERLAEE

SEQ ID NO: 28707 - protein, 8 aa, Mycobacterium avium
AERLGAPR

SEQ ID NO: 28708 - protein, 20 aa, Mycobacterium avium
AERLPRGADPNTHTKLGRGG

SEQ ID NO: 28709 - protein, 4 aa, Mycobacterium avium
AERP

SEQ ID NO: 28710 - protein, 10 aa, Mycobacterium avium
AERPDLDQNR

SEQ ID NO: 28711 - protein, 7 aa, Mycobacterium avium
AERPGDA

SEQ ID NO: 28712 - protein, 10 aa, Mycobacterium avium
AERPHAAPQY

SEQ ID NO: 28713 - protein, 7 aa, Mycobacterium avium
AERPRGV

SEQ ID NO: 28714 - protein, 6 aa, Mycobacterium avium
AERQEA

SEQ ID NO: 28715 - protein, 11 aa, Mycobacterium avium
AERQGSKRPTF

SEQ ID NO: 28716 - protein, 16 aa, Mycobacterium avium
AERRRLPRDAAGAEQA

SEQ ID NO: 28717 - protein, 4 aa, Mycobacterium avium
AERS

SEQ ID NO: 28718 - protein, 4 aa, Mycobacterium avium
AERT

SEQ ID NO: 28719 - protein, 5 aa, Mycobacterium avium
AERTK

SEQ ID NO: 28720 - protein, 5 aa, Mycobacterium avium
AESAE

SEQ ID NO: 28721 - protein, 7 aa, Mycobacterium avium
AESAGRA

SEQ ID NO: 28722 - protein, 12 aa, Mycobacterium avium
AESAHTPGTPEW

SEQ ID NO: 28723 - protein, 16 aa, Mycobacterium avium
AESANKAAQTNDPTAH

SEQ ID NO: 28724 - protein, 14 aa, Mycobacterium avium
AESDPDDEVAETTT

SEQ ID NO: 28725 - protein, 10 aa, Mycobacterium avium
AESDRPPAEV

SEQ ID NO: 28726 - protein, 6 aa, Mycobacterium avium
AESEDI

SEQ ID NO: 28727 - protein, 8 aa, Mycobacterium avium
AESELTAR

SEQ ID NO: 28728 - protein, 7 aa, Mycobacterium avium
AESERPA

SEQ ID NO: 28729 - protein, 24 aa, Mycobacterium avium
AESESDADVGDRANDPVRVNGSSV

SEQ ID NO: 28730 - protein, 9 aa, Mycobacterium avium
AESGADERR

SEQ ID NO: 28731 - protein, 5 aa, Mycobacterium avium
AESGK

SEQ ID NO: 28732 - protein, 7 aa, Mycobacterium avium
AESGTPL

SEQ ID NO: 28733 - protein, 7 aa, Mycobacterium avium
AESNAPA

SEQ ID NO: 28734 - protein, 9 aa, Mycobacterium avium
AESPSGRAE

SEQ ID NO: 28735 - protein, 5 aa, Mycobacterium avium
AESRG

SEQ ID NO: 28736 - protein, 8 aa, Mycobacterium avium
AESRGAAV

SEQ ID NO: 28737 - protein, 25 aa, Mycobacterium avium
AESSAAAQGDATEFPGSTDTLIGAP

SEQ ID NO: 28738 - protein, 11 aa, Mycobacterium avium
AESSGETLPTP

SEQ ID NO: 28739 - protein, 8 aa, Mycobacterium avium
AESSPSIV

SEQ ID NO: 28740 - protein, 20 aa, Mycobacterium avium
AESTDDAKAETILDEVLAAA

SEQ ID NO: 28741 - protein, 5 aa, Mycobacterium avium
AESTV

SEQ ID NO: 28742 - protein, 7 aa, Mycobacterium avium
AESVTAT

SEQ ID NO: 28743 - protein, 5 aa, Mycobacterium avium
AETAG

SEQ ID NO: 28744 - protein, 7 aa, Mycobacterium avium
AETAGSQ

SEQ ID NO: 28745 - protein, 14 aa, Mycobacterium avium
AETDGIASAEVAGP

SEQ ID NO: 28746 - protein, 7 aa, Mycobacterium avium
AETDSGT

SEQ ID NO: 28747 - protein, 7 aa, Mycobacterium avium
AETDTAV

SEQ ID NO: 28748 - protein, 5 aa, Mycobacterium avium
AETEA

SEQ ID NO: 28749 - protein, 5 aa, Mycobacterium avium
AETEP

SEQ ID NO: 28750 - protein, 12 aa, Mycobacterium avium
AETFTENTEPHI

SEQ ID NO: 28751 - protein, 7 aa, Mycobacterium avium
AETGARL

SEQ ID NO: 28752 - protein, 5 aa, Mycobacterium avium
AETGF

SEQ ID NO: 28753 - protein, 5 aa, Mycobacterium avium
AETGH

SEQ ID NO: 28754 - protein, 7 aa, Mycobacterium avium
AETGRQT

SEQ ID NO: 28755 - protein, 6 aa, Mycobacterium avium
AETGVT

SEQ ID NO: 28756 - protein, 8 aa, Mycobacterium avium
AETPAVAE

SEQ ID NO: 28757 - protein, 12 aa, Mycobacterium avium
AETPDTGRIEPG

SEQ ID NO: 28758 - protein, 6 aa, Mycobacterium avium
AETPGR

SEQ ID NO: 28759 - protein, 11 aa, Mycobacterium avium
AETQSAAPHLG

SEQ ID NO: 28760 - protein, 4 aa, Mycobacterium avium
AETR

SEQ ID NO: 28761 - protein, 20 aa, Mycobacterium avium
AEVAAADAARAAAEDDPAQF

SEQ ID NO: 28762 - protein, 4 aa, Mycobacterium avium
AEVG

SEQ ID NO: 28763 - protein, 13 aa, Mycobacterium avium
AEVGAEPTATRRT

SEQ ID NO: 28764 - protein, 18 aa, Mycobacterium avium
AEVGAKTEGSAEASTPEV

SEQ ID NO: 28765 - protein, 5 aa, Mycobacterium avium
AEVGE

SEQ ID NO: 28766 - protein, 9 aa, Mycobacterium avium
AEVGTGAGV

SEQ ID NO: 28767 - protein, 4 aa, Mycobacterium avium
AEVK

SEQ ID NO: 28768 - protein, 11 aa, Mycobacterium avium
AEVPDSDQAAV

SEQ ID NO: 28769 - protein, 12 aa, Mycobacterium avium
AEVRGDDAREAK

SEQ ID NO: 28770 - protein, 10 aa, Mycobacterium avium
AEVSSTASQW

SEQ ID NO: 28771 - protein, 11 aa, Mycobacterium avium
AEWDEREETPW

SEQ ID NO: 28772 - protein, 5 aa, Mycobacterium avium
AEYAE

SEQ ID NO: 28773 - protein, 4 aa, Mycobacterium avium
AEYE

SEQ ID NO: 28774 - protein, 8 aa, Mycobacterium avium
AEYGKTAS

SEQ ID NO: 28775 - protein, 16 aa, Mycobacterium avium
AEYPEGDTRGERMPKV

SEQ ID NO: 28776 - protein, 12 aa, Mycobacterium avium
AEYRETKEKLDA

SEQ ID NO: 28777 - protein, 8 aa, Mycobacterium avium
AFAAPDTE

SEQ ID NO: 28778 - protein, 6 aa, Mycobacterium avium
AFDSGD

SEQ ID NO: 28779 - protein, 10 aa, Mycobacterium avium
AFGADGARLT

SEQ ID NO: 28780 - protein, 7 aa, Mycobacterium avium
AFGDDKD

SEQ ID NO: 28781 - protein, 10 aa, Mycobacterium avium
AFGGEQNLAG

SEQ ID NO: 28782 - protein, 13 aa, Mycobacterium avium
AFGGGDGESTAQV

SEQ ID NO: 28783 - protein, 4 aa, Mycobacterium avium
AFGI

SEQ ID NO: 28784 - protein, 8 aa, Mycobacterium avium
AFGTPEAN

SEQ ID NO: 28785 - protein, 16 aa, Mycobacterium avium
AFHGPGRAQVGYNEHN

SEQ ID NO: 28786 - protein, 6 aa, Mycobacterium avium
AFPDQD

SEQ ID NO: 28787 - protein, 6 aa, Mycobacterium avium
AFPDSH

SEQ ID NO: 28788 - protein, 12 aa, Mycobacterium avium
AFRGRSPTEGAV

SEQ ID NO: 28789 - protein, 6 aa, Mycobacterium avium
AFSGQK

SEQ ID NO: 28790 - protein, 9 aa, Mycobacterium avium
AGAAAAKLA

SEQ ID NO: 28791 - protein, 17 aa, Mycobacterium avium
AGAAAFGAGPDGWDGPG

SEQ ID NO: 28792 - protein, 10 aa, Mycobacterium avium
AGAAEATTEA

SEQ ID NO: 28793 - protein, 8 aa, Mycobacterium avium
AGAAETTP

SEQ ID NO: 28794 - protein, 11 aa, Mycobacterium avium
AGAAKRDPALG

SEQ ID NO: 28795 - protein, 7 aa, Mycobacterium avium
AGAARHG

SEQ ID NO: 28796 - protein, 23 aa, Mycobacterium avium
AGAARSRLSPPVPSLPGRRRPPT

SEQ ID NO: 28797 - protein, 12 aa, Mycobacterium avium
AGAARTLFGRDP

SEQ ID NO: 28798 - protein, 6 aa, Mycobacterium avium
AGAATY

SEQ ID NO: 28799 - protein, 9 aa, Mycobacterium avium
AGADPDDYT

SEQ ID NO: 28800 - protein, 10 aa, Mycobacterium avium
AGADVTYSSS

SEQ ID NO: 28801 - protein, 8 aa, Mycobacterium avium
AGAEGADV

SEQ ID NO: 28802 - protein, 8 aa, Mycobacterium avium
AGAEGMSR

SEQ ID NO: 28803 - protein, 6 aa, Mycobacterium avium
AGAERA

SEQ ID NO: 28804 - protein, 8 aa, Mycobacterium avium
AGAETGID

SEQ ID NO: 28805 - protein, 5 aa, Mycobacterium avium
AGAGA

SEQ ID NO: 28806 - protein, 10 aa, Mycobacterium avium
AGAGAGPRAA

SEQ ID NO: 28807 - protein, 8 aa, Mycobacterium avium
AGAGGREA

SEQ ID NO: 28808 - protein, 8 aa, Mycobacterium avium
AGAGIGRA

SEQ ID NO: 28809 - protein, 8 aa, Mycobacterium avium
AGAGIGRG

SEQ ID NO: 28810 - protein, 7 aa, Mycobacterium avium
AGAGMNQ

SEQ ID NO: 28811 - protein, 7 aa, Mycobacterium avium
AGAGPEL

SEQ ID NO: 28812 - protein, 7 aa, Mycobacterium avium
AGAGPVS

SEQ ID NO: 28813 - protein, 12 aa, Mycobacterium avium
AGAGRDDRAREF

SEQ ID NO: 28814 - protein, 8 aa, Mycobacterium avium
AGAGSGAL

SEQ ID NO: 28815 - protein, 16 aa, Mycobacterium avium
AGAGSPEMPMDQPASN

SEQ ID NO: 28816 - protein, 11 aa, Mycobacterium avium
AGAGTAGFTDD

SEQ ID NO: 28817 - protein, 8 aa, Mycobacterium avium
AGAGVGKD

SEQ ID NO: 28818 - protein, 12 aa, Mycobacterium avium
AGAHAGAASWPF

SEQ ID NO: 28819 - protein, 8 aa, Mycobacterium avium
AGAHGPAD

SEQ ID NO: 28820 - protein, 7 aa, Mycobacterium avium
AGANPLG

SEQ ID NO: 28821 - protein, 15 aa, Mycobacterium avium
AGAPARHPQVGTRTP

SEQ ID NO: 28822 - protein, 8 aa, Mycobacterium avium
AGAPENYA

SEQ ID NO: 28823 - protein, 6 aa, Mycobacterium avium
AGAPGG

SEQ ID NO: 28824 - protein, 6 aa, Mycobacterium avium
AGAPGI

SEQ ID NO: 28825 - protein, 14 aa, Mycobacterium avium
AGAPGRASANGTSM

SEQ ID NO: 28826 - protein, 8 aa, Mycobacterium avium
AGAPHVAE

SEQ ID NO: 28827 - protein, 5 aa, Mycobacterium avium
AGAPI

SEQ ID NO: 28828 - protein, 6 aa, Mycobacterium avium
AGAPLR

SEQ ID NO: 28829 - protein, 9 aa, Mycobacterium avium
AGAPPDEFN

SEQ ID NO: 28830 - protein, 9 aa, Mycobacterium avium
AGAPTPDDL

SEQ ID NO: 28831 - protein, 7 aa, Mycobacterium avium
AGAPTRC

SEQ ID NO: 28832 - protein, 4 aa, Mycobacterium avium
AGAQ

SEQ ID NO: 28833 - protein, 15 aa, Mycobacterium avium
AGAQEALSIADSMSN

SEQ ID NO: 28834 - protein, 6 aa, Mycobacterium avium
AGAQPM

SEQ ID NO: 28835 - protein, 21 aa, Mycobacterium avium
AGARLTDAQGNPHTHKSASTV

SEQ ID NO: 28836 - protein, 8 aa, Mycobacterium avium
AGARRREE

SEQ ID NO: 28837 - protein, 7 aa, Mycobacterium avium
AGARTVG

SEQ ID NO: 28838 - protein, 6 aa, Mycobacterium avium
AGASAV

SEQ ID NO: 28839 - protein, 6 aa, Mycobacterium avium
AGASGW

SEQ ID NO: 28840 - protein, 7 aa, Mycobacterium avium
AGASKAK

SEQ ID NO: 28841 - protein, 6 aa, Mycobacterium avium
AGASPL

SEQ ID NO: 28842 - protein, 8 aa, Mycobacterium avium
AGASTGGF

SEQ ID NO: 28843 - protein, 5 aa, Mycobacterium avium
AGASV

SEQ ID NO: 28844 - protein, 8 aa, Mycobacterium avium
AGATEDVA

SEQ ID NO: 28845 - protein, 7 aa, Mycobacterium avium
AGATPQR

SEQ ID NO: 28846 - protein, 9 aa, Mycobacterium avium
AGATVNRPE

SEQ ID NO: 28847 - protein, 11 aa, Mycobacterium avium
AGATVTQTDDS

SEQ ID NO: 28848 - protein, 23 aa, Mycobacterium avium
AGAVAPQLTGERRELPGERREVR

SEQ ID NO: 28849 - protein, 10 aa, Mycobacterium avium
AGAVAPSGAM

SEQ ID NO: 28850 - protein, 8 aa, Mycobacterium avium
AGAVPGPF

SEQ ID NO: 28851 - protein, 14 aa, Mycobacterium avium
AGAYNNAARGLGPA

SEQ ID NO: 28852 - protein, 13 aa, Mycobacterium avium
AGDAASASTYLSA

SEQ ID NO: 28853 - protein, 7 aa, Mycobacterium avium
AGDADQL

SEQ ID NO: 28854 - protein, 6 aa, Mycobacterium avium
AGDARL

SEQ ID NO: 28855 - protein, 18 aa, Mycobacterium avium
AGDCAPRAEEIERALRGK

SEQ ID NO: 28856 - protein, 9 aa, Mycobacterium avium
AGDDEHSYL

SEQ ID NO: 28857 - protein, 7 aa, Mycobacterium avium
AGDDFGE

SEQ ID NO: 28858 - protein, 8 aa, Mycobacterium avium
AGDDLAGE

SEQ ID NO: 28859 - protein, 8 aa, Mycobacterium avium
AGDDLDSS

SEQ ID NO: 28860 - protein, 9 aa, Mycobacterium avium
AGDDPEVNE

SEQ ID NO: 28861 - protein, 9 aa, Mycobacterium avium
AGDDPTDVH

SEQ ID NO: 28862 - protein, 10 aa, Mycobacterium avium
AGDDVQPGDV

SEQ ID NO: 28863 - protein, 6 aa, Mycobacterium avium
AGDEFE

SEQ ID NO: 28864 - protein, 13 aa, Mycobacterium avium
AGDFDDDDGPARL

SEQ ID NO: 28865 - protein, 13 aa, Mycobacterium avium
AGDGLRDTRPGDT

SEQ ID NO: 28866 - protein, 7 aa, Mycobacterium avium
AGDGNTH

SEQ ID NO: 28867 - protein, 9 aa, Mycobacterium avium
AGDGSTGHA

SEQ ID NO: 28868 - protein, 10 aa, Mycobacterium avium
AGDGVETGRH

SEQ ID NO: 28869 - protein, 5 aa, Mycobacterium avium
AGDHG

SEQ ID NO: 28870 - protein, 6 aa, Mycobacterium avium
AGDIDD

SEQ ID NO: 28871 - protein, 6 aa, Mycobacterium avium
AGDNKF

SEQ ID NO: 28872 - protein, 4 aa, Mycobacterium avium
AGDP

SEQ ID NO: 28873 - protein, 6 aa, Mycobacterium avium
AGDPDY

SEQ ID NO: 28874 - protein, 9 aa, Mycobacterium avium
AGDPERVDE

SEQ ID NO: 28875 - protein, 7 aa, Mycobacterium avium
AGDPGKP

SEQ ID NO: 28876 - protein, 10 aa, Mycobacterium avium
AGDPNDPGLH

SEQ ID NO: 28877 - protein, 6 aa, Mycobacterium avium
AGDPVA

SEQ ID NO: 28878 - protein, 5 aa, Mycobacterium avium
AGDPW

SEQ ID NO: 28879 - protein, 6 aa, Mycobacterium avium
AGDQRS

SEQ ID NO: 28880 - protein, 22 aa, Mycobacterium avium
AGDRNRGRTPRRPLNSEVPQGK

SEQ ID NO: 28881 - protein, 5 aa, Mycobacterium avium
AGDRP

SEQ ID NO: 28882 - protein, 7 aa, Mycobacterium avium
AGDSAAT

SEQ ID NO: 28883 - protein, 9 aa, Mycobacterium avium
AGDSAGGTL

SEQ ID NO: 28884 - protein, 11 aa, Mycobacterium avium
AGDSDDGGYNT

SEQ ID NO: 28885 - protein, 34 aa, Mycobacterium avium
AGDSRDSRGDRDSRGRRGDGGRGGRDRDGDKSNY

SEQ ID NO: 28886 - protein, 7 aa, Mycobacterium avium
AGDTGLA

SEQ ID NO: 28887 - protein, 9 aa, Mycobacterium avium
AGDTRTRIS

SEQ ID NO: 28888 - protein, 6 aa, Mycobacterium avium
AGDVPA

SEQ ID NO: 28889 - protein, 6 aa, Mycobacterium avium
AGEAAG

SEQ ID NO: 28890 - protein, 8 aa, Mycobacterium avium
AGEAAGVH

SEQ ID NO: 28891 - protein, 14 aa, Mycobacterium avium
AGEAEQRAANVDGT

SEQ ID NO: 28892 - protein, 8 aa, Mycobacterium avium
AGEAGKDA

SEQ ID NO: 28893 - protein, 5 aa, Mycobacterium avium
AGEDI

SEQ ID NO: 28894 - protein, 12 aa, Mycobacterium avium
AGEDLDAYPRTL

SEQ ID NO: 28895 - protein, 6 aa, Mycobacterium avium
AGEDRR

SEQ ID NO: 28896 - protein, 7 aa, Mycobacterium avium
AGEETAA

SEQ ID NO: 28897 - protein, 4 aa, Mycobacterium avium
AGEF

SEQ ID NO: 28898 - protein, 9 aa, Mycobacterium avium
AGEFGKAGT

SEQ ID NO: 28899 - protein, 6 aa, Mycobacterium avium
AGEGDA

SEQ ID NO: 28900 - protein, 9 aa, Mycobacterium avium
AGEGEPDQV

SEQ ID NO: 28901 - protein, 10 aa, Mycobacterium avium
AGEGGRSSGI

SEQ ID NO: 28902 - protein, 6 aa, Mycobacterium avium
AGEGPV

SEQ ID NO: 28903 - protein, 7 aa, Mycobacterium avium
AGEGTQQ

SEQ ID NO: 28904 - protein, 5 aa, Mycobacterium avium
AGEHM

SEQ ID NO: 28905 - protein, 13 aa, Mycobacterium avium
AGEIDADGPATPF

SEQ ID NO: 28906 - protein, 10 aa, Mycobacterium avium
AGEKAKDDPF

SEQ ID NO: 28907 - protein, 5 aa, Mycobacterium avium
AGEKI

SEQ ID NO: 28908 - protein, 8 aa, Mycobacterium avium
AGELAETA

SEQ ID NO: 28909 - protein, 6 aa, Mycobacterium avium
AGELGV

SEQ ID NO: 28910 - protein, 6 aa, Mycobacterium avium
AGELRY

SEQ ID NO: 28911 - protein, 8 aa, Mycobacterium avium
AGEPDGKE

SEQ ID NO: 28912 - protein, 6 aa, Mycobacterium avium
AGEPEQ

SEQ ID NO: 28913 - protein, 11 aa, Mycobacterium avium
AGEPKAIKSGT

SEQ ID NO: 28914 - protein, 14 aa, Mycobacterium avium
AGEPPQDSSLAATY

SEQ ID NO: 28915 - protein, 9 aa, Mycobacterium avium
AGEPPRASV

SEQ ID NO: 28916 - protein, 6 aa, Mycobacterium avium
AGEQFT

SEQ ID NO: 28917 - protein, 5 aa, Mycobacterium avium
AGEQR

SEQ ID NO: 28918 - protein, 9 aa, Mycobacterium avium
AGERLPSPL

SEQ ID NO: 28919 - protein, 10 aa, Mycobacterium avium
AGESGSGKST

SEQ ID NO: 28920 - protein, 16 aa, Mycobacterium avium
AGETGGNCELTEPGKT

SEQ ID NO: 28921 - protein, 13 aa, Mycobacterium avium
AGEVTTAAGSITS

SEQ ID NO: 28922 - protein, 9 aa, Mycobacterium avium
AGFDASRPA

SEQ ID NO: 28923 - protein, 4 aa, Mycobacterium avium
AGFE

SEQ ID NO: 28924 - protein, 7 aa, Mycobacterium avium
AGFEPSN

SEQ ID NO: 28925 - protein, 6 aa, Mycobacterium avium
AGFGTS

SEQ ID NO: 28926 - protein, 10 aa, Mycobacterium avium
AGFTQNGGAK

SEQ ID NO: 28927 - protein, 5 aa, Mycobacterium avium
AGGAA

SEQ ID NO: 28928 - protein, 9 aa, Mycobacterium avium
AGGADRTAS

SEQ ID NO: 28929 - protein, 9 aa, Mycobacterium avium
AGGASAVQA

SEQ ID NO: 28930 - protein, 7 aa, Mycobacterium avium
AGGATDS

SEQ ID NO: 28931 - protein, 9 aa, Mycobacterium avium
AGGEDVSPQ

SEQ ID NO: 28932 - protein, 13 aa, Mycobacterium avium
AGGEGDGQTGMNQ

SEQ ID NO: 28933 - protein, 11 aa, Mycobacterium avium
AGGEKGKPRYD

SEQ ID NO: 28934 - protein, 10 aa, Mycobacterium avium
AGGELGAESS

SEQ ID NO: 28935 - protein, 9 aa, Mycobacterium avium
AGGEPPAGV

SEQ ID NO: 28936 - protein, 12 aa, Mycobacterium avium
AGGESPADGPLT

SEQ ID NO: 28937 - protein, 6 aa, Mycobacterium avium
AGGGAH

SEQ ID NO: 28938 - protein, 8 aa, Mycobacterium avium
AGGGGRGM

SEQ ID NO: 28939 - protein, 9 aa, Mycobacterium avium
AGGGGRGMR

SEQ ID NO: 28940 - protein, 15 aa, Mycobacterium avium
AGGGGSGGDPRARSH

SEQ ID NO: 28941 - protein, 18 aa, Mycobacterium avium
AGGGIAKRTLTKNGPHDL

SEQ ID NO: 28942 - protein, 7 aa, Mycobacterium avium
AGGGIGR

SEQ ID NO: 28943 - protein, 6 aa, Mycobacterium avium
AGGGKP

SEQ ID NO: 28944 - protein, 5 aa, Mycobacterium avium
AGGGM

SEQ ID NO: 28945 - protein, 12 aa, Mycobacterium avium
AGGGQGGAVVIE

SEQ ID NO: 28946 - protein, 6 aa, Mycobacterium avium
AGGGSA

SEQ ID NO: 28947 - protein, 8 aa, Mycobacterium avium
AGGHTQPA

SEQ ID NO: 28948 - protein, 7 aa, Mycobacterium avium
AGGIGTS

SEQ ID NO: 28949 - protein, 7 aa, Mycobacterium avium
AGGKRGA

SEQ ID NO: 28950 - protein, 7 aa, Mycobacterium avium
AGGKVEQ

SEQ ID NO: 28951 - protein, 11 aa, Mycobacterium avium
AGGLAEGTAAL

SEQ ID NO: 28952 - protein, 5 aa, Mycobacterium avium
AGGLG

SEQ ID NO: 28953 - protein, 10 aa, Mycobacterium avium
AGGNAEALRD

SEQ ID NO: 28954 - protein, 7 aa, Mycobacterium avium
AGGPEKC

SEQ ID NO: 28955 - protein, 11 aa, Mycobacterium avium
AGGPGRPAGLD

SEQ ID NO: 28956 - protein, 16 aa, Mycobacterium avium
AGGPYPAGDEYDPDGY

SEQ ID NO: 28957 - protein, 4 aa, Mycobacterium avium
AGGQ

SEQ ID NO: 28958 - protein, 8 aa, Mycobacterium avium
AGGQGRYG

SEQ ID NO: 28959 - protein, 13 aa, Mycobacterium avium
AGGQLSVSGRTEI

SEQ ID NO: 28960 - protein, 7 aa, Mycobacterium avium
AGGRGAD

SEQ ID NO: 28961 - protein, 7 aa, Mycobacterium avium
AGGRRGI

SEQ ID NO: 28962 - protein, 6 aa, Mycobacterium avium
AGGSAE

SEQ ID NO: 28963 - protein, 9 aa, Mycobacterium avium
AGGSDALAE

SEQ ID NO: 28964 - protein, 9 aa, Mycobacterium avium
AGGSHDDWD

SEQ ID NO: 28965 - protein, 11 aa, Mycobacterium avium
AGGSPQGRELA

SEQ ID NO: 28966 - protein, 15 aa, Mycobacterium avium
AGGTDPVEKAIPGTI

SEQ ID NO: 28967 - protein, 5 aa, Mycobacterium avium
AGGTE

SEQ ID NO: 28968 - protein, 14 aa, Mycobacterium avium
AGGTLAGGSGGELR

SEQ ID NO: 28969 - protein, 6 aa, Mycobacterium avium
AGGTLR

SEQ ID NO: 28970 - protein, 7 aa, Mycobacterium avium
AGGTRQA

SEQ ID NO: 28971 - protein, 7 aa, Mycobacterium avium
AGGTSEI

SEQ ID NO: 28972 - protein, 11 aa, Mycobacterium avium
AGGTSEVTRNQ

SEQ ID NO: 28973 - protein, 9 aa, Mycobacterium avium
AGGTTQINK

SEQ ID NO: 28974 - protein, 8 aa, Mycobacterium avium
AGGTVNEE

SEQ ID NO: 28975 - protein, 5 aa, Mycobacterium avium
AGGVA

SEQ ID NO: 28976 - protein, 6 aa, Mycobacterium avium
AGGVDP

SEQ ID NO: 28977 - protein, 14 aa, Mycobacterium avium
AGGVDTTSDAPIGL

SEQ ID NO: 28978 - protein, 7 aa, Mycobacterium avium
AGGVRDT

SEQ ID NO: 28979 - protein, 5 aa, Mycobacterium avium
AGHDH

SEQ ID NO: 28980 - protein, 6 aa, Mycobacterium avium
AGHDYG

SEQ ID NO: 28981 - protein, 4 aa, Mycobacterium avium
AGHP

SEQ ID NO: 28982 - protein, 11 aa, Mycobacterium avium
AGHRERGVKQE

SEQ ID NO: 28983 - protein, 5 aa, Mycobacterium avium
AGHRG

SEQ ID NO: 28984 - protein, 6 aa, Mycobacterium avium
AGHSRE

SEQ ID NO: 28985 - protein, 23 aa, Mycobacterium avium
AGHTAAGDDNDAFSDAVVAFVKR

SEQ ID NO: 28986 - protein, 7 aa, Mycobacterium avium
AGIDAGD

SEQ ID NO: 28987 - protein, 13 aa, Mycobacterium avium
AGIDPSALRGTAT

SEQ ID NO: 28988 - protein, 9 aa, Mycobacterium avium
AGIEPRPPR

SEQ ID NO: 28989 - protein, 8 aa, Mycobacterium avium
AGIGPGDA

SEQ ID NO: 28990 - protein, 8 aa, Mycobacterium avium
AGIGPSRT

SEQ ID NO: 28991 - protein, 5 aa, Mycobacterium avium
AGINP

SEQ ID NO: 28992 - protein, 7 aa, Mycobacterium avium
AGIPKAG

SEQ ID NO: 28993 - protein, 13 aa, Mycobacterium avium
AGIPSQAPASRPH

SEQ ID NO: 28994 - protein, 8 aa, Mycobacterium avium
AGIQDGPG

SEQ ID NO: 28995 - protein, 4 aa, Mycobacterium avium
AGIS

SEQ ID NO: 28996 - protein, 23 aa, Mycobacterium avium
AGISTDSGIPDYRGPESPPSNPM

SEQ ID NO: 28997 - protein, 7 aa, Mycobacterium avium
AGKADAV

SEQ ID NO: 28998 - protein, 8 aa, Mycobacterium avium
AGKAGAGL

SEQ ID NO: 28999 - protein, 19 aa, Mycobacterium avium
AGKAKGHGRHVKQSGGHGQ

SEQ ID NO: 29000 - protein, 6 aa, Mycobacterium avium
AGKATA

SEQ ID NO: 29001 - protein, 4 aa, Mycobacterium avium
AGKG

SEQ ID NO: 29002 - protein, 11 aa, Mycobacterium avium
AGKGGAEPRSA

SEQ ID NO: 29003 - protein, 8 aa, Mycobacterium avium
AGKGRAGI

SEQ ID NO: 29004 - protein, 9 aa, Mycobacterium avium
AGKPAPDSF

SEQ ID NO: 29005 - protein, 6 aa, Mycobacterium avium
AGKPRE

SEQ ID NO: 29006 - protein, 5 aa, Mycobacterium avium
AGKRD

SEQ ID NO: 29007 - protein, 8 aa, Mycobacterium avium
AGKSALSS

SEQ ID NO: 29008 - protein, 8 aa, Mycobacterium avium
AGKTTTTE

SEQ ID NO: 29009 - protein, 7 aa, Mycobacterium avium
AGKVGGR

SEQ ID NO: 29010 - protein, 6 aa, Mycobacterium avium
AGLADG

SEQ ID NO: 29011 - protein, 15 aa, Mycobacterium avium
AGLAGVGSADPGSVG

SEQ ID NO: 29012 - protein, 8 aa, Mycobacterium avium
AGLAPTDI

SEQ ID NO: 29013 - protein, 6 aa, Mycobacterium avium
AGLARR

SEQ ID NO: 29014 - protein, 5 aa, Mycobacterium avium
AGLDG

SEQ ID NO: 29015 - protein, 6 aa, Mycobacterium avium
AGLDPD

SEQ ID NO: 29016 - protein, 11 aa, Mycobacterium avium
AGLDSVSSGDT

SEQ ID NO: 29017 - protein, 6 aa, Mycobacterium avium
AGLEAS

SEQ ID NO: 29018 - protein, 11 aa, Mycobacterium avium
AGLEPARELPG

SEQ ID NO: 29019 - protein, 5 aa, Mycobacterium avium
AGLGT

SEQ ID NO: 29020 - protein, 6 aa, Mycobacterium avium
AGLGTG

SEQ ID NO: 29021 - protein, 4 aa, Mycobacterium avium
AGLP

SEQ ID NO: 29022 - protein, 8 aa, Mycobacterium avium
AGLPAPDI

SEQ ID NO: 29023 - protein, 5 aa, Mycobacterium avium
AGLPE

SEQ ID NO: 29024 - protein, 12 aa, Mycobacterium avium
AGLPGEPEPEAP

SEQ ID NO: 29025 - protein, 8 aa, Mycobacterium avium
AGLPPATY

SEQ ID NO: 29026 - protein, 8 aa, Mycobacterium avium
AGLRVSSA

SEQ ID NO: 29027 - protein, 9 aa, Mycobacterium avium
AGLSPADVD

SEQ ID NO: 29028 - protein, 12 aa, Mycobacterium avium
AGLSRQGRRGPM

SEQ ID NO: 29029 - protein, 8 aa, Mycobacterium avium
AGLTGGQT

SEQ ID NO: 29030 - protein, 14 aa, Mycobacterium avium
AGMDPVGDDVGTPT

SEQ ID NO: 29031 - protein, 8 aa, Mycobacterium avium
AGMGNAGT

SEQ ID NO: 29032 - protein, 6 aa, Mycobacterium avium
AGMQTS

SEQ ID NO: 29033 - protein, 4 aa, Mycobacterium avium
AGMT

SEQ ID NO: 29034 - protein, 5 aa, Mycobacterium avium
AGNAP

SEQ ID NO: 29035 - protein, 12 aa, Mycobacterium avium
AGNDHSDRSGAL

SEQ ID NO: 29036 - protein, 6 aa, Mycobacterium avium
AGNEKN

SEQ ID NO: 29037 - protein, 7 aa, Mycobacterium avium
AGNGKAD

SEQ ID NO: 29038 - protein, 8 aa, Mycobacterium avium
AGNGMAGL

SEQ ID NO: 29039 - protein, 7 aa, Mycobacterium avium
AGNGPGV

SEQ ID NO: 29040 - protein, 4 aa, Mycobacterium avium
AGNL

SEQ ID NO: 29041 - protein, 12 aa, Mycobacterium avium
AGNMSKRQSATG

SEQ ID NO: 29042 - protein, 7 aa, Mycobacterium avium
AGNPEGE

SEQ ID NO: 29043 - protein, 9 aa, Mycobacterium avium
AGNPELDPD

SEQ ID NO: 29044 - protein, 5 aa, Mycobacterium avium
AGNPM

SEQ ID NO: 29045 - protein, 12 aa, Mycobacterium avium
AGNRGPTAAPQN

SEQ ID NO: 29046 - protein, 11 aa, Mycobacterium avium
AGNSSPLSDGS

SEQ ID NO: 29047 - protein, 5 aa, Mycobacterium avium
AGNTG

SEQ ID NO: 29048 - protein, 6 aa, Mycobacterium avium
AGNVSR

SEQ ID NO: 29049 - protein, 8 aa, Mycobacterium avium
AGPAAAPR

SEQ ID NO: 29050 - protein, 7 aa, Mycobacterium avium
AGPAGGY

SEQ ID NO: 29051 - protein, 6 aa, Mycobacterium avium
AGPAPY

SEQ ID NO: 29052 - protein, 6 aa, Mycobacterium avium
AGPAVV

SEQ ID NO: 29053 - protein, 9 aa, Mycobacterium avium
AGPDFRPSA

SEQ ID NO: 29054 - protein, 10 aa, Mycobacterium avium
AGPDHGVPQD

SEQ ID NO: 29055 - protein, 5 aa, Mycobacterium avium
AGPDL

SEQ ID NO: 29056 - protein, 8 aa, Mycobacterium avium
AGPDRAEK

SEQ ID NO: 29057 - protein, 10 aa, Mycobacterium avium
AGPDRRAAVP

SEQ ID NO: 29058 - protein, 15 aa, Mycobacterium avium
AGPDSTLQSQPANAI

SEQ ID NO: 29059 - protein, 9 aa, Mycobacterium avium
AGPDTSATY

SEQ ID NO: 29060 - protein, 8 aa, Mycobacterium avium
AGPEAAAD

SEQ ID NO: 29061 - protein, 7 aa, Mycobacterium avium
AGPEIGV

SEQ ID NO: 29062 - protein, 9 aa, Mycobacterium avium
AGPEKIGRD

SEQ ID NO: 29063 - protein, 9 aa, Mycobacterium avium
AGPERATEA

SEQ ID NO: 29064 - protein, 4 aa, Mycobacterium avium
AGPG

SEQ ID NO: 29065 - protein, 6 aa, Mycobacterium avium
AGPGAE

SEQ ID NO: 29066 - protein, 8 aa, Mycobacterium avium
AGPGAHGY

SEQ ID NO: 29067 - protein, 10 aa, Mycobacterium avium
AGPGEGSIGF

SEQ ID NO: 29068 - protein, 7 aa, Mycobacterium avium
AGPGNAD

SEQ ID NO: 29069 - protein, 6 aa, Mycobacterium avium
AGPGTR

SEQ ID NO: 29070 - protein, 7 aa, Mycobacterium avium
AGPHGVR

SEQ ID NO: 29071 - protein, 6 aa, Mycobacterium avium
AGPHPF

SEQ ID NO: 29072 - protein, 8 aa, Mycobacterium avium
AGPHPGRG

SEQ ID NO: 29073 - protein, 6 aa, Mycobacterium avium
AGPKEA

SEQ ID NO: 29074 - protein, 6 aa, Mycobacterium avium
AGPKKI

SEQ ID NO: 29075 - protein, 8 aa, Mycobacterium avium
AGPKVTAN

SEQ ID NO: 29076 - protein, 10 aa, Mycobacterium avium
AGPLGAQAAN

SEQ ID NO: 29077 - protein, 6 aa, Mycobacterium avium
AGPNCD

SEQ ID NO: 29078 - protein, 7 aa, Mycobacterium avium
AGPNTLQ

SEQ ID NO: 29079 - protein, 5 aa, Mycobacterium avium
AGPNV

SEQ ID NO: 29080 - protein, 4 aa, Mycobacterium avium
AGPP

SEQ ID NO: 29081 - protein, 8 aa, Mycobacterium avium
AGPPHGPE

SEQ ID NO: 29082 - protein, 5 aa, Mycobacterium avium
AGPQV

SEQ ID NO: 29083 - protein, 6 aa, Mycobacterium avium
AGPQVG

SEQ ID NO: 29084 - protein, 7 aa, Mycobacterium avium
AGPRGTS

SEQ ID NO: 29085 - protein, 8 aa, Mycobacterium avium
AGPRLGKD

SEQ ID NO: 29086 - protein, 6 aa, Mycobacterium avium
AGPRPV

SEQ ID NO: 29087 - protein, 7 aa, Mycobacterium avium
AGPRSSF

SEQ ID NO: 29088 - protein, 5 aa, Mycobacterium avium
AGPSA

SEQ ID NO: 29089 - protein, 6 aa, Mycobacterium avium
AGPSGR

SEQ ID NO: 29090 - protein, 8 aa, Mycobacterium avium
AGPSRAAA

SEQ ID NO: 29091 - protein, 14 aa, Mycobacterium avium
AGPTAGSLSLKPSQ

SEQ ID NO: 29092 - protein, 16 aa, Mycobacterium avium
AGPTDSTVDPSSAWQS

SEQ ID NO: 29093 - protein, 7 aa, Mycobacterium avium
AGPTEFT

SEQ ID NO: 29094 - protein, 8 aa, Mycobacterium avium
AGPTPRVN

SEQ ID NO: 29095 - protein, 4 aa, Mycobacterium avium
AGPV

SEQ ID NO: 29096 - protein, 8 aa, Mycobacterium avium
AGPVPQAE

SEQ ID NO: 29097 - protein, 6 aa, Mycobacterium avium
AGQAAG

SEQ ID NO: 29098 - protein, 6 aa, Mycobacterium avium
AGQAGV

SEQ ID NO: 29099 - protein, 14 aa, Mycobacterium avium
AGQANPAPPVGPAL

SEQ ID NO: 29100 - protein, 5 aa, Mycobacterium avium
AGQCT

SEQ ID NO: 29101 - protein, 4 aa, Mycobacterium avium
AGQG

SEQ ID NO: 29102 - protein, 5 aa, Mycobacterium avium
AGQGF

SEQ ID NO: 29103 - protein, 13 aa, Mycobacterium avium
AGQGGDAGADPHG

SEQ ID NO: 29104 - protein, 6 aa, Mycobacterium avium
AGQHGL

SEQ ID NO: 29105 - protein, 8 aa, Mycobacterium avium
AGQKVGST

SEQ ID NO: 29106 - protein, 4 aa, Mycobacterium avium
AGQM

SEQ ID NO: 29107 - protein, 11 aa, Mycobacterium avium
AGQPAPGAEPL

SEQ ID NO: 29108 - protein, 10 aa, Mycobacterium avium
AGQPGRYRKP

SEQ ID NO: 29109 - protein, 14 aa, Mycobacterium avium
AGQPSVGAPEPVRA

SEQ ID NO: 29110 - protein, 7 aa, Mycobacterium avium
AGQQRST

SEQ ID NO: 29111 - protein, 7 aa, Mycobacterium avium
AGQRDHS

SEQ ID NO: 29112 - protein, 5 aa, Mycobacterium avium
AGQRR

SEQ ID NO: 29113 - protein, 24 aa, Mycobacterium avium
AGQSGPDRAPQIASGTLAPNQGSW

SEQ ID NO: 29114 - protein, 22 aa, Mycobacterium avium
AGQTRELATGPSLAADIAAALR

SEQ ID NO: 29115 - protein, 13 aa, Mycobacterium avium
AGQVRKAGRQTKG

SEQ ID NO: 29116 - protein, 8 aa, Mycobacterium avium
AGRAAREV

SEQ ID NO: 29117 - protein, 11 aa, Mycobacterium avium
AGRAASAEEGI

SEQ ID NO: 29118 - protein, 18 aa, Mycobacterium avium
AGRANKARLNRSPVRSTR

SEQ ID NO: 29119 - protein, 8 aa, Mycobacterium avium
AGRAQAAA

SEQ ID NO: 29120 - protein, 6 aa, Mycobacterium avium
AGRARA

SEQ ID NO: 29121 - protein, 7 aa, Mycobacterium avium
AGRARNV

SEQ ID NO: 29122 - protein, 4 aa, Mycobacterium avium
AGRD

SEQ ID NO: 29123 - protein, 6 aa, Mycobacterium avium
AGRDDT

SEQ ID NO: 29124 - protein, 5 aa, Mycobacterium avium
AGRDG

SEQ ID NO: 29125 - protein, 16 aa, Mycobacterium avium
AGRDGAGKGPTHDPPC

SEQ ID NO: 29126 - protein, 8 aa, Mycobacterium avium
AGRDYADV

SEQ ID NO: 29127 - protein, 13 aa, Mycobacterium avium
AGREDDYLMSRTL

SEQ ID NO: 29128 - protein, 11 aa, Mycobacterium avium
AGRGFSAGTDL

SEQ ID NO: 29129 - protein, 18 aa, Mycobacterium avium
AGRGFSSGADHKSAGTVP

SEQ ID NO: 29130 - protein, 9 aa, Mycobacterium avium
AGRGRPAKR

SEQ ID NO: 29131 - protein, 8 aa, Mycobacterium avium
AGRHGKKS

SEQ ID NO: 29132 - protein, 19 aa, Mycobacterium avium
AGRLTGTDSGSGRLPEAEE

SEQ ID NO: 29133 - protein, 4 aa, Mycobacterium avium
AGRN

SEQ ID NO: 29134 - protein, 6 aa, Mycobacterium avium
AGRNKV

SEQ ID NO: 29135 - protein, 9 aa, Mycobacterium avium
AGRNPKLGY

SEQ ID NO: 29136 - protein, 9 aa, Mycobacterium avium
AGRPAASSW

SEQ ID NO: 29137 - protein, 7 aa, Mycobacterium avium
AGRPAEA

SEQ ID NO: 29138 - protein, 7 aa, Mycobacterium avium
AGRPELY

SEQ ID NO: 29139 - protein, 9 aa, Mycobacterium avium
AGRPEPPIG

SEQ ID NO: 29140 - protein, 6 aa, Mycobacterium avium
AGRPIS

SEQ ID NO: 29141 - protein, 6 aa, Mycobacterium avium
AGRPPV

SEQ ID NO: 29142 - protein, 10 aa, Mycobacterium avium
AGRPSDFPLQ

SEQ ID NO: 29143 - protein, 7 aa, Mycobacterium avium
AGRPVDY

SEQ ID NO: 29144 - protein, 9 aa, Mycobacterium avium
AGRQPAPAV

SEQ ID NO: 29145 - protein, 27 aa, Mycobacterium avium
AGRQPGDTVTYPTPQGEKQVELIAVKL

SEQ ID NO: 29146 - protein, 7 aa, Mycobacterium avium
AGRRDSF

SEQ ID NO: 29147 - protein, 7 aa, Mycobacterium avium
AGRREPI

SEQ ID NO: 29148 - protein, 11 aa, Mycobacterium avium
AGRRPRLTAAS

SEQ ID NO: 29149 - protein, 14 aa, Mycobacterium avium
AGRRRGGSAPDGYR

SEQ ID NO: 29150 - protein, 7 aa, Mycobacterium avium
AGRRSVA

SEQ ID NO: 29151 - protein, 25 aa, Mycobacterium avium
AGRRTEPHERPLDGTPVVDTDRGGK

SEQ ID NO: 29152 - protein, 10 aa, Mycobacterium avium
AGRSAADETA

SEQ ID NO: 29153 - protein, 9 aa, Mycobacterium avium
AGRSGGTNI

SEQ ID NO: 29154 - protein, 6 aa, Mycobacterium avium
AGRSIR

SEQ ID NO: 29155 - protein, 6 aa, Mycobacterium avium
AGRTEQ

SEQ ID NO: 29156 - protein, 7 aa, Mycobacterium avium
AGRTPQL

SEQ ID NO: 29157 - protein, 9 aa, Mycobacterium avium
AGRTPRIGE

SEQ ID NO: 29158 - protein, 11 aa, Mycobacterium avium
AGRTSPGPEEV

SEQ ID NO: 29159 - protein, 11 aa, Mycobacterium avium
AGRVEAVGPDV

SEQ ID NO: 29160 - protein, 29 aa, Mycobacterium avium
AGSAPRAADPDTDAANGAALASSAKNRHE

SEQ ID NO: 29161 - protein, 10 aa, Mycobacterium avium
AGSAQPATDL

SEQ ID NO: 29162 - protein, 9 aa, Mycobacterium avium
AGSDPMDPR

SEQ ID NO: 29163 - protein, 7 aa, Mycobacterium avium
AGSDPPA

SEQ ID NO: 29164 - protein, 9 aa, Mycobacterium avium
AGSDRRPSR

SEQ ID NO: 29165 - protein, 9 aa, Mycobacterium avium
AGSDTRPVQ

SEQ ID NO: 29166 - protein, 11 aa, Mycobacterium avium
AGSEHGSAKTV

SEQ ID NO: 29167 - protein, 5 aa, Mycobacterium avium
AGSEL

SEQ ID NO: 29168 - protein, 7 aa, Mycobacterium avium
AGSEQRR

SEQ ID NO: 29169 - protein, 6 aa, Mycobacterium avium
AGSEVS

SEQ ID NO: 29170 - protein, 6 aa, Mycobacterium avium
AGSGAT

SEQ ID NO: 29171 - protein, 13 aa, Mycobacterium avium
AGSGATSASRDKF

SEQ ID NO: 29172 - protein, 8 aa, Mycobacterium avium
AGSGEAPE

SEQ ID NO: 29173 - protein, 6 aa, Mycobacterium avium
AGSGEF

SEQ ID NO: 29174 - protein, 12 aa, Mycobacterium avium
AGSGESIPFPDN

SEQ ID NO: 29175 - protein, 19 aa, Mycobacterium avium
AGSGGRVTGVRTESGETLS

SEQ ID NO: 29176 - protein, 7 aa, Mycobacterium avium
AGSGIGR

SEQ ID NO: 29177 - protein, 7 aa, Mycobacterium avium
AGSGNIT

SEQ ID NO: 29178 - protein, 8 aa, Mycobacterium avium
AGSGQNCS

SEQ ID NO: 29179 - protein, 6 aa, Mycobacterium avium
AGSGSI

SEQ ID NO: 29180 - protein, 7 aa, Mycobacterium avium
AGSGTAT

SEQ ID NO: 29181 - protein, 6 aa, Mycobacterium avium
AGSGYK

SEQ ID NO: 29182 - protein, 4 aa, Mycobacterium avium
AGSI

SEQ ID NO: 29183 - protein, 4 aa, Mycobacterium avium
AGSL

SEQ ID NO: 29184 - protein, 6 aa, Mycobacterium avium
AGSLEG

SEQ ID NO: 29185 - protein, 9 aa, Mycobacterium avium
AGSLRPTPD

SEQ ID NO: 29186 - protein, 7 aa, Mycobacterium avium
AGSNPQM

SEQ ID NO: 29187 - protein, 5 aa, Mycobacterium avium
AGSPM

SEQ ID NO: 29188 - protein, 15 aa, Mycobacterium avium
AGSPPGDDRVGATRK

SEQ ID NO: 29189 - protein, 7 aa, Mycobacterium avium
AGSPPRR

SEQ ID NO: 29190 - protein, 7 aa, Mycobacterium avium
AGSPQRR

SEQ ID NO: 29191 - protein, 14 aa, Mycobacterium avium
AGSPSALTVRDGEA

SEQ ID NO: 29192 - protein, 6 aa, Mycobacterium avium
AGSQRF

SEQ ID NO: 29193 - protein, 11 aa, Mycobacterium avium
AGSRGSADTVR

SEQ ID NO: 29194 - protein, 12 aa, Mycobacterium avium
AGSRVDPDERRT

SEQ ID NO: 29195 - protein, 7 aa, Mycobacterium avium
AGSSAEI

SEQ ID NO: 29196 - protein, 7 aa, Mycobacterium avium
AGSSAGA

SEQ ID NO: 29197 - protein, 8 aa, Mycobacterium avium
AGSSAGAA

SEQ ID NO: 29198 - protein, 9 aa, Mycobacterium avium
AGSSTTEAF

SEQ ID NO: 29199 - protein, 7 aa, Mycobacterium avium
AGSTAER

SEQ ID NO: 29200 - protein, 10 aa, Mycobacterium avium
AGSTDERDRP

SEQ ID NO: 29201 - protein, 7 aa, Mycobacterium avium
AGSVSER

SEQ ID NO: 29202 - protein, 15 aa, Mycobacterium avium
AGSYAAAEIANTAAV

SEQ ID NO: 29203 - protein, 10 aa, Mycobacterium avium
AGTAEGGNQV

SEQ ID NO: 29204 - protein, 8 aa, Mycobacterium avium
AGTAGQRC

SEQ ID NO: 29205 - protein, 6 aa, Mycobacterium avium
AGTALS

SEQ ID NO: 29206 - protein, 11 aa, Mycobacterium avium
AGTASSEAAAS

SEQ ID NO: 29207 - protein, 8 aa, Mycobacterium avium
AGTASVAR

SEQ ID NO: 29208 - protein, 12 aa, Mycobacterium avium
AGTATLDGPDGR

SEQ ID NO: 29209 - protein, 6 aa, Mycobacterium avium
AGTATV

SEQ ID NO: 29210 - protein, 4 aa, Mycobacterium avium
AGTD

SEQ ID NO: 29211 - protein, 8 aa, Mycobacterium avium
AGTDEEFR

SEQ ID NO: 29212 - protein, 14 aa, Mycobacterium avium
AGTDEQHPDAQGRI

SEQ ID NO: 29213 - protein, 6 aa, Mycobacterium avium
AGTDGA

SEQ ID NO: 29214 - protein, 7 aa, Mycobacterium avium
AGTEDRE

SEQ ID NO: 29215 - protein, 9 aa, Mycobacterium avium
AGTEETLQS

SEQ ID NO: 29216 - protein, 11 aa, Mycobacterium avium
AGTEQERNDAL

SEQ ID NO: 29217 - protein, 11 aa, Mycobacterium avium
AGTGATASVEL

SEQ ID NO: 29218 - protein, 9 aa, Mycobacterium avium
AGTGDEAEL

SEQ ID NO: 29219 - protein, 10 aa, Mycobacterium avium
AGTGGTSATI

SEQ ID NO: 29220 - protein, 5 aa, Mycobacterium avium
AGTGI

SEQ ID NO: 29221 - protein, 7 aa, Mycobacterium avium
AGTGIGR

SEQ ID NO: 29222 - protein, 7 aa, Mycobacterium avium
AGTGKLT

SEQ ID NO: 29223 - protein, 9 aa, Mycobacterium avium
AGTGKTRTI

SEQ ID NO: 29224 - protein, 7 aa, Mycobacterium avium
AGTKDRM

SEQ ID NO: 29225 - protein, 7 aa, Mycobacterium avium
AGTKGLA

SEQ ID NO: 29226 - protein, 9 aa, Mycobacterium avium
AGTLSANGT

SEQ ID NO: 29227 - protein, 5 aa, Mycobacterium avium
AGTNE

SEQ ID NO: 29228 - protein, 7 aa, Mycobacterium avium
AGTNPTL

SEQ ID NO: 29229 - protein, 8 aa, Mycobacterium avium
AGTPEQKR

SEQ ID NO: 29230 - protein, 7 aa, Mycobacterium avium
AGTPGKR

SEQ ID NO: 29231 - protein, 5 aa, Mycobacterium avium
AGTPH

SEQ ID NO: 29232 - protein, 5 aa, Mycobacterium avium
AGTPI

SEQ ID NO: 29233 - protein, 12 aa, Mycobacterium avium
AGTPLGDDDRRP

SEQ ID NO: 29234 - protein, 18 aa, Mycobacterium avium
AGTQAEEAAGQARAAAAA

SEQ ID NO: 29235 - protein, 7 aa, Mycobacterium avium
AGTRDPD

SEQ ID NO: 29236 - protein, 6 aa, Mycobacterium avium
AGTRVT

SEQ ID NO: 29237 - protein, 8 aa, Mycobacterium avium
AGTSPRRA

SEQ ID NO: 29238 - protein, 10 aa, Mycobacterium avium
AGTTDARNEE

SEQ ID NO: 29239 - protein, 6 aa, Mycobacterium avium
AGTTRV

SEQ ID NO: 29240 - protein, 7 aa, Mycobacterium avium
AGTVAEA

SEQ ID NO: 29241 - protein, 6 aa, Mycobacterium avium
AGTVKP

SEQ ID NO: 29242 - protein, 9 aa, Mycobacterium avium
AGTYADPAR

SEQ ID NO: 29243 - protein, 7 aa, Mycobacterium avium
AGTYDTA

SEQ ID NO: 29244 - protein, 7 aa, Mycobacterium avium
AGVAPQD

SEQ ID NO: 29245 - protein, 7 aa, Mycobacterium avium
AGVDAGT

SEQ ID NO: 29246 - protein, 11 aa, Mycobacterium avium
AGVDGSNVGRD

SEQ ID NO: 29247 - protein, 7 aa, Mycobacterium avium
AGVDPDS

SEQ ID NO: 29248 - protein, 6 aa, Mycobacterium avium
AGVDPG

SEQ ID NO: 29249 - protein, 6 aa, Mycobacterium avium
AGVDPR

SEQ ID NO: 29250 - protein, 5 aa, Mycobacterium avium
AGVGD

SEQ ID NO: 29251 - protein, 16 aa, Mycobacterium avium
AGVGEADVQRLRAALL

SEQ ID NO: 29252 - protein, 6 aa, Mycobacterium avium
AGVGGA

SEQ ID NO: 29253 - protein, 6 aa, Mycobacterium avium
AGVGGR

SEQ ID NO: 29254 - protein, 7 aa, Mycobacterium avium
AGVNNLT

SEQ ID NO: 29255 - protein, 6 aa, Mycobacterium avium
AGVNPE

SEQ ID NO: 29256 - protein, 10 aa, Mycobacterium avium
AGVPEGTTSY

SEQ ID NO: 29257 - protein, 8 aa, Mycobacterium avium
AGVPPRDC

SEQ ID NO: 29258 - protein, 5 aa, Mycobacterium avium
AGVPS

SEQ ID NO: 29259 - protein, 20 aa, Mycobacterium avium
AGVRGQPGTAPYSAAKGALE

SEQ ID NO: 29260 - protein, 6 aa, Mycobacterium avium
AGVRPD

SEQ ID NO: 29261 - protein, 7 aa, Mycobacterium avium
AGVSREE

SEQ ID NO: 29262 - protein, 7 aa, Mycobacterium avium
AGVSRPT

SEQ ID NO: 29263 - protein, 6 aa, Mycobacterium avium
AGVSSA

SEQ ID NO: 29264 - protein, 7 aa, Mycobacterium avium
AGVTDPS

SEQ ID NO: 29265 - protein, 5 aa, Mycobacterium avium
AGVTR

SEQ ID NO: 29266 - protein, 8 aa, Mycobacterium avium
AGVTSGDL

SEQ ID NO: 29267 - protein, 6 aa, Mycobacterium avium
AGVTSL

SEQ ID NO: 29268 - protein, 11 aa, Mycobacterium avium
AGWAPATGEPL

SEQ ID NO: 29269 - protein, 18 aa, Mycobacterium avium
AGWSSAPRSSYRKDEMAD

SEQ ID NO: 29270 - protein, 8 aa, Mycobacterium avium
AGYDDDEL

SEQ ID NO: 29271 - protein, 11 aa, Mycobacterium avium
AGYEDALTGEG

SEQ ID NO: 29272 - protein, 5 aa, Mycobacterium avium
AGYKY

SEQ ID NO: 29273 - protein, 8 aa, Mycobacterium avium
AGYPAGPL

SEQ ID NO: 29274 - protein, 20 aa, Mycobacterium avium
AGYSTTGSIEDAVASLRAAL

SEQ ID NO: 29275 - protein, 10 aa, Mycobacterium avium
AHAGDKEKAA

SEQ ID NO: 29276 - protein, 7 aa, Mycobacterium avium
AHDAPQG

SEQ ID NO: 29277 - protein, 5 aa, Mycobacterium avium
AHDED

SEQ ID NO: 29278 - protein, 7 aa, Mycobacterium avium
AHDPELA

SEQ ID NO: 29279 - protein, 6 aa, Mycobacterium avium
AHDPPL

SEQ ID NO: 29280 - protein, 7 aa, Mycobacterium avium
AHDRIGT

SEQ ID NO: 29281 - protein, 8 aa, Mycobacterium avium
AHEEGGER

SEQ ID NO: 29282 - protein, 4 aa, Mycobacterium avium
AHEF

SEQ ID NO: 29283 - protein, 5 aa, Mycobacterium avium
AHEHT

SEQ ID NO: 29284 - protein, 20 aa, Mycobacterium avium
AHEHTSRRRRTAGRGYGPRH

SEQ ID NO: 29285 - protein, 8 aa, Mycobacterium avium
AHERDPLG

SEQ ID NO: 29286 - protein, 8 aa, Mycobacterium avium
AHGGHRET

SEQ ID NO: 29287 - protein, 7 aa, Mycobacterium avium
AHGGTVT

SEQ ID NO: 29288 - protein, 6 aa, Mycobacterium avium
AHGQGG

SEQ ID NO: 29289 - protein, 6 aa, Mycobacterium avium
AHGRPG

SEQ ID NO: 29290 - protein, 11 aa, Mycobacterium avium
AHGSPAAKLAQ

SEQ ID NO: 29291 - protein, 16 aa, Mycobacterium avium
AHGTATPIGDTAEANA

SEQ ID NO: 29292 - protein, 13 aa, Mycobacterium avium
AHGTGNGAEVRPV

SEQ ID NO: 29293 - protein, 7 aa, Mycobacterium avium
AHHTNAT

SEQ ID NO: 29294 - protein, 9 aa, Mycobacterium avium
AHKRSGAEI

SEQ ID NO: 29295 - protein, 6 aa, Mycobacterium avium
AHLGPD

SEQ ID NO: 29296 - protein, 10 aa, Mycobacterium avium
AHPAAAGFPE

SEQ ID NO: 29297 - protein, 7 aa, Mycobacterium avium
AHPDEEG

SEQ ID NO: 29298 - protein, 5 aa, Mycobacterium avium
AHPDR

SEQ ID NO: 29299 - protein, 13 aa, Mycobacterium avium
AHPELKSRPTRPH

SEQ ID NO: 29300 - protein, 7 aa, Mycobacterium avium
AHPEVQA

SEQ ID NO: 29301 - protein, 10 aa, Mycobacterium avium
AHPGGSNTEL

SEQ ID NO: 29302 - protein, 6 aa, Mycobacterium avium
AHPGLA

SEQ ID NO: 29303 - protein, 8 aa, Mycobacterium avium
AHPRSPGL

SEQ ID NO: 29304 - protein, 12 aa, Mycobacterium avium
AHPSAEQAAEGY

SEQ ID NO: 29305 - protein, 7 aa, Mycobacterium avium
AHPSAGE

SEQ ID NO: 29306 - protein, 7 aa, Mycobacterium avium
AHPSLPR

SEQ ID NO: 29307 - protein, 14 aa, Mycobacterium avium
AHQDRADDPSVAET

SEQ ID NO: 29308 - protein, 13 aa, Mycobacterium avium
AHQEADAAATAAA

SEQ ID NO: 29309 - protein, 4 aa, Mycobacterium avium
AHRD

SEQ ID NO: 29310 - protein, 5 aa, Mycobacterium avium
AHRPD

SEQ ID NO: 29311 - protein, 5 aa, Mycobacterium avium
AHRQP

SEQ ID NO: 29312 - protein, 11 aa, Mycobacterium avium
AHRTTDAGELD

SEQ ID NO: 29313 - protein, 5 aa, Mycobacterium avium
AHSDE

SEQ ID NO: 29314 - protein, 20 aa, Mycobacterium avium
AHSDTPAPAGTGSPAYEPYD

SEQ ID NO: 29315 - protein, 19 aa, Mycobacterium avium
AHSGGDHPRLDDDSESAVR

SEQ ID NO: 29316 - protein, 7 aa, Mycobacterium avium
AHSPQRL

SEQ ID NO: 29317 - protein, 7 aa, Mycobacterium avium
AHSVDSS

SEQ ID NO: 29318 - protein, 5 aa, Mycobacterium avium
AHTPD

SEQ ID NO: 29319 - protein, 19 aa, Mycobacterium avium
AIAAGKADGARLSAAVKER

SEQ ID NO: 29320 - protein, 9 aa, Mycobacterium avium
AIAATEDEY

SEQ ID NO: 29321 - protein, 10 aa, Mycobacterium avium
AIANGSEPWR

SEQ ID NO: 29322 - protein, 9 aa, Mycobacterium avium
AIDERGTVS

SEQ ID NO: 29323 - protein, 8 aa, Mycobacterium avium
AIDPDHAS

SEQ ID NO: 29324 - protein, 16 aa, Mycobacterium avium
AIDPKAAAKELGPDGA

SEQ ID NO: 29325 - protein, 7 aa, Mycobacterium avium
AIEDPNG

SEQ ID NO: 29326 - protein, 6 aa, Mycobacterium avium
AIEEQS

SEQ ID NO: 29327 - protein, 9 aa, Mycobacterium avium
AIEQRTGRP

SEQ ID NO: 29328 - protein, 8 aa, Mycobacterium avium
AIGDPDRV

SEQ ID NO: 29329 - protein, 7 aa, Mycobacterium avium
AIGGTRA

SEQ ID NO: 29330 - protein, 6 aa, Mycobacterium avium
AIGRPR

SEQ ID NO: 29331 - protein, 8 aa, Mycobacterium avium
AIGTTTAA

SEQ ID NO: 29332 - protein, 4 aa, Mycobacterium avium
AIND

SEQ ID NO: 29333 - protein, 6 aa, Mycobacterium avium
AINDND

SEQ ID NO: 29334 - protein, 17 aa, Mycobacterium avium
AINQDGASGGLTVPNGV

SEQ ID NO: 29335 - protein, 19 aa, Mycobacterium avium
AINQDGRSAGLSAPSGDAQ

SEQ ID NO: 29336 - protein, 12 aa, Mycobacterium avium
AIPDERSQAEPP

SEQ ID NO: 29337 - protein, 9 aa, Mycobacterium avium
AIPGELDDA

SEQ ID NO: 29338 - protein, 13 aa, Mycobacterium avium
AIPGEPQSLAGDA

SEQ ID NO: 29339 - protein, 6 aa, Mycobacterium avium
AIPGRG

SEQ ID NO: 29340 - protein, 5 aa, Mycobacterium avium
AIPPG

SEQ ID NO: 29341 - protein, 10 aa, Mycobacterium avium
AIPQTNDSVS

SEQ ID NO: 29342 - protein, 12 aa, Mycobacterium avium
AIPRTTSGKLAR

SEQ ID NO: 29343 - protein, 10 aa, Mycobacterium avium
AIRAKGPSAG

SEQ ID NO: 29344 - protein, 6 aa, Mycobacterium avium
AIRDGD

SEQ ID NO: 29345 - protein, 11 aa, Mycobacterium avium
AIRPTGDEREQ

SEQ ID NO: 29346 - protein, 12 aa, Mycobacterium avium
AIRSQQSGYGAH

SEQ ID NO: 29347 - protein, 15 aa, Mycobacterium avium
AISTNQRGAQSGGIV

SEQ ID NO: 29348 - protein, 7 aa, Mycobacterium avium
AISTPAR

SEQ ID NO: 29349 - protein, 10 aa, Mycobacterium avium
AITEPSTGEL

SEQ ID NO: 29350 - protein, 6 aa, Mycobacterium avium
AITERQ

SEQ ID NO: 29351 - protein, 8 aa, Mycobacterium avium
AITPDEGA

SEQ ID NO: 29352 - protein, 11 aa, Mycobacterium avium
AITPGTKALST

SEQ ID NO: 29353 - protein, 8 aa, Mycobacterium avium
AKAAAAAG

SEQ ID NO: 29354 - protein, 8 aa, Mycobacterium avium
AKAAAGAV

SEQ ID NO: 29355 - protein, 12 aa, Mycobacterium avium
AKAAGDAVRNGD

SEQ ID NO: 29356 - protein, 6 aa, Mycobacterium avium
AKAAGI

SEQ ID NO: 29357 - protein, 10 aa, Mycobacterium avium
AKAAGSAMSG

SEQ ID NO: 29358 - protein, 17 aa, Mycobacterium avium
AKAANGGLDPFSPEGQP

SEQ ID NO: 29359 - protein, 11 aa, Mycobacterium avium
AKAARGAPLDG

SEQ ID NO: 29360 - protein, 6 aa, Mycobacterium avium
AKAAVE

SEQ ID NO: 29361 - protein, 7 aa, Mycobacterium avium
AKADLHA

SEQ ID NO: 29362 - protein, 7 aa, Mycobacterium avium
AKADRVA

SEQ ID NO: 29363 - protein, 12 aa, Mycobacterium avium
AKAEAKGDADAV

SEQ ID NO: 29364 - protein, 6 aa, Mycobacterium avium
AKAGAT

SEQ ID NO: 29365 - protein, 5 aa, Mycobacterium avium
AKAGV

SEQ ID NO: 29366 - protein, 10 aa, Mycobacterium avium
AKAKGHLDAG

SEQ ID NO: 29367 - protein, 11 aa, Mycobacterium avium
AKALSDTVTPA

SEQ ID NO: 29368 - protein, 15 aa, Mycobacterium avium
AKANPETGKKTLKAK

SEQ ID NO: 29369 - protein, 8 aa, Mycobacterium avium
AKANTGDG

SEQ ID NO: 29370 - protein, 8 aa, Mycobacterium avium
AKAPQGAR

SEQ ID NO: 29371 - protein, 14 aa, Mycobacterium avium
AKARAAWGSEMVSF

SEQ ID NO: 29372 - protein, 21 aa, Mycobacterium avium
AKARERAARAGLSAARSFEES

SEQ ID NO: 29373 - protein, 6 aa, Mycobacterium avium
AKASPY

SEQ ID NO: 29374 - protein, 7 aa, Mycobacterium avium
AKATRKL

SEQ ID NO: 29375 - protein, 5 aa, Mycobacterium avium
AKAVT

SEQ ID NO: 29376 - protein, 10 aa, Mycobacterium avium
AKDAKQEVAH

SEQ ID NO: 29377 - protein, 21 aa, Mycobacterium avium
AKDGAGAGTIPDPFGGPGRAP

SEQ ID NO: 29378 - protein, 7 aa, Mycobacterium avium
AKDGLGA

SEQ ID NO: 29379 - protein, 5 aa, Mycobacterium avium
AKDPL

SEQ ID NO: 29380 - protein, 7 aa, Mycobacterium avium
AKEGIRG

SEQ ID NO: 29381 - protein, 6 aa, Mycobacterium avium
AKEHDA

SEQ ID NO: 29382 - protein, 6 aa, Mycobacterium avium
AKEQKA

SEQ ID NO: 29383 - protein, 7 aa, Mycobacterium avium
AKEQLRA

SEQ ID NO: 29384 - protein, 6 aa, Mycobacterium avium
AKEQQL

SEQ ID NO: 29385 - protein, 12 aa, Mycobacterium avium
AKEVETKDQIAA

SEQ ID NO: 29386 - protein, 5 aa, Mycobacterium avium
AKEVN

SEQ ID NO: 29387 - protein, 8 aa, Mycobacterium avium
AKGAGLSR

SEQ ID NO: 29388 - protein, 7 aa, Mycobacterium avium
AKGATLA

SEQ ID NO: 29389 - protein, 9 aa, Mycobacterium avium
AKGEDAASL

SEQ ID NO: 29390 - protein, 14 aa, Mycobacterium avium
AKGEPTPEDGYAGS

SEQ ID NO: 29391 - protein, 7 aa, Mycobacterium avium
AKGEWGH

SEQ ID NO: 29392 - protein, 5 aa, Mycobacterium avium
AKGKA

SEQ ID NO: 29393 - protein, 10 aa, Mycobacterium avium
AKGPGVNPFG

SEQ ID NO: 29394 - protein, 4 aa, Mycobacterium avium
AKGR

SEQ ID NO: 29395 - protein, 8 aa, Mycobacterium avium
AKGRGRDM

SEQ ID NO: 29396 - protein, 10 aa, Mycobacterium avium
AKGTSQQHGQ

SEQ ID NO: 29397 - protein, 14 aa, Mycobacterium avium
AKGWPEDGIAPGTR

SEQ ID NO: 29398 - protein, 5 aa, Mycobacterium avium
AKHAR

SEQ ID NO: 29399 - protein, 9 aa, Mycobacterium avium
AKHGPAGAR

SEQ ID NO: 29400 - protein, 12 aa, Mycobacterium avium
AKHGPASSRQYR

SEQ ID NO: 29401 - protein, 7 aa, Mycobacterium avium
AKHGPLD

SEQ ID NO: 29402 - protein, 20 aa, Mycobacterium avium
AKIEGIPDTESAVTPDLLED

SEQ ID NO: 29403 - protein, 9 aa, Mycobacterium avium
AKIGADNDI

SEQ ID NO: 29404 - protein, 8 aa, Mycobacterium avium
AKIGDTTV

SEQ ID NO: 29405 - protein, 12 aa, Mycobacterium avium
AKIGPDKDIPHV

SEQ ID NO: 29406 - protein, 7 aa, Mycobacterium avium
AKIGYPP

SEQ ID NO: 29407 - protein, 8 aa, Mycobacterium avium
AKITGEGE

SEQ ID NO: 29408 - protein, 8 aa, Mycobacterium avium
AKKAASDA

SEQ ID NO: 29409 - protein, 5 aa, Mycobacterium avium
AKKGI

SEQ ID NO: 29410 - protein, 16 aa, Mycobacterium avium
AKKTDDVAGDGTTTAT

SEQ ID NO: 29411 - protein, 14 aa, Mycobacterium avium
AKLAERQGEKSYAQ

SEQ ID NO: 29412 - protein, 6 aa, Mycobacterium avium
AKLGEK

SEQ ID NO: 29413 - protein, 8 aa, Mycobacterium avium
AKLGGADE

SEQ ID NO: 29414 - protein, 6 aa, Mycobacterium avium
AKMAPD

SEQ ID NO: 29415 - protein, 6 aa, Mycobacterium avium
AKMPAD

SEQ ID NO: 29416 - protein, 7 aa, Mycobacterium avium
AKNAGME

SEQ ID NO: 29417 - protein, 5 aa, Mycobacterium avium
AKNDA

SEQ ID NO: 29418 - protein, 6 aa, Mycobacterium avium
AKNHPS

SEQ ID NO: 29419 - protein, 13 aa, Mycobacterium avium
AKNIVDGKPEEIY

SEQ ID NO: 29420 - protein, 9 aa, Mycobacterium avium
AKNRGGTPD

SEQ ID NO: 29421 - protein, 15 aa, Mycobacterium avium
AKNTDTREHDIADSD

SEQ ID NO: 29422 - protein, 17 aa, Mycobacterium avium
AKPAAQQPSWPTDQATA

SEQ ID NO: 29423 - protein, 19 aa, Mycobacterium avium
AKPAGPAGSPEWAPYQEQD

SEQ ID NO: 29424 - protein, 9 aa, Mycobacterium avium
AKPAPRGHS

SEQ ID NO: 29425 - protein, 16 aa, Mycobacterium avium
AKPDDVAALARELLKA

SEQ ID NO: 29426 - protein, 7 aa, Mycobacterium avium
AKPDQTL

SEQ ID NO: 29427 - protein, 8 aa, Mycobacterium avium
AKPEAEIN

SEQ ID NO: 29428 - protein, 8 aa, Mycobacterium avium
AKPERNRA

SEQ ID NO: 29429 - protein, 18 aa, Mycobacterium avium
AKPGEPSWPTPWGRGRPG

SEQ ID NO: 29430 - protein, 13 aa, Mycobacterium avium
AKPGRLAGPDPSL

SEQ ID NO: 29431 - protein, 7 aa, Mycobacterium avium
AKPIPGS

SEQ ID NO: 29432 - protein, 7 aa, Mycobacterium avium
AKPISPA

SEQ ID NO: 29433 - protein, 10 aa, Mycobacterium avium
AKPPPSDSPG

SEQ ID NO: 29434 - protein, 13 aa, Mycobacterium avium
AKPPVTVTDPPAD

SEQ ID NO: 29435 - protein, 16 aa, Mycobacterium avium
AKPTDARKPRLRITVE

SEQ ID NO: 29436 - protein, 21 aa, Mycobacterium avium
AKPTGSLRDFPSSKQPAPSER

SEQ ID NO: 29437 - protein, 10 aa, Mycobacterium avium
AKPTPADAAD

SEQ ID NO: 29438 - protein, 4 aa, Mycobacterium avium
AKPY

SEQ ID NO: 29439 - protein, 11 aa, Mycobacterium avium
AKQALKERKTI

SEQ ID NO: 29440 - protein, 7 aa, Mycobacterium avium
AKQGTNI

SEQ ID NO: 29441 - protein, 21 aa, Mycobacterium avium
AKQKADDLDERARRTVEEANQ

SEQ ID NO: 29442 - protein, 4 aa, Mycobacterium avium
AKQQ

SEQ ID NO: 29443 - protein, 6 aa, Mycobacterium avium
AKQRTQ

SEQ ID NO: 29444 - protein, 10 aa, Mycobacterium avium
AKQTAKSGAT

SEQ ID NO: 29445 - protein, 8 aa, Mycobacterium avium
AKRAEDAG

SEQ ID NO: 29446 - protein, 8 aa, Mycobacterium avium
AKRAVDAG

SEQ ID NO: 29447 - protein, 7 aa, Mycobacterium avium
AKRCRQR

SEQ ID NO: 29448 - protein, 7 aa, Mycobacterium avium
AKRDGDR

SEQ ID NO: 29449 - protein, 11 aa, Mycobacterium avium
AKRRANNDCRD

SEQ ID NO: 29450 - protein, 4 aa, Mycobacterium avium
AKSA

SEQ ID NO: 29451 - protein, 11 aa, Mycobacterium avium
AKSAGEGVAKA

SEQ ID NO: 29452 - protein, 9 aa, Mycobacterium avium
AKSASGGEL

SEQ ID NO: 29453 - protein, 10 aa, Mycobacterium avium
AKSGGAMNAA

SEQ ID NO: 29454 - protein, 8 aa, Mycobacterium avium
AKSGTAEL

SEQ ID NO: 29455 - protein, 7 aa, Mycobacterium avium
AKSGVRR

SEQ ID NO: 29456 - protein, 4 aa, Mycobacterium avium
AKSM

SEQ ID NO: 29457 - protein, 6 aa, Mycobacterium avium
AKSNVQ

SEQ ID NO: 29458 - protein, 6 aa, Mycobacterium avium
AKSPAV

SEQ ID NO: 29459 - protein, 15 aa, Mycobacterium avium
AKSQTAAYGSLPAQG

SEQ ID NO: 29460 - protein, 8 aa, Mycobacterium avium
AKSRNEID

SEQ ID NO: 29461 - protein, 7 aa, Mycobacterium avium
AKSYSAT

SEQ ID NO: 29462 - protein, 12 aa, Mycobacterium avium
AKTFPADNPNRQ

SEQ ID NO: 29463 - protein, 8 aa, Mycobacterium avium
AKTGRTSA

SEQ ID NO: 29464 - protein, 6 aa, Mycobacterium avium
AKTIPD

SEQ ID NO: 29465 - protein, 7 aa, Mycobacterium avium
AKTIRDG

SEQ ID NO: 29466 - protein, 10 aa, Mycobacterium avium
AKTLEEAQYA

SEQ ID NO: 29467 - protein, 10 aa, Mycobacterium avium
AKTPNDPNAL

SEQ ID NO: 29468 - protein, 8 aa, Mycobacterium avium
AKTSDETL

SEQ ID NO: 29469 - protein, 10 aa, Mycobacterium avium
AKVDGSQTGR

SEQ ID NO: 29470 - protein, 4 aa, Mycobacterium avium
AKVG

SEQ ID NO: 29471 - protein, 8 aa, Mycobacterium avium
AKVTSDAA

SEQ ID NO: 29472 - protein, 7 aa, Mycobacterium avium
AKYAPKP

SEQ ID NO: 29473 - protein, 9 aa, Mycobacterium avium
AKYKDRAPR

SEQ ID NO: 29474 - protein, 5 aa, Mycobacterium avium
AKYPD

SEQ ID NO: 29475 - protein, 6 aa, Mycobacterium avium
AKYPET

SEQ ID NO: 29476 - protein, 6 aa, Mycobacterium avium
AKYPTY

SEQ ID NO: 29477 - protein, 5 aa, Mycobacterium avium
ALADG

SEQ ID NO: 29478 - protein, 7 aa, Mycobacterium avium
ALADPDE

SEQ ID NO: 29479 - protein, 6 aa, Mycobacterium avium
ALAGGD

SEQ ID NO: 29480 - protein, 11 aa, Mycobacterium avium
ALAGNGTPEQL

SEQ ID NO: 29481 - protein, 5 aa, Mycobacterium avium
ALAGP

SEQ ID NO: 29482 - protein, 9 aa, Mycobacterium avium
ALAGSHPDG

SEQ ID NO: 29483 - protein, 7 aa, Mycobacterium avium
ALAKTKP

SEQ ID NO: 29484 - protein, 7 aa, Mycobacterium avium
ALANSTG

SEQ ID NO: 29485 - protein, 10 aa, Mycobacterium avium
ALAPAAGSAR

SEQ ID NO: 29486 - protein, 7 aa, Mycobacterium avium
ALAPSTV

SEQ ID NO: 29487 - protein, 14 aa, Mycobacterium avium
ALAQGDSPEPPLRT

SEQ ID NO: 29488 - protein, 10 aa, Mycobacterium avium
ALDADDPDKV

SEQ ID NO: 29489 - protein, 5 aa, Mycobacterium avium
ALDDT

SEQ ID NO: 29490 - protein, 11 aa, Mycobacterium avium
ALDEAGLKPED

SEQ ID NO: 29491 - protein, 8 aa, Mycobacterium avium
ALDGPDGP

SEQ ID NO: 29492 - protein, 9 aa, Mycobacterium avium
ALDPDDEAA

SEQ ID NO: 29493 - protein, 8 aa, Mycobacterium avium
ALDPEEVD

SEQ ID NO: 29494 - protein, 14 aa, Mycobacterium avium
ALDPTGYLNAAVLF

SEQ ID NO: 29495 - protein, 4 aa, Mycobacterium avium
ALDR

SEQ ID NO: 29496 - protein, 9 aa, Mycobacterium avium
ALDSGKPVR

SEQ ID NO: 29497 - protein, 5 aa, Mycobacterium avium
ALEGD

SEQ ID NO: 29498 - protein, 16 aa, Mycobacterium avium
ALEQASAQATASAAAY

SEQ ID NO: 29499 - protein, 7 aa, Mycobacterium avium
ALERAKG

SEQ ID NO: 29500 - protein, 12 aa, Mycobacterium avium
ALERPRSSSHVP

SEQ ID NO: 29501 - protein, 4 aa, Mycobacterium avium
ALES

SEQ ID NO: 29502 - protein, 14 aa, Mycobacterium avium
ALGAAGGGSAETGL

SEQ ID NO: 29503 - protein, 9 aa, Mycobacterium avium
ALGASVPEH

SEQ ID NO: 29504 - protein, 8 aa, Mycobacterium avium
ALGDAGRK

SEQ ID NO: 29505 - protein, 6 aa, Mycobacterium avium
ALGEPS

SEQ ID NO: 29506 - protein, 5 aa, Mycobacterium avium
ALGGR

SEQ ID NO: 29507 - protein, 11 aa, Mycobacterium avium
ALGGTYARKQT

SEQ ID NO: 29508 - protein, 6 aa, Mycobacterium avium
ALGKGA

SEQ ID NO: 29509 - protein, 10 aa, Mycobacterium avium
ALGKPDKKAV

SEQ ID NO: 29510 - protein, 6 aa, Mycobacterium avium
ALGNRN

SEQ ID NO: 29511 - protein, 13 aa, Mycobacterium avium
ALGPGGLSRERAG

SEQ ID NO: 29512 - protein, 6 aa, Mycobacterium avium
ALGRSG

SEQ ID NO: 29513 - protein, 6 aa, Mycobacterium avium
ALKETS

SEQ ID NO: 29514 - protein, 6 aa, Mycobacterium avium
ALKGHP

SEQ ID NO: 29515 - protein, 9 aa, Mycobacterium avium
ALLPPPAPR

SEQ ID NO: 29516 - protein, 5 aa, Mycobacterium avium
ALNEV

SEQ ID NO: 29517 - protein, 8 aa, Mycobacterium avium
ALNNSGTT

SEQ ID NO: 29518 - protein, 7 aa, Mycobacterium avium
ALPADAD

SEQ ID NO: 29519 - protein, 10 aa, Mycobacterium avium
ALPAGPDATD

SEQ ID NO: 29520 - protein, 7 aa, Mycobacterium avium
ALPATSL

SEQ ID NO: 29521 - protein, 6 aa, Mycobacterium avium
ALPDAP

SEQ ID NO: 29522 - protein, 6 aa, Mycobacterium avium
ALPDSA

SEQ ID NO: 29523 - protein, 5 aa, Mycobacterium avium
ALPDT

SEQ ID NO: 29524 - protein, 5 aa, Mycobacterium avium
ALPEP

SEQ ID NO: 29525 - protein, 7 aa, Mycobacterium avium
ALPEPGR

SEQ ID NO: 29526 - protein, 12 aa, Mycobacterium avium
ALPGGDAIGSRP

SEQ ID NO: 29527 - protein, 5 aa, Mycobacterium avium
ALPGQ

SEQ ID NO: 29528 - protein, 12 aa, Mycobacterium avium
ALPGRAVPGDGA

SEQ ID NO: 29529 - protein, 6 aa, Mycobacterium avium
ALPGRR

SEQ ID NO: 29530 - protein, 5 aa, Mycobacterium avium
ALPHK

SEQ ID NO: 29531 - protein, 7 aa, Mycobacterium avium
ALPMPES

SEQ ID NO: 29532 - protein, 4 aa, Mycobacterium avium
ALPP

SEQ ID NO: 29533 - protein, 7 aa, Mycobacterium avium
ALPPARG

SEQ ID NO: 29534 - protein, 7 aa, Mycobacterium avium
ALPPESG

SEQ ID NO: 29535 - protein, 7 aa, Mycobacterium avium
ALPPTEP

SEQ ID NO: 29536 - protein, 9 aa, Mycobacterium avium
ALPRGGADV

SEQ ID NO: 29537 - protein, 15 aa, Mycobacterium avium
ALPRYKDGTVAEQVE

SEQ ID NO: 29538 - protein, 13 aa, Mycobacterium avium
ALPSEKEIQRRAE

SEQ ID NO: 29539 - protein, 10 aa, Mycobacterium avium
ALPSPGSDEQ

SEQ ID NO: 29540 - protein, 7 aa, Mycobacterium avium
ALPSPRR

SEQ ID NO: 29541 - protein, 16 aa, Mycobacterium avium
ALPVGTDGAADDGASE

SEQ ID NO: 29542 - protein, 9 aa, Mycobacterium avium
ALQESRDRV

SEQ ID NO: 29543 - protein, 6 aa, Mycobacterium avium
ALQGRG

SEQ ID NO: 29544 - protein, 13 aa, Mycobacterium avium
ALQPDDPRSSGDN

SEQ ID NO: 29545 - protein, 17 aa, Mycobacterium avium
ALQRASEDALEAAGSAG

SEQ ID NO: 29546 - protein, 12 aa, Mycobacterium avium
ALQRSPDYAPGE

SEQ ID NO: 29547 - protein, 6 aa, Mycobacterium avium
ALQSDQ

SEQ ID NO: 29548 - protein, 4 aa, Mycobacterium avium
ALQT

SEQ ID NO: 29549 - protein, 5 aa, Mycobacterium avium
ALQTK

SEQ ID NO: 29550 - protein, 5 aa, Mycobacterium avium
ALRDG

SEQ ID NO: 29551 - protein, 7 aa, Mycobacterium avium
ALRDSGR

SEQ ID NO: 29552 - protein, 9 aa, Mycobacterium avium
ALRPSQALE

SEQ ID NO: 29553 - protein, 13 aa, Mycobacterium avium
ALSEEEKADAGIA

SEQ ID NO: 29554 - protein, 7 aa, Mycobacterium avium
ALSGSGP

SEQ ID NO: 29555 - protein, 4 aa, Mycobacterium avium
ALSS

SEQ ID NO: 29556 - protein, 9 aa, Mycobacterium avium
ALSSPSGIG

SEQ ID NO: 29557 - protein, 11 aa, Mycobacterium avium
ALSTTKDNRRR

SEQ ID NO: 29558 - protein, 10 aa, Mycobacterium avium
ALTDRRTETV

SEQ ID NO: 29559 - protein, 5 aa, Mycobacterium avium
ALTEA

SEQ ID NO: 29560 - protein, 7 aa, Mycobacterium avium
ALTGGPG

SEQ ID NO: 29561 - protein, 11 aa, Mycobacterium avium
ALTGPKTRPYL

SEQ ID NO: 29562 - protein, 7 aa, Mycobacterium avium
ALTPEEA

SEQ ID NO: 29563 - protein, 8 aa, Mycobacterium avium
ALTPEQAA

SEQ ID NO: 29564 - protein, 10 aa, Mycobacterium avium
AMATKDPRGL

SEQ ID NO: 29565 - protein, 5 aa, Mycobacterium avium
AMENA

SEQ ID NO: 29566 - protein, 4 aa, Mycobacterium avium
AMEP

SEQ ID NO: 29567 - protein, 18 aa, Mycobacterium avium
AMGGVTGRAYGGAGGTLG

SEQ ID NO: 29568 - protein, 12 aa, Mycobacterium avium
AMGPDADPTTVS

SEQ ID NO: 29569 - protein, 8 aa, Mycobacterium avium
AMKETGAN

SEQ ID NO: 29570 - protein, 8 aa, Mycobacterium avium
AMKGNLAK

SEQ ID NO: 29571 - protein, 8 aa, Mycobacterium avium
AMKPPVNP

SEQ ID NO: 29572 - protein, 17 aa, Mycobacterium avium
AMNPEGPLPDSATTVDL

SEQ ID NO: 29573 - protein, 6 aa, Mycobacterium avium
AMPPSV

SEQ ID NO: 29574 - protein, 6 aa, Mycobacterium avium
AMPSED

SEQ ID NO: 29575 - protein, 17 aa, Mycobacterium avium
AMRERSELARKGIARGK

SEQ ID NO: 29576 - protein, 5 aa, Mycobacterium avium
AMSAE

SEQ ID NO: 29577 - protein, 12 aa, Mycobacterium avium
AMSNGRSDSRFT

SEQ ID NO: 29578 - protein, 8 aa, Mycobacterium avium
AMSPAGGV

SEQ ID NO: 29579 - protein, 12 aa, Mycobacterium avium
AMSSGDDAQAAA

SEQ ID NO: 29580 - protein, 7 aa, Mycobacterium avium
AMTGGLG

SEQ ID NO: 29581 - protein, 7 aa, Mycobacterium avium
AMTPQER

SEQ ID NO: 29582 - protein, 8 aa, Mycobacterium avium
ANAAGGDI

SEQ ID NO: 29583 - protein, 12 aa, Mycobacterium avium
ANAARGTPSKGA

SEQ ID NO: 29584 - protein, 10 aa, Mycobacterium avium
ANAARLRSSA

SEQ ID NO: 29585 - protein, 9 aa, Mycobacterium avium
ANAGATEVR

SEQ ID NO: 29586 - protein, 8 aa, Mycobacterium avium
ANAPGIQE

SEQ ID NO: 29587 - protein, 17 aa, Mycobacterium avium
ANAPTDPRSLAEHPKAG

SEQ ID NO: 29588 - protein, 9 aa, Mycobacterium avium
ANASDALTK

SEQ ID NO: 29589 - protein, 5 aa, Mycobacterium avium
ANASP

SEQ ID NO: 29590 - protein, 4 aa, Mycobacterium avium
ANAT

SEQ ID NO: 29591 - protein, 10 aa, Mycobacterium avium
ANAVAGSYAE

SEQ ID NO: 29592 - protein, 7 aa, Mycobacterium avium
ANCPPTR

SEQ ID NO: 29593 - protein, 6 aa, Mycobacterium avium
ANDADE

SEQ ID NO: 29594 - protein, 7 aa, Mycobacterium avium
ANDEQLQ

SEQ ID NO: 29595 - protein, 7 aa, Mycobacterium avium
ANDGDLS

SEQ ID NO: 29596 - protein, 9 aa, Mycobacterium avium
ANDGGGSIR

SEQ ID NO: 29597 - protein, 11 aa, Mycobacterium avium
ANDGKVGGQFE

SEQ ID NO: 29598 - protein, 7 aa, Mycobacterium avium
ANDPERA

SEQ ID NO: 29599 - protein, 6 aa, Mycobacterium avium
ANDSRY

SEQ ID NO: 29600 - protein, 12 aa, Mycobacterium avium
ANDYVGKGLSGG

SEQ ID NO: 29601 - protein, 6 aa, Mycobacterium avium
ANEANI

SEQ ID NO: 29602 - protein, 6 aa, Mycobacterium avium
ANEEAR

SEQ ID NO: 29603 - protein, 6 aa, Mycobacterium avium
ANEPEP

SEQ ID NO: 29604 - protein, 4 aa, Mycobacterium avium
ANER

SEQ ID NO: 29605 - protein, 8 aa, Mycobacterium avium
ANERPVPP

SEQ ID NO: 29606 - protein, 8 aa, Mycobacterium avium
ANESALGQ

SEQ ID NO: 29607 - protein, 13 aa, Mycobacterium avium
ANEYSGQPRPPAV

SEQ ID NO: 29608 - protein, 6 aa, Mycobacterium avium
ANGANV

SEQ ID NO: 29609 - protein, 6 aa, Mycobacterium avium
ANGDHA

SEQ ID NO: 29610 - protein, 5 aa, Mycobacterium avium
ANGDK

SEQ ID NO: 29611 - protein, 6 aa, Mycobacterium avium
ANGDPL

SEQ ID NO: 29612 - protein, 14 aa, Mycobacterium avium
ANGDTSWVFDASAL

SEQ ID NO: 29613 - protein, 5 aa, Mycobacterium avium
ANGGS

SEQ ID NO: 29614 - protein, 6 aa, Mycobacterium avium
ANGGWS

SEQ ID NO: 29615 - protein, 8 aa, Mycobacterium avium
ANGGYGHR

SEQ ID NO: 29616 - protein, 19 aa, Mycobacterium avium
ANGHRGETGWRAIGLPWKQ

SEQ ID NO: 29617 - protein, 12 aa, Mycobacterium avium
ANGQSATGTSKL

SEQ ID NO: 29618 - protein, 8 aa, Mycobacterium avium
ANGSGGRV

SEQ ID NO: 29619 - protein, 6 aa, Mycobacterium avium
ANGSNE

SEQ ID NO: 29620 - protein, 8 aa, Mycobacterium avium
ANGTGQAT

SEQ ID NO: 29621 - protein, 7 aa, Mycobacterium avium
ANGTPIK

SEQ ID NO: 29622 - protein, 14 aa, Mycobacterium avium
ANIGNSAVTSSIAE

SEQ ID NO: 29623 - protein, 19 aa, Mycobacterium avium
ANISGHPAAVDADEARGQL

SEQ ID NO: 29624 - protein, 7 aa, Mycobacterium avium
ANKRSTV

SEQ ID NO: 29625 - protein, 5 aa, Mycobacterium avium
ANLET

SEQ ID NO: 29626 - protein, 13 aa, Mycobacterium avium
ANLTRNAADFGGS

SEQ ID NO: 29627 - protein, 6 aa, Mycobacterium avium
ANNRVR

SEQ ID NO: 29628 - protein, 4 aa, Mycobacterium avium
ANPA

SEQ ID NO: 29629 - protein, 8 aa, Mycobacterium avium
ANPAAQDL

SEQ ID NO: 29630 - protein, 7 aa, Mycobacterium avium
ANPAGGP

SEQ ID NO: 29631 - protein, 10 aa, Mycobacterium avium
ANPASDKPGY

SEQ ID NO: 29632 - protein, 13 aa, Mycobacterium avium
ANPDAHEQPWDKK

SEQ ID NO: 29633 - protein, 8 aa, Mycobacterium avium
ANPDDRAT

SEQ ID NO: 29634 - protein, 5 aa, Mycobacterium avium
ANPDG

SEQ ID NO: 29635 - protein, 7 aa, Mycobacterium avium
ANPDMEA

SEQ ID NO: 29636 - protein, 9 aa, Mycobacterium avium
ANPEDYTNR

SEQ ID NO: 29637 - protein, 10 aa, Mycobacterium avium
ANPGRADSPV

SEQ ID NO: 29638 - protein, 9 aa, Mycobacterium avium
ANPGTSEDE

SEQ ID NO: 29639 - protein, 5 aa, Mycobacterium avium
ANPIE

SEQ ID NO: 29640 - protein, 6 aa, Mycobacterium avium
ANPKVS

SEQ ID NO: 29641 - protein, 7 aa, Mycobacterium avium
ANPLDPA

SEQ ID NO: 29642 - protein, 5 aa, Mycobacterium avium
ANPLK

SEQ ID NO: 29643 - protein, 11 aa, Mycobacterium avium
ANPNGKLTPLR

SEQ ID NO: 29644 - protein, 7 aa, Mycobacterium avium
ANPPADP

SEQ ID NO: 29645 - protein, 6 aa, Mycobacterium avium
ANPSDD

SEQ ID NO: 29646 - protein, 6 aa, Mycobacterium avium
ANPSHL

SEQ ID NO: 29647 - protein, 7 aa, Mycobacterium avium
ANPTGPI

SEQ ID NO: 29648 - protein, 23 aa, Mycobacterium avium
ANQGTSSQKELETKGREAGRAAT

SEQ ID NO: 29649 - protein, 5 aa, Mycobacterium avium
ANQLP

SEQ ID NO: 29650 - protein, 8 aa, Mycobacterium avium
ANQSPARY

SEQ ID NO: 29651 - protein, 8 aa, Mycobacterium avium
ANRAAAQK

SEQ ID NO: 29652 - protein, 11 aa, Mycobacterium avium
ANRASGSAAGI

SEQ ID NO: 29653 - protein, 6 aa, Mycobacterium avium
ANRDDT

SEQ ID NO: 29654 - protein, 7 aa, Mycobacterium avium
ANRDEDV

SEQ ID NO: 29655 - protein, 14 aa, Mycobacterium avium
ANRDEDVFGPDSEE

SEQ ID NO: 29656 - protein, 6 aa, Mycobacterium avium
ANRDEE

SEQ ID NO: 29657 - protein, 12 aa, Mycobacterium avium
ANRDEREYPDPD

SEQ ID NO: 29658 - protein, 14 aa, Mycobacterium avium
ANRDERQYGPDAGE

SEQ ID NO: 29659 - protein, 11 aa, Mycobacterium avium
ANRDERRWERS

SEQ ID NO: 29660 - protein, 11 aa, Mycobacterium avium
ANRDETRWTDP

SEQ ID NO: 29661 - protein, 10 aa, Mycobacterium avium
ANRDPEAFTD

SEQ ID NO: 29662 - protein, 8 aa, Mycobacterium avium
ANRDPKVF

SEQ ID NO: 29663 - protein, 23 aa, Mycobacterium avium
ANRDPRRFDDPATFDPARKNARQ

SEQ ID NO: 29664 - protein, 14 aa, Mycobacterium avium
ANRDPRTRYGPPSA

SEQ ID NO: 29665 - protein, 6 aa, Mycobacterium avium
ANSAYH

SEQ ID NO: 29666 - protein, 4 aa, Mycobacterium avium
ANSP

SEQ ID NO: 29667 - protein, 13 aa, Mycobacterium avium
ANSPKPGRAPTGM

SEQ ID NO: 29668 - protein, 9 aa, Mycobacterium avium
ANSTATVAQ

SEQ ID NO: 29669 - protein, 4 aa, Mycobacterium avium
ANTA

SEQ ID NO: 29670 - protein, 5 aa, Mycobacterium avium
ANTAP

SEQ ID NO: 29671 - protein, 8 aa, Mycobacterium avium
ANTDEGRS

SEQ ID NO: 29672 - protein, 8 aa, Mycobacterium avium
ANTEYDTG

SEQ ID NO: 29673 - protein, 7 aa, Mycobacterium avium
ANTLEAT

SEQ ID NO: 29674 - protein, 7 aa, Mycobacterium avium
ANTLSSY

SEQ ID NO: 29675 - protein, 4 aa, Mycobacterium avium
ANTP

SEQ ID NO: 29676 - protein, 5 aa, Mycobacterium avium
ANTRR

SEQ ID NO: 29677 - protein, 6 aa, Mycobacterium avium
ANTSRD

SEQ ID NO: 29678 - protein, 6 aa, Mycobacterium avium
ANVQDG

SEQ ID NO: 29679 - protein, 18 aa, Mycobacterium avium
ANYADDRHRPDIEGTSRM

SEQ ID NO: 29680 - protein, 8 aa, Mycobacterium avium
APAAADAL

SEQ ID NO: 29681 - protein, 16 aa, Mycobacterium avium
APAAGASSSLLSRPSV

SEQ ID NO: 29682 - protein, 6 aa, Mycobacterium avium
APADPQ

SEQ ID NO: 29683 - protein, 10 aa, Mycobacterium avium
APAESPTTRG

SEQ ID NO: 29684 - protein, 10 aa, Mycobacterium avium
APAGGGPGPH

SEQ ID NO: 29685 - protein, 10 aa, Mycobacterium avium
APAGPGSSVT

SEQ ID NO: 29686 - protein, 7 aa, Mycobacterium avium
APAIAAT

SEQ ID NO: 29687 - protein, 5 aa, Mycobacterium avium
APAKV

SEQ ID NO: 29688 - protein, 9 aa, Mycobacterium avium
APALSDKDI

SEQ ID NO: 29689 - protein, 7 aa, Mycobacterium avium
APANGPA

SEQ ID NO: 29690 - protein, 4 aa, Mycobacterium avium
APAP

SEQ ID NO: 29691 - protein, 9 aa, Mycobacterium avium
APAPAAAAM

SEQ ID NO: 29692 - protein, 13 aa, Mycobacterium avium
APAPAAAPAGSED

SEQ ID NO: 29693 - protein, 12 aa, Mycobacterium avium
APAPTPSGKTGL

SEQ ID NO: 29694 - protein, 5 aa, Mycobacterium avium
APAPV

SEQ ID NO: 29695 - protein, 7 aa, Mycobacterium avium
APAQDYT

SEQ ID NO: 29696 - protein, 6 aa, Mycobacterium avium
APAQGA

SEQ ID NO: 29697 - protein, 16 aa, Mycobacterium avium
APAQRREGYSPSPEGV

SEQ ID NO: 29698 - protein, 5 aa, Mycobacterium avium
APAQS

SEQ ID NO: 29699 - protein, 14 aa, Mycobacterium avium
APARRLATASADDV

SEQ ID NO: 29700 - protein, 4 aa, Mycobacterium avium
APAS

SEQ ID NO: 29701 - protein, 9 aa, Mycobacterium avium
APASADRSR

SEQ ID NO: 29702 - protein, 8 aa, Mycobacterium avium
APASDSAG

SEQ ID NO: 29703 - protein, 6 aa, Mycobacterium avium
APASHR

SEQ ID NO: 29704 - protein, 6 aa, Mycobacterium avium
APASQV

SEQ ID NO: 29705 - protein, 6 aa, Mycobacterium avium
APASWT

SEQ ID NO: 29706 - protein, 4 aa, Mycobacterium avium
APAT

SEQ ID NO: 29707 - protein, 7 aa, Mycobacterium avium
APATDED

SEQ ID NO: 29708 - protein, 15 aa, Mycobacterium avium
APATNPASASAVQAR

SEQ ID NO: 29709 - protein, 10 aa, Mycobacterium avium
APATSAPAGT

SEQ ID NO: 29710 - protein, 5 aa, Mycobacterium avium
APDAD

SEQ ID NO: 29711 - protein, 9 aa, Mycobacterium avium
APDAPRGER

SEQ ID NO: 29712 - protein, 5 aa, Mycobacterium avium
APDAV

SEQ ID NO: 29713 - protein, 6 aa, Mycobacterium avium
APDDEL

SEQ ID NO: 29714 - protein, 8 aa, Mycobacterium avium
APDDPESA

SEQ ID NO: 29715 - protein, 6 aa, Mycobacterium avium
APDDTT

SEQ ID NO: 29716 - protein, 4 aa, Mycobacterium avium
APDG

SEQ ID NO: 29717 - protein, 21 aa, Mycobacterium avium
APDGTGRAAVPPAAVRPPGQR

SEQ ID NO: 29718 - protein, 5 aa, Mycobacterium avium
APDHG

SEQ ID NO: 29719 - protein, 9 aa, Mycobacterium avium
APDHQNTKK

SEQ ID NO: 29720 - protein, 7 aa, Mycobacterium avium
APDIPRE

SEQ ID NO: 29721 - protein, 8 aa, Mycobacterium avium
APDNRLDD

SEQ ID NO: 29722 - protein, 7 aa, Mycobacterium avium
APDPADL

SEQ ID NO: 29723 - protein, 12 aa, Mycobacterium avium
APDPADLDERTE

SEQ ID NO: 29724 - protein, 7 aa, Mycobacterium avium
APDPDGG

SEQ ID NO: 29725 - protein, 8 aa, Mycobacterium avium
APDPPLGD

SEQ ID NO: 29726 - protein, 9 aa, Mycobacterium avium
APDRLEHDA

SEQ ID NO: 29727 - protein, 6 aa, Mycobacterium avium
APDSDA

SEQ ID NO: 29728 - protein, 5 aa, Mycobacterium avium
APDSL

SEQ ID NO: 29729 - protein, 9 aa, Mycobacterium avium
APDSPAGRR

SEQ ID NO: 29730 - protein, 8 aa, Mycobacterium avium
APDSPVGK

SEQ ID NO: 29731 - protein, 8 aa, Mycobacterium avium
APDTPEIA

SEQ ID NO: 29732 - protein, 6 aa, Mycobacterium avium
APDVES

SEQ ID NO: 29733 - protein, 6 aa, Mycobacterium avium
APDVTE

SEQ ID NO: 29734 - protein, 6 aa, Mycobacterium avium
APDWPQ

SEQ ID NO: 29735 - protein, 6 aa, Mycobacterium avium
APEAAS

SEQ ID NO: 29736 - protein, 6 aa, Mycobacterium avium
APEDAA

SEQ ID NO: 29737 - protein, 7 aa, Mycobacterium avium
APEDPGS

SEQ ID NO: 29738 - protein, 4 aa, Mycobacterium avium
APEE

SEQ ID NO: 29739 - protein, 10 aa, Mycobacterium avium
APEGADYPAG

SEQ ID NO: 29740 - protein, 6 aa, Mycobacterium avium
APEGEG

SEQ ID NO: 29741 - protein, 8 aa, Mycobacterium avium
APEHPPTT

SEQ ID NO: 29742 - protein, 5 aa, Mycobacterium avium
APENV

SEQ ID NO: 29743 - protein, 7 aa, Mycobacterium avium
APEPDVD

SEQ ID NO: 29744 - protein, 15 aa, Mycobacterium avium
APEPLAAPPPPEPIP

SEQ ID NO: 29745 - protein, 7 aa, Mycobacterium avium
APEPPRV

SEQ ID NO: 29746 - protein, 7 aa, Mycobacterium avium
APEPSHD

SEQ ID NO: 29747 - protein, 6 aa, Mycobacterium avium
APEQGL

SEQ ID NO: 29748 - protein, 11 aa, Mycobacterium avium
APESPPPAQFD

SEQ ID NO: 29749 - protein, 5 aa, Mycobacterium avium
APFAE

SEQ ID NO: 29750 - protein, 8 aa, Mycobacterium avium
APFAPKGR

SEQ ID NO: 29751 - protein, 15 aa, Mycobacterium avium
APFGGYKQSGNGREM

SEQ ID NO: 29752 - protein, 5 aa, Mycobacterium avium
APFPT

SEQ ID NO: 29753 - protein, 4 aa, Mycobacterium avium
APFQ

SEQ ID NO: 29754 - protein, 11 aa, Mycobacterium avium
APFTDASSTYK

SEQ ID NO: 29755 - protein, 6 aa, Mycobacterium avium
APGADV

SEQ ID NO: 29756 - protein, 5 aa, Mycobacterium avium
APGAE

SEQ ID NO: 29757 - protein, 5 aa, Mycobacterium avium
APGAP

SEQ ID NO: 29758 - protein, 5 aa, Mycobacterium avium
APGAQ

SEQ ID NO: 29759 - protein, 7 aa, Mycobacterium avium
APGAQSQ

SEQ ID NO: 29760 - protein, 20 aa, Mycobacterium avium
APGARPDPELGGPDALAGDD

SEQ ID NO: 29761 - protein, 8 aa, Mycobacterium avium
APGARTGW

SEQ ID NO: 29762 - protein, 4 aa, Mycobacterium avium
APGC

SEQ ID NO: 29763 - protein, 7 aa, Mycobacterium avium
APGCDRP

SEQ ID NO: 29764 - protein, 4 aa, Mycobacterium avium
APGD

SEQ ID NO: 29765 - protein, 11 aa, Mycobacterium avium
APGDAKTLNSN

SEQ ID NO: 29766 - protein, 6 aa, Mycobacterium avium
APGDPS

SEQ ID NO: 29767 - protein, 6 aa, Mycobacterium avium
APGELR

SEQ ID NO: 29768 - protein, 7 aa, Mycobacterium avium
APGFGDR

SEQ ID NO: 29769 - protein, 14 aa, Mycobacterium avium
APGFNGQPSVVNGA

SEQ ID NO: 29770 - protein, 4 aa, Mycobacterium avium
APGG

SEQ ID NO: 29771 - protein, 8 aa, Mycobacterium avium
APGGDAAA

SEQ ID NO: 29772 - protein, 5 aa, Mycobacterium avium
APGGL

SEQ ID NO: 29773 - protein, 4 aa, Mycobacterium avium
APGI

SEQ ID NO: 29774 - protein, 12 aa, Mycobacterium avium
APGIASASEADT

SEQ ID NO: 29775 - protein, 11 aa, Mycobacterium avium
APGNAGTARLA

SEQ ID NO: 29776 - protein, 8 aa, Mycobacterium avium
APGNIPTP

SEQ ID NO: 29777 - protein, 6 aa, Mycobacterium avium
APGPAG

SEQ ID NO: 29778 - protein, 13 aa, Mycobacterium avium
APGPDGAPRPVAR

SEQ ID NO: 29779 - protein, 7 aa, Mycobacterium avium
APGPGRR

SEQ ID NO: 29780 - protein, 6 aa, Mycobacterium avium
APGPVT

SEQ ID NO: 29781 - protein, 7 aa, Mycobacterium avium
APGQAAY

SEQ ID NO: 29782 - protein, 8 aa, Mycobacterium avium
APGQHSLE

SEQ ID NO: 29783 - protein, 7 aa, Mycobacterium avium
APGQPAR

SEQ ID NO: 29784 - protein, 11 aa, Mycobacterium avium
APGQVGSSAMP

SEQ ID NO: 29785 - protein, 5 aa, Mycobacterium avium
APGRL

SEQ ID NO: 29786 - protein, 6 aa, Mycobacterium avium
APGSAE

SEQ ID NO: 29787 - protein, 23 aa, Mycobacterium avium
APGSEYAPNTDGPDGQYPGSDPE

SEQ ID NO: 29788 - protein, 13 aa, Mycobacterium avium
APGSKPIDLFGAP

SEQ ID NO: 29789 - protein, 12 aa, Mycobacterium avium
APGSRAASIGYR

SEQ ID NO: 29790 - protein, 13 aa, Mycobacterium avium
APGTAGGTGPEVH

SEQ ID NO: 29791 - protein, 7 aa, Mycobacterium avium
APGTGIP

SEQ ID NO: 29792 - protein, 8 aa, Mycobacterium avium
APGTGLRD

SEQ ID NO: 29793 - protein, 8 aa, Mycobacterium avium
APGTGTAH

SEQ ID NO: 29794 - protein, 8 aa, Mycobacterium avium
APGVDDSA

SEQ ID NO: 29795 - protein, 4 aa, Mycobacterium avium
APHA

SEQ ID NO: 29796 - protein, 14 aa, Mycobacterium avium
APHGPLAQDPDAKR

SEQ ID NO: 29797 - protein, 6 aa, Mycobacterium avium
APHPQV

SEQ ID NO: 29798 - protein, 4 aa, Mycobacterium avium
APHQ

SEQ ID NO: 29799 - protein, 5 aa, Mycobacterium avium
APHRE

SEQ ID NO: 29800 - protein, 8 aa, Mycobacterium avium
APHSPMAG

SEQ ID NO: 29801 - protein, 6 aa, Mycobacterium avium
APIGRT

SEQ ID NO: 29802 - protein, 22 aa, Mycobacterium avium
APINTAAKAGLSELAKLATNRS

SEQ ID NO: 29803 - protein, 7 aa, Mycobacterium avium
APIQGSA

SEQ ID NO: 29804 - protein, 6 aa, Mycobacterium avium
APITGT

SEQ ID NO: 29805 - protein, 6 aa, Mycobacterium avium
APKARD

SEQ ID NO: 29806 - protein, 6 aa, Mycobacterium avium
APKDLQ

SEQ ID NO: 29807 - protein, 22 aa, Mycobacterium avium
APKPEASAEAVEETAEMPRPTA

SEQ ID NO: 29808 - protein, 16 aa, Mycobacterium avium
APKPGYEDAIETDTGN

SEQ ID NO: 29809 - protein, 7 aa, Mycobacterium avium
APKPMLP

SEQ ID NO: 29810 - protein, 8 aa, Mycobacterium avium
APKSALGH

SEQ ID NO: 29811 - protein, 19 aa, Mycobacterium avium
APKSEGVEPDSTAVSRRRA

SEQ ID NO: 29812 - protein, 8 aa, Mycobacterium avium
APKTGRSI

SEQ ID NO: 29813 - protein, 4 aa, Mycobacterium avium
APLA

SEQ ID NO: 29814 - protein, 9 aa, Mycobacterium avium
APLAQRATK

SEQ ID NO: 29815 - protein, 9 aa, Mycobacterium avium
APLCSPSRG

SEQ ID NO: 29816 - protein, 9 aa, Mycobacterium avium
APLEPGQKD

SEQ ID NO: 29817 - protein, 7 aa, Mycobacterium avium
APLESNA

SEQ ID NO: 29818 - protein, 6 aa, Mycobacterium avium
APLGDA

SEQ ID NO: 29819 - protein, 6 aa, Mycobacterium avium
APLHET

SEQ ID NO: 29820 - protein, 4 aa, Mycobacterium avium
APLP

SEQ ID NO: 29821 - protein, 6 aa, Mycobacterium avium
APLPAP

SEQ ID NO: 29822 - protein, 6 aa, Mycobacterium avium
APLPCT

SEQ ID NO: 29823 - protein, 13 aa, Mycobacterium avium
APLPRPRAEAYDR

SEQ ID NO: 29824 - protein, 15 aa, Mycobacterium avium
APLQKNGAPRSGERI

SEQ ID NO: 29825 - protein, 8 aa, Mycobacterium avium
APLQPDEY

SEQ ID NO: 29826 - protein, 21 aa, Mycobacterium avium
APLRTDQSPFDAPLPRSEAKG

SEQ ID NO: 29827 - protein, 4 aa, Mycobacterium avium
APLS

SEQ ID NO: 29828 - protein, 9 aa, Mycobacterium avium
APLSGEPAV

SEQ ID NO: 29829 - protein, 8 aa, Mycobacterium avium
APLTEQDQ

SEQ ID NO: 29830 - protein, 7 aa, Mycobacterium avium
APLTETA

SEQ ID NO: 29831 - protein, 8 aa, Mycobacterium avium
APMESGEL

SEQ ID NO: 29832 - protein, 10 aa, Mycobacterium avium
APMPNSLPGQ

SEQ ID NO: 29833 - protein, 10 aa, Mycobacterium avium
APMSAGDDGW

SEQ ID NO: 29834 - protein, 5 aa, Mycobacterium avium
APNLN

SEQ ID NO: 29835 - protein, 9 aa, Mycobacterium avium
APNPTDQAS

SEQ ID NO: 29836 - protein, 5 aa, Mycobacterium avium
APNQA

SEQ ID NO: 29837 - protein, 10 aa, Mycobacterium avium
APNRRQRKSC

SEQ ID NO: 29838 - protein, 14 aa, Mycobacterium avium
APNTGNAIRTAAAT

SEQ ID NO: 29839 - protein, 12 aa, Mycobacterium avium
APNYSPGHGAGH

SEQ ID NO: 29840 - protein, 4 aa, Mycobacterium avium
APPA

SEQ ID NO: 29841 - protein, 7 aa, Mycobacterium avium
APPAAGA

SEQ ID NO: 29842 - protein, 6 aa, Mycobacterium avium
APPAEL

SEQ ID NO: 29843 - protein, 12 aa, Mycobacterium avium
APPCAQPADFGE

SEQ ID NO: 29844 - protein, 6 aa, Mycobacterium avium
APPDAR

SEQ ID NO: 29845 - protein, 6 aa, Mycobacterium avium
APPDDW

SEQ ID NO: 29846 - protein, 5 aa, Mycobacterium avium
APPDL

SEQ ID NO: 29847 - protein, 7 aa, Mycobacterium avium
APPDTSL

SEQ ID NO: 29848 - protein, 4 aa, Mycobacterium avium
APPG

SEQ ID NO: 29849 - protein, 5 aa, Mycobacterium avium
APPGI

SEQ ID NO: 29850 - protein, 6 aa, Mycobacterium avium
APPGIR

SEQ ID NO: 29851 - protein, 5 aa, Mycobacterium avium
APPGL

SEQ ID NO: 29852 - protein, 6 aa, Mycobacterium avium
APPGLL

SEQ ID NO: 29853 - protein, 18 aa, Mycobacterium avium
APPGPAYGDTISGTNLAG

SEQ ID NO: 29854 - protein, 10 aa, Mycobacterium avium
APPGPSTSEI

SEQ ID NO: 29855 - protein, 8 aa, Mycobacterium avium
APPGSFNN

SEQ ID NO: 29856 - protein, 7 aa, Mycobacterium avium
APPGSPA

SEQ ID NO: 29857 - protein, 8 aa, Mycobacterium avium
APPGTVGS

SEQ ID NO: 29858 - protein, 5 aa, Mycobacterium avium
APPGY

SEQ ID NO: 29859 - protein, 6 aa, Mycobacterium avium
APPGYV

SEQ ID NO: 29860 - protein, 4 aa, Mycobacterium avium
APPH

SEQ ID NO: 29861 - protein, 6 aa, Mycobacterium avium
APPHGG

SEQ ID NO: 29862 - protein, 4 aa, Mycobacterium avium
APPI

SEQ ID NO: 29863 - protein, 5 aa, Mycobacterium avium
APPMP

SEQ ID NO: 29864 - protein, 6 aa, Mycobacterium avium
APPNLV

SEQ ID NO: 29865 - protein, 4 aa, Mycobacterium avium
APPP

SEQ ID NO: 29866 - protein, 8 aa, Mycobacterium avium
APPPEVTS

SEQ ID NO: 29867 - protein, 10 aa, Mycobacterium avium
APPPQETRPR

SEQ ID NO: 29868 - protein, 6 aa, Mycobacterium avium
APPQGF

SEQ ID NO: 29869 - protein, 8 aa, Mycobacterium avium
APPRDRRG

SEQ ID NO: 29870 - protein, 9 aa, Mycobacterium avium
APPRPPHAA

SEQ ID NO: 29871 - protein, 11 aa, Mycobacterium avium
APPRRQQTSDG

SEQ ID NO: 29872 - protein, 6 aa, Mycobacterium avium
APPRSP

SEQ ID NO: 29873 - protein, 8 aa, Mycobacterium avium
APPSVASG

SEQ ID NO: 29874 - protein, 7 aa, Mycobacterium avium
APPTADE

SEQ ID NO: 29875 - protein, 6 aa, Mycobacterium avium
APPTGR

SEQ ID NO: 29876 - protein, 6 aa, Mycobacterium avium
APPVEE

SEQ ID NO: 29877 - protein, 5 aa, Mycobacterium avium
APPVK

SEQ ID NO: 29878 - protein, 7 aa, Mycobacterium avium
APPYDDA

SEQ ID NO: 29879 - protein, 9 aa, Mycobacterium avium
APPYNRRSR

SEQ ID NO: 29880 - protein, 5 aa, Mycobacterium avium
APQAG

SEQ ID NO: 29881 - protein, 5 aa, Mycobacterium avium
APQDD

SEQ ID NO: 29882 - protein, 19 aa, Mycobacterium avium
APQIGNTGWNGEDAESRGD

SEQ ID NO: 29883 - protein, 9 aa, Mycobacterium avium
APQPAQPWS

SEQ ID NO: 29884 - protein, 5 aa, Mycobacterium avium
APQPG

SEQ ID NO: 29885 - protein, 8 aa, Mycobacterium avium
APQPPERW

SEQ ID NO: 29886 - protein, 5 aa, Mycobacterium avium
APQQR

SEQ ID NO: 29887 - protein, 4 aa, Mycobacterium avium
APQR

SEQ ID NO: 29888 - protein, 5 aa, Mycobacterium avium
APQRT

SEQ ID NO: 29889 - protein, 8 aa, Mycobacterium avium
APQTGAAQ

SEQ ID NO: 29890 - protein, 14 aa, Mycobacterium avium
APQTGPAPGFAEQT

SEQ ID NO: 29891 - protein, 7 aa, Mycobacterium avium
APRDAAR

SEQ ID NO: 29892 - protein, 7 aa, Mycobacterium avium
APRDGRH

SEQ ID NO: 29893 - protein, 4 aa, Mycobacterium avium
APRE

SEQ ID NO: 29894 - protein, 7 aa, Mycobacterium avium
APRGTRY

SEQ ID NO: 29895 - protein, 7 aa, Mycobacterium avium
APRPERE

SEQ ID NO: 29896 - protein, 6 aa, Mycobacterium avium
APRPGE

SEQ ID NO: 29897 - protein, 6 aa, Mycobacterium avium
APRPGR

SEQ ID NO: 29898 - protein, 8 aa, Mycobacterium avium
APRPTTPF

SEQ ID NO: 29899 - protein, 8 aa, Mycobacterium avium
APRSPSDC

SEQ ID NO: 29900 - protein, 7 aa, Mycobacterium avium
APRSTGA

SEQ ID NO: 29901 - protein, 5 aa, Mycobacterium avium
APRTA

SEQ ID NO: 29902 - protein, 5 aa, Mycobacterium avium
APRTL

SEQ ID NO: 29903 - protein, 17 aa, Mycobacterium avium
APRTRSGAALPRSADTV

SEQ ID NO: 29904 - protein, 5 aa, Mycobacterium avium
APRTS

SEQ ID NO: 29905 - protein, 8 aa, Mycobacterium avium
APSARTRM

SEQ ID NO: 29906 - protein, 4 aa, Mycobacterium avium
APSF

SEQ ID NO: 29907 - protein, 14 aa, Mycobacterium avium
APSGELKTKPTQHS

SEQ ID NO: 29908 - protein, 11 aa, Mycobacterium avium
APSGGGTDVTE

SEQ ID NO: 29909 - protein, 4 aa, Mycobacterium avium
APSI

SEQ ID NO: 29910 - protein, 4 aa, Mycobacterium avium
APSK

SEQ ID NO: 29911 - protein, 5 aa, Mycobacterium avium
APSKQ

SEQ ID NO: 29912 - protein, 8 aa, Mycobacterium avium
APSLPAAA

SEQ ID NO: 29913 - protein, 10 aa, Mycobacterium avium
APSPALHGHR

SEQ ID NO: 29914 - protein, 8 aa, Mycobacterium avium
APSPSAAV

SEQ ID NO: 29915 - protein, 4 aa, Mycobacterium avium
APSR

SEQ ID NO: 29916 - protein, 6 aa, Mycobacterium avium
APSRDN

SEQ ID NO: 29917 - protein, 4 aa, Mycobacterium avium
APST

SEQ ID NO: 29918 - protein, 37 aa, Mycobacterium avium
APTAEELAEEGAGEVTEEPAAAEAEEAGEEEAAEAES

SEQ ID NO: 29919 - protein, 15 aa, Mycobacterium avium
APTAVGATAVGPSLP

SEQ ID NO: 29920 - protein, 5 aa, Mycobacterium avium
APTDG

SEQ ID NO: 29921 - protein, 5 aa, Mycobacterium avium
APTEA

SEQ ID NO: 29922 - protein, 4 aa, Mycobacterium avium
APTI

SEQ ID NO: 29923 - protein, 6 aa, Mycobacterium avium
APTLGA

SEQ ID NO: 29924 - protein, 4 aa, Mycobacterium avium
APTP

SEQ ID NO: 29925 - protein, 6 aa, Mycobacterium avium
APTPMQ

SEQ ID NO: 29926 - protein, 5 aa, Mycobacterium avium
APTQR

SEQ ID NO: 29927 - protein, 5 aa, Mycobacterium avium
APTRA

SEQ ID NO: 29928 - protein, 6 aa, Mycobacterium avium
APTRRQ

SEQ ID NO: 29929 - protein, 4 aa, Mycobacterium avium
APTT

SEQ ID NO: 29930 - protein, 4 aa, Mycobacterium avium
APTV

SEQ ID NO: 29931 - protein, 13 aa, Mycobacterium avium
APVADREGRVDQQ

SEQ ID NO: 29932 - protein, 25 aa, Mycobacterium avium
APVDGRGGGKADLAQGSGKDPAGID

SEQ ID NO: 29933 - protein, 6 aa, Mycobacterium avium
APVDHS

SEQ ID NO: 29934 - protein, 7 aa, Mycobacterium avium
APVNDGA

SEQ ID NO: 29935 - protein, 8 aa, Mycobacterium avium
APVPAGAT

SEQ ID NO: 29936 - protein, 7 aa, Mycobacterium avium
APVPGTG

SEQ ID NO: 29937 - protein, 10 aa, Mycobacterium avium
APVPGYRGSR

SEQ ID NO: 29938 - protein, 6 aa, Mycobacterium avium
APVQQR

SEQ ID NO: 29939 - protein, 12 aa, Mycobacterium avium
APVSELRSGGLG

SEQ ID NO: 29940 - protein, 5 aa, Mycobacterium avium
APVSG

SEQ ID NO: 29941 - protein, 13 aa, Mycobacterium avium
APVSGGGGAAAEG

SEQ ID NO: 29942 - protein, 8 aa, Mycobacterium avium
APWSTGHT

SEQ ID NO: 29943 - protein, 10 aa, Mycobacterium avium
APYDPDSSRE

SEQ ID NO: 29944 - protein, 6 aa, Mycobacterium avium
APYEAT

SEQ ID NO: 29945 - protein, 4 aa, Mycobacterium avium
APYP

SEQ ID NO: 29946 - protein, 6 aa, Mycobacterium avium
APYPDY

SEQ ID NO: 29947 - protein, 12 aa, Mycobacterium avium
APYPGRTGNAGH

SEQ ID NO: 29948 - protein, 5 aa, Mycobacterium avium
APYPR

SEQ ID NO: 29949 - protein, 7 aa, Mycobacterium avium
APYSGAS

SEQ ID NO: 29950 - protein, 5 aa, Mycobacterium avium
APYTD

SEQ ID NO: 29951 - protein, 9 aa, Mycobacterium avium
APYTERPGF

SEQ ID NO: 29952 - protein, 6 aa, Mycobacterium avium
AQAAGG

SEQ ID NO: 29953 - protein, 5 aa, Mycobacterium avium
AQAAQ

SEQ ID NO: 29954 - protein, 7 aa, Mycobacterium avium
AQADPGF

SEQ ID NO: 29955 - protein, 9 aa, Mycobacterium avium
AQADTVDEA

SEQ ID NO: 29956 - protein, 13 aa, Mycobacterium avium
AQAEGARGDSAAA

SEQ ID NO: 29957 - protein, 14 aa, Mycobacterium avium
AQAEGARGDSTAAA

SEQ ID NO: 29958 - protein, 5 aa, Mycobacterium avium
AQAEH

SEQ ID NO: 29959 - protein, 13 aa, Mycobacterium avium
AQAERSGEPIPPL

SEQ ID NO: 29960 - protein, 9 aa, Mycobacterium avium
AQALSSTAA

SEQ ID NO: 29961 - protein, 14 aa, Mycobacterium avium
AQAPARRGRHKNIP

SEQ ID NO: 29962 - protein, 5 aa, Mycobacterium avium
AQAPD

SEQ ID NO: 29963 - protein, 7 aa, Mycobacterium avium
AQAQSFS

SEQ ID NO: 29964 - protein, 28 aa, Mycobacterium avium
AQARSEAQLRQAQEKADALQADAERKHS

SEQ ID NO: 29965 - protein, 11 aa, Mycobacterium avium
AQARSFTGSQA

SEQ ID NO: 29966 - protein, 10 aa, Mycobacterium avium
AQARTAVTAT

SEQ ID NO: 29967 - protein, 4 aa, Mycobacterium avium
AQAS

SEQ ID NO: 29968 - protein, 6 aa, Mycobacterium avium
AQASGV

SEQ ID NO: 29969 - protein, 7 aa, Mycobacterium avium
AQATGSG

SEQ ID NO: 29970 - protein, 7 aa, Mycobacterium avium
AQCRAGA

SEQ ID NO: 29971 - protein, 10 aa, Mycobacterium avium
AQDARGSSLD

SEQ ID NO: 29972 - protein, 9 aa, Mycobacterium avium
AQDDDGAPT

SEQ ID NO: 29973 - protein, 9 aa, Mycobacterium avium
AQDDNQGKF

SEQ ID NO: 29974 - protein, 7 aa, Mycobacterium avium
AQDDTVR

SEQ ID NO: 29975 - protein, 10 aa, Mycobacterium avium
AQDENGWYDT

SEQ ID NO: 29976 - protein, 4 aa, Mycobacterium avium
AQDI

SEQ ID NO: 29977 - protein, 6 aa, Mycobacterium avium
AQDNGP

SEQ ID NO: 29978 - protein, 8 aa, Mycobacterium avium
AQDREENI

SEQ ID NO: 29979 - protein, 8 aa, Mycobacterium avium
AQDTAALG

SEQ ID NO: 29980 - protein, 7 aa, Mycobacterium avium
AQDTSEL

SEQ ID NO: 29981 - protein, 9 aa, Mycobacterium avium
AQEAKRGDG

SEQ ID NO: 29982 - protein, 19 aa, Mycobacterium avium
AQEARRAIKEGDLRDDIDP

SEQ ID NO: 29983 - protein, 7 aa, Mycobacterium avium
AQELSGL

SEQ ID NO: 29984 - protein, 27 aa, Mycobacterium avium
AQEPDLRERGESSMAASRGRGEQPGYE

SEQ ID NO: 29985 - protein, 13 aa, Mycobacterium avium
AQEPNYDAALAAA

SEQ ID NO: 29986 - protein, 9 aa, Mycobacterium avium
AQETLNGGK

SEQ ID NO: 29987 - protein, 4 aa, Mycobacterium avium
AQGA

SEQ ID NO: 29988 - protein, 9 aa, Mycobacterium avium
AQGAAADGE

SEQ ID NO: 29989 - protein, 11 aa, Mycobacterium avium
AQGARAPERLD

SEQ ID NO: 29990 - protein, 7 aa, Mycobacterium avium
AQGAWTG

SEQ ID NO: 29991 - protein, 5 aa, Mycobacterium avium
AQGGG

SEQ ID NO: 29992 - protein, 15 aa, Mycobacterium avium
AQGGTSLGDGPARAW

SEQ ID NO: 29993 - protein, 6 aa, Mycobacterium avium
AQGIRS

SEQ ID NO: 29994 - protein, 6 aa, Mycobacterium avium
AQGLSE

SEQ ID NO: 29995 - protein, 8 aa, Mycobacterium avium
AQGPGKIA

SEQ ID NO: 29996 - protein, 4 aa, Mycobacterium avium
AQGR

SEQ ID NO: 29997 - protein, 8 aa, Mycobacterium avium
AQGRGLGE

SEQ ID NO: 29998 - protein, 7 aa, Mycobacterium avium
AQGRPEA

SEQ ID NO: 29999 - protein, 6 aa, Mycobacterium avium
AQGTGL

SEQ ID NO: 30000 - protein, 9 aa, Mycobacterium avium
AQGTPEDVA

SEQ ID NO: 30001 - protein, 8 aa, Mycobacterium avium
AQGTTATI

SEQ ID NO: 30002 - protein, 26 aa, Mycobacterium avium
AQGVASVGGDIGSGLSEGLGATTASL

SEQ ID NO: 30003 - protein, 5 aa, Mycobacterium avium
AQGYS

SEQ ID NO: 30004 - protein, 10 aa, Mycobacterium avium
AQGYSDSQGI

SEQ ID NO: 30005 - protein, 10 aa, Mycobacterium avium
AQHARNEAEL

SEQ ID NO: 30006 - protein, 13 aa, Mycobacterium avium
AQHPASEPAITGS

SEQ ID NO: 30007 - protein, 4 aa, Mycobacterium avium
AQIA

SEQ ID NO: 30008 - protein, 6 aa, Mycobacterium avium
AQIGIA

SEQ ID NO: 30009 - protein, 12 aa, Mycobacterium avium
AQIPPPDERRAY

SEQ ID NO: 30010 - protein, 8 aa, Mycobacterium avium
AQKAASEA

SEQ ID NO: 30011 - protein, 9 aa, Mycobacterium avium
AQKDQPAAQ

SEQ ID NO: 30012 - protein, 10 aa, Mycobacterium avium
AQKGADGRMH

SEQ ID NO: 30013 - protein, 7 aa, Mycobacterium avium
AQKPLDG

SEQ ID NO: 30014 - protein, 6 aa, Mycobacterium avium
AQLPAD

SEQ ID NO: 30015 - protein, 8 aa, Mycobacterium avium
AQLSDAEV

SEQ ID NO: 30016 - protein, 7 aa, Mycobacterium avium
AQLSPEE

SEQ ID NO: 30017 - protein, 11 aa, Mycobacterium avium
AQLTGGRTTPT

SEQ ID NO: 30018 - protein, 5 aa, Mycobacterium avium
AQNAA

SEQ ID NO: 30019 - protein, 6 aa, Mycobacterium avium
AQNAES

SEQ ID NO: 30020 - protein, 6 aa, Mycobacterium avium
AQNAFG

SEQ ID NO: 30021 - protein, 4 aa, Mycobacterium avium
AQNH

SEQ ID NO: 30022 - protein, 7 aa, Mycobacterium avium
AQNTTAE

SEQ ID NO: 30023 - protein, 14 aa, Mycobacterium avium
AQPANGRPNHVRTS

SEQ ID NO: 30024 - protein, 6 aa, Mycobacterium avium
AQPDCK

SEQ ID NO: 30025 - protein, 10 aa, Mycobacterium avium
AQPGPDRDDA

SEQ ID NO: 30026 - protein, 6 aa, Mycobacterium avium
AQPGQH

SEQ ID NO: 30027 - protein, 9 aa, Mycobacterium avium
AQPGSHKSI

SEQ ID NO: 30028 - protein, 6 aa, Mycobacterium avium
AQPKYV

SEQ ID NO: 30029 - protein, 5 aa, Mycobacterium avium
AQPNQ

SEQ ID NO: 30030 - protein, 4 aa, Mycobacterium avium
AQPR

SEQ ID NO: 30031 - protein, 6 aa, Mycobacterium avium
AQPREL

SEQ ID NO: 30032 - protein, 5 aa, Mycobacterium avium
AQPTA

SEQ ID NO: 30033 - protein, 6 aa, Mycobacterium avium
AQPTEP

SEQ ID NO: 30034 - protein, 10 aa, Mycobacterium avium
AQPVTTMDPT

SEQ ID NO: 30035 - protein, 16 aa, Mycobacterium avium
AQPWADGGATSAGNGL

SEQ ID NO: 30036 - protein, 7 aa, Mycobacterium avium
AQQGGTV

SEQ ID NO: 30037 - protein, 5 aa, Mycobacterium avium
AQQGS

SEQ ID NO: 30038 - protein, 10 aa, Mycobacterium avium
AQQPDGAPGL

SEQ ID NO: 30039 - protein, 8 aa, Mycobacterium avium
AQQPGFRG

SEQ ID NO: 30040 - protein, 6 aa, Mycobacterium avium
AQQQSV

SEQ ID NO: 30041 - protein, 5 aa, Mycobacterium avium
AQQRY

SEQ ID NO: 30042 - protein, 15 aa, Mycobacterium avium
AQQTEPIGTDPGLAD

SEQ ID NO: 30043 - protein, 6 aa, Mycobacterium avium
AQQTGS

SEQ ID NO: 30044 - protein, 12 aa, Mycobacterium avium
AQRAASADTRGV

SEQ ID NO: 30045 - protein, 7 aa, Mycobacterium avium
AQRALDE

SEQ ID NO: 30046 - protein, 6 aa, Mycobacterium avium
AQRAQT

SEQ ID NO: 30047 - protein, 5 aa, Mycobacterium avium
AQRDA

SEQ ID NO: 30048 - protein, 7 aa, Mycobacterium avium
AQRDGID

SEQ ID NO: 30049 - protein, 6 aa, Mycobacterium avium
AQRDRV

SEQ ID NO: 30050 - protein, 4 aa, Mycobacterium avium
AQRG

SEQ ID NO: 30051 - protein, 5 aa, Mycobacterium avium
AQRGA

SEQ ID NO: 30052 - protein, 7 aa, Mycobacterium avium
AQRGMGR

SEQ ID NO: 30053 - protein, 6 aa, Mycobacterium avium
AQRGRA

SEQ ID NO: 30054 - protein, 34 aa, Mycobacterium avium
AQRHGLNRDTPDPKGARYGRDADGELDGTAEETG

SEQ ID NO: 30055 - protein, 7 aa, Mycobacterium avium
AQRKNPW

SEQ ID NO: 30056 - protein, 12 aa, Mycobacterium avium
AQRLPSEGPAVK

SEQ ID NO: 30057 - protein, 7 aa, Mycobacterium avium
AQRNGTP

SEQ ID NO: 30058 - protein, 12 aa, Mycobacterium avium
AQRQATKEAGQI

SEQ ID NO: 30059 - protein, 5 aa, Mycobacterium avium
AQRQL

SEQ ID NO: 30060 - protein, 7 aa, Mycobacterium avium
AQRQPDE

SEQ ID NO: 30061 - protein, 8 aa, Mycobacterium avium
AQRRDPDA

SEQ ID NO: 30062 - protein, 6 aa, Mycobacterium avium
AQRREA

SEQ ID NO: 30063 - protein, 13 aa, Mycobacterium avium
AQRSRLSKQLGDR

SEQ ID NO: 30064 - protein, 7 aa, Mycobacterium avium
AQRTPAL

SEQ ID NO: 30065 - protein, 5 aa, Mycobacterium avium
AQRVR

SEQ ID NO: 30066 - protein, 7 aa, Mycobacterium avium
AQRVTDA

SEQ ID NO: 30067 - protein, 7 aa, Mycobacterium avium
AQSAGAT

SEQ ID NO: 30068 - protein, 4 aa, Mycobacterium avium
AQSE

SEQ ID NO: 30069 - protein, 5 aa, Mycobacterium avium
AQSEP

SEQ ID NO: 30070 - protein, 5 aa, Mycobacterium avium
AQSGR

SEQ ID NO: 30071 - protein, 10 aa, Mycobacterium avium
AQSPDIAQGV

SEQ ID NO: 30072 - protein, 7 aa, Mycobacterium avium
AQTADND

SEQ ID NO: 30073 - protein, 6 aa, Mycobacterium avium
AQTDPE

SEQ ID NO: 30074 - protein, 10 aa, Mycobacterium avium
AQTESEQMKE

SEQ ID NO: 30075 - protein, 7 aa, Mycobacterium avium
AQTGLTK

SEQ ID NO: 30076 - protein, 9 aa, Mycobacterium avium
AQTGTGKTA

SEQ ID NO: 30077 - protein, 6 aa, Mycobacterium avium
AQTMAG

SEQ ID NO: 30078 - protein, 5 aa, Mycobacterium avium
AQTQT

SEQ ID NO: 30079 - protein, 10 aa, Mycobacterium avium
AQTSFDSGQQ

SEQ ID NO: 30080 - protein, 6 aa, Mycobacterium avium
AQTSGG

SEQ ID NO: 30081 - protein, 13 aa, Mycobacterium avium
AQVDADPFDRAGT

SEQ ID NO: 30082 - protein, 10 aa, Mycobacterium avium
AQVDGESVAG

SEQ ID NO: 30083 - protein, 10 aa, Mycobacterium avium
AQVPTELPTS

SEQ ID NO: 30084 - protein, 9 aa, Mycobacterium avium
AQVSEAGDA

SEQ ID NO: 30085 - protein, 4 aa, Mycobacterium avium
AQWN

SEQ ID NO: 30086 - protein, 12 aa, Mycobacterium avium
AQYEDQGNPYYS

SEQ ID NO: 30087 - protein, 4 aa, Mycobacterium avium
ARAA

SEQ ID NO: 30088 - protein, 15 aa, Mycobacterium avium
ARAAAGNAAAGAERI

SEQ ID NO: 30089 - protein, 12 aa, Mycobacterium avium
ARAAGAGSRRET

SEQ ID NO: 30090 - protein, 10 aa, Mycobacterium avium
ARAAGTPSPR

SEQ ID NO: 30091 - protein, 11 aa, Mycobacterium avium
ARAAKQATIAR

SEQ ID NO: 30092 - protein, 10 aa, Mycobacterium avium
ARAARGEDDV

SEQ ID NO: 30093 - protein, 4 aa, Mycobacterium avium
ARAD

SEQ ID NO: 30094 - protein, 7 aa, Mycobacterium avium
ARADAAR

SEQ ID NO: 30095 - protein, 7 aa, Mycobacterium avium
ARADLGQ

SEQ ID NO: 30096 - protein, 14 aa, Mycobacterium avium
ARADPGRTRAHPGN

SEQ ID NO: 30097 - protein, 5 aa, Mycobacterium avium
ARAEE

SEQ ID NO: 30098 - protein, 8 aa, Mycobacterium avium
ARAEETDH

SEQ ID NO: 30099 - protein, 19 aa, Mycobacterium avium
ARAEGNRALDSGDHEGALR

SEQ ID NO: 30100 - protein, 6 aa, Mycobacterium avium
ARAEGY

SEQ ID NO: 30101 - protein, 5 aa, Mycobacterium avium
ARAEN

SEQ ID NO: 30102 - protein, 7 aa, Mycobacterium avium
ARAEQGL

SEQ ID NO: 30103 - protein, 7 aa, Mycobacterium avium
ARAERGG

SEQ ID NO: 30104 - protein, 7 aa, Mycobacterium avium
ARAERRA

SEQ ID NO: 30105 - protein, 13 aa, Mycobacterium avium
ARAERRPPVFTDD

SEQ ID NO: 30106 - protein, 4 aa, Mycobacterium avium
ARAG

SEQ ID NO: 30107 - protein, 10 aa, Mycobacterium avium
ARAGAPPRPS

SEQ ID NO: 30108 - protein, 6 aa, Mycobacterium avium
ARAGEI

SEQ ID NO: 30109 - protein, 9 aa, Mycobacterium avium
ARAGGADAV

SEQ ID NO: 30110 - protein, 9 aa, Mycobacterium avium
ARAGKPAPH

SEQ ID NO: 30111 - protein, 10 aa, Mycobacterium avium
ARAGQADRDR

SEQ ID NO: 30112 - protein, 6 aa, Mycobacterium avium
ARAGVG

SEQ ID NO: 30113 - protein, 19 aa, Mycobacterium avium
ARAHRDLQGRKTTGSIVLL

SEQ ID NO: 30114 - protein, 9 aa, Mycobacterium avium
ARAKEQDTE

SEQ ID NO: 30115 - protein, 8 aa, Mycobacterium avium
ARAKESFG

SEQ ID NO: 30116 - protein, 7 aa, Mycobacterium avium
ARAKMSG

SEQ ID NO: 30117 - protein, 7 aa, Mycobacterium avium
ARAKSDR

SEQ ID NO: 30118 - protein, 8 aa, Mycobacterium avium
ARAKYNPA

SEQ ID NO: 30119 - protein, 7 aa, Mycobacterium avium
ARALGES

SEQ ID NO: 30120 - protein, 8 aa, Mycobacterium avium
ARALPAPE

SEQ ID NO: 30121 - protein, 7 aa, Mycobacterium avium
ARANADQ

SEQ ID NO: 30122 - protein, 8 aa, Mycobacterium avium
ARANRTPI

SEQ ID NO: 30123 - protein, 15 aa, Mycobacterium avium
ARAPRPYDAGNHDDD

SEQ ID NO: 30124 - protein, 15 aa, Mycobacterium avium
ARAQARQSIKAATDD

SEQ ID NO: 30125 - protein, 8 aa, Mycobacterium avium
ARAQRVTS

SEQ ID NO: 30126 - protein, 11 aa, Mycobacterium avium
ARAQSVTRTPD

SEQ ID NO: 30127 - protein, 5 aa, Mycobacterium avium
ARAQY

SEQ ID NO: 30128 - protein, 5 aa, Mycobacterium avium
ARARG

SEQ ID NO: 30129 - protein, 22 aa, Mycobacterium avium
ARARHERPGDVGEQPAPPRFDP

SEQ ID NO: 30130 - protein, 17 aa, Mycobacterium avium
ARARSGNLKPDELSGGT

SEQ ID NO: 30131 - protein, 13 aa, Mycobacterium avium
ARATDAYEEARDT

SEQ ID NO: 30132 - protein, 39 aa, Mycobacterium avium
ARATDEQRRRRERANAERKAAALRTQAAKLGAKATKAVA

SEQ ID NO: 30133 - protein, 6 aa, Mycobacterium avium
ARATQT

SEQ ID NO: 30134 - protein, 12 aa, Mycobacterium avium
ARAVADPSIPMP

SEQ ID NO: 30135 - protein, 5 aa, Mycobacterium avium
ARAVG

SEQ ID NO: 30136 - protein, 9 aa, Mycobacterium avium
ARDAGGPAP

SEQ ID NO: 30137 - protein, 10 aa, Mycobacterium avium
ARDATEDDLR

SEQ ID NO: 30138 - protein, 17 aa, Mycobacterium avium
ARDESTASMATEAGREA

SEQ ID NO: 30139 - protein, 7 aa, Mycobacterium avium
ARDGDGV

SEQ ID NO: 30140 - protein, 7 aa, Mycobacterium avium
ARDGDIT

SEQ ID NO: 30141 - protein, 7 aa, Mycobacterium avium
ARDGEPT

SEQ ID NO: 30142 - protein, 6 aa, Mycobacterium avium
ARDGHN

SEQ ID NO: 30143 - protein, 6 aa, Mycobacterium avium
ARDGIR

SEQ ID NO: 30144 - protein, 10 aa, Mycobacterium avium
ARDGKLTAED

SEQ ID NO: 30145 - protein, 5 aa, Mycobacterium avium
ARDHR

SEQ ID NO: 30146 - protein, 14 aa, Mycobacterium avium
ARDIATNAVEKASD

SEQ ID NO: 30147 - protein, 7 aa, Mycobacterium avium
ARDKPLS

SEQ ID NO: 30148 - protein, 7 aa, Mycobacterium avium
ARDLAKP

SEQ ID NO: 30149 - protein, 6 aa, Mycobacterium avium
ARDQTE

SEQ ID NO: 30150 - protein, 7 aa, Mycobacterium avium
ARDRGTT

SEQ ID NO: 30151 - protein, 18 aa, Mycobacterium avium
ARDSATVGGMASTNAGGL

SEQ ID NO: 30152 - protein, 9 aa, Mycobacterium avium
ARDSSDPRP

SEQ ID NO: 30153 - protein, 7 aa, Mycobacterium avium
ARDTEGR

SEQ ID NO: 30154 - protein, 6 aa, Mycobacterium avium
ARDTEI

SEQ ID NO: 30155 - protein, 6 aa, Mycobacterium avium
ARDTRP

SEQ ID NO: 30156 - protein, 8 aa, Mycobacterium avium
AREAESAG

SEQ ID NO: 30157 - protein, 4 aa, Mycobacterium avium
AREF

SEQ ID NO: 30158 - protein, 6 aa, Mycobacterium avium
AREGGL

SEQ ID NO: 30159 - protein, 8 aa, Mycobacterium avium
AREGPFPY

SEQ ID NO: 30160 - protein, 6 aa, Mycobacterium avium
AREHGG

SEQ ID NO: 30161 - protein, 5 aa, Mycobacterium avium
AREHN

SEQ ID NO: 30162 - protein, 6 aa, Mycobacterium avium
ARENND

SEQ ID NO: 30163 - protein, 5 aa, Mycobacterium avium
ARENP

SEQ ID NO: 30164 - protein, 14 aa, Mycobacterium avium
AREQPLAGVSGASV

SEQ ID NO: 30165 - protein, 6 aa, Mycobacterium avium
ARERDD

SEQ ID NO: 30166 - protein, 11 aa, Mycobacterium avium
ARERDPAAPTT

SEQ ID NO: 30167 - protein, 6 aa, Mycobacterium avium
ARESAG

SEQ ID NO: 30168 - protein, 11 aa, Mycobacterium avium
ARESGTNALAD

SEQ ID NO: 30169 - protein, 5 aa, Mycobacterium avium
ARETA

SEQ ID NO: 30170 - protein, 8 aa, Mycobacterium avium
ARETGATP

SEQ ID NO: 30171 - protein, 6 aa, Mycobacterium avium
ARETLA

SEQ ID NO: 30172 - protein, 11 aa, Mycobacterium avium
ARETSKDDAER

SEQ ID NO: 30173 - protein, 7 aa, Mycobacterium avium
AREVRDT

SEQ ID NO: 30174 - protein, 5 aa, Mycobacterium avium
ARFAD

SEQ ID NO: 30175 - protein, 6 aa, Mycobacterium avium
ARFGER

SEQ ID NO: 30176 - protein, 7 aa, Mycobacterium avium
ARGADVD

SEQ ID NO: 30177 - protein, 17 aa, Mycobacterium avium
ARGAGLDDLAADEVPVV

SEQ ID NO: 30178 - protein, 6 aa, Mycobacterium avium
ARGAGV

SEQ ID NO: 30179 - protein, 18 aa, Mycobacterium avium
ARGASSAASAASATTDAA

SEQ ID NO: 30180 - protein, 12 aa, Mycobacterium avium
ARGDAEPKGGLE

SEQ ID NO: 30181 - protein, 9 aa, Mycobacterium avium
ARGEFRPRP

SEQ ID NO: 30182 - protein, 9 aa, Mycobacterium avium
ARGETPNPC

SEQ ID NO: 30183 - protein, 4 aa, Mycobacterium avium
ARGG

SEQ ID NO: 30184 - protein, 9 aa, Mycobacterium avium
ARGGEPATR

SEQ ID NO: 30185 - protein, 8 aa, Mycobacterium avium
ARGGGQTM

SEQ ID NO: 30186 - protein, 16 aa, Mycobacterium avium
ARGGKAAGSVSKKTDY

SEQ ID NO: 30187 - protein, 7 aa, Mycobacterium avium
ARGGTSR

SEQ ID NO: 30188 - protein, 5 aa, Mycobacterium avium
ARGGV

SEQ ID NO: 30189 - protein, 4 aa, Mycobacterium avium
ARGH

SEQ ID NO: 30190 - protein, 7 aa, Mycobacterium avium
ARGHDRH

SEQ ID NO: 30191 - protein, 5 aa, Mycobacterium avium
ARGIG

SEQ ID NO: 30192 - protein, 6 aa, Mycobacterium avium
ARGIGA

SEQ ID NO: 30193 - protein, 5 aa, Mycobacterium avium
ARGKK

SEQ ID NO: 30194 - protein, 8 aa, Mycobacterium avium
ARGKSGRL

SEQ ID NO: 30195 - protein, 7 aa, Mycobacterium avium
ARGMGAP

SEQ ID NO: 30196 - protein, 9 aa, Mycobacterium avium
ARGNSDVAP

SEQ ID NO: 30197 - protein, 8 aa, Mycobacterium avium
ARGPAGHG

SEQ ID NO: 30198 - protein, 6 aa, Mycobacterium avium
ARGPGN

SEQ ID NO: 30199 - protein, 11 aa, Mycobacterium avium
ARGQQDSRYPL

SEQ ID NO: 30200 - protein, 6 aa, Mycobacterium avium
ARGQSQ

SEQ ID NO: 30201 - protein, 10 aa, Mycobacterium avium
ARGRADDTDE

SEQ ID NO: 30202 - protein, 10 aa, Mycobacterium avium
ARGRGPVSRA

SEQ ID NO: 30203 - protein, 14 aa, Mycobacterium avium
ARGRTTAGGRRYPV

SEQ ID NO: 30204 - protein, 9 aa, Mycobacterium avium
ARGSQHDDV

SEQ ID NO: 30205 - protein, 4 aa, Mycobacterium avium
ARGT

SEQ ID NO: 30206 - protein, 6 aa, Mycobacterium avium
ARGTGY

SEQ ID NO: 30207 - protein, 11 aa, Mycobacterium avium
ARGTKYPDEVE

SEQ ID NO: 30208 - protein, 8 aa, Mycobacterium avium
ARGTSAAE

SEQ ID NO: 30209 - protein, 9 aa, Mycobacterium avium
ARGVPEPAA

SEQ ID NO: 30210 - protein, 11 aa, Mycobacterium avium
ARGYRGRPDLT

SEQ ID NO: 30211 - protein, 8 aa, Mycobacterium avium
ARHAKDPL

SEQ ID NO: 30212 - protein, 22 aa, Mycobacterium avium
ARHASRRTGPHQRAHAPATRPV

SEQ ID NO: 30213 - protein, 20 aa, Mycobacterium avium
ARHGGGAFSGKDPSKVDRSA

SEQ ID NO: 30214 - protein, 8 aa, Mycobacterium avium
ARHGTLDA

SEQ ID NO: 30215 - protein, 5 aa, Mycobacterium avium
ARHIT

SEQ ID NO: 30216 - protein, 6 aa, Mycobacterium avium
ARHPPV

SEQ ID NO: 30217 - protein, 4 aa, Mycobacterium avium
ARHT

SEQ ID NO: 30218 - protein, 6 aa, Mycobacterium avium
ARIQPE

SEQ ID NO: 30219 - protein, 9 aa, Mycobacterium avium
ARKATTGPL

SEQ ID NO: 30220 - protein, 9 aa, Mycobacterium avium
ARKDGYTST

SEQ ID NO: 30221 - protein, 10 aa, Mycobacterium avium
ARKEAVGPQT

SEQ ID NO: 30222 - protein, 15 aa, Mycobacterium avium
ARKEGRHGDAAELEN

SEQ ID NO: 30223 - protein, 10 aa, Mycobacterium avium
ARKGRGPGGI

SEQ ID NO: 30224 - protein, 5 aa, Mycobacterium avium
ARKHG

SEQ ID NO: 30225 - protein, 7 aa, Mycobacterium avium
ARKNLEA

SEQ ID NO: 30226 - protein, 7 aa, Mycobacterium avium
ARKRRAE

SEQ ID NO: 30227 - protein, 7 aa, Mycobacterium avium
ARKVEKA

SEQ ID NO: 30228 - protein, 6 aa, Mycobacterium avium
ARLAAE

SEQ ID NO: 30229 - protein, 5 aa, Mycobacterium avium
ARLAE

SEQ ID NO: 30230 - protein, 11 aa, Mycobacterium avium
ARLTPRSNNRQ

SEQ ID NO: 30231 - protein, 17 aa, Mycobacterium avium
ARNGVGTGISASDRATT

SEQ ID NO: 30232 - protein, 6 aa, Mycobacterium avium
ARNRAV

SEQ ID NO: 30233 - protein, 4 aa, Mycobacterium avium
ARNS

SEQ ID NO: 30234 - protein, 12 aa, Mycobacterium avium
ARNSGRGIRSGA

SEQ ID NO: 30235 - protein, 9 aa, Mycobacterium avium
ARNSGRRDK

SEQ ID NO: 30236 - protein, 6 aa, Mycobacterium avium
ARNVSG

SEQ ID NO: 30237 - protein, 6 aa, Mycobacterium avium
ARPAAQ

SEQ ID NO: 30238 - protein, 8 aa, Mycobacterium avium
ARPADEPI

SEQ ID NO: 30239 - protein, 5 aa, Mycobacterium avium
ARPAG

SEQ ID NO: 30240 - protein, 9 aa, Mycobacterium avium
ARPAGADPL

SEQ ID NO: 30241 - protein, 25 aa, Mycobacterium avium
ARPAPPPRGTRTTTRTARNGARTAT

SEQ ID NO: 30242 - protein, 5 aa, Mycobacterium avium
ARPDL

SEQ ID NO: 30243 - protein, 11 aa, Mycobacterium avium
ARPDPQPVEGL

SEQ ID NO: 30244 - protein, 9 aa, Mycobacterium avium
ARPEDLDET

SEQ ID NO: 30245 - protein, 5 aa, Mycobacterium avium
ARPER

SEQ ID NO: 30246 - protein, 11 aa, Mycobacterium avium
ARPESPGGSLD

SEQ ID NO: 30247 - protein, 4 aa, Mycobacterium avium
ARPF

SEQ ID NO: 30248 - protein, 4 aa, Mycobacterium avium
ARPG

SEQ ID NO: 30249 - protein, 9 aa, Mycobacterium avium
ARPGEKAPL

SEQ ID NO: 30250 - protein, 9 aa, Mycobacterium avium
ARPGGNKQR

SEQ ID NO: 30251 - protein, 12 aa, Mycobacterium avium
ARPGPPSTDYTR

SEQ ID NO: 30252 - protein, 12 aa, Mycobacterium avium
ARPGTPLHDPGK

SEQ ID NO: 30253 - protein, 13 aa, Mycobacterium avium
ARPITERKEAAVI

SEQ ID NO: 30254 - protein, 6 aa, Mycobacterium avium
ARPKRY

SEQ ID NO: 30255 - protein, 13 aa, Mycobacterium avium
ARPLTQDDTNIER

SEQ ID NO: 30256 - protein, 11 aa, Mycobacterium avium
ARPPEEDPQGT

SEQ ID NO: 30257 - protein, 13 aa, Mycobacterium avium
ARPRASAFGRDAY

SEQ ID NO: 30258 - protein, 5 aa, Mycobacterium avium
ARPRG

SEQ ID NO: 30259 - protein, 15 aa, Mycobacterium avium
ARPRPARTHAGSSAA

SEQ ID NO: 30260 - protein, 9 aa, Mycobacterium avium
ARPRPQALA

SEQ ID NO: 30261 - protein, 6 aa, Mycobacterium avium
ARPRRD

SEQ ID NO: 30262 - protein, 8 aa, Mycobacterium avium
ARPRYTEP

SEQ ID NO: 30263 - protein, 9 aa, Mycobacterium avium
ARPSEPGGV

SEQ ID NO: 30264 - protein, 10 aa, Mycobacterium avium
ARPSSAEETD

SEQ ID NO: 30265 - protein, 8 aa, Mycobacterium avium
ARPTARSA

SEQ ID NO: 30266 - protein, 5 aa, Mycobacterium avium
ARPTV

SEQ ID NO: 30267 - protein, 12 aa, Mycobacterium avium
ARPVDSAGHGAG

SEQ ID NO: 30268 - protein, 4 aa, Mycobacterium avium
ARPY

SEQ ID NO: 30269 - protein, 6 aa, Mycobacterium avium
ARQAGM

SEQ ID NO: 30270 - protein, 5 aa, Mycobacterium avium
ARQAV

SEQ ID NO: 30271 - protein, 5 aa, Mycobacterium avium
ARQDT

SEQ ID NO: 30272 - protein, 5 aa, Mycobacterium avium
ARQPR

SEQ ID NO: 30273 - protein, 14 aa, Mycobacterium avium
ARQQDSDTAADAQG

SEQ ID NO: 30274 - protein, 7 aa, Mycobacterium avium
ARQTPQQ

SEQ ID NO: 30275 - protein, 4 aa, Mycobacterium avium
ARRA

SEQ ID NO: 30276 - protein, 6 aa, Mycobacterium avium
ARRAVT

SEQ ID NO: 30277 - protein, 4 aa, Mycobacterium avium
ARRD

SEQ ID NO: 30278 - protein, 8 aa, Mycobacterium avium
ARRDDEAR

SEQ ID NO: 30279 - protein, 10 aa, Mycobacterium avium
ARRDDLSGLP

SEQ ID NO: 30280 - protein, 5 aa, Mycobacterium avium
ARRDE

SEQ ID NO: 30281 - protein, 7 aa, Mycobacterium avium
ARRDGAE

SEQ ID NO: 30282 - protein, 8 aa, Mycobacterium avium
ARRDPAAA

SEQ ID NO: 30283 - protein, 12 aa, Mycobacterium avium
ARRDQVRATGRA

SEQ ID NO: 30284 - protein, 9 aa, Mycobacterium avium
ARREHPTED

SEQ ID NO: 30285 - protein, 6 aa, Mycobacterium avium
ARRGDP

SEQ ID NO: 30286 - protein, 10 aa, Mycobacterium avium
ARRGGEAPSW

SEQ ID NO: 30287 - protein, 6 aa, Mycobacterium avium
ARRGRH

SEQ ID NO: 30288 - protein, 4 aa, Mycobacterium avium
ARRM

SEQ ID NO: 30289 - protein, 10 aa, Mycobacterium avium
ARRNGAADDP

SEQ ID NO: 30290 - protein, 7 aa, Mycobacterium avium
ARRPAAE

SEQ ID NO: 30291 - protein, 9 aa, Mycobacterium avium
ARRPDRADT

SEQ ID NO: 30292 - protein, 7 aa, Mycobacterium avium
ARRQPGA

SEQ ID NO: 30293 - protein, 10 aa, Mycobacterium avium
ARRQTTRSAA

SEQ ID NO: 30294 - protein, 15 aa, Mycobacterium avium
ARRRGGAAPPGPLRP

SEQ ID NO: 30295 - protein, 5 aa, Mycobacterium avium
ARRRT

SEQ ID NO: 30296 - protein, 10 aa, Mycobacterium avium
ARRSGASWTD

SEQ ID NO: 30297 - protein, 8 aa, Mycobacterium avium
ARRTQSAG

SEQ ID NO: 30298 - protein, 10 aa, Mycobacterium avium
ARSAKRAVKS

SEQ ID NO: 30299 - protein, 5 aa, Mycobacterium avium
ARSAP

SEQ ID NO: 30300 - protein, 5 aa, Mycobacterium avium
ARSER

SEQ ID NO: 30301 - protein, 11 aa, Mycobacterium avium
ARSGAETAFDR

SEQ ID NO: 30302 - protein, 9 aa, Mycobacterium avium
ARSGLRTDP

SEQ ID NO: 30303 - protein, 7 aa, Mycobacterium avium
ARSGPDF

SEQ ID NO: 30304 - protein, 9 aa, Mycobacterium avium
ARSGPGGKR

SEQ ID NO: 30305 - protein, 5 aa, Mycobacterium avium
ARSGR

SEQ ID NO: 30306 - protein, 9 aa, Mycobacterium avium
ARSIAEKGH

SEQ ID NO: 30307 - protein, 8 aa, Mycobacterium avium
ARSIGAEP

SEQ ID NO: 30308 - protein, 5 aa, Mycobacterium avium
ARSKG

SEQ ID NO: 30309 - protein, 7 aa, Mycobacterium avium
ARSKLTR

SEQ ID NO: 30310 - protein, 9 aa, Mycobacterium avium
ARSLSNTET

SEQ ID NO: 30311 - protein, 6 aa, Mycobacterium avium
ARSPEA

SEQ ID NO: 30312 - protein, 7 aa, Mycobacterium avium
ARSPGDR

SEQ ID NO: 30313 - protein, 8 aa, Mycobacterium avium
ARSRQQAA

SEQ ID NO: 30314 - protein, 5 aa, Mycobacterium avium
ARSRS

SEQ ID NO: 30315 - protein, 5 aa, Mycobacterium avium
ARSSE

SEQ ID NO: 30316 - protein, 9 aa, Mycobacterium avium
ARSTDNGQN

SEQ ID NO: 30317 - protein, 15 aa, Mycobacterium avium
ARSVEGTGPGPEGNV

SEQ ID NO: 30318 - protein, 8 aa, Mycobacterium avium
ARTAGSGE

SEQ ID NO: 30319 - protein, 13 aa, Mycobacterium avium
ARTDAADPHPVRD

SEQ ID NO: 30320 - protein, 8 aa, Mycobacterium avium
ARTDEKLR

SEQ ID NO: 30321 - protein, 11 aa, Mycobacterium avium
ARTEGPLDRPA

SEQ ID NO: 30322 - protein, 11 aa, Mycobacterium avium
ARTELPRSDTS

SEQ ID NO: 30323 - protein, 13 aa, Mycobacterium avium
ARTFGDPVGPQDL

SEQ ID NO: 30324 - protein, 6 aa, Mycobacterium avium
ARTGDR

SEQ ID NO: 30325 - protein, 13 aa, Mycobacterium avium
ARTGTVPDSHTPL

SEQ ID NO: 30326 - protein, 14 aa, Mycobacterium avium
ARTKETDLSVPTRQ

SEQ ID NO: 30327 - protein, 13 aa, Mycobacterium avium
ARTLGTDAVDEAG

SEQ ID NO: 30328 - protein, 7 aa, Mycobacterium avium
ARTNRTN

SEQ ID NO: 30329 - protein, 5 aa, Mycobacterium avium
ARTNS

SEQ ID NO: 30330 - protein, 4 aa, Mycobacterium avium
ARTP

SEQ ID NO: 30331 - protein, 14 aa, Mycobacterium avium
ARTPGAADKVVVTF

SEQ ID NO: 30332 - protein, 7 aa, Mycobacterium avium
ARTPGGV

SEQ ID NO: 30333 - protein, 10 aa, Mycobacterium avium
ARTPRDQATV

SEQ ID NO: 30334 - protein, 6 aa, Mycobacterium avium
ARTPTA

SEQ ID NO: 30335 - protein, 9 aa, Mycobacterium avium
ARTRRDGRS

SEQ ID NO: 30336 - protein, 7 aa, Mycobacterium avium
ARTSDVP

SEQ ID NO: 30337 - protein, 8 aa, Mycobacterium avium
ARTSGAIQ

SEQ ID NO: 30338 - protein, 12 aa, Mycobacterium avium
ARTSVDDRLPGY

SEQ ID NO: 30339 - protein, 9 aa, Mycobacterium avium
ARTTQGRTL

SEQ ID NO: 30340 - protein, 8 aa, Mycobacterium avium
ARTTTRDV

SEQ ID NO: 30341 - protein, 6 aa, Mycobacterium avium
ARTVGA

SEQ ID NO: 30342 - protein, 4 aa, Mycobacterium avium
ARTW

SEQ ID NO: 30343 - protein, 8 aa, Mycobacterium avium
ARVAGGPD

SEQ ID NO: 30344 - protein, 6 aa, Mycobacterium avium
ARVPEE

SEQ ID NO: 30345 - protein, 7 aa, Mycobacterium avium
ARVPSAR

SEQ ID NO: 30346 - protein, 12 aa, Mycobacterium avium
ARVRGGTTVPHT

SEQ ID NO: 30347 - protein, 8 aa, Mycobacterium avium
ARVTERRV

SEQ ID NO: 30348 - protein, 9 aa, Mycobacterium avium
ARVTTDEDI

SEQ ID NO: 30349 - protein, 7 aa, Mycobacterium avium
ARYDEAT

SEQ ID NO: 30350 - protein, 8 aa, Mycobacterium avium
ARYGDSPA

SEQ ID NO: 30351 - protein, 4 aa, Mycobacterium avium
ARYI

SEQ ID NO: 30352 - protein, 11 aa, Mycobacterium avium
ARYRRGPAAPA

SEQ ID NO: 30353 - protein, 6 aa, Mycobacterium avium
ARYSSF

SEQ ID NO: 30354 - protein, 10 aa, Mycobacterium avium
ARYTGEQPIP

SEQ ID NO: 30355 - protein, 7 aa, Mycobacterium avium
ASAAATR

SEQ ID NO: 30356 - protein, 10 aa, Mycobacterium avium
ASAAPTPPSV

SEQ ID NO: 30357 - protein, 5 aa, Mycobacterium avium
ASAAQ

SEQ ID NO: 30358 - protein, 6 aa, Mycobacterium avium
ASAAQE

SEQ ID NO: 30359 - protein, 29 aa, Mycobacterium avium
ASAARSTANAADRTDRRLQGAGFGANPVL

SEQ ID NO: 30360 - protein, 6 aa, Mycobacterium avium
ASAASI

SEQ ID NO: 30361 - protein, 6 aa, Mycobacterium avium
ASAATL

SEQ ID NO: 30362 - protein, 13 aa, Mycobacterium avium
ASADPDGKPWSER

SEQ ID NO: 30363 - protein, 10 aa, Mycobacterium avium
ASADPGRPTN

SEQ ID NO: 30364 - protein, 17 aa, Mycobacterium avium
ASADSASRLVGTESGYR

SEQ ID NO: 30365 - protein, 14 aa, Mycobacterium avium
ASAFRAQGTPLSPG

SEQ ID NO: 30366 - protein, 7 aa, Mycobacterium avium
ASAGARL

SEQ ID NO: 30367 - protein, 6 aa, Mycobacterium avium
ASAGNL

SEQ ID NO: 30368 - protein, 5 aa, Mycobacterium avium
ASAGR

SEQ ID NO: 30369 - protein, 13 aa, Mycobacterium avium
ASAGRGGYGMGPR

SEQ ID NO: 30370 - protein, 6 aa, Mycobacterium avium
ASAGSW

SEQ ID NO: 30371 - protein, 6 aa, Mycobacterium avium
ASAKEV

SEQ ID NO: 30372 - protein, 11 aa, Mycobacterium avium
ASAKQRLTDSV

SEQ ID NO: 30373 - protein, 8 aa, Mycobacterium avium
ASALGAAD

SEQ ID NO: 30374 - protein, 18 aa, Mycobacterium avium
ASAPADEGNDEDPADGVR

SEQ ID NO: 30375 - protein, 10 aa, Mycobacterium avium
ASAPGGDSYA

SEQ ID NO: 30376 - protein, 9 aa, Mycobacterium avium
ASAPRIGAP

SEQ ID NO: 30377 - protein, 13 aa, Mycobacterium avium
ASAPRLDGYPRAG

SEQ ID NO: 30378 - protein, 18 aa, Mycobacterium avium
ASAQAASPNTVRHKSSAI

SEQ ID NO: 30379 - protein, 4 aa, Mycobacterium avium
ASAR

SEQ ID NO: 30380 - protein, 9 aa, Mycobacterium avium
ASARETAAR

SEQ ID NO: 30381 - protein, 6 aa, Mycobacterium avium
ASASAA

SEQ ID NO: 30382 - protein, 9 aa, Mycobacterium avium
ASASGQHVP

SEQ ID NO: 30383 - protein, 9 aa, Mycobacterium avium
ASASTGLPI

SEQ ID NO: 30384 - protein, 8 aa, Mycobacterium avium
ASASTHEG

SEQ ID NO: 30385 - protein, 6 aa, Mycobacterium avium
ASATDR

SEQ ID NO: 30386 - protein, 8 aa, Mycobacterium avium
ASATDVSK

SEQ ID NO: 30387 - protein, 14 aa, Mycobacterium avium
ASATIDRPALGPSA

SEQ ID NO: 30388 - protein, 7 aa, Mycobacterium avium
ASATLGT

SEQ ID NO: 30389 - protein, 6 aa, Mycobacterium avium
ASDAEA

SEQ ID NO: 30390 - protein, 4 aa, Mycobacterium avium
ASDD

SEQ ID NO: 30391 - protein, 9 aa, Mycobacterium avium
ASDDDARRR

SEQ ID NO: 30392 - protein, 7 aa, Mycobacterium avium
ASDDGGA

SEQ ID NO: 30393 - protein, 4 aa, Mycobacterium avium
ASDE

SEQ ID NO: 30394 - protein, 6 aa, Mycobacterium avium
ASDGRI

SEQ ID NO: 30395 - protein, 5 aa, Mycobacterium avium
ASDGV

SEQ ID NO: 30396 - protein, 5 aa, Mycobacterium avium
ASDIA

SEQ ID NO: 30397 - protein, 7 aa, Mycobacterium avium
ASDPGLR

SEQ ID NO: 30398 - protein, 6 aa, Mycobacterium avium
ASDQGV

SEQ ID NO: 30399 - protein, 4 aa, Mycobacterium avium
ASDS

SEQ ID NO: 30400 - protein, 7 aa, Mycobacterium avium
ASDSPHG

SEQ ID NO: 30401 - protein, 7 aa, Mycobacterium avium
ASDTDTE

SEQ ID NO: 30402 - protein, 13 aa, Mycobacterium avium
ASECGRSGGRAPS

SEQ ID NO: 30403 - protein, 11 aa, Mycobacterium avium
ASEGEPADMSA

SEQ ID NO: 30404 - protein, 13 aa, Mycobacterium avium
ASEGVKEDDIRGD

SEQ ID NO: 30405 - protein, 6 aa, Mycobacterium avium
ASEIAE

SEQ ID NO: 30406 - protein, 8 aa, Mycobacterium avium
ASEKLGEL

SEQ ID NO: 30407 - protein, 9 aa, Mycobacterium avium
ASEPAQKRR

SEQ ID NO: 30408 - protein, 7 aa, Mycobacterium avium
ASEQPAS

SEQ ID NO: 30409 - protein, 8 aa, Mycobacterium avium
ASERPGHR

SEQ ID NO: 30410 - protein, 4 aa, Mycobacterium avium
ASGA

SEQ ID NO: 30411 - protein, 5 aa, Mycobacterium avium
ASGAA

SEQ ID NO: 30412 - protein, 16 aa, Mycobacterium avium
ASGAAKADDVAAQQDS

SEQ ID NO: 30413 - protein, 11 aa, Mycobacterium avium
ASGAERDEDGS

SEQ ID NO: 30414 - protein, 5 aa, Mycobacterium avium
ASGAP

SEQ ID NO: 30415 - protein, 12 aa, Mycobacterium avium
ASGAPVPAGGDG

SEQ ID NO: 30416 - protein, 10 aa, Mycobacterium avium
ASGDDPGTDW

SEQ ID NO: 30417 - protein, 8 aa, Mycobacterium avium
ASGDGAHA

SEQ ID NO: 30418 - protein, 14 aa, Mycobacterium avium
ASGEASETDDTPMP

SEQ ID NO: 30419 - protein, 9 aa, Mycobacterium avium
ASGEDPQRL

SEQ ID NO: 30420 - protein, 5 aa, Mycobacterium avium
ASGGG

SEQ ID NO: 30421 - protein, 18 aa, Mycobacterium avium
ASGGRPEPYEAGTWGPDS

SEQ ID NO: 30422 - protein, 8 aa, Mycobacterium avium
ASGGSVGY

SEQ ID NO: 30423 - protein, 5 aa, Mycobacterium avium
ASGGV

SEQ ID NO: 30424 - protein, 4 aa, Mycobacterium avium
ASGH

SEQ ID NO: 30425 - protein, 4 aa, Mycobacterium avium
ASGI

SEQ ID NO: 30426 - protein, 7 aa, Mycobacterium avium
ASGIEPV

SEQ ID NO: 30427 - protein, 6 aa, Mycobacterium avium
ASGIGS

SEQ ID NO: 30428 - protein, 10 aa, Mycobacterium avium
ASGIPKAGGV

SEQ ID NO: 30429 - protein, 6 aa, Mycobacterium avium
ASGKPF

SEQ ID NO: 30430 - protein, 5 aa, Mycobacterium avium
ASGLT

SEQ ID NO: 30431 - protein, 13 aa, Mycobacterium avium
ASGNIDGTRTNPS

SEQ ID NO: 30432 - protein, 18 aa, Mycobacterium avium
ASGNVDGDRHKPPPITAS

SEQ ID NO: 30433 - protein, 6 aa, Mycobacterium avium
ASGPQV

SEQ ID NO: 30434 - protein, 5 aa, Mycobacterium avium
ASGPS

SEQ ID NO: 30435 - protein, 11 aa, Mycobacterium avium
ASGPVPPFDPQ

SEQ ID NO: 30436 - protein, 8 aa, Mycobacterium avium
ASGQERRT

SEQ ID NO: 30437 - protein, 8 aa, Mycobacterium avium
ASGQPAPD

SEQ ID NO: 30438 - protein, 7 aa, Mycobacterium avium
ASGRDDD

SEQ ID NO: 30439 - protein, 21 aa, Mycobacterium avium
ASGRGAQPGYDGLSRSPAPVA

SEQ ID NO: 30440 - protein, 8 aa, Mycobacterium avium
ASGRPARH

SEQ ID NO: 30441 - protein, 11 aa, Mycobacterium avium
ASGRRDTAQRL

SEQ ID NO: 30442 - protein, 11 aa, Mycobacterium avium
ASGRYRSASDV

SEQ ID NO: 30443 - protein, 8 aa, Mycobacterium avium
ASGSGKST

SEQ ID NO: 30444 - protein, 7 aa, Mycobacterium avium
ASGSRMR

SEQ ID NO: 30445 - protein, 7 aa, Mycobacterium avium
ASGSVYD

SEQ ID NO: 30446 - protein, 8 aa, Mycobacterium avium
ASGTERSF

SEQ ID NO: 30447 - protein, 9 aa, Mycobacterium avium
ASGTETGLP

SEQ ID NO: 30448 - protein, 10 aa, Mycobacterium avium
ASGTGDARKI

SEQ ID NO: 30449 - protein, 5 aa, Mycobacterium avium
ASGTL

SEQ ID NO: 30450 - protein, 6 aa, Mycobacterium avium
ASGTPI

SEQ ID NO: 30451 - protein, 9 aa, Mycobacterium avium
ASGTSEELK

SEQ ID NO: 30452 - protein, 5 aa, Mycobacterium avium
ASGVG

SEQ ID NO: 30453 - protein, 7 aa, Mycobacterium avium
ASGYAGG

SEQ ID NO: 30454 - protein, 7 aa, Mycobacterium avium
ASGYAPR

SEQ ID NO: 30455 - protein, 7 aa, Mycobacterium avium
ASHDEPL

SEQ ID NO: 30456 - protein, 7 aa, Mycobacterium avium
ASHEESA

SEQ ID NO: 30457 - protein, 12 aa, Mycobacterium avium
ASHGGVDDTREL

SEQ ID NO: 30458 - protein, 12 aa, Mycobacterium avium
ASIDGARSASAT

SEQ ID NO: 30459 - protein, 5 aa, Mycobacterium avium
ASISE

SEQ ID NO: 30460 - protein, 8 aa, Mycobacterium avium
ASISGESL

SEQ ID NO: 30461 - protein, 9 aa, Mycobacterium avium
ASKEPEPSA

SEQ ID NO: 30462 - protein, 9 aa, Mycobacterium avium
ASKNGSDAV

SEQ ID NO: 30463 - protein, 12 aa, Mycobacterium avium
ASKPGSDGVTPI

SEQ ID NO: 30464 - protein, 5 aa, Mycobacterium avium
ASKPI

SEQ ID NO: 30465 - protein, 16 aa, Mycobacterium avium
ASKSDLERQESKAKTG

SEQ ID NO: 30466 - protein, 8 aa, Mycobacterium avium
ASKTLPAS

SEQ ID NO: 30467 - protein, 6 aa, Mycobacterium avium
ASLDDA

SEQ ID NO: 30468 - protein, 6 aa, Mycobacterium avium
ASLDGR

SEQ ID NO: 30469 - protein, 6 aa, Mycobacterium avium
ASLDQI

SEQ ID NO: 30470 - protein, 11 aa, Mycobacterium avium
ASLGGRDGSNV

SEQ ID NO: 30471 - protein, 5 aa, Mycobacterium avium
ASLPQ

SEQ ID NO: 30472 - protein, 7 aa, Mycobacterium avium
ASLRDRE

SEQ ID NO: 30473 - protein, 6 aa, Mycobacterium avium
ASLRDT

SEQ ID NO: 30474 - protein, 5 aa, Mycobacterium avium
ASLRE

SEQ ID NO: 30475 - protein, 14 aa, Mycobacterium avium
ASLSAQAEAAANGC

SEQ ID NO: 30476 - protein, 5 aa, Mycobacterium avium
ASLSD

SEQ ID NO: 30477 - protein, 12 aa, Mycobacterium avium
ASMGNTNPKDNW

SEQ ID NO: 30478 - protein, 7 aa, Mycobacterium avium
ASNERQV

SEQ ID NO: 30479 - protein, 5 aa, Mycobacterium avium
ASNGD

SEQ ID NO: 30480 - protein, 13 aa, Mycobacterium avium
ASNGGVARGVPTG

SEQ ID NO: 30481 - protein, 6 aa, Mycobacterium avium
ASNPRF

SEQ ID NO: 30482 - protein, 10 aa, Mycobacterium avium
ASNSLGDHVS

SEQ ID NO: 30483 - protein, 7 aa, Mycobacterium avium
ASNTSSI

SEQ ID NO: 30484 - protein, 9 aa, Mycobacterium avium
ASPADRARR

SEQ ID NO: 30485 - protein, 13 aa, Mycobacterium avium
ASPAGRDPDSLSE

SEQ ID NO: 30486 - protein, 8 aa, Mycobacterium avium
ASPAISNR

SEQ ID NO: 30487 - protein, 6 aa, Mycobacterium avium
ASPALQ

SEQ ID NO: 30488 - protein, 16 aa, Mycobacterium avium
ASPAPEDFGKYQTFCG

SEQ ID NO: 30489 - protein, 15 aa, Mycobacterium avium
ASPASAKGPHAKPED

SEQ ID NO: 30490 - protein, 5 aa, Mycobacterium avium
ASPDI

SEQ ID NO: 30491 - protein, 6 aa, Mycobacterium avium
ASPDTV

SEQ ID NO: 30492 - protein, 5 aa, Mycobacterium avium
ASPEA

SEQ ID NO: 30493 - protein, 7 aa, Mycobacterium avium
ASPERRK

SEQ ID NO: 30494 - protein, 6 aa, Mycobacterium avium
ASPGFR

SEQ ID NO: 30495 - protein, 5 aa, Mycobacterium avium
ASPGI

SEQ ID NO: 30496 - protein, 4 aa, Mycobacterium avium
ASPI

SEQ ID NO: 30497 - protein, 10 aa, Mycobacterium avium
ASPLPGPSGN

SEQ ID NO: 30498 - protein, 7 aa, Mycobacterium avium
ASPNADV

SEQ ID NO: 30499 - protein, 6 aa, Mycobacterium avium
ASPNAL

SEQ ID NO: 30500 - protein, 9 aa, Mycobacterium avium
ASPNGARRA

SEQ ID NO: 30501 - protein, 16 aa, Mycobacterium avium
ASPPAGSKQRLTELGP

SEQ ID NO: 30502 - protein, 6 aa, Mycobacterium avium
ASPPEM

SEQ ID NO: 30503 - protein, 7 aa, Mycobacterium avium
ASPQRDP

SEQ ID NO: 30504 - protein, 6 aa, Mycobacterium avium
ASPRAS

SEQ ID NO: 30505 - protein, 7 aa, Mycobacterium avium
ASPSARV

SEQ ID NO: 30506 - protein, 12 aa, Mycobacterium avium
ASPSGGSPRRAV

SEQ ID NO: 30507 - protein, 12 aa, Mycobacterium avium
ASPSSGGTRMQE

SEQ ID NO: 30508 - protein, 8 aa, Mycobacterium avium
ASPTGARL

SEQ ID NO: 30509 - protein, 13 aa, Mycobacterium avium
ASPVGRLGTGEDI

SEQ ID NO: 30510 - protein, 16 aa, Mycobacterium avium
ASPVPYPTSCSPQAWA

SEQ ID NO: 30511 - protein, 6 aa, Mycobacterium avium
ASPVRY

SEQ ID NO: 30512 - protein, 10 aa, Mycobacterium avium
ASQAAPGLEL

SEQ ID NO: 30513 - protein, 9 aa, Mycobacterium avium
ASQHGGGRL

SEQ ID NO: 30514 - protein, 8 aa, Mycobacterium avium
ASQQAKPD

SEQ ID NO: 30515 - protein, 11 aa, Mycobacterium avium
ASQQPAPTAET

SEQ ID NO: 30516 - protein, 10 aa, Mycobacterium avium
ASQQSRPIAS

SEQ ID NO: 30517 - protein, 13 aa, Mycobacterium avium
ASQRARLVSRKGD

SEQ ID NO: 30518 - protein, 6 aa, Mycobacterium avium
ASQRAS

SEQ ID NO: 30519 - protein, 8 aa, Mycobacterium avium
ASQSADAY

SEQ ID NO: 30520 - protein, 17 aa, Mycobacterium avium
ASQSDAPVGAPRQFGST

SEQ ID NO: 30521 - protein, 8 aa, Mycobacterium avium
ASRAGGAH

SEQ ID NO: 30522 - protein, 7 aa, Mycobacterium avium
ASRAGLK

SEQ ID NO: 30523 - protein, 6 aa, Mycobacterium avium
ASRDGL

SEQ ID NO: 30524 - protein, 7 aa, Mycobacterium avium
ASRETVN

SEQ ID NO: 30525 - protein, 16 aa, Mycobacterium avium
ASREVTRGDTPVSLSS

SEQ ID NO: 30526 - protein, 7 aa, Mycobacterium avium
ASRGEPH

SEQ ID NO: 30527 - protein, 6 aa, Mycobacterium avium
ASRGER

SEQ ID NO: 30528 - protein, 9 aa, Mycobacterium avium
ASRGKSNRL

SEQ ID NO: 30529 - protein, 14 aa, Mycobacterium avium
ASRLGDGDAYQVSA

SEQ ID NO: 30530 - protein, 7 aa, Mycobacterium avium
ASRLPDG

SEQ ID NO: 30531 - protein, 9 aa, Mycobacterium avium
ASRPRAGTR

SEQ ID NO: 30532 - protein, 7 aa, Mycobacterium avium
ASRPTFQ

SEQ ID NO: 30533 - protein, 7 aa, Mycobacterium avium
ASRPWAT

SEQ ID NO: 30534 - protein, 4 aa, Mycobacterium avium
ASRQ

SEQ ID NO: 30535 - protein, 16 aa, Mycobacterium avium
ASRQKARAARRLGFEV

SEQ ID NO: 30536 - protein, 5 aa, Mycobacterium avium
ASRRE

SEQ ID NO: 30537 - protein, 6 aa, Mycobacterium avium
ASRRGR

SEQ ID NO: 30538 - protein, 15 aa, Mycobacterium avium
ASRTRINASTDDVRD

SEQ ID NO: 30539 - protein, 8 aa, Mycobacterium avium
ASRVGAPL

SEQ ID NO: 30540 - protein, 8 aa, Mycobacterium avium
ASRYSDPV

SEQ ID NO: 30541 - protein, 9 aa, Mycobacterium avium
ASSAAGLPP

SEQ ID NO: 30542 - protein, 16 aa, Mycobacterium avium
ASSADDDHRHGGRADR

SEQ ID NO: 30543 - protein, 8 aa, Mycobacterium avium
ASSAGAQV

SEQ ID NO: 30544 - protein, 7 aa, Mycobacterium avium
ASSAPDW

SEQ ID NO: 30545 - protein, 8 aa, Mycobacterium avium
ASSEVPDG

SEQ ID NO: 30546 - protein, 16 aa, Mycobacterium avium
ASSFTTGSILRADGGI

SEQ ID NO: 30547 - protein, 16 aa, Mycobacterium avium
ASSGARRIGAPDAKNR

SEQ ID NO: 30548 - protein, 7 aa, Mycobacterium avium
ASSGIGA

SEQ ID NO: 30549 - protein, 8 aa, Mycobacterium avium
ASSGIGEA

SEQ ID NO: 30550 - protein, 8 aa, Mycobacterium avium
ASSGIGRA

SEQ ID NO: 30551 - protein, 8 aa, Mycobacterium avium
ASSGSPMY

SEQ ID NO: 30552 - protein, 5 aa, Mycobacterium avium
ASSGV

SEQ ID NO: 30553 - protein, 4 aa, Mycobacterium avium
ASSL

SEQ ID NO: 30554 - protein, 7 aa, Mycobacterium avium
ASSLRKA

SEQ ID NO: 30555 - protein, 6 aa, Mycobacterium avium
ASSNLE

SEQ ID NO: 30556 - protein, 6 aa, Mycobacterium avium
ASSQQV

SEQ ID NO: 30557 - protein, 4 aa, Mycobacterium avium
ASSR

SEQ ID NO: 30558 - protein, 7 aa, Mycobacterium avium
ASSRLED

SEQ ID NO: 30559 - protein, 8 aa, Mycobacterium avium
ASSSGRAT

SEQ ID NO: 30560 - protein, 4 aa, Mycobacterium avium
ASSV

SEQ ID NO: 30561 - protein, 7 aa, Mycobacterium avium
ASSYMTG

SEQ ID NO: 30562 - protein, 6 aa, Mycobacterium avium
ASTAAV

SEQ ID NO: 30563 - protein, 5 aa, Mycobacterium avium
ASTDA

SEQ ID NO: 30564 - protein, 5 aa, Mycobacterium avium
ASTER

SEQ ID NO: 30565 - protein, 10 aa, Mycobacterium avium
ASTEVRADST

SEQ ID NO: 30566 - protein, 7 aa, Mycobacterium avium
ASTEYQT

SEQ ID NO: 30567 - protein, 8 aa, Mycobacterium avium
ASTGAGAL

SEQ ID NO: 30568 - protein, 7 aa, Mycobacterium avium
ASTGGNV

SEQ ID NO: 30569 - protein, 6 aa, Mycobacterium avium
ASTGSE

SEQ ID NO: 30570 - protein, 7 aa, Mycobacterium avium
ASTHEAN

SEQ ID NO: 30571 - protein, 4 aa, Mycobacterium avium
ASTL

SEQ ID NO: 30572 - protein, 4 aa, Mycobacterium avium
ASTP

SEQ ID NO: 30573 - protein, 17 aa, Mycobacterium avium
ASTPAERVKLIEALRQL

SEQ ID NO: 30574 - protein, 10 aa, Mycobacterium avium
ASTPDERDAM

SEQ ID NO: 30575 - protein, 8 aa, Mycobacterium avium
ASTPLDRS

SEQ ID NO: 30576 - protein, 6 aa, Mycobacterium avium
ASTPMD

SEQ ID NO: 30577 - protein, 9 aa, Mycobacterium avium
ASTPNAQPR

SEQ ID NO: 30578 - protein, 6 aa, Mycobacterium avium
ASTPVA

SEQ ID NO: 30579 - protein, 15 aa, Mycobacterium avium
ASTTSLPETPQGERN

SEQ ID NO: 30580 - protein, 7 aa, Mycobacterium avium
ASVDPEA

SEQ ID NO: 30581 - protein, 4 aa, Mycobacterium avium
ASVH

SEQ ID NO: 30582 - protein, 19 aa, Mycobacterium avium
ASVPPGARVAPATADAQRS

SEQ ID NO: 30583 - protein, 8 aa, Mycobacterium avium
ASVSDGAV

SEQ ID NO: 30584 - protein, 13 aa, Mycobacterium avium
ASVSDPQASPPTF

SEQ ID NO: 30585 - protein, 11 aa, Mycobacterium avium
ASVSGGAPLGS

SEQ ID NO: 30586 - protein, 12 aa, Mycobacterium avium
ASYAPRSGGTAA

SEQ ID NO: 30587 - protein, 9 aa, Mycobacterium avium
ASYDPGAES

SEQ ID NO: 30588 - protein, 6 aa, Mycobacterium avium
ASYGGA

SEQ ID NO: 30589 - protein, 9 aa, Mycobacterium avium
ASYGNEAAV

SEQ ID NO: 30590 - protein, 6 aa, Mycobacterium avium
ATAADG

SEQ ID NO: 30591 - protein, 5 aa, Mycobacterium avium
ATAAI

SEQ ID NO: 30592 - protein, 10 aa, Mycobacterium avium
ATAASAAISK

SEQ ID NO: 30593 - protein, 5 aa, Mycobacterium avium
ATAAT

SEQ ID NO: 30594 - protein, 5 aa, Mycobacterium avium
ATAAY

SEQ ID NO: 30595 - protein, 8 aa, Mycobacterium avium
ATADLSQR

SEQ ID NO: 30596 - protein, 8 aa, Mycobacterium avium
ATADTASR

SEQ ID NO: 30597 - protein, 7 aa, Mycobacterium avium
ATADTGM

SEQ ID NO: 30598 - protein, 6 aa, Mycobacterium avium
ATAEPV

SEQ ID NO: 30599 - protein, 22 aa, Mycobacterium avium
ATAGKLKGATGSAESEAVDPEL

SEQ ID NO: 30600 - protein, 8 aa, Mycobacterium avium
ATAGPRDV

SEQ ID NO: 30601 - protein, 6 aa, Mycobacterium avium
ATAGQP

SEQ ID NO: 30602 - protein, 8 aa, Mycobacterium avium
ATAGTPRR

SEQ ID NO: 30603 - protein, 8 aa, Mycobacterium avium
ATALREDN

SEQ ID NO: 30604 - protein, 8 aa, Mycobacterium avium
ATANAGGL

SEQ ID NO: 30605 - protein, 9 aa, Mycobacterium avium
ATAPAERDR

SEQ ID NO: 30606 - protein, 10 aa, Mycobacterium avium
ATAPAPPGAY

SEQ ID NO: 30607 - protein, 12 aa, Mycobacterium avium
ATAPDGSSSEYE

SEQ ID NO: 30608 - protein, 10 aa, Mycobacterium avium
ATAPGGLSAA

SEQ ID NO: 30609 - protein, 6 aa, Mycobacterium avium
ATAPKT

SEQ ID NO: 30610 - protein, 8 aa, Mycobacterium avium
ATAPRPSV

SEQ ID NO: 30611 - protein, 5 aa, Mycobacterium avium
ATAQH

SEQ ID NO: 30612 - protein, 8 aa, Mycobacterium avium
ATAQPGQP

SEQ ID NO: 30613 - protein, 6 aa, Mycobacterium avium
ATARRE

SEQ ID NO: 30614 - protein, 7 aa, Mycobacterium avium
ATASARR

SEQ ID NO: 30615 - protein, 5 aa, Mycobacterium avium
ATASS

SEQ ID NO: 30616 - protein, 19 aa, Mycobacterium avium
ATATAAPTEAGAPEPTTDP

SEQ ID NO: 30617 - protein, 5 aa, Mycobacterium avium
ATATG

SEQ ID NO: 30618 - protein, 7 aa, Mycobacterium avium
ATATPQV

SEQ ID NO: 30619 - protein, 13 aa, Mycobacterium avium
ATAVDEGAGPAEL

SEQ ID NO: 30620 - protein, 14 aa, Mycobacterium avium
ATAVRGTLSAPADL

SEQ ID NO: 30621 - protein, 7 aa, Mycobacterium avium
ATDAALS

SEQ ID NO: 30622 - protein, 8 aa, Mycobacterium avium
ATDANPAF

SEQ ID NO: 30623 - protein, 11 aa, Mycobacterium avium
ATDARRHTRAE

SEQ ID NO: 30624 - protein, 8 aa, Mycobacterium avium
ATDATTGQ

SEQ ID NO: 30625 - protein, 5 aa, Mycobacterium avium
ATDEL

SEQ ID NO: 30626 - protein, 8 aa, Mycobacterium avium
ATDEPRPG

SEQ ID NO: 30627 - protein, 5 aa, Mycobacterium avium
ATDER

SEQ ID NO: 30628 - protein, 7 aa, Mycobacterium avium
ATDEVGQ

SEQ ID NO: 30629 - protein, 4 aa, Mycobacterium avium
ATDG

SEQ ID NO: 30630 - protein, 10 aa, Mycobacterium avium
ATDGPSAQAA

SEQ ID NO: 30631 - protein, 9 aa, Mycobacterium avium
ATDGRPPAA

SEQ ID NO: 30632 - protein, 8 aa, Mycobacterium avium
ATDGTPAQ

SEQ ID NO: 30633 - protein, 9 aa, Mycobacterium avium
ATDHITDTE

SEQ ID NO: 30634 - protein, 9 aa, Mycobacterium avium
ATDNDPAVT

SEQ ID NO: 30635 - protein, 7 aa, Mycobacterium avium
ATDNPIG

SEQ ID NO: 30636 - protein, 16 aa, Mycobacterium avium
ATDPDPRRRFSSTEEM

SEQ ID NO: 30637 - protein, 9 aa, Mycobacterium avium
ATDPVSRQT

SEQ ID NO: 30638 - protein, 5 aa, Mycobacterium avium
ATDRG

SEQ ID NO: 30639 - protein, 9 aa, Mycobacterium avium
ATDTDTHPK

SEQ ID NO: 30640 - protein, 8 aa, Mycobacterium avium
ATDTRESL

SEQ ID NO: 30641 - protein, 6 aa, Mycobacterium avium
ATEARF

SEQ ID NO: 30642 - protein, 6 aa, Mycobacterium avium
ATEDLS

SEQ ID NO: 30643 - protein, 8 aa, Mycobacterium avium
ATEGADGI

SEQ ID NO: 30644 - protein, 6 aa, Mycobacterium avium
ATEGTR

SEQ ID NO: 30645 - protein, 5 aa, Mycobacterium avium
ATEHG

SEQ ID NO: 30646 - protein, 8 aa, Mycobacterium avium
ATELGEKG

SEQ ID NO: 30647 - protein, 12 aa, Mycobacterium avium
ATEPDDEHLAPD

SEQ ID NO: 30648 - protein, 19 aa, Mycobacterium avium
ATEPLTKTTIERRDPGPRD

SEQ ID NO: 30649 - protein, 5 aa, Mycobacterium avium
ATEPS

SEQ ID NO: 30650 - protein, 14 aa, Mycobacterium avium
ATEPSLSGPGREEL

SEQ ID NO: 30651 - protein, 21 aa, Mycobacterium avium
ATEQARLAQRAENEYVGAPTG

SEQ ID NO: 30652 - protein, 6 aa, Mycobacterium avium
ATERGD

SEQ ID NO: 30653 - protein, 6 aa, Mycobacterium avium
ATESEA

SEQ ID NO: 30654 - protein, 9 aa, Mycobacterium avium
ATESNPTAA

SEQ ID NO: 30655 - protein, 10 aa, Mycobacterium avium
ATFSDDAARA

SEQ ID NO: 30656 - protein, 9 aa, Mycobacterium avium
ATFTPGRRI

SEQ ID NO: 30657 - protein, 8 aa, Mycobacterium avium
ATGADGAA

SEQ ID NO: 30658 - protein, 8 aa, Mycobacterium avium
ATGAQTGS

SEQ ID NO: 30659 - protein, 7 aa, Mycobacterium avium
ATGDDKA

SEQ ID NO: 30660 - protein, 5 aa, Mycobacterium avium
ATGDE

SEQ ID NO: 30661 - protein, 10 aa, Mycobacterium avium
ATGDKTAMPS

SEQ ID NO: 30662 - protein, 8 aa, Mycobacterium avium
ATGDPEAF

SEQ ID NO: 30663 - protein, 6 aa, Mycobacterium avium
ATGDQH

SEQ ID NO: 30664 - protein, 4 aa, Mycobacterium avium
ATGE

SEQ ID NO: 30665 - protein, 9 aa, Mycobacterium avium
ATGEDGGYG

SEQ ID NO: 30666 - protein, 10 aa, Mycobacterium avium
ATGEDTVKGA

SEQ ID NO: 30667 - protein, 7 aa, Mycobacterium avium
ATGGARL

SEQ ID NO: 30668 - protein, 11 aa, Mycobacterium avium
ATGGEFVPGDE

SEQ ID NO: 30669 - protein, 6 aa, Mycobacterium avium
ATGGPV

SEQ ID NO: 30670 - protein, 8 aa, Mycobacterium avium
ATGGRGAD

SEQ ID NO: 30671 - protein, 6 aa, Mycobacterium avium
ATGHDD

SEQ ID NO: 30672 - protein, 6 aa, Mycobacterium avium
ATGHPV

SEQ ID NO: 30673 - protein, 5 aa, Mycobacterium avium
ATGIE

SEQ ID NO: 30674 - protein, 6 aa, Mycobacterium avium
ATGIGA

SEQ ID NO: 30675 - protein, 15 aa, Mycobacterium avium
ATGMGAAAAKSAAEL

SEQ ID NO: 30676 - protein, 5 aa, Mycobacterium avium
ATGNK

SEQ ID NO: 30677 - protein, 8 aa, Mycobacterium avium
ATGNTTAT

SEQ ID NO: 30678 - protein, 5 aa, Mycobacterium avium
ATGPL

SEQ ID NO: 30679 - protein, 7 aa, Mycobacterium avium
ATGRTRD

SEQ ID NO: 30680 - protein, 6 aa, Mycobacterium avium
ATGSLE

SEQ ID NO: 30681 - protein, 12 aa, Mycobacterium avium
ATGSRTANAGPV

SEQ ID NO: 30682 - protein, 14 aa, Mycobacterium avium
ATGSSTRLVPGTSL

SEQ ID NO: 30683 - protein, 10 aa, Mycobacterium avium
ATGTGKSATT

SEQ ID NO: 30684 - protein, 13 aa, Mycobacterium avium
ATGTLSASFGTPL

SEQ ID NO: 30685 - protein, 8 aa, Mycobacterium avium
ATGTTISP

SEQ ID NO: 30686 - protein, 4 aa, Mycobacterium avium
ATGV

SEQ ID NO: 30687 - protein, 7 aa, Mycobacterium avium
ATGVRRG

SEQ ID NO: 30688 - protein, 21 aa, Mycobacterium avium
ATGVTGVTDATPDLDDDDRAA

SEQ ID NO: 30689 - protein, 9 aa, Mycobacterium avium
ATHDAGSRA

SEQ ID NO: 30690 - protein, 6 aa, Mycobacterium avium
ATHPDV

SEQ ID NO: 30691 - protein, 6 aa, Mycobacterium avium
ATHTPV

SEQ ID NO: 30692 - protein, 21 aa, Mycobacterium avium
ATHTRSDRESVKGRLSGRTQE

SEQ ID NO: 30693 - protein, 11 aa, Mycobacterium avium
ATKAALGDHDE

SEQ ID NO: 30694 - protein, 5 aa, Mycobacterium avium
ATKAD

SEQ ID NO: 30695 - protein, 5 aa, Mycobacterium avium
ATKAG

SEQ ID NO: 30696 - protein, 6 aa, Mycobacterium avium
ATKAGI

SEQ ID NO: 30697 - protein, 11 aa, Mycobacterium avium
ATKANADPRSL

SEQ ID NO: 30698 - protein, 9 aa, Mycobacterium avium
ATKAPIATE

SEQ ID NO: 30699 - protein, 13 aa, Mycobacterium avium
ATKATRPEVRGGL

SEQ ID NO: 30700 - protein, 4 aa, Mycobacterium avium
ATKG

SEQ ID NO: 30701 - protein, 5 aa, Mycobacterium avium
ATKLT

SEQ ID NO: 30702 - protein, 7 aa, Mycobacterium avium
ATKNPQR

SEQ ID NO: 30703 - protein, 9 aa, Mycobacterium avium
ATKPAPSDV

SEQ ID NO: 30704 - protein, 8 aa, Mycobacterium avium
ATKPPTVQ

SEQ ID NO: 30705 - protein, 7 aa, Mycobacterium avium
ATKSRVR

SEQ ID NO: 30706 - protein, 16 aa, Mycobacterium avium
ATKTNDVAGDGTTTAT

SEQ ID NO: 30707 - protein, 6 aa, Mycobacterium avium
ATLDDG

SEQ ID NO: 30708 - protein, 13 aa, Mycobacterium avium
ATLGTDPDEIAGT

SEQ ID NO: 30709 - protein, 15 aa, Mycobacterium avium
ATLPAGEYRQISGNT

SEQ ID NO: 30710 - protein, 13 aa, Mycobacterium avium
ATLTGSEPAGQSV

SEQ ID NO: 30711 - protein, 8 aa, Mycobacterium avium
ATMGPGVP

SEQ ID NO: 30712 - protein, 6 aa, Mycobacterium avium
ATNALG

SEQ ID NO: 30713 - protein, 5 aa, Mycobacterium avium
ATNDV

SEQ ID NO: 30714 - protein, 8 aa, Mycobacterium avium
ATNGVGLG

SEQ ID NO: 30715 - protein, 7 aa, Mycobacterium avium
ATNPADP

SEQ ID NO: 30716 - protein, 10 aa, Mycobacterium avium
ATNPTNGKPV

SEQ ID NO: 30717 - protein, 6 aa, Mycobacterium avium
ATNRSE

SEQ ID NO: 30718 - protein, 14 aa, Mycobacterium avium
ATNRSSDYATAPAH

SEQ ID NO: 30719 - protein, 11 aa, Mycobacterium avium
ATNSTAQTAGL

SEQ ID NO: 30720 - protein, 12 aa, Mycobacterium avium
ATNTLNAPPPLS

SEQ ID NO: 30721 - protein, 21 aa, Mycobacterium avium
ATPADLRAAPDTAGRPAGGTE

SEQ ID NO: 30722 - protein, 13 aa, Mycobacterium avium
ATPAHIVNPEVLA

SEQ ID NO: 30723 - protein, 15 aa, Mycobacterium avium
ATPDELEPIVAAYRA

SEQ ID NO: 30724 - protein, 6 aa, Mycobacterium avium
ATPDQM

SEQ ID NO: 30725 - protein, 5 aa, Mycobacterium avium
ATPEL

SEQ ID NO: 30726 - protein, 7 aa, Mycobacterium avium
ATPEQTI

SEQ ID NO: 30727 - protein, 14 aa, Mycobacterium avium
ATPGPYELSQTGGE

SEQ ID NO: 30728 - protein, 9 aa, Mycobacterium avium
ATPGSGKTT

SEQ ID NO: 30729 - protein, 14 aa, Mycobacterium avium
ATPIGSGPDGRPRT

SEQ ID NO: 30730 - protein, 5 aa, Mycobacterium avium
ATPIT

SEQ ID NO: 30731 - protein, 4 aa, Mycobacterium avium
ATPM

SEQ ID NO: 30732 - protein, 6 aa, Mycobacterium avium
ATPPDG

SEQ ID NO: 30733 - protein, 8 aa, Mycobacterium avium
ATPPGGGV

SEQ ID NO: 30734 - protein, 12 aa, Mycobacterium avium
ATPPPVRGGKQP

SEQ ID NO: 30735 - protein, 5 aa, Mycobacterium avium
ATPRA

SEQ ID NO: 30736 - protein, 9 aa, Mycobacterium avium
ATPRDGKGL

SEQ ID NO: 30737 - protein, 5 aa, Mycobacterium avium
ATPRP

SEQ ID NO: 30738 - protein, 6 aa, Mycobacterium avium
ATPSRA

SEQ ID NO: 30739 - protein, 19 aa, Mycobacterium avium
ATPTSSGKTVWGSVGREDR

SEQ ID NO: 30740 - protein, 5 aa, Mycobacterium avium
ATPYN

SEQ ID NO: 30741 - protein, 18 aa, Mycobacterium avium
ATQAEQAGAQANAAAAAY

SEQ ID NO: 30742 - protein, 27 aa, Mycobacterium avium
ATQAESAQAGGPDGAAAGGGSGSADDV

SEQ ID NO: 30743 - protein, 6 aa, Mycobacterium avium
ATQAGL

SEQ ID NO: 30744 - protein, 9 aa, Mycobacterium avium
ATQGHTQSL

SEQ ID NO: 30745 - protein, 8 aa, Mycobacterium avium
ATQNAGAA

SEQ ID NO: 30746 - protein, 10 aa, Mycobacterium avium
ATQPNYPAEI

SEQ ID NO: 30747 - protein, 4 aa, Mycobacterium avium
ATQQ

SEQ ID NO: 30748 - protein, 8 aa, Mycobacterium avium
ATQRTQFG

SEQ ID NO: 30749 - protein, 9 aa, Mycobacterium avium
ATQSAGRWS

SEQ ID NO: 30750 - protein, 6 aa, Mycobacterium avium
ATQTRL

SEQ ID NO: 30751 - protein, 11 aa, Mycobacterium avium
ATRAGSPGIAA

SEQ ID NO: 30752 - protein, 5 aa, Mycobacterium avium
ATRDG

SEQ ID NO: 30753 - protein, 8 aa, Mycobacterium avium
ATRDPIAE

SEQ ID NO: 30754 - protein, 10 aa, Mycobacterium avium
ATRDTEETVE

SEQ ID NO: 30755 - protein, 9 aa, Mycobacterium avium
ATREENEEF

SEQ ID NO: 30756 - protein, 7 aa, Mycobacterium avium
ATREPGR

SEQ ID NO: 30757 - protein, 9 aa, Mycobacterium avium
ATRERRPAG

SEQ ID NO: 30758 - protein, 7 aa, Mycobacterium avium
ATRGAEM

SEQ ID NO: 30759 - protein, 18 aa, Mycobacterium avium
ATRGDPNNVDIDGATAAG

SEQ ID NO: 30760 - protein, 9 aa, Mycobacterium avium
ATRGQADAA

SEQ ID NO: 30761 - protein, 10 aa, Mycobacterium avium
ATRGVTTSDE

SEQ ID NO: 30762 - protein, 10 aa, Mycobacterium avium
ATRKAPSGRV

SEQ ID NO: 30763 - protein, 6 aa, Mycobacterium avium
ATRPPA

SEQ ID NO: 30764 - protein, 6 aa, Mycobacterium avium
ATRQPE

SEQ ID NO: 30765 - protein, 4 aa, Mycobacterium avium
ATRR

SEQ ID NO: 30766 - protein, 5 aa, Mycobacterium avium
ATRRY

SEQ ID NO: 30767 - protein, 5 aa, Mycobacterium avium
ATRSG

SEQ ID NO: 30768 - protein, 7 aa, Mycobacterium avium
ATRSPRV

SEQ ID NO: 30769 - protein, 14 aa, Mycobacterium avium
ATRSSGQDSAGYGR

SEQ ID NO: 30770 - protein, 8 aa, Mycobacterium avium
ATRSSPAL

SEQ ID NO: 30771 - protein, 5 aa, Mycobacterium avium
ATRTD

SEQ ID NO: 30772 - protein, 6 aa, Mycobacterium avium
ATRTGQ

SEQ ID NO: 30773 - protein, 9 aa, Mycobacterium avium
ATRVEQRTD

SEQ ID NO: 30774 - protein, 17 aa, Mycobacterium avium
ATSAKGSTTEDPGPDLA

SEQ ID NO: 30775 - protein, 13 aa, Mycobacterium avium
ATSAPHAAPPMPA

SEQ ID NO: 30776 - protein, 6 aa, Mycobacterium avium
ATSAST

SEQ ID NO: 30777 - protein, 9 aa, Mycobacterium avium
ATSDQGFKG

SEQ ID NO: 30778 - protein, 7 aa, Mycobacterium avium
ATSGPGA

SEQ ID NO: 30779 - protein, 12 aa, Mycobacterium avium
ATSGTTGAPKGA

SEQ ID NO: 30780 - protein, 10 aa, Mycobacterium avium
ATSHLTPDQL

SEQ ID NO: 30781 - protein, 7 aa, Mycobacterium avium
ATSPAVD

SEQ ID NO: 30782 - protein, 5 aa, Mycobacterium avium
ATSPP

SEQ ID NO: 30783 - protein, 6 aa, Mycobacterium avium
ATSRDF

SEQ ID NO: 30784 - protein, 7 aa, Mycobacterium avium
ATSRDGV

SEQ ID NO: 30785 - protein, 9 aa, Mycobacterium avium
ATSRPSALS

SEQ ID NO: 30786 - protein, 9 aa, Mycobacterium avium
ATSSDPEQA

SEQ ID NO: 30787 - protein, 17 aa, Mycobacterium avium
ATSSDTVRSRSMTGKPA

SEQ ID NO: 30788 - protein, 6 aa, Mycobacterium avium
ATSSQA

SEQ ID NO: 30789 - protein, 8 aa, Mycobacterium avium
ATSSTAPI

SEQ ID NO: 30790 - protein, 9 aa, Mycobacterium avium
ATSTSAALQ

SEQ ID NO: 30791 - protein, 8 aa, Mycobacterium avium
ATTADEAA

SEQ ID NO: 30792 - protein, 12 aa, Mycobacterium avium
ATTAGEAKYAAK

SEQ ID NO: 30793 - protein, 7 aa, Mycobacterium avium
ATTAGVP

SEQ ID NO: 30794 - protein, 7 aa, Mycobacterium avium
ATTGSLD

SEQ ID NO: 30795 - protein, 6 aa, Mycobacterium avium
ATTHPI

SEQ ID NO: 30796 - protein, 5 aa, Mycobacterium avium
ATTLG

SEQ ID NO: 30797 - protein, 7 aa, Mycobacterium avium
ATTPGKV

SEQ ID NO: 30798 - protein, 5 aa, Mycobacterium avium
ATTPR

SEQ ID NO: 30799 - protein, 7 aa, Mycobacterium avium
ATTQKPQ

SEQ ID NO: 30800 - protein, 11 aa, Mycobacterium avium
ATTRAPQASEH

SEQ ID NO: 30801 - protein, 12 aa, Mycobacterium avium
ATTRAPRPGEVD

SEQ ID NO: 30802 - protein, 7 aa, Mycobacterium avium
ATTRNGR

SEQ ID NO: 30803 - protein, 11 aa, Mycobacterium avium
ATTSAGRHPDS

SEQ ID NO: 30804 - protein, 9 aa, Mycobacterium avium
ATTSPQDAR

SEQ ID NO: 30805 - protein, 7 aa, Mycobacterium avium
ATTSRAH

SEQ ID NO: 30806 - protein, 4 aa, Mycobacterium avium
ATTV

SEQ ID NO: 30807 - protein, 5 aa, Mycobacterium avium
ATTVS

SEQ ID NO: 30808 - protein, 4 aa, Mycobacterium avium
ATVA

SEQ ID NO: 30809 - protein, 6 aa, Mycobacterium avium
ATVAAS

SEQ ID NO: 30810 - protein, 8 aa, Mycobacterium avium
ATVASGTI

SEQ ID NO: 30811 - protein, 13 aa, Mycobacterium avium
ATVDGRRQRADDI

SEQ ID NO: 30812 - protein, 8 aa, Mycobacterium avium
ATVEDPVG

SEQ ID NO: 30813 - protein, 9 aa, Mycobacterium avium
ATVKGGTYY

SEQ ID NO: 30814 - protein, 12 aa, Mycobacterium avium
ATVSPSAPSYED

SEQ ID NO: 30815 - protein, 6 aa, Mycobacterium avium
ATWAAD

SEQ ID NO: 30816 - protein, 12 aa, Mycobacterium avium
ATWTADSGGVVS

SEQ ID NO: 30817 - protein, 8 aa, Mycobacterium avium
AVAADPAR

SEQ ID NO: 30818 - protein, 9 aa, Mycobacterium avium
AVAAPDAET

SEQ ID NO: 30819 - protein, 8 aa, Mycobacterium avium
AVAAQDQV

SEQ ID NO: 30820 - protein, 8 aa, Mycobacterium avium
AVAAQKDG

SEQ ID NO: 30821 - protein, 8 aa, Mycobacterium avium
AVADGDGW

SEQ ID NO: 30822 - protein, 8 aa, Mycobacterium avium
AVANSDGT

SEQ ID NO: 30823 - protein, 8 aa, Mycobacterium avium
AVDAPDEV

SEQ ID NO: 30824 - protein, 5 aa, Mycobacterium avium
AVDDD

SEQ ID NO: 30825 - protein, 17 aa, Mycobacterium avium
AVDGAEALRSATETRPD

SEQ ID NO: 30826 - protein, 6 aa, Mycobacterium avium
AVDNSA

SEQ ID NO: 30827 - protein, 6 aa, Mycobacterium avium
AVDQHG

SEQ ID NO: 30828 - protein, 12 aa, Mycobacterium avium
AVDRDSSWAAKR

SEQ ID NO: 30829 - protein, 5 aa, Mycobacterium avium
AVDRG

SEQ ID NO: 30830 - protein, 9 aa, Mycobacterium avium
AVDSTTSGL

SEQ ID NO: 30831 - protein, 6 aa, Mycobacterium avium
AVDTDG

SEQ ID NO: 30832 - protein, 11 aa, Mycobacterium avium
AVDTDPAERAE

SEQ ID NO: 30833 - protein, 17 aa, Mycobacterium avium
AVEDQRDADLEARAQKL

SEQ ID NO: 30834 - protein, 16 aa, Mycobacterium avium
AVEGAGALDAAGRATF

SEQ ID NO: 30835 - protein, 17 aa, Mycobacterium avium
AVEPDPRVSDVPSTKGV

SEQ ID NO: 30836 - protein, 11 aa, Mycobacterium avium
AVEPPGSARSD

SEQ ID NO: 30837 - protein, 10 aa, Mycobacterium avium
AVETEQPDPL

SEQ ID NO: 30838 - protein, 8 aa, Mycobacterium avium
AVGAPSGV

SEQ ID NO: 30839 - protein, 8 aa, Mycobacterium avium
AVGDGPLD

SEQ ID NO: 30840 - protein, 7 aa, Mycobacterium avium
AVGGASD

SEQ ID NO: 30841 - protein, 12 aa, Mycobacterium avium
AVGGPAAPSKKE

SEQ ID NO: 30842 - protein, 5 aa, Mycobacterium avium
AVGGR

SEQ ID NO: 30843 - protein, 9 aa, Mycobacterium avium
AVGKRGGSL

SEQ ID NO: 30844 - protein, 9 aa, Mycobacterium avium
AVGKSTTAR

SEQ ID NO: 30845 - protein, 19 aa, Mycobacterium avium
AVGQGSEFASGGGSEGGHT

SEQ ID NO: 30846 - protein, 10 aa, Mycobacterium avium
AVGSGDAETI

SEQ ID NO: 30847 - protein, 10 aa, Mycobacterium avium
AVGSGGPTMV

SEQ ID NO: 30848 - protein, 4 aa, Mycobacterium avium
AVHR

SEQ ID NO: 30849 - protein, 12 aa, Mycobacterium avium
AVHRSGPGPMGP

SEQ ID NO: 30850 - protein, 13 aa, Mycobacterium avium
AVKSPADLDALAE

SEQ ID NO: 30851 - protein, 7 aa, Mycobacterium avium
AVKTPDE

SEQ ID NO: 30852 - protein, 9 aa, Mycobacterium avium
AVNDTKDAL

SEQ ID NO: 30853 - protein, 20 aa, Mycobacterium avium
AVNQDGASSGLTVPNGGAQQ

SEQ ID NO: 30854 - protein, 12 aa, Mycobacterium avium
AVPADDPRTRAT

SEQ ID NO: 30855 - protein, 8 aa, Mycobacterium avium
AVPAQDPL

SEQ ID NO: 30856 - protein, 5 aa, Mycobacterium avium
AVPDG

SEQ ID NO: 30857 - protein, 6 aa, Mycobacterium avium
AVPGRP

SEQ ID NO: 30858 - protein, 4 aa, Mycobacterium avium
AVPH

SEQ ID NO: 30859 - protein, 7 aa, Mycobacterium avium
AVPPTGS

SEQ ID NO: 30860 - protein, 17 aa, Mycobacterium avium
AVPQASGRGLGHTGGTL

SEQ ID NO: 30861 - protein, 5 aa, Mycobacterium avium
AVPQS

SEQ ID NO: 30862 - protein, 8 aa, Mycobacterium avium
AVPRNGFG

SEQ ID NO: 30863 - protein, 12 aa, Mycobacterium avium
AVPSGASTGEHE

SEQ ID NO: 30864 - protein, 7 aa, Mycobacterium avium
AVQGPNA

SEQ ID NO: 30865 - protein, 8 aa, Mycobacterium avium
AVQPGSNL

SEQ ID NO: 30866 - protein, 8 aa, Mycobacterium avium
AVQTPGAD

SEQ ID NO: 30867 - protein, 5 aa, Mycobacterium avium
AVRDG

SEQ ID NO: 30868 - protein, 9 aa, Mycobacterium avium
AVRDKDGIS

SEQ ID NO: 30869 - protein, 6 aa, Mycobacterium avium
AVRGPY

SEQ ID NO: 30870 - protein, 6 aa, Mycobacterium avium
AVRHDP

SEQ ID NO: 30871 - protein, 5 aa, Mycobacterium avium
AVRPD

SEQ ID NO: 30872 - protein, 26 aa, Mycobacterium avium
AVRPGRHQPEGGGDPRARDERTPSQR

SEQ ID NO: 30873 - protein, 12 aa, Mycobacterium avium
AVRQGDPLDSET

SEQ ID NO: 30874 - protein, 4 aa, Mycobacterium avium
AVRR

SEQ ID NO: 30875 - protein, 5 aa, Mycobacterium avium
AVRSG

SEQ ID NO: 30876 - protein, 4 aa, Mycobacterium avium
AVSD

SEQ ID NO: 30877 - protein, 6 aa, Mycobacterium avium
AVSEPV

SEQ ID NO: 30878 - protein, 7 aa, Mycobacterium avium
AVSGEKT

SEQ ID NO: 30879 - protein, 8 aa, Mycobacterium avium
AVSGRPGG

SEQ ID NO: 30880 - protein, 8 aa, Mycobacterium avium
AVSPEELG

SEQ ID NO: 30881 - protein, 20 aa, Mycobacterium avium
AVSPYGSGALAGSSLGLDPD

SEQ ID NO: 30882 - protein, 10 aa, Mycobacterium avium
AVSSGDNSNI

SEQ ID NO: 30883 - protein, 8 aa, Mycobacterium avium
AVSSNPDA

SEQ ID NO: 30884 - protein, 8 aa, Mycobacterium avium
AVTAAPDG

SEQ ID NO: 30885 - protein, 17 aa, Mycobacterium avium
AVTGGPLRKNEIPRPPL

SEQ ID NO: 30886 - protein, 10 aa, Mycobacterium avium
AVTPKPAPPL

SEQ ID NO: 30887 - protein, 6 aa, Mycobacterium avium
AVTPRT

SEQ ID NO: 30888 - protein, 11 aa, Mycobacterium avium
AVTSSSKQRSR

SEQ ID NO: 30889 - protein, 7 aa, Mycobacterium avium
AVTTEEI

SEQ ID NO: 30890 - protein, 7 aa, Mycobacterium avium
AVVTPSA

SEQ ID NO: 30891 - protein, 6 aa, Mycobacterium avium
AWGGPP

SEQ ID NO: 30892 - protein, 9 aa, Mycobacterium avium
AWPASQDAS

SEQ ID NO: 30893 - protein, 10 aa, Mycobacterium avium
AWPDGTDPRW

SEQ ID NO: 30894 - protein, 5 aa, Mycobacterium avium
AWQNG

SEQ ID NO: 30895 - protein, 11 aa, Mycobacterium avium
AWTNDAAEQQR

SEQ ID NO: 30896 - protein, 6 aa, Mycobacterium avium
AYADAG

SEQ ID NO: 30897 - protein, 5 aa, Mycobacterium avium
AYADP

SEQ ID NO: 30898 - protein, 5 aa, Mycobacterium avium
AYAGA

SEQ ID NO: 30899 - protein, 13 aa, Mycobacterium avium
AYAGNQAKRIAIT

SEQ ID NO: 30900 - protein, 21 aa, Mycobacterium avium
AYAKAGSRDTVRSRSFTGKPA

SEQ ID NO: 30901 - protein, 6 aa, Mycobacterium avium
AYAPRA

SEQ ID NO: 30902 - protein, 5 aa, Mycobacterium avium
AYAPY

SEQ ID NO: 30903 - protein, 10 aa, Mycobacterium avium
AYASRSAGRV

SEQ ID NO: 30904 - protein, 4 aa, Mycobacterium avium
AYDD

SEQ ID NO: 30905 - protein, 7 aa, Mycobacterium avium
AYDEDND

SEQ ID NO: 30906 - protein, 8 aa, Mycobacterium avium
AYDEPASL

SEQ ID NO: 30907 - protein, 12 aa, Mycobacterium avium
AYDEQQGSADDG

SEQ ID NO: 30908 - protein, 11 aa, Mycobacterium avium
AYDEVTKKTDG

SEQ ID NO: 30909 - protein, 21 aa, Mycobacterium avium
AYDPDGPLPDVEPVENPTITR

SEQ ID NO: 30910 - protein, 4 aa, Mycobacterium avium
AYEE

SEQ ID NO: 30911 - protein, 7 aa, Mycobacterium avium
AYEGPPR

SEQ ID NO: 30912 - protein, 6 aa, Mycobacterium avium
AYGEDD

SEQ ID NO: 30913 - protein, 8 aa, Mycobacterium avium
AYGGDDGF

SEQ ID NO: 30914 - protein, 13 aa, Mycobacterium avium
AYGGNGPEGSRPG

SEQ ID NO: 30915 - protein, 8 aa, Mycobacterium avium
AYGKNGAD

SEQ ID NO: 30916 - protein, 4 aa, Mycobacterium avium
AYGP

SEQ ID NO: 30917 - protein, 5 aa, Mycobacterium avium
AYGQS

SEQ ID NO: 30918 - protein, 10 aa, Mycobacterium avium
AYGREGESCR

SEQ ID NO: 30919 - protein, 5 aa, Mycobacterium avium
AYLPS

SEQ ID NO: 30920 - protein, 9 aa, Mycobacterium avium
AYNQPDPKL

SEQ ID NO: 30921 - protein, 5 aa, Mycobacterium avium
AYPDR

SEQ ID NO: 30922 - protein, 7 aa, Mycobacterium avium
AYPGEPL

SEQ ID NO: 30923 - protein, 7 aa, Mycobacterium avium
AYPPEVT

SEQ ID NO: 30924 - protein, 9 aa, Mycobacterium avium
AYPPVTETR

SEQ ID NO: 30925 - protein, 14 aa, Mycobacterium avium
AYPSTLGYKGYPKS

SEQ ID NO: 30926 - protein, 20 aa, Mycobacterium avium
AYPTESIPDRWSNDAGPEQL

SEQ ID NO: 30927 - protein, 8 aa, Mycobacterium avium
AYQASKGA

SEQ ID NO: 30928 - protein, 7 aa, Mycobacterium avium
AYQGPER

SEQ ID NO: 30929 - protein, 7 aa, Mycobacterium avium
AYTPDGI

SEQ ID NO: 30930 - protein, 5 aa, Mycobacterium avium
AYTRK

SEQ ID NO: 30931 - protein, 27 aa, Mycobacterium avium
AYVQSGGGVVADSNGPYEYTEATNKAR

SEQ ID NO: 30932 - protein, 5 aa, Mycobacterium avium
AYYDR

SEQ ID NO: 30933 - protein, 4 aa, Mycobacterium avium
CAAP

SEQ ID NO: 30934 - protein, 6 aa, Mycobacterium avium
CADGQF

SEQ ID NO: 30935 - protein, 8 aa, Mycobacterium avium
CAEARSKD

SEQ ID NO: 30936 - protein, 12 aa, Mycobacterium avium
CAEKARADEPYR

SEQ ID NO: 30937 - protein, 19 aa, Mycobacterium avium
CAGGRDGPVQVPDQPHQHE

SEQ ID NO: 30938 - protein, 12 aa, Mycobacterium avium
CAGQAEKEVGDQ

SEQ ID NO: 30939 - protein, 14 aa, Mycobacterium avium
CANRDPGHLDSPSF

SEQ ID NO: 30940 - protein, 6 aa, Mycobacterium avium
CAPDAA

SEQ ID NO: 30941 - protein, 8 aa, Mycobacterium avium
CAQGRGLG

SEQ ID NO: 30942 - protein, 10 aa, Mycobacterium avium
CAQRTDHRRG

SEQ ID NO: 30943 - protein, 14 aa, Mycobacterium avium
CARSPGCPLGTDPA

SEQ ID NO: 30944 - protein, 7 aa, Mycobacterium avium
CASGQEA

SEQ ID NO: 30945 - protein, 12 aa, Mycobacterium avium
CASGSQALQSAR

SEQ ID NO: 30946 - protein, 4 aa, Mycobacterium avium
CATR

SEQ ID NO: 30947 - protein, 11 aa, Mycobacterium avium
CDAGRPGDSGD

SEQ ID NO: 30948 - protein, 6 aa, Mycobacterium avium
CDPDGP

SEQ ID NO: 30949 - protein, 19 aa, Mycobacterium avium
CDQPRSEHADLTGAAAEAM

SEQ ID NO: 30950 - protein, 7 aa, Mycobacterium avium
CEAGNTS

SEQ ID NO: 30951 - protein, 10 aa, Mycobacterium avium
CEKRDPKGLY

SEQ ID NO: 30952 - protein, 10 aa, Mycobacterium avium
CEPNRRTGAA

SEQ ID NO: 30953 - protein, 9 aa, Mycobacterium avium
CEQRDDTRL

SEQ ID NO: 30954 - protein, 18 aa, Mycobacterium avium
CESGGNWHANTGNGEYGG

SEQ ID NO: 30955 - protein, 6 aa, Mycobacterium avium
CESGRH

SEQ ID NO: 30956 - protein, 5 aa, Mycobacterium avium
CETER

SEQ ID NO: 30957 - protein, 7 aa, Mycobacterium avium
CGAGADC

SEQ ID NO: 30958 - protein, 9 aa, Mycobacterium avium
CGAGGDCGR

SEQ ID NO: 30959 - protein, 21 aa, Mycobacterium avium
CGDAGQSPGTWKQNGQTGGQI

SEQ ID NO: 30960 - protein, 8 aa, Mycobacterium avium
CGDDRRSV

SEQ ID NO: 30961 - protein, 5 aa, Mycobacterium avium
CGEGA

SEQ ID NO: 30962 - protein, 6 aa, Mycobacterium avium
CGEGYG

SEQ ID NO: 30963 - protein, 4 aa, Mycobacterium avium
CGGA

SEQ ID NO: 30964 - protein, 10 aa, Mycobacterium avium
CGGGRPADKD

SEQ ID NO: 30965 - protein, 14 aa, Mycobacterium avium
CGGPPIAAASREQL

SEQ ID NO: 30966 - protein, 9 aa, Mycobacterium avium
CGGRGEVQT

SEQ ID NO: 30967 - protein, 12 aa, Mycobacterium avium
CGGSGRDVHTPA

SEQ ID NO: 30968 - protein, 10 aa, Mycobacterium avium
CGKPGSADAA

SEQ ID NO: 30969 - protein, 7 aa, Mycobacterium avium
CGNEEAN

SEQ ID NO: 30970 - protein, 5 aa, Mycobacterium avium
CGPAG

SEQ ID NO: 30971 - protein, 7 aa, Mycobacterium avium
CGPDGTA

SEQ ID NO: 30972 - protein, 6 aa, Mycobacterium avium
CGPGRL

SEQ ID NO: 30973 - protein, 4 aa, Mycobacterium avium
CGPQ

SEQ ID NO: 30974 - protein, 6 aa, Mycobacterium avium
CGQEDA

SEQ ID NO: 30975 - protein, 7 aa, Mycobacterium avium
CGRGDEG

SEQ ID NO: 30976 - protein, 6 aa, Mycobacterium avium
CGRGDF

SEQ ID NO: 30977 - protein, 7 aa, Mycobacterium avium
CGRPDTG

SEQ ID NO: 30978 - protein, 5 aa, Mycobacterium avium
CGRPR

SEQ ID NO: 30979 - protein, 7 aa, Mycobacterium avium
CGSGQQA

SEQ ID NO: 30980 - protein, 5 aa, Mycobacterium avium
CGSTG

SEQ ID NO: 30981 - protein, 4 aa, Mycobacterium avium
CGTG

SEQ ID NO: 30982 - protein, 8 aa, Mycobacterium avium
CGTGASTA

SEQ ID NO: 30983 - protein, 11 aa, Mycobacterium avium
CKGEKAPEGLR

SEQ ID NO: 30984 - protein, 11 aa, Mycobacterium avium
CKGTGVTTRTR

SEQ ID NO: 30985 - protein, 20 aa, Mycobacterium avium
CKPGSGPFSLTGQPNAMGGR

SEQ ID NO: 30986 - protein, 10 aa, Mycobacterium avium
CLTPSDDDNV

SEQ ID NO: 30987 - protein, 4 aa, Mycobacterium avium
CNGA

SEQ ID NO: 30988 - protein, 23 aa, Mycobacterium avium
CNRHPDGAKALGVTTEETAAWRD

SEQ ID NO: 30989 - protein, 5 aa, Mycobacterium avium
CNTAR

SEQ ID NO: 30990 - protein, 5 aa, Mycobacterium avium
CPAPG

SEQ ID NO: 30991 - protein, 10 aa, Mycobacterium avium
CPDAADPRPA

SEQ ID NO: 30992 - protein, 5 aa, Mycobacterium avium
CPDCT

SEQ ID NO: 30993 - protein, 5 aa, Mycobacterium avium
CPEHT

SEQ ID NO: 30994 - protein, 4 aa, Mycobacterium avium
CPFD

SEQ ID NO: 30995 - protein, 6 aa, Mycobacterium avium
CPGPEA

SEQ ID NO: 30996 - protein, 17 aa, Mycobacterium avium
CPKGSASEQLVNSPGRQ

SEQ ID NO: 30997 - protein, 11 aa, Mycobacterium avium
CPKKTEISDRV

SEQ ID NO: 30998 - protein, 5 aa, Mycobacterium avium
CPNCG

SEQ ID NO: 30999 - protein, 15 aa, Mycobacterium avium
CPPASRFARATRAAG

SEQ ID NO: 31000 - protein, 4 aa, Mycobacterium avium
CPPD

SEQ ID NO: 31001 - protein, 4 aa, Mycobacterium avium
CPPE

SEQ ID NO: 31002 - protein, 17 aa, Mycobacterium avium
CPPPDDPVTNLSGGERR

SEQ ID NO: 31003 - protein, 5 aa, Mycobacterium avium
CPPRP

SEQ ID NO: 31004 - protein, 4 aa, Mycobacterium avium
CPSG

SEQ ID NO: 31005 - protein, 14 aa, Mycobacterium avium
CPTGAVTVNMPYLL

SEQ ID NO: 31006 - protein, 19 aa, Mycobacterium avium
CPVPRPETYHDDPRIARTQ

SEQ ID NO: 31007 - protein, 11 aa, Mycobacterium avium
CQASGSPRDPE

SEQ ID NO: 31008 - protein, 7 aa, Mycobacterium avium
CQPRPTD

SEQ ID NO: 31009 - protein, 7 aa, Mycobacterium avium
CREAGAE

SEQ ID NO: 31010 - protein, 12 aa, Mycobacterium avium
CRGGAPGTRETD

SEQ ID NO: 31011 - protein, 19 aa, Mycobacterium avium
CRGSTGPSSRTRDGKPWGS

SEQ ID NO: 31012 - protein, 12 aa, Mycobacterium avium
CRPDASPGSPEW

SEQ ID NO: 31013 - protein, 7 aa, Mycobacterium avium
CRSQEPE

SEQ ID NO: 31014 - protein, 4 aa, Mycobacterium avium
CRTP

SEQ ID NO: 31015 - protein, 5 aa, Mycobacterium avium
CSAPV

SEQ ID NO: 31016 - protein, 14 aa, Mycobacterium avium
CSEDEGPKLSAEAG

SEQ ID NO: 31017 - protein, 8 aa, Mycobacterium avium
CSEPSEKE

SEQ ID NO: 31018 - protein, 16 aa, Mycobacterium avium
CSGGMHGSNRLGGNSL

SEQ ID NO: 31019 - protein, 8 aa, Mycobacterium avium
CSGNGGFA

SEQ ID NO: 31020 - protein, 9 aa, Mycobacterium avium
CSGRPRGRT

SEQ ID NO: 31021 - protein, 11 aa, Mycobacterium avium
CSPTSDGSGAA

SEQ ID NO: 31022 - protein, 5 aa, Mycobacterium avium
CSREE

SEQ ID NO: 31023 - protein, 4 aa, Mycobacterium avium
CSSG

SEQ ID NO: 31024 - protein, 5 aa, Mycobacterium avium
CSSGT

SEQ ID NO: 31025 - protein, 5 aa, Mycobacterium avium
CSTAE

SEQ ID NO: 31026 - protein, 6 aa, Mycobacterium avium
CTNDDG

SEQ ID NO: 31027 - protein, 8 aa, Mycobacterium avium
CTNTSNPE

SEQ ID NO: 31028 - protein, 18 aa, Mycobacterium avium
CTPGYYNNEGGGGGEGIR

SEQ ID NO: 31029 - protein, 8 aa, Mycobacterium avium
CTQDDTGV

SEQ ID NO: 31030 - protein, 6 aa, Mycobacterium avium
DAAAAD

SEQ ID NO: 31031 - protein, 8 aa, Mycobacterium avium
DAAAAEPH

SEQ ID NO: 31032 - protein, 6 aa, Mycobacterium avium
DAAAAG

SEQ ID NO: 31033 - protein, 7 aa, Mycobacterium avium
DAAAATG

SEQ ID NO: 31034 - protein, 6 aa, Mycobacterium avium
DAAAGA

SEQ ID NO: 31035 - protein, 23 aa, Mycobacterium avium
DAAAQAAGEHARRGDRGKKFESS

SEQ ID NO: 31036 - protein, 24 aa, Mycobacterium avium
DAAAQAASEHARRGDRRKEVESST

SEQ ID NO: 31037 - protein, 9 aa, Mycobacterium avium
DAAAQPVSG

SEQ ID NO: 31038 - protein, 8 aa, Mycobacterium avium
DAAARAGS

SEQ ID NO: 31039 - protein, 5 aa, Mycobacterium avium
DAAAT

SEQ ID NO: 31040 - protein, 7 aa, Mycobacterium avium
DAAATTV

SEQ ID NO: 31041 - protein, 7 aa, Mycobacterium avium
DAADAAD

SEQ ID NO: 31042 - protein, 9 aa, Mycobacterium avium
DAAEAERSG

SEQ ID NO: 31043 - protein, 4 aa, Mycobacterium avium
DAAF

SEQ ID NO: 31044 - protein, 36 aa, Mycobacterium avium
DAAGPGRKPVIGGSADKGEKTGGAHRIESAKAGKLT

SEQ ID NO: 31045 - protein, 7 aa, Mycobacterium avium
DAAGRAA

SEQ ID NO: 31046 - protein, 12 aa, Mycobacterium avium
DAAGRSRNVTET

SEQ ID NO: 31047 - protein, 6 aa, Mycobacterium avium
DAAGVT

SEQ ID NO: 31048 - protein, 8 aa, Mycobacterium avium
DAAHAGEY

SEQ ID NO: 31049 - protein, 8 aa, Mycobacterium avium
DAAKGGFD

SEQ ID NO: 31050 - protein, 4 aa, Mycobacterium avium
DAAL

SEQ ID NO: 31051 - protein, 6 aa, Mycobacterium avium
DAALGR

SEQ ID NO: 31052 - protein, 5 aa, Mycobacterium avium
DAALK

SEQ ID NO: 31053 - protein, 10 aa, Mycobacterium avium
DAAPEGVSAL

SEQ ID NO: 31054 - protein, 6 aa, Mycobacterium avium
DAAPEL

SEQ ID NO: 31055 - protein, 8 aa, Mycobacterium avium
DAAPGDID

SEQ ID NO: 31056 - protein, 8 aa, Mycobacterium avium
DAAPLQDA

SEQ ID NO: 31057 - protein, 7 aa, Mycobacterium avium
DAAQGTR

SEQ ID NO: 31058 - protein, 7 aa, Mycobacterium avium
DAAQRDW

SEQ ID NO: 31059 - protein, 8 aa, Mycobacterium avium
DAARATAS

SEQ ID NO: 31060 - protein, 6 aa, Mycobacterium avium
DAARNV

SEQ ID NO: 31061 - protein, 8 aa, Mycobacterium avium
DAARQGNS

SEQ ID NO: 31062 - protein, 35 aa, Mycobacterium avium
DAARRAAISTADTLRAEQKSASKSVGAASPEQRPA

SEQ ID NO: 31063 - protein, 7 aa, Mycobacterium avium
DAARRAR

SEQ ID NO: 31064 - protein, 8 aa, Mycobacterium avium
DAARTTYR

SEQ ID NO: 31065 - protein, 6 aa, Mycobacterium avium
DAARYA

SEQ ID NO: 31066 - protein, 11 aa, Mycobacterium avium
DAATAESAADA

SEQ ID NO: 31067 - protein, 6 aa, Mycobacterium avium
DAATDA

SEQ ID NO: 31068 - protein, 6 aa, Mycobacterium avium
DAATER

SEQ ID NO: 31069 - protein, 8 aa, Mycobacterium avium
DAATGRLA

SEQ ID NO: 31070 - protein, 12 aa, Mycobacterium avium
DAATGTADPEIE

SEQ ID NO: 31071 - protein, 7 aa, Mycobacterium avium
DAATQKA

SEQ ID NO: 31072 - protein, 8 aa, Mycobacterium avium
DACTPSHT

SEQ ID NO: 31073 - protein, 11 aa, Mycobacterium avium
DADADGREGST

SEQ ID NO: 31074 - protein, 6 aa, Mycobacterium avium
DADDDY

SEQ ID NO: 31075 - protein, 9 aa, Mycobacterium avium
DADDLDDPA

SEQ ID NO: 31076 - protein, 7 aa, Mycobacterium avium
DADDQTL

SEQ ID NO: 31077 - protein, 9 aa, Mycobacterium avium
DADETDYDL

SEQ ID NO: 31078 - protein, 26 aa, Mycobacterium avium
DADGNDLPGVTTSDCEYKGGLPGVDN

SEQ ID NO: 31079 - protein, 9 aa, Mycobacterium avium
DADGRASAV

SEQ ID NO: 31080 - protein, 8 aa, Mycobacterium avium
DADGSGAA

SEQ ID NO: 31081 - protein, 8 aa, Mycobacterium avium
DADGSPAY

SEQ ID NO: 31082 - protein, 8 aa, Mycobacterium avium
DADGTKAG

SEQ ID NO: 31083 - protein, 5 aa, Mycobacterium avium
DADGV

SEQ ID NO: 31084 - protein, 4 aa, Mycobacterium avium
DADP

SEQ ID NO: 31085 - protein, 7 aa, Mycobacterium avium
DADPTWS

SEQ ID NO: 31086 - protein, 4 aa, Mycobacterium avium
DADQ

SEQ ID NO: 31087 - protein, 9 aa, Mycobacterium avium
DADQPSVRE

SEQ ID NO: 31088 - protein, 6 aa, Mycobacterium avium
DADRDA

SEQ ID NO: 31089 - protein, 10 aa, Mycobacterium avium
DADSADAAKG

SEQ ID NO: 31090 - protein, 7 aa, Mycobacterium avium
DADSDEV

SEQ ID NO: 31091 - protein, 4 aa, Mycobacterium avium
DADT

SEQ ID NO: 31092 - protein, 8 aa, Mycobacterium avium
DADTARQL

SEQ ID NO: 31093 - protein, 7 aa, Mycobacterium avium
DADTIGA

SEQ ID NO: 31094 - protein, 7 aa, Mycobacterium avium
DADTVSL

SEQ ID NO: 31095 - protein, 10 aa, Mycobacterium avium
DADYDAAEAA

SEQ ID NO: 31096 - protein, 4 aa, Mycobacterium avium
DAEA

SEQ ID NO: 31097 - protein, 9 aa, Mycobacterium avium
DAEAADKAG

SEQ ID NO: 31098 - protein, 8 aa, Mycobacterium avium
DAEAGPTE

SEQ ID NO: 31099 - protein, 5 aa, Mycobacterium avium
DAEAY

SEQ ID NO: 31100 - protein, 7 aa, Mycobacterium avium
DAEGADE

SEQ ID NO: 31101 - protein, 7 aa, Mycobacterium avium
DAEGATR

SEQ ID NO: 31102 - protein, 8 aa, Mycobacterium avium
DAEGGDTF

SEQ ID NO: 31103 - protein, 7 aa, Mycobacterium avium
DAEGGTG

SEQ ID NO: 31104 - protein, 8 aa, Mycobacterium avium
DAEHARAV

SEQ ID NO: 31105 - protein, 14 aa, Mycobacterium avium
DAEITTEANPESTW

SEQ ID NO: 31106 - protein, 21 aa, Mycobacterium avium
DAELRAKTDEFKKRHADGESL

SEQ ID NO: 31107 - protein, 9 aa, Mycobacterium avium
DAEPAGKRA

SEQ ID NO: 31108 - protein, 12 aa, Mycobacterium avium
DAERDGRTRPAQ

SEQ ID NO: 31109 - protein, 5 aa, Mycobacterium avium
DAERE

SEQ ID NO: 31110 - protein, 9 aa, Mycobacterium avium
DAERGTGGN

SEQ ID NO: 31111 - protein, 6 aa, Mycobacterium avium
DAETAE

SEQ ID NO: 31112 - protein, 7 aa, Mycobacterium avium
DAETDDD

SEQ ID NO: 31113 - protein, 7 aa, Mycobacterium avium
DAETDEV

SEQ ID NO: 31114 - protein, 5 aa, Mycobacterium avium
DAETE

SEQ ID NO: 31115 - protein, 21 aa, Mycobacterium avium
DAETPGAAQAAPAVDDSGYDQ

SEQ ID NO: 31116 - protein, 7 aa, Mycobacterium avium
DAEVPGG

SEQ ID NO: 31117 - protein, 13 aa, Mycobacterium avium
DAFERDDPRGGEA

SEQ ID NO: 31118 - protein, 15 aa, Mycobacterium avium
DAGAELAGHIVEFLR

SEQ ID NO: 31119 - protein, 11 aa, Mycobacterium avium
DAGAERDRAEQ

SEQ ID NO: 31120 - protein, 10 aa, Mycobacterium avium
DAGAFGPPWP

SEQ ID NO: 31121 - protein, 7 aa, Mycobacterium avium
DAGANAV

SEQ ID NO: 31122 - protein, 6 aa, Mycobacterium avium
DAGARP

SEQ ID NO: 31123 - protein, 11 aa, Mycobacterium avium
DAGASGEDRSF

SEQ ID NO: 31124 - protein, 8 aa, Mycobacterium avium
DAGDHGDL

SEQ ID NO: 31125 - protein, 6 aa, Mycobacterium avium
DAGDPV

SEQ ID NO: 31126 - protein, 6 aa, Mycobacterium avium
DAGDSL

SEQ ID NO: 31127 - protein, 8 aa, Mycobacterium avium
DAGDTPTL

SEQ ID NO: 31128 - protein, 9 aa, Mycobacterium avium
DAGEPADWD

SEQ ID NO: 31129 - protein, 25 aa, Mycobacterium avium
DAGERMASEERAAVAAPAGPSIDAS

SEQ ID NO: 31130 - protein, 4 aa, Mycobacterium avium
DAGF

SEQ ID NO: 31131 - protein, 18 aa, Mycobacterium avium
DAGGETGQPPRNRRQEET

SEQ ID NO: 31132 - protein, 6 aa, Mycobacterium avium
DAGGRY

SEQ ID NO: 31133 - protein, 14 aa, Mycobacterium avium
DAGIPGTSGRPNPD

SEQ ID NO: 31134 - protein, 6 aa, Mycobacterium avium
DAGIPT

SEQ ID NO: 31135 - protein, 5 aa, Mycobacterium avium
DAGLD

SEQ ID NO: 31136 - protein, 5 aa, Mycobacterium avium
DAGLG

SEQ ID NO: 31137 - protein, 11 aa, Mycobacterium avium
DAGLPGRGAPD

SEQ ID NO: 31138 - protein, 7 aa, Mycobacterium avium
DAGPATR

SEQ ID NO: 31139 - protein, 6 aa, Mycobacterium avium
DAGPEN

SEQ ID NO: 31140 - protein, 5 aa, Mycobacterium avium
DAGPG

SEQ ID NO: 31141 - protein, 11 aa, Mycobacterium avium
DAGPGHHDGEF

SEQ ID NO: 31142 - protein, 7 aa, Mycobacterium avium
DAGPQTR

SEQ ID NO: 31143 - protein, 8 aa, Mycobacterium avium
DAGPREGW

SEQ ID NO: 31144 - protein, 10 aa, Mycobacterium avium
DAGQGETELS

SEQ ID NO: 31145 - protein, 6 aa, Mycobacterium avium
DAGRCQ

SEQ ID NO: 31146 - protein, 6 aa, Mycobacterium avium
DAGREV

SEQ ID NO: 31147 - protein, 5 aa, Mycobacterium avium
DAGRP

SEQ ID NO: 31148 - protein, 6 aa, Mycobacterium avium
DAGRRP

SEQ ID NO: 31149 - protein, 7 aa, Mycobacterium avium
DAGSEGW

SEQ ID NO: 31150 - protein, 7 aa, Mycobacterium avium
DAGSGVA

SEQ ID NO: 31151 - protein, 10 aa, Mycobacterium avium
DAGTPDLAPP

SEQ ID NO: 31152 - protein, 13 aa, Mycobacterium avium
DAGTTDDRNFSGP

SEQ ID NO: 31153 - protein, 8 aa, Mycobacterium avium
DAGVGKST

SEQ ID NO: 31154 - protein, 10 aa, Mycobacterium avium
DAGWARKTAA

SEQ ID NO: 31155 - protein, 6 aa, Mycobacterium avium
DAHAAG

SEQ ID NO: 31156 - protein, 7 aa, Mycobacterium avium
DAHAPGQ

SEQ ID NO: 31157 - protein, 6 aa, Mycobacterium avium
DAHERG

SEQ ID NO: 31158 - protein, 8 aa, Mycobacterium avium
DAHNAQSR

SEQ ID NO: 31159 - protein, 9 aa, Mycobacterium avium
DAHNREQRF

SEQ ID NO: 31160 - protein, 9 aa, Mycobacterium avium
DAHPQSVAA

SEQ ID NO: 31161 - protein, 8 aa, Mycobacterium avium
DAHRAAGR

SEQ ID NO: 31162 - protein, 8 aa, Mycobacterium avium
DAHRRPKG

SEQ ID NO: 31163 - protein, 4 aa, Mycobacterium avium
DAIA

SEQ ID NO: 31164 - protein, 12 aa, Mycobacterium avium
DAIPGGNVKRGD

SEQ ID NO: 31165 - protein, 11 aa, Mycobacterium avium
DAITAAGRAAA

SEQ ID NO: 31166 - protein, 19 aa, Mycobacterium avium
DAKEGPRAFAEKRKPNFQN

SEQ ID NO: 31167 - protein, 11 aa, Mycobacterium avium
DAKFSRPNDRR

SEQ ID NO: 31168 - protein, 9 aa, Mycobacterium avium
DAKKDTELA

SEQ ID NO: 31169 - protein, 7 aa, Mycobacterium avium
DAKPGNF

SEQ ID NO: 31170 - protein, 9 aa, Mycobacterium avium
DAKPKTTRR

SEQ ID NO: 31171 - protein, 8 aa, Mycobacterium avium
DAKPPRTF

SEQ ID NO: 31172 - protein, 23 aa, Mycobacterium avium
DAKQGADHYRDTARRAVEEASAQ

SEQ ID NO: 31173 - protein, 4 aa, Mycobacterium avium
DAKS

SEQ ID NO: 31174 - protein, 8 aa, Mycobacterium avium
DAKTHAES

SEQ ID NO: 31175 - protein, 8 aa, Mycobacterium avium
DALEPDEV

SEQ ID NO: 31176 - protein, 8 aa, Mycobacterium avium
DALGADPA

SEQ ID NO: 31177 - protein, 6 aa, Mycobacterium avium
DALPNG

SEQ ID NO: 31178 - protein, 9 aa, Mycobacterium avium
DALSSQTRL

SEQ ID NO: 31179 - protein, 7 aa, Mycobacterium avium
DAMGTTE

SEQ ID NO: 31180 - protein, 5 aa, Mycobacterium avium
DANAD

SEQ ID NO: 31181 - protein, 7 aa, Mycobacterium avium
DANIGMG

SEQ ID NO: 31182 - protein, 10 aa, Mycobacterium avium
DANPDRGTLS

SEQ ID NO: 31183 - protein, 8 aa, Mycobacterium avium
DANPETAQ

SEQ ID NO: 31184 - protein, 5 aa, Mycobacterium avium
DANPQ

SEQ ID NO: 31185 - protein, 8 aa, Mycobacterium avium
DANTLEAT

SEQ ID NO: 31186 - protein, 14 aa, Mycobacterium avium
DAPADRDQKARLSK

SEQ ID NO: 31187 - protein, 5 aa, Mycobacterium avium
DAPAE

SEQ ID NO: 31188 - protein, 5 aa, Mycobacterium avium
DAPAS

SEQ ID NO: 31189 - protein, 8 aa, Mycobacterium avium
DAPDGDER

SEQ ID NO: 31190 - protein, 8 aa, Mycobacterium avium
DAPDGRGL

SEQ ID NO: 31191 - protein, 15 aa, Mycobacterium avium
DAPEVPAGGVDPLSP

SEQ ID NO: 31192 - protein, 8 aa, Mycobacterium avium
DAPGFSAT

SEQ ID NO: 31193 - protein, 10 aa, Mycobacterium avium
DAPGRGGPAN

SEQ ID NO: 31194 - protein, 12 aa, Mycobacterium avium
DAPGRPASRALA

SEQ ID NO: 31195 - protein, 5 aa, Mycobacterium avium
DAPGY

SEQ ID NO: 31196 - protein, 10 aa, Mycobacterium avium
DAPHAGGPRV

SEQ ID NO: 31197 - protein, 4 aa, Mycobacterium avium
DAPI

SEQ ID NO: 31198 - protein, 7 aa, Mycobacterium avium
DAPLDAD

SEQ ID NO: 31199 - protein, 6 aa, Mycobacterium avium
DAPLES

SEQ ID NO: 31200 - protein, 7 aa, Mycobacterium avium
DAPLGRA

SEQ ID NO: 31201 - protein, 8 aa, Mycobacterium avium
DAPNLTQA

SEQ ID NO: 31202 - protein, 12 aa, Mycobacterium avium
DAPNQPSPSIAP

SEQ ID NO: 31203 - protein, 9 aa, Mycobacterium avium
DAPPDKVAA

SEQ ID NO: 31204 - protein, 12 aa, Mycobacterium avium
DAPQAELRDKSV

SEQ ID NO: 31205 - protein, 23 aa, Mycobacterium avium
DAPQGADSSGTPRSVADSVGDID

SEQ ID NO: 31206 - protein, 6 aa, Mycobacterium avium
DAPRQN

SEQ ID NO: 31207 - protein, 30 aa, Mycobacterium avium
DAPRSMAQQPQPTGPPQREQLEQQQQQRAG

SEQ ID NO: 31208 - protein, 4 aa, Mycobacterium avium
DAPS

SEQ ID NO: 31209 - protein, 6 aa, Mycobacterium avium
DAPSAT

SEQ ID NO: 31210 - protein, 5 aa, Mycobacterium avium
DAPVD

SEQ ID NO: 31211 - protein, 13 aa, Mycobacterium avium
DAPVKLSTPSDAV

SEQ ID NO: 31212 - protein, 6 aa, Mycobacterium avium
DAQAPL

SEQ ID NO: 31213 - protein, 7 aa, Mycobacterium avium
DAQDEAM

SEQ ID NO: 31214 - protein, 8 aa, Mycobacterium avium
DAQDTAEL

SEQ ID NO: 31215 - protein, 10 aa, Mycobacterium avium
DAQGNAAYTG

SEQ ID NO: 31216 - protein, 8 aa, Mycobacterium avium
DAQKAGKP

SEQ ID NO: 31217 - protein, 10 aa, Mycobacterium avium
DAQNEKNTKQ

SEQ ID NO: 31218 - protein, 9 aa, Mycobacterium avium
DAQPDGELP

SEQ ID NO: 31219 - protein, 14 aa, Mycobacterium avium
DAQPRYSAARRDAV

SEQ ID NO: 31220 - protein, 7 aa, Mycobacterium avium
DAQQQSH

SEQ ID NO: 31221 - protein, 32 aa, Mycobacterium avium
DAQSQPFTTAPELKPQPSSTPPPPPPLPPTPF

SEQ ID NO: 31222 - protein, 9 aa, Mycobacterium avium
DARAATGLD

SEQ ID NO: 31223 - protein, 18 aa, Mycobacterium avium
DARAQNIAKTAAAAGAGD

SEQ ID NO: 31224 - protein, 5 aa, Mycobacterium avium
DARAT

SEQ ID NO: 31225 - protein, 5 aa, Mycobacterium avium
DARDT

SEQ ID NO: 31226 - protein, 12 aa, Mycobacterium avium
DARDTKLGAEEI

SEQ ID NO: 31227 - protein, 4 aa, Mycobacterium avium
DARG

SEQ ID NO: 31228 - protein, 7 aa, Mycobacterium avium
DARGDFA

SEQ ID NO: 31229 - protein, 15 aa, Mycobacterium avium
DARGGRQRWRAVKPI

SEQ ID NO: 31230 - protein, 6 aa, Mycobacterium avium
DARHGS

SEQ ID NO: 31231 - protein, 7 aa, Mycobacterium avium
DARPDTD

SEQ ID NO: 31232 - protein, 6 aa, Mycobacterium avium
DARPGQ

SEQ ID NO: 31233 - protein, 6 aa, Mycobacterium avium
DARRAE

SEQ ID NO: 31234 - protein, 7 aa, Mycobacterium avium
DARRSAD

SEQ ID NO: 31235 - protein, 7 aa, Mycobacterium avium
DARRTGA

SEQ ID NO: 31236 - protein, 7 aa, Mycobacterium avium
DARTDGH

SEQ ID NO: 31237 - protein, 7 aa, Mycobacterium avium
DARTPLT

SEQ ID NO: 31238 - protein, 7 aa, Mycobacterium avium
DASAAAG

SEQ ID NO: 31239 - protein, 5 aa, Mycobacterium avium
DASAM

SEQ ID NO: 31240 - protein, 5 aa, Mycobacterium avium
DASAN

SEQ ID NO: 31241 - protein, 7 aa, Mycobacterium avium
DASDDRM

SEQ ID NO: 31242 - protein, 10 aa, Mycobacterium avium
DASGAPYNGF

SEQ ID NO: 31243 - protein, 8 aa, Mycobacterium avium
DASGPEPY

SEQ ID NO: 31244 - protein, 8 aa, Mycobacterium avium
DASKQVTR

SEQ ID NO: 31245 - protein, 4 aa, Mycobacterium avium
DASP

SEQ ID NO: 31246 - protein, 5 aa, Mycobacterium avium
DASPQ

SEQ ID NO: 31247 - protein, 12 aa, Mycobacterium avium
DASQLPEELRPE

SEQ ID NO: 31248 - protein, 8 aa, Mycobacterium avium
DASQPLTS

SEQ ID NO: 31249 - protein, 8 aa, Mycobacterium avium
DASRASHD

SEQ ID NO: 31250 - protein, 14 aa, Mycobacterium avium
DASRGDAGAPDHRH

SEQ ID NO: 31251 - protein, 5 aa, Mycobacterium avium
DASSY

SEQ ID NO: 31252 - protein, 8 aa, Mycobacterium avium
DASTGVDA

SEQ ID NO: 31253 - protein, 4 aa, Mycobacterium avium
DASW

SEQ ID NO: 31254 - protein, 4 aa, Mycobacterium avium
DASY

SEQ ID NO: 31255 - protein, 5 aa, Mycobacterium avium
DATAA

SEQ ID NO: 31256 - protein, 8 aa, Mycobacterium avium
DATAAPRE

SEQ ID NO: 31257 - protein, 10 aa, Mycobacterium avium
DATADGYVRS

SEQ ID NO: 31258 - protein, 7 aa, Mycobacterium avium
DATARGR

SEQ ID NO: 31259 - protein, 8 aa, Mycobacterium avium
DATDSAVG

SEQ ID NO: 31260 - protein, 7 aa, Mycobacterium avium
DATDVTA

SEQ ID NO: 31261 - protein, 6 aa, Mycobacterium avium
DATEAS

SEQ ID NO: 31262 - protein, 5 aa, Mycobacterium avium
DATFG

SEQ ID NO: 31263 - protein, 8 aa, Mycobacterium avium
DATGAEPV

SEQ ID NO: 31264 - protein, 4 aa, Mycobacterium avium
DATH

SEQ ID NO: 31265 - protein, 18 aa, Mycobacterium avium
DATPAEPLGEATDASGGI

SEQ ID NO: 31266 - protein, 5 aa, Mycobacterium avium
DATPE

SEQ ID NO: 31267 - protein, 7 aa, Mycobacterium avium
DATRRAG

SEQ ID NO: 31268 - protein, 8 aa, Mycobacterium avium
DATSDSPL

SEQ ID NO: 31269 - protein, 15 aa, Mycobacterium avium
DATSRARSRARAKAR

SEQ ID NO: 31270 - protein, 8 aa, Mycobacterium avium
DATTNSTP

SEQ ID NO: 31271 - protein, 5 aa, Mycobacterium avium
DATYG

SEQ ID NO: 31272 - protein, 6 aa, Mycobacterium avium
DAVAAG

SEQ ID NO: 31273 - protein, 11 aa, Mycobacterium avium
DAVDPISNQPE

SEQ ID NO: 31274 - protein, 6 aa, Mycobacterium avium
DAVEDR

SEQ ID NO: 31275 - protein, 6 aa, Mycobacterium avium
DAVHPG

SEQ ID NO: 31276 - protein, 4 aa, Mycobacterium avium
DAVN

SEQ ID NO: 31277 - protein, 15 aa, Mycobacterium avium
DAVPPPSAPPAGVQG

SEQ ID NO: 31278 - protein, 7 aa, Mycobacterium avium
DAVRDGD

SEQ ID NO: 31279 - protein, 5 aa, Mycobacterium avium
DAVSK

SEQ ID NO: 31280 - protein, 8 aa, Mycobacterium avium
DAVSRDPE

SEQ ID NO: 31281 - protein, 11 aa, Mycobacterium avium
DAYAGDEHERT

SEQ ID NO: 31282 - protein, 5 aa, Mycobacterium avium
DAYGG

SEQ ID NO: 31283 - protein, 10 aa, Mycobacterium avium
DAYKTGRGSI

SEQ ID NO: 31284 - protein, 12 aa, Mycobacterium avium
DCESASGAAAAL

SEQ ID NO: 31285 - protein, 16 aa, Mycobacterium avium
DCGVPGDGSAPSTVAP

SEQ ID NO: 31286 - protein, 6 aa, Mycobacterium avium
DCRGSG

SEQ ID NO: 31287 - protein, 8 aa, Mycobacterium avium
DCRKPGPG

SEQ ID NO: 31288 - protein, 13 aa, Mycobacterium avium
DCTNAASLQQQSE

SEQ ID NO: 31289 - protein, 8 aa, Mycobacterium avium
DDAARARE

SEQ ID NO: 31290 - protein, 11 aa, Mycobacterium avium
DDAATKKRRGE

SEQ ID NO: 31291 - protein, 4 aa, Mycobacterium avium
DDAD

SEQ ID NO: 31292 - protein, 14 aa, Mycobacterium avium
DDADEQAADELEGP

SEQ ID NO: 31293 - protein, 8 aa, Mycobacterium avium
DDADGAPR

SEQ ID NO: 31294 - protein, 12 aa, Mycobacterium avium
DDADTRASVTAE

SEQ ID NO: 31295 - protein, 10 aa, Mycobacterium avium
DDAERQAAEK

SEQ ID NO: 31296 - protein, 16 aa, Mycobacterium avium
DDAGFRAEAAQGREMG

SEQ ID NO: 31297 - protein, 10 aa, Mycobacterium avium
DDAGKASAMR

SEQ ID NO: 31298 - protein, 7 aa, Mycobacterium avium
DDAGSAI

SEQ ID NO: 31299 - protein, 6 aa, Mycobacterium avium
DDAGTV

SEQ ID NO: 31300 - protein, 7 aa, Mycobacterium avium
DDAHSPH

SEQ ID NO: 31301 - protein, 8 aa, Mycobacterium avium
DDAISTGG

SEQ ID NO: 31302 - protein, 7 aa, Mycobacterium avium
DDAKNRQ

SEQ ID NO: 31303 - protein, 7 aa, Mycobacterium avium
DDANGAL

SEQ ID NO: 31304 - protein, 6 aa, Mycobacterium avium
DDANGV

SEQ ID NO: 31305 - protein, 6 aa, Mycobacterium avium
DDAPAL

SEQ ID NO: 31306 - protein, 11 aa, Mycobacterium avium
DDAPDTGSLAG

SEQ ID NO: 31307 - protein, 4 aa, Mycobacterium avium
DDAQ

SEQ ID NO: 31308 - protein, 7 aa, Mycobacterium avium
DDAQDAR

SEQ ID NO: 31309 - protein, 8 aa, Mycobacterium avium
DDAQTSAG

SEQ ID NO: 31310 - protein, 12 aa, Mycobacterium avium
DDAREHDDDGRH

SEQ ID NO: 31311 - protein, 5 aa, Mycobacterium avium
DDARF

SEQ ID NO: 31312 - protein, 11 aa, Mycobacterium avium
DDARRARDGGV

SEQ ID NO: 31313 - protein, 7 aa, Mycobacterium avium
DDASAND

SEQ ID NO: 31314 - protein, 8 aa, Mycobacterium avium
DDATARRH

SEQ ID NO: 31315 - protein, 10 aa, Mycobacterium avium
DDATATLAEA

SEQ ID NO: 31316 - protein, 6 aa, Mycobacterium avium
DDDAVA

SEQ ID NO: 31317 - protein, 7 aa, Mycobacterium avium
DDDDAVR

SEQ ID NO: 31318 - protein, 6 aa, Mycobacterium avium
DDDDRV

SEQ ID NO: 31319 - protein, 7 aa, Mycobacterium avium
DDDEAAA

SEQ ID NO: 31320 - protein, 21 aa, Mycobacterium avium
DDDGGDGAAKARAYERSATEA

SEQ ID NO: 31321 - protein, 14 aa, Mycobacterium avium
DDDGNPVPHDGETV

SEQ ID NO: 31322 - protein, 6 aa, Mycobacterium avium
DDDGNV

SEQ ID NO: 31323 - protein, 7 aa, Mycobacterium avium
DDDGSGK

SEQ ID NO: 31324 - protein, 7 aa, Mycobacterium avium
DDDGTEL

SEQ ID NO: 31325 - protein, 14 aa, Mycobacterium avium
DDDGVQRMVHAWRR

SEQ ID NO: 31326 - protein, 8 aa, Mycobacterium avium
DDDITASY

SEQ ID NO: 31327 - protein, 5 aa, Mycobacterium avium
DDDNW

SEQ ID NO: 31328 - protein, 9 aa, Mycobacterium avium
DDDRPVPMK

SEQ ID NO: 31329 - protein, 9 aa, Mycobacterium avium
DDDSDRPGR

SEQ ID NO: 31330 - protein, 7 aa, Mycobacterium avium
DDDTGEL

SEQ ID NO: 31331 - protein, 20 aa, Mycobacterium avium
DDDVAAPATEVAGSDALPEP

SEQ ID NO: 31332 - protein, 4 aa, Mycobacterium avium
DDEA

SEQ ID NO: 31333 - protein, 10 aa, Mycobacterium avium
DDEDGVRRKL

SEQ ID NO: 31334 - protein, 7 aa, Mycobacterium avium
DDEEARR

SEQ ID NO: 31335 - protein, 5 aa, Mycobacterium avium
DDEMG

SEQ ID NO: 31336 - protein, 8 aa, Mycobacterium avium
DDEPQFSR

SEQ ID NO: 31337 - protein, 6 aa, Mycobacterium avium
DDEQKR

SEQ ID NO: 31338 - protein, 9 aa, Mycobacterium avium
DDEQRRLAE

SEQ ID NO: 31339 - protein, 8 aa, Mycobacterium avium
DDERAVRD

SEQ ID NO: 31340 - protein, 7 aa, Mycobacterium avium
DDETRQY

SEQ ID NO: 31341 - protein, 6 aa, Mycobacterium avium
DDEWED

SEQ ID NO: 31342 - protein, 5 aa, Mycobacterium avium
DDEWR

SEQ ID NO: 31343 - protein, 5 aa, Mycobacterium avium
DDEYQ

SEQ ID NO: 31344 - protein, 5 aa, Mycobacterium avium
DDFST

SEQ ID NO: 31345 - protein, 5 aa, Mycobacterium avium
DDGAL

SEQ ID NO: 31346 - protein, 5 aa, Mycobacterium avium
DDGAR

SEQ ID NO: 31347 - protein, 4 aa, Mycobacterium avium
DDGE

SEQ ID NO: 31348 - protein, 4 aa, Mycobacterium avium
DDGL

SEQ ID NO: 31349 - protein, 7 aa, Mycobacterium avium
DDGLSPL

SEQ ID NO: 31350 - protein, 4 aa, Mycobacterium avium
DDGR

SEQ ID NO: 31351 - protein, 5 aa, Mycobacterium avium
DDGRI

SEQ ID NO: 31352 - protein, 8 aa, Mycobacterium avium
DDGRPQDA

SEQ ID NO: 31353 - protein, 8 aa, Mycobacterium avium
DDGRPSQL

SEQ ID NO: 31354 - protein, 12 aa, Mycobacterium avium
DDGRRAVDAGAA

SEQ ID NO: 31355 - protein, 6 aa, Mycobacterium avium
DDGTRV

SEQ ID NO: 31356 - protein, 8 aa, Mycobacterium avium
DDGTTGLS

SEQ ID NO: 31357 - protein, 8 aa, Mycobacterium avium
DDGTYVST

SEQ ID NO: 31358 - protein, 8 aa, Mycobacterium avium
DDHGDPAN

SEQ ID NO: 31359 - protein, 6 aa, Mycobacterium avium
DDHGEK

SEQ ID NO: 31360 - protein, 6 aa, Mycobacterium avium
DDHGRR

SEQ ID NO: 31361 - protein, 8 aa, Mycobacterium avium
DDHGTEVA

SEQ ID NO: 31362 - protein, 5 aa, Mycobacterium avium
DDIDA

SEQ ID NO: 31363 - protein, 7 aa, Mycobacterium avium
DDIGGTW

SEQ ID NO: 31364 - protein, 8 aa, Mycobacterium avium
DDKETLGR

SEQ ID NO: 31365 - protein, 5 aa, Mycobacterium avium
DDKQL

SEQ ID NO: 31366 - protein, 5 aa, Mycobacterium avium
DDKSY

SEQ ID NO: 31367 - protein, 4 aa, Mycobacterium avium
DDKV

SEQ ID NO: 31368 - protein, 9 aa, Mycobacterium avium
DDKYDGSQN

SEQ ID NO: 31369 - protein, 10 aa, Mycobacterium avium
DDLAQAQGIP

SEQ ID NO: 31370 - protein, 8 aa, Mycobacterium avium
DDLEDTVE

SEQ ID NO: 31371 - protein, 7 aa, Mycobacterium avium
DDLEPDL

SEQ ID NO: 31372 - protein, 5 aa, Mycobacterium avium
DDMPE

SEQ ID NO: 31373 - protein, 5 aa, Mycobacterium avium
DDNAL

SEQ ID NO: 31374 - protein, 11 aa, Mycobacterium avium
DDNPRGEDPAA

SEQ ID NO: 31375 - protein, 4 aa, Mycobacterium avium
DDNV

SEQ ID NO: 31376 - protein, 4 aa, Mycobacterium avium
DDPA

SEQ ID NO: 31377 - protein, 8 aa, Mycobacterium avium
DDPADESF

SEQ ID NO: 31378 - protein, 10 aa, Mycobacterium avium
DDPAGTAEAI

SEQ ID NO: 31379 - protein, 5 aa, Mycobacterium avium
DDPAL

SEQ ID NO: 31380 - protein, 19 aa, Mycobacterium avium
DDPALTARLPDGTLADRQP

SEQ ID NO: 31381 - protein, 8 aa, Mycobacterium avium
DDPARPLT

SEQ ID NO: 31382 - protein, 6 aa, Mycobacterium avium
DDPAYP

SEQ ID NO: 31383 - protein, 5 aa, Mycobacterium avium
DDPDA

SEQ ID NO: 31384 - protein, 14 aa, Mycobacterium avium
DDPDAARPVAGATA

SEQ ID NO: 31385 - protein, 9 aa, Mycobacterium avium
DDPDDPRLD

SEQ ID NO: 31386 - protein, 6 aa, Mycobacterium avium
DDPDKL

SEQ ID NO: 31387 - protein, 5 aa, Mycobacterium avium
DDPDS

SEQ ID NO: 31388 - protein, 6 aa, Mycobacterium avium
DDPDVT

SEQ ID NO: 31389 - protein, 10 aa, Mycobacterium avium
DDPEAAQRRA

SEQ ID NO: 31390 - protein, 5 aa, Mycobacterium avium
DDPEI

SEQ ID NO: 31391 - protein, 7 aa, Mycobacterium avium
DDPELSR

SEQ ID NO: 31392 - protein, 6 aa, Mycobacterium avium
DDPFYQ

SEQ ID NO: 31393 - protein, 7 aa, Mycobacterium avium
DDPGDEL

SEQ ID NO: 31394 - protein, 7 aa, Mycobacterium avium
DDPGNTT

SEQ ID NO: 31395 - protein, 8 aa, Mycobacterium avium
DDPGSQAY

SEQ ID NO: 31396 - protein, 9 aa, Mycobacterium avium
DDPGSSARI

SEQ ID NO: 31397 - protein, 6 aa, Mycobacterium avium
DDPGVT

SEQ ID NO: 31398 - protein, 8 aa, Mycobacterium avium
DDPHGKRA

SEQ ID NO: 31399 - protein, 6 aa, Mycobacterium avium
DDPLGV

SEQ ID NO: 31400 - protein, 4 aa, Mycobacterium avium
DDPM

SEQ ID NO: 31401 - protein, 6 aa, Mycobacterium avium
DDPNQL

SEQ ID NO: 31402 - protein, 7 aa, Mycobacterium avium
DDPQPEW

SEQ ID NO: 31403 - protein, 17 aa, Mycobacterium avium
DDPQPGWYDTESGELVD

SEQ ID NO: 31404 - protein, 8 aa, Mycobacterium avium
DDPRFGTA

SEQ ID NO: 31405 - protein, 9 aa, Mycobacterium avium
DDPRGLGGR

SEQ ID NO: 31406 - protein, 8 aa, Mycobacterium avium
DDPRTGAR

SEQ ID NO: 31407 - protein, 4 aa, Mycobacterium avium
DDPS

SEQ ID NO: 31408 - protein, 6 aa, Mycobacterium avium
DDPSLA

SEQ ID NO: 31409 - protein, 7 aa, Mycobacterium avium
DDPSMTA

SEQ ID NO: 31410 - protein, 9 aa, Mycobacterium avium
DDPSRGKDR

SEQ ID NO: 31411 - protein, 12 aa, Mycobacterium avium
DDPTADVSEGRR

SEQ ID NO: 31412 - protein, 8 aa, Mycobacterium avium
DDPTGSAN

SEQ ID NO: 31413 - protein, 4 aa, Mycobacterium avium
DDPV

SEQ ID NO: 31414 - protein, 5 aa, Mycobacterium avium
DDPVA

SEQ ID NO: 31415 - protein, 12 aa, Mycobacterium avium
DDPYEAPPRPEL

SEQ ID NO: 31416 - protein, 6 aa, Mycobacterium avium
DDPYPR

SEQ ID NO: 31417 - protein, 5 aa, Mycobacterium avium
DDQAE

SEQ ID NO: 31418 - protein, 8 aa, Mycobacterium avium
DDQAGTSI

SEQ ID NO: 31419 - protein, 11 aa, Mycobacterium avium
DDQLSDDARGV

SEQ ID NO: 31420 - protein, 4 aa, Mycobacterium avium
DDQR

SEQ ID NO: 31421 - protein, 6 aa, Mycobacterium avium
DDQRDN

SEQ ID NO: 31422 - protein, 7 aa, Mycobacterium avium
DDQRTKA

SEQ ID NO: 31423 - protein, 5 aa, Mycobacterium avium
DDRAT

SEQ ID NO: 31424 - protein, 5 aa, Mycobacterium avium
DDRAY

SEQ ID NO: 31425 - protein, 5 aa, Mycobacterium avium
DDRDK

SEQ ID NO: 31426 - protein, 6 aa, Mycobacterium avium
DDRGEG

SEQ ID NO: 31427 - protein, 10 aa, Mycobacterium avium
DDRIGDVRGR

SEQ ID NO: 31428 - protein, 10 aa, Mycobacterium avium
DDRLSRGIGT

SEQ ID NO: 31429 - protein, 7 aa, Mycobacterium avium
DDRPAPG

SEQ ID NO: 31430 - protein, 16 aa, Mycobacterium avium
DDRPGFGDDAAVGGGL

SEQ ID NO: 31431 - protein, 6 aa, Mycobacterium avium
DDRSEY

SEQ ID NO: 31432 - protein, 4 aa, Mycobacterium avium
DDRT

SEQ ID NO: 31433 - protein, 12 aa, Mycobacterium avium
DDSATRRGRPTT

SEQ ID NO: 31434 - protein, 5 aa, Mycobacterium avium
DDSST

SEQ ID NO: 31435 - protein, 6 aa, Mycobacterium avium
DDSVPD

SEQ ID NO: 31436 - protein, 8 aa, Mycobacterium avium
DDTAGNTV

SEQ ID NO: 31437 - protein, 9 aa, Mycobacterium avium
DDTASADEF

SEQ ID NO: 31438 - protein, 9 aa, Mycobacterium avium
DDTGGPGRP

SEQ ID NO: 31439 - protein, 5 aa, Mycobacterium avium
DDTGT

SEQ ID NO: 31440 - protein, 6 aa, Mycobacterium avium
DDTLDE

SEQ ID NO: 31441 - protein, 5 aa, Mycobacterium avium
DDTLG

SEQ ID NO: 31442 - protein, 7 aa, Mycobacterium avium
DDTLSGD

SEQ ID NO: 31443 - protein, 10 aa, Mycobacterium avium
DDTPVASASI

SEQ ID NO: 31444 - protein, 9 aa, Mycobacterium avium
DDTPWGGKP

SEQ ID NO: 31445 - protein, 6 aa, Mycobacterium avium
DDTRTE

SEQ ID NO: 31446 - protein, 7 aa, Mycobacterium avium
DDTTSHQ

SEQ ID NO: 31447 - protein, 5 aa, Mycobacterium avium
DDTYP

SEQ ID NO: 31448 - protein, 20 aa, Mycobacterium avium
DDVAAYGDTEVDKSRRYDRT

SEQ ID NO: 31449 - protein, 5 aa, Mycobacterium avium
DDVES

SEQ ID NO: 31450 - protein, 8 aa, Mycobacterium avium
DDVKPADA

SEQ ID NO: 31451 - protein, 6 aa, Mycobacterium avium
DDVRAA

SEQ ID NO: 31452 - protein, 6 aa, Mycobacterium avium
DDYGPD

SEQ ID NO: 31453 - protein, 17 aa, Mycobacterium avium
DDYRKQESQRHGTARTG

SEQ ID NO: 31454 - protein, 11 aa, Mycobacterium avium
DDYTDPAPATT

SEQ ID NO: 31455 - protein, 5 aa, Mycobacterium avium
DEAAM

SEQ ID NO: 31456 - protein, 16 aa, Mycobacterium avium
DEAAPGPIPDVPEPSV

SEQ ID NO: 31457 - protein, 8 aa, Mycobacterium avium
DEAETGVN

SEQ ID NO: 31458 - protein, 7 aa, Mycobacterium avium
DEAGAPH

SEQ ID NO: 31459 - protein, 8 aa, Mycobacterium avium
DEAGVSRS

SEQ ID NO: 31460 - protein, 6 aa, Mycobacterium avium
DEALTR

SEQ ID NO: 31461 - protein, 14 aa, Mycobacterium avium
DEAMGRARKPEVYS

SEQ ID NO: 31462 - protein, 5 aa, Mycobacterium avium
DEANA

SEQ ID NO: 31463 - protein, 14 aa, Mycobacterium avium
DEANAGDTAERAGT

SEQ ID NO: 31464 - protein, 8 aa, Mycobacterium avium
DEASADAV

SEQ ID NO: 31465 - protein, 5 aa, Mycobacterium avium
DEAST

SEQ ID NO: 31466 - protein, 6 aa, Mycobacterium avium
DEATDL

SEQ ID NO: 31467 - protein, 8 aa, Mycobacterium avium
DEATTDEH

SEQ ID NO: 31468 - protein, 4 aa, Mycobacterium avium
DEDA

SEQ ID NO: 31469 - protein, 5 aa, Mycobacterium avium
DEDDA

SEQ ID NO: 31470 - protein, 5 aa, Mycobacterium avium
DEDEA

SEQ ID NO: 31471 - protein, 9 aa, Mycobacterium avium
DEDEQPNFT

SEQ ID NO: 31472 - protein, 4 aa, Mycobacterium avium
DEDF

SEQ ID NO: 31473 - protein, 10 aa, Mycobacterium avium
DEDFGRGDEA

SEQ ID NO: 31474 - protein, 6 aa, Mycobacterium avium
DEDGAV

SEQ ID NO: 31475 - protein, 35 aa, Mycobacterium avium
DEDGNPKHEVAEGTDHADEGRDEQALRDQIEKDKA

SEQ ID NO: 31476 - protein, 7 aa, Mycobacterium avium
DEDLDQA

SEQ ID NO: 31477 - protein, 10 aa, Mycobacterium avium
DEDPESDDER

SEQ ID NO: 31478 - protein, 4 aa, Mycobacterium avium
DEDT

SEQ ID NO: 31479 - protein, 6 aa, Mycobacterium avium
DEDTDE

SEQ ID NO: 31480 - protein, 6 aa, Mycobacterium avium
DEDVER

SEQ ID NO: 31481 - protein, 6 aa, Mycobacterium avium
DEEDRH

SEQ ID NO: 31482 - protein, 16 aa, Mycobacterium avium
DEEERDHSPAPSDTYH

SEQ ID NO: 31483 - protein, 11 aa, Mycobacterium avium
DEERGTARSTS

SEQ ID NO: 31484 - protein, 17 aa, Mycobacterium avium
DEETGKRVRISKRNGKD

SEQ ID NO: 31485 - protein, 7 aa, Mycobacterium avium
DEFEDRD

SEQ ID NO: 31486 - protein, 5 aa, Mycobacterium avium
DEFGE

SEQ ID NO: 31487 - protein, 4 aa, Mycobacterium avium
DEFP

SEQ ID NO: 31488 - protein, 4 aa, Mycobacterium avium
DEFR

SEQ ID NO: 31489 - protein, 6 aa, Mycobacterium avium
DEFTKR

SEQ ID NO: 31490 - protein, 22 aa, Mycobacterium avium
DEGFTVGPKEKKLGIKGSPTTE

SEQ ID NO: 31491 - protein, 5 aa, Mycobacterium avium
DEGGR

SEQ ID NO: 31492 - protein, 13 aa, Mycobacterium avium
DEGKAVAAEVGEA

SEQ ID NO: 31493 - protein, 12 aa, Mycobacterium avium
DEGKAVADEIGD

SEQ ID NO: 31494 - protein, 4 aa, Mycobacterium avium
DEGP

SEQ ID NO: 31495 - protein, 15 aa, Mycobacterium avium
DEGPKGVKTQIQGDE

SEQ ID NO: 31496 - protein, 8 aa, Mycobacterium avium
DEGTAAAE

SEQ ID NO: 31497 - protein, 5 aa, Mycobacterium avium
DEGVP

SEQ ID NO: 31498 - protein, 5 aa, Mycobacterium avium
DEHPG

SEQ ID NO: 31499 - protein, 13 aa, Mycobacterium avium
DEIETDDGLRGLP

SEQ ID NO: 31500 - protein, 6 aa, Mycobacterium avium
DEIGYG

SEQ ID NO: 31501 - protein, 6 aa, Mycobacterium avium
DEKERA

SEQ ID NO: 31502 - protein, 8 aa, Mycobacterium avium
DEKGGDDK

SEQ ID NO: 31503 - protein, 10 aa, Mycobacterium avium
DEKPTASDDG

SEQ ID NO: 31504 - protein, 5 aa, Mycobacterium avium
DELAE

SEQ ID NO: 31505 - protein, 8 aa, Mycobacterium avium
DELGRRDD

SEQ ID NO: 31506 - protein, 10 aa, Mycobacterium avium
DELPDRDDQV

SEQ ID NO: 31507 - protein, 9 aa, Mycobacterium avium
DELVPSGQA

SEQ ID NO: 31508 - protein, 30 aa, Mycobacterium avium
DEMYPGPDGVVRSTNRAGGLEGGMTNGQPL

SEQ ID NO: 31509 - protein, 7 aa, Mycobacterium avium
DENDPTV

SEQ ID NO: 31510 - protein, 16 aa, Mycobacterium avium
DENGTTVAAASSIEDD

SEQ ID NO: 31511 - protein, 7 aa, Mycobacterium avium
DENSTVP

SEQ ID NO: 31512 - protein, 12 aa, Mycobacterium avium
DEPADAGKVGAA

SEQ ID NO: 31513 - protein, 7 aa, Mycobacterium avium
DEPDGRA

SEQ ID NO: 31514 - protein, 7 aa, Mycobacterium avium
DEPEVSA

SEQ ID NO: 31515 - protein, 4 aa, Mycobacterium avium
DEPL

SEQ ID NO: 31516 - protein, 7 aa, Mycobacterium avium
DEPPGTR

SEQ ID NO: 31517 - protein, 6 aa, Mycobacterium avium
DEPPHP

SEQ ID NO: 31518 - protein, 6 aa, Mycobacterium avium
DEPPLP

SEQ ID NO: 31519 - protein, 6 aa, Mycobacterium avium
DEPRKG

SEQ ID NO: 31520 - protein, 9 aa, Mycobacterium avium
DEPSDPAGA

SEQ ID NO: 31521 - protein, 7 aa, Mycobacterium avium
DEPTANA

SEQ ID NO: 31522 - protein, 13 aa, Mycobacterium avium
DEPTGNLDSSTGA

SEQ ID NO: 31523 - protein, 7 aa, Mycobacterium avium
DEPTSAL

SEQ ID NO: 31524 - protein, 5 aa, Mycobacterium avium
DEPVA

SEQ ID NO: 31525 - protein, 7 aa, Mycobacterium avium
DEPVDDA

SEQ ID NO: 31526 - protein, 13 aa, Mycobacterium avium
DEPVPQADPDLPW

SEQ ID NO: 31527 - protein, 4 aa, Mycobacterium avium
DEQA

SEQ ID NO: 31528 - protein, 5 aa, Mycobacterium avium
DEQDA

SEQ ID NO: 31529 - protein, 5 aa, Mycobacterium avium
DEQDL

SEQ ID NO: 31530 - protein, 4 aa, Mycobacterium avium
DEQG

SEQ ID NO: 31531 - protein, 7 aa, Mycobacterium avium
DEQGQSP

SEQ ID NO: 31532 - protein, 6 aa, Mycobacterium avium
DEQGRP

SEQ ID NO: 31533 - protein, 5 aa, Mycobacterium avium
DEQPA

SEQ ID NO: 31534 - protein, 10 aa, Mycobacterium avium
DEQQRDPAEF

SEQ ID NO: 31535 - protein, 7 aa, Mycobacterium avium
DEQRTEL

SEQ ID NO: 31536 - protein, 7 aa, Mycobacterium avium
DEQTHRP

SEQ ID NO: 31537 - protein, 4 aa, Mycobacterium avium
DEQV

SEQ ID NO: 31538 - protein, 6 aa, Mycobacterium avium
DEQYGQ

SEQ ID NO: 31539 - protein, 4 aa, Mycobacterium avium
DERA

SEQ ID NO: 31540 - protein, 5 aa, Mycobacterium avium
DERAI

SEQ ID NO: 31541 - protein, 10 aa, Mycobacterium avium
DERDASVPRT

SEQ ID NO: 31542 - protein, 6 aa, Mycobacterium avium
DEREAV

SEQ ID NO: 31543 - protein, 5 aa, Mycobacterium avium
DERGA

SEQ ID NO: 31544 - protein, 7 aa, Mycobacterium avium
DERGGSV

SEQ ID NO: 31545 - protein, 7 aa, Mycobacterium avium
DERRGRQ

SEQ ID NO: 31546 - protein, 8 aa, Mycobacterium avium
DERTVAPS

SEQ ID NO: 31547 - protein, 14 aa, Mycobacterium avium
DERVDDGTGSDTPK

SEQ ID NO: 31548 - protein, 7 aa, Mycobacterium avium
DERVGAD

SEQ ID NO: 31549 - protein, 6 aa, Mycobacterium avium
DERVGD

SEQ ID NO: 31550 - protein, 6 aa, Mycobacterium avium
DESAAE

SEQ ID NO: 31551 - protein, 10 aa, Mycobacterium avium
DESARGTRRE

SEQ ID NO: 31552 - protein, 16 aa, Mycobacterium avium
DESDEEGGTAVREDEV

SEQ ID NO: 31553 - protein, 7 aa, Mycobacterium avium
DESDHGK

SEQ ID NO: 31554 - protein, 12 aa, Mycobacterium avium
DESDPTKRDPEL

SEQ ID NO: 31555 - protein, 8 aa, Mycobacterium avium
DESEPGTC

SEQ ID NO: 31556 - protein, 9 aa, Mycobacterium avium
DESETARHR

SEQ ID NO: 31557 - protein, 16 aa, Mycobacterium avium
DESGGRWDQSTLPQGV

SEQ ID NO: 31558 - protein, 9 aa, Mycobacterium avium
DESGRFRSR

SEQ ID NO: 31559 - protein, 16 aa, Mycobacterium avium
DESGRGKAARDCTPDE

SEQ ID NO: 31560 - protein, 15 aa, Mycobacterium avium
DESGRKMSKSKGNVI

SEQ ID NO: 31561 - protein, 10 aa, Mycobacterium avium
DESIRKADDP

SEQ ID NO: 31562 - protein, 8 aa, Mycobacterium avium
DESMDPDA

SEQ ID NO: 31563 - protein, 6 aa, Mycobacterium avium
DESPMQ

SEQ ID NO: 31564 - protein, 19 aa, Mycobacterium avium
DESRKVTAAQIPVDQGSTQ

SEQ ID NO: 31565 - protein, 6 aa, Mycobacterium avium
DESSPN

SEQ ID NO: 31566 - protein, 9 aa, Mycobacterium avium
DESSYATGS

SEQ ID NO: 31567 - protein, 9 aa, Mycobacterium avium
DESSYSTGS

SEQ ID NO: 31568 - protein, 8 aa, Mycobacterium avium
DETAEYSL

SEQ ID NO: 31569 - protein, 8 aa, Mycobacterium avium
DETAPGDS

SEQ ID NO: 31570 - protein, 9 aa, Mycobacterium avium
DETEAGRGW

SEQ ID NO: 31571 - protein, 9 aa, Mycobacterium avium
DETGGYPHP

SEQ ID NO: 31572 - protein, 5 aa, Mycobacterium avium
DETGV

SEQ ID NO: 31573 - protein, 17 aa, Mycobacterium avium
DETPPAPARAPEHGQHT

SEQ ID NO: 31574 - protein, 14 aa, Mycobacterium avium
DETSTTRMVRLRPH

SEQ ID NO: 31575 - protein, 8 aa, Mycobacterium avium
DETTGRGI

SEQ ID NO: 31576 - protein, 5 aa, Mycobacterium avium
DETTR

SEQ ID NO: 31577 - protein, 14 aa, Mycobacterium avium
DETTRHTLSGGTEQ

SEQ ID NO: 31578 - protein, 4 aa, Mycobacterium avium
DEVG

SEQ ID NO: 31579 - protein, 5 aa, Mycobacterium avium
DEVGC

SEQ ID NO: 31580 - protein, 7 aa, Mycobacterium avium
DEVGRGA

SEQ ID NO: 31581 - protein, 7 aa, Mycobacterium avium
DEVPSRT

SEQ ID NO: 31582 - protein, 9 aa, Mycobacterium avium
DFASDDRRR

SEQ ID NO: 31583 - protein, 13 aa, Mycobacterium avium
DFASDGGDTPPGA

SEQ ID NO: 31584 - protein, 8 aa, Mycobacterium avium
DFASPGLE

SEQ ID NO: 31585 - protein, 4 aa, Mycobacterium avium
DFDP

SEQ ID NO: 31586 - protein, 9 aa, Mycobacterium avium
DFGTDDDNY

SEQ ID NO: 31587 - protein, 6 aa, Mycobacterium avium
DFNSGG

SEQ ID NO: 31588 - protein, 10 aa, Mycobacterium avium
DFPGEYTEDD

SEQ ID NO: 31589 - protein, 4 aa, Mycobacterium avium
DFPP

SEQ ID NO: 31590 - protein, 6 aa, Mycobacterium avium
DFPTGP

SEQ ID NO: 31591 - protein, 11 aa, Mycobacterium avium
DFQDGKPHSIE

SEQ ID NO: 31592 - protein, 5 aa, Mycobacterium avium
DFRNP

SEQ ID NO: 31593 - protein, 4 aa, Mycobacterium avium
DFRP

SEQ ID NO: 31594 - protein, 7 aa, Mycobacterium avium
DFRQPGH

SEQ ID NO: 31595 - protein, 4 aa, Mycobacterium avium
DFSE

SEQ ID NO: 31596 - protein, 25 aa, Mycobacterium avium
DFSGGASPFDAPAGDGAFTASPITP

SEQ ID NO: 31597 - protein, 11 aa, Mycobacterium avium
DFSKDSGRSEL

SEQ ID NO: 31598 - protein, 10 aa, Mycobacterium avium
DFTADGTIEA

SEQ ID NO: 31599 - protein, 4 aa, Mycobacterium avium
DFTD

SEQ ID NO: 31600 - protein, 11 aa, Mycobacterium avium
DGAASDAAGLG

SEQ ID NO: 31601 - protein, 7 aa, Mycobacterium avium
DGAASPV

SEQ ID NO: 31602 - protein, 8 aa, Mycobacterium avium
DGADDQAA

SEQ ID NO: 31603 - protein, 8 aa, Mycobacterium avium
DGAEFDGR

SEQ ID NO: 31604 - protein, 11 aa, Mycobacterium avium
DGAEGEVREGE

SEQ ID NO: 31605 - protein, 9 aa, Mycobacterium avium
DGAGDAGYE

SEQ ID NO: 31606 - protein, 10 aa, Mycobacterium avium
DGAGRDLPTG

SEQ ID NO: 31607 - protein, 8 aa, Mycobacterium avium
DGAGRQLS

SEQ ID NO: 31608 - protein, 5 aa, Mycobacterium avium
DGAPG

SEQ ID NO: 31609 - protein, 7 aa, Mycobacterium avium
DGAPGNL

SEQ ID NO: 31610 - protein, 8 aa, Mycobacterium avium
DGAPRPVP

SEQ ID NO: 31611 - protein, 8 aa, Mycobacterium avium
DGAPRYPV

SEQ ID NO: 31612 - protein, 5 aa, Mycobacterium avium
DGAQA

SEQ ID NO: 31613 - protein, 11 aa, Mycobacterium avium
DGAQERRGRPA

SEQ ID NO: 31614 - protein, 5 aa, Mycobacterium avium
DGAQP

SEQ ID NO: 31615 - protein, 4 aa, Mycobacterium avium
DGAR

SEQ ID NO: 31616 - protein, 9 aa, Mycobacterium avium
DGARDGERK

SEQ ID NO: 31617 - protein, 23 aa, Mycobacterium avium
DGASPPAGGNGPAGSGPRGDDAW

SEQ ID NO: 31618 - protein, 4 aa, Mycobacterium avium
DGAT

SEQ ID NO: 31619 - protein, 6 aa, Mycobacterium avium
DGATEI

SEQ ID NO: 31620 - protein, 9 aa, Mycobacterium avium
DGATNTGSF

SEQ ID NO: 31621 - protein, 12 aa, Mycobacterium avium
DGCAGHSDGDVG

SEQ ID NO: 31622 - protein, 5 aa, Mycobacterium avium
DGCPP

SEQ ID NO: 31623 - protein, 4 aa, Mycobacterium avium
DGDA

SEQ ID NO: 31624 - protein, 7 aa, Mycobacterium avium
DGDALSI

SEQ ID NO: 31625 - protein, 9 aa, Mycobacterium avium
DGDARGGAA

SEQ ID NO: 31626 - protein, 5 aa, Mycobacterium avium
DGDDE

SEQ ID NO: 31627 - protein, 9 aa, Mycobacterium avium
DGDDHRRRR

SEQ ID NO: 31628 - protein, 9 aa, Mycobacterium avium
DGDDPRREI

SEQ ID NO: 31629 - protein, 17 aa, Mycobacterium avium
DGDESRGGVDISRPGAV

SEQ ID NO: 31630 - protein, 13 aa, Mycobacterium avium
DGDIKSDDAGRNA

SEQ ID NO: 31631 - protein, 4 aa, Mycobacterium avium
DGDL

SEQ ID NO: 31632 - protein, 6 aa, Mycobacterium avium
DGDLPL

SEQ ID NO: 31633 - protein, 11 aa, Mycobacterium avium
DGDLPSGDELG

SEQ ID NO: 31634 - protein, 13 aa, Mycobacterium avium
DGDLSEPSATEVA

SEQ ID NO: 31635 - protein, 7 aa, Mycobacterium avium
DGDPAAL

SEQ ID NO: 31636 - protein, 9 aa, Mycobacterium avium
DGDPETTSL

SEQ ID NO: 31637 - protein, 11 aa, Mycobacterium avium
DGDPKGATPAR

SEQ ID NO: 31638 - protein, 7 aa, Mycobacterium avium
DGDPSNV

SEQ ID NO: 31639 - protein, 4 aa, Mycobacterium avium
DGDQ

SEQ ID NO: 31640 - protein, 9 aa, Mycobacterium avium
DGDQASGTQ

SEQ ID NO: 31641 - protein, 11 aa, Mycobacterium avium
DGDQHRTDRRQ

SEQ ID NO: 31642 - protein, 7 aa, Mycobacterium avium
DGDSASA

SEQ ID NO: 31643 - protein, 7 aa, Mycobacterium avium
DGDTASS

SEQ ID NO: 31644 - protein, 5 aa, Mycobacterium avium
DGDTE

SEQ ID NO: 31645 - protein, 7 aa, Mycobacterium avium
DGDTGTF

SEQ ID NO: 31646 - protein, 8 aa, Mycobacterium avium
DGDTGTVA

SEQ ID NO: 31647 - protein, 7 aa, Mycobacterium avium
DGDTIDV

SEQ ID NO: 31648 - protein, 8 aa, Mycobacterium avium
DGDVSDED

SEQ ID NO: 31649 - protein, 6 aa, Mycobacterium avium
DGEAAA

SEQ ID NO: 31650 - protein, 9 aa, Mycobacterium avium
DGEAETGPL

SEQ ID NO: 31651 - protein, 28 aa, Mycobacterium avium
DGEDRDPAGYRRGDGTLNAGGARDGLAD

SEQ ID NO: 31652 - protein, 6 aa, Mycobacterium avium
DGEEDA

SEQ ID NO: 31653 - protein, 5 aa, Mycobacterium avium
DGEEG

SEQ ID NO: 31654 - protein, 4 aa, Mycobacterium avium
DGEF

SEQ ID NO: 31655 - protein, 7 aa, Mycobacterium avium
DGEGGPF

SEQ ID NO: 31656 - protein, 7 aa, Mycobacterium avium
DGEKQAA

SEQ ID NO: 31657 - protein, 9 aa, Mycobacterium avium
DGELGGPVA

SEQ ID NO: 31658 - protein, 7 aa, Mycobacterium avium
DGEPAPD

SEQ ID NO: 31659 - protein, 5 aa, Mycobacterium avium
DGEPI

SEQ ID NO: 31660 - protein, 7 aa, Mycobacterium avium
DGEPTAH

SEQ ID NO: 31661 - protein, 9 aa, Mycobacterium avium
DGEPVPGTF

SEQ ID NO: 31662 - protein, 6 aa, Mycobacterium avium
DGEQEK

SEQ ID NO: 31663 - protein, 14 aa, Mycobacterium avium
DGEQVAVGSPASKL

SEQ ID NO: 31664 - protein, 6 aa, Mycobacterium avium
DGEREF

SEQ ID NO: 31665 - protein, 5 aa, Mycobacterium avium
DGERF

SEQ ID NO: 31666 - protein, 12 aa, Mycobacterium avium
DGERGALIGPQG

SEQ ID NO: 31667 - protein, 11 aa, Mycobacterium avium
DGESKRRTTVG

SEQ ID NO: 31668 - protein, 8 aa, Mycobacterium avium
DGETDSEQ

SEQ ID NO: 31669 - protein, 5 aa, Mycobacterium avium
DGETH

SEQ ID NO: 31670 - protein, 4 aa, Mycobacterium avium
DGEW

SEQ ID NO: 31671 - protein, 7 aa, Mycobacterium avium
DGFGSTE

SEQ ID NO: 31672 - protein, 5 aa, Mycobacterium avium
DGGAD

SEQ ID NO: 31673 - protein, 5 aa, Mycobacterium avium
DGGAE

SEQ ID NO: 31674 - protein, 15 aa, Mycobacterium avium
DGGARPGSAASERLR

SEQ ID NO: 31675 - protein, 5 aa, Mycobacterium avium
DGGDA

SEQ ID NO: 31676 - protein, 5 aa, Mycobacterium avium
DGGDI

SEQ ID NO: 31677 - protein, 7 aa, Mycobacterium avium
DGGEATV

SEQ ID NO: 31678 - protein, 7 aa, Mycobacterium avium
DGGETAA

SEQ ID NO: 31679 - protein, 4 aa, Mycobacterium avium
DGGG

SEQ ID NO: 31680 - protein, 5 aa, Mycobacterium avium
DGGHE

SEQ ID NO: 31681 - protein, 4 aa, Mycobacterium avium
DGGI

SEQ ID NO: 31682 - protein, 8 aa, Mycobacterium avium
DGGISTED

SEQ ID NO: 31683 - protein, 6 aa, Mycobacterium avium
DGGPHV

SEQ ID NO: 31684 - protein, 5 aa, Mycobacterium avium
DGGQA

SEQ ID NO: 31685 - protein, 5 aa, Mycobacterium avium
DGGRG

SEQ ID NO: 31686 - protein, 7 aa, Mycobacterium avium
DGGRGGS

SEQ ID NO: 31687 - protein, 6 aa, Mycobacterium avium
DGGRKK

SEQ ID NO: 31688 - protein, 7 aa, Mycobacterium avium
DGGSNDV

SEQ ID NO: 31689 - protein, 9 aa, Mycobacterium avium
DGGTEPPLR

SEQ ID NO: 31690 - protein, 6 aa, Mycobacterium avium
DGGTIS

SEQ ID NO: 31691 - protein, 9 aa, Mycobacterium avium
DGGTQASSG

SEQ ID NO: 31692 - protein, 6 aa, Mycobacterium avium
DGGTQR

SEQ ID NO: 31693 - protein, 7 aa, Mycobacterium avium
DGGTRPY

SEQ ID NO: 31694 - protein, 7 aa, Mycobacterium avium
DGGVTSS

SEQ ID NO: 31695 - protein, 13 aa, Mycobacterium avium
DGGYGNGYGNSKW

SEQ ID NO: 31696 - protein, 6 aa, Mycobacterium avium
DGGYGW

SEQ ID NO: 31697 - protein, 11 aa, Mycobacterium avium
DGHAAAAPPRT

SEQ ID NO: 31698 - protein, 16 aa, Mycobacterium avium
DGHGDLATARAAAATG

SEQ ID NO: 31699 - protein, 9 aa, Mycobacterium avium
DGHHGPGVT

SEQ ID NO: 31700 - protein, 8 aa, Mycobacterium avium
DGHPAYEA

SEQ ID NO: 31701 - protein, 4 aa, Mycobacterium avium
DGHQ

SEQ ID NO: 31702 - protein, 6 aa, Mycobacterium avium
DGHRNG

SEQ ID NO: 31703 - protein, 7 aa, Mycobacterium avium
DGHSDDQ

SEQ ID NO: 31704 - protein, 5 aa, Mycobacterium avium
DGHTG

SEQ ID NO: 31705 - protein, 4 aa, Mycobacterium avium
DGID

SEQ ID NO: 31706 - protein, 7 aa, Mycobacterium avium
DGIDGEE

SEQ ID NO: 31707 - protein, 9 aa, Mycobacterium avium
DGIEPSDDP

SEQ ID NO: 31708 - protein, 5 aa, Mycobacterium avium
DGIPS

SEQ ID NO: 31709 - protein, 4 aa, Mycobacterium avium
DGIR

SEQ ID NO: 31710 - protein, 9 aa, Mycobacterium avium
DGIRDPRAP

SEQ ID NO: 31711 - protein, 6 aa, Mycobacterium avium
DGKAMS

SEQ ID NO: 31712 - protein, 8 aa, Mycobacterium avium
DGKGITSR

SEQ ID NO: 31713 - protein, 9 aa, Mycobacterium avium
DGKKREDGV

SEQ ID NO: 31714 - protein, 12 aa, Mycobacterium avium
DGKLPPDAAAWL

SEQ ID NO: 31715 - protein, 10 aa, Mycobacterium avium
DGKNDPATAS

SEQ ID NO: 31716 - protein, 8 aa, Mycobacterium avium
DGKPLQSI

SEQ ID NO: 31717 - protein, 5 aa, Mycobacterium avium
DGKPV

SEQ ID NO: 31718 - protein, 4 aa, Mycobacterium avium
DGKR

SEQ ID NO: 31719 - protein, 8 aa, Mycobacterium avium
DGKRVEGT

SEQ ID NO: 31720 - protein, 6 aa, Mycobacterium avium
DGKTQA

SEQ ID NO: 31721 - protein, 13 aa, Mycobacterium avium
DGKTVEAEAAHGT

SEQ ID NO: 31722 - protein, 7 aa, Mycobacterium avium
DGKWTDS

SEQ ID NO: 31723 - protein, 8 aa, Mycobacterium avium
DGLASGEW

SEQ ID NO: 31724 - protein, 10 aa, Mycobacterium avium
DGLESDQGPL

SEQ ID NO: 31725 - protein, 14 aa, Mycobacterium avium
DGLGPAEGLPPANN

SEQ ID NO: 31726 - protein, 6 aa, Mycobacterium avium
DGLPDR

SEQ ID NO: 31727 - protein, 8 aa, Mycobacterium avium
DGMANPAN

SEQ ID NO: 31728 - protein, 6 aa, Mycobacterium avium
DGMHGS

SEQ ID NO: 31729 - protein, 8 aa, Mycobacterium avium
DGNAGGRF

SEQ ID NO: 31730 - protein, 4 aa, Mycobacterium avium
DGND

SEQ ID NO: 31731 - protein, 10 aa, Mycobacterium avium
DGNDDLGPGA

SEQ ID NO: 31732 - protein, 6 aa, Mycobacterium avium
DGNKFS

SEQ ID NO: 31733 - protein, 10 aa, Mycobacterium avium
DGNPRGKHGR

SEQ ID NO: 31734 - protein, 7 aa, Mycobacterium avium
DGNPYGA

SEQ ID NO: 31735 - protein, 16 aa, Mycobacterium avium
DGNRYRPRPGSRTGAK

SEQ ID NO: 31736 - protein, 7 aa, Mycobacterium avium
DGNSVSR

SEQ ID NO: 31737 - protein, 4 aa, Mycobacterium avium
DGNY

SEQ ID NO: 31738 - protein, 7 aa, Mycobacterium avium
DGPAGAD

SEQ ID NO: 31739 - protein, 7 aa, Mycobacterium avium
DGPAGPG

SEQ ID NO: 31740 - protein, 9 aa, Mycobacterium avium
DGPAHGRSG

SEQ ID NO: 31741 - protein, 5 aa, Mycobacterium avium
DGPAP

SEQ ID NO: 31742 - protein, 9 aa, Mycobacterium avium
DGPAPEPVA

SEQ ID NO: 31743 - protein, 7 aa, Mycobacterium avium
DGPARTR

SEQ ID NO: 31744 - protein, 9 aa, Mycobacterium avium
DGPCTENGE

SEQ ID NO: 31745 - protein, 10 aa, Mycobacterium avium
DGPDDSGARA

SEQ ID NO: 31746 - protein, 9 aa, Mycobacterium avium
DGPDPECVQ

SEQ ID NO: 31747 - protein, 5 aa, Mycobacterium avium
DGPDV

SEQ ID NO: 31748 - protein, 10 aa, Mycobacterium avium
DGPEGQSYTQ

SEQ ID NO: 31749 - protein, 13 aa, Mycobacterium avium
DGPEVLTASPFWQ

SEQ ID NO: 31750 - protein, 5 aa, Mycobacterium avium
DGPGR

SEQ ID NO: 31751 - protein, 6 aa, Mycobacterium avium
DGPHGA

SEQ ID NO: 31752 - protein, 5 aa, Mycobacterium avium
DGPLN

SEQ ID NO: 31753 - protein, 6 aa, Mycobacterium avium
DGPLPP

SEQ ID NO: 31754 - protein, 6 aa, Mycobacterium avium
DGPLSA

SEQ ID NO: 31755 - protein, 4 aa, Mycobacterium avium
DGPR

SEQ ID NO: 31756 - protein, 7 aa, Mycobacterium avium
DGPRESQ

SEQ ID NO: 31757 - protein, 6 aa, Mycobacterium avium
DGPTEV

SEQ ID NO: 31758 - protein, 7 aa, Mycobacterium avium
DGPVATG

SEQ ID NO: 31759 - protein, 5 aa, Mycobacterium avium
DGPVD

SEQ ID NO: 31760 - protein, 8 aa, Mycobacterium avium
DGPVRGNG

SEQ ID NO: 31761 - protein, 8 aa, Mycobacterium avium
DGPVTREY

SEQ ID NO: 31762 - protein, 8 aa, Mycobacterium avium
DGPVTSPS

SEQ ID NO: 31763 - protein, 4 aa, Mycobacterium avium
DGPY

SEQ ID NO: 31764 - protein, 4 aa, Mycobacterium avium
DGQA

SEQ ID NO: 31765 - protein, 8 aa, Mycobacterium avium
DGQAADAA

SEQ ID NO: 31766 - protein, 6 aa, Mycobacterium avium
DGQAAR

SEQ ID NO: 31767 - protein, 9 aa, Mycobacterium avium
DGQAEDFAG

SEQ ID NO: 31768 - protein, 7 aa, Mycobacterium avium
DGQKRLK

SEQ ID NO: 31769 - protein, 6 aa, Mycobacterium avium
DGQPEY

SEQ ID NO: 31770 - protein, 7 aa, Mycobacterium avium
DGQPGEV

SEQ ID NO: 31771 - protein, 10 aa, Mycobacterium avium
DGQPVTTPAG

SEQ ID NO: 31772 - protein, 7 aa, Mycobacterium avium
DGQRGAQ

SEQ ID NO: 31773 - protein, 6 aa, Mycobacterium avium
DGQRLP

SEQ ID NO: 31774 - protein, 13 aa, Mycobacterium avium
DGQTGVSCPPRDV

SEQ ID NO: 31775 - protein, 5 aa, Mycobacterium avium
DGREM

SEQ ID NO: 31776 - protein, 10 aa, Mycobacterium avium
DGREPNEAGS

SEQ ID NO: 31777 - protein, 10 aa, Mycobacterium avium
DGRGGGGQGM

SEQ ID NO: 31778 - protein, 11 aa, Mycobacterium avium
DGRGPGSPPAT

SEQ ID NO: 31779 - protein, 18 aa, Mycobacterium avium
DGRGRTPGGPQNQPLPAL

SEQ ID NO: 31780 - protein, 7 aa, Mycobacterium avium
DGRHAQR

SEQ ID NO: 31781 - protein, 15 aa, Mycobacterium avium
DGRIEDPVGSRPHLG

SEQ ID NO: 31782 - protein, 9 aa, Mycobacterium avium
DGRKSAVRA

SEQ ID NO: 31783 - protein, 4 aa, Mycobacterium avium
DGRL

SEQ ID NO: 31784 - protein, 11 aa, Mycobacterium avium
DGRNPPEKGSR

SEQ ID NO: 31785 - protein, 11 aa, Mycobacterium avium
DGRPDGDITPY

SEQ ID NO: 31786 - protein, 6 aa, Mycobacterium avium
DGRPYN

SEQ ID NO: 31787 - protein, 6 aa, Mycobacterium avium
DGRRAT

SEQ ID NO: 31788 - protein, 5 aa, Mycobacterium avium
DGRRL

SEQ ID NO: 31789 - protein, 12 aa, Mycobacterium avium
DGRVGSDVLAVA

SEQ ID NO: 31790 - protein, 10 aa, Mycobacterium avium
DGRVSFSRTA

SEQ ID NO: 31791 - protein, 5 aa, Mycobacterium avium
DGRVT

SEQ ID NO: 31792 - protein, 6 aa, Mycobacterium avium
DGRYGP

SEQ ID NO: 31793 - protein, 8 aa, Mycobacterium avium
DGSAGNSF

SEQ ID NO: 31794 - protein, 20 aa, Mycobacterium avium
DGSAPATGKAEVSVGEQPGL

SEQ ID NO: 31795 - protein, 8 aa, Mycobacterium avium
DGSATSRP

SEQ ID NO: 31796 - protein, 6 aa, Mycobacterium avium
DGSDDL

SEQ ID NO: 31797 - protein, 10 aa, Mycobacterium avium
DGSDKDYQRY

SEQ ID NO: 31798 - protein, 6 aa, Mycobacterium avium
DGSDSV

SEQ ID NO: 31799 - protein, 5 aa, Mycobacterium avium
DGSES

SEQ ID NO: 31800 - protein, 9 aa, Mycobacterium avium
DGSGTGSIT

SEQ ID NO: 31801 - protein, 10 aa, Mycobacterium avium
DGSLTDRELT

SEQ ID NO: 31802 - protein, 8 aa, Mycobacterium avium
DGSMDGAD

SEQ ID NO: 31803 - protein, 8 aa, Mycobacterium avium
DGSPASEL

SEQ ID NO: 31804 - protein, 5 aa, Mycobacterium avium
DGSSI

SEQ ID NO: 31805 - protein, 9 aa, Mycobacterium avium
DGSTDQSRV

SEQ ID NO: 31806 - protein, 6 aa, Mycobacterium avium
DGSTLD

SEQ ID NO: 31807 - protein, 6 aa, Mycobacterium avium
DGSTQI

SEQ ID NO: 31808 - protein, 6 aa, Mycobacterium avium
DGSVSA

SEQ ID NO: 31809 - protein, 7 aa, Mycobacterium avium
DGSYGVP

SEQ ID NO: 31810 - protein, 5 aa, Mycobacterium avium
DGTAA

SEQ ID NO: 31811 - protein, 11 aa, Mycobacterium avium
DGTAADSRASM

SEQ ID NO: 31812 - protein, 7 aa, Mycobacterium avium
DGTASTV

SEQ ID NO: 31813 - protein, 4 aa, Mycobacterium avium
DGTC

SEQ ID NO: 31814 - protein, 4 aa, Mycobacterium avium
DGTE

SEQ ID NO: 31815 - protein, 17 aa, Mycobacterium avium
DGTEDYWSDEYRDLIEL

SEQ ID NO: 31816 - protein, 9 aa, Mycobacterium avium
DGTEMTDED

SEQ ID NO: 31817 - protein, 12 aa, Mycobacterium avium
DGTESALQHGSK

SEQ ID NO: 31818 - protein, 13 aa, Mycobacterium avium
DGTEVATSPLATE

SEQ ID NO: 31819 - protein, 18 aa, Mycobacterium avium
DGTHPAGAPAPALGQDTA

SEQ ID NO: 31820 - protein, 15 aa, Mycobacterium avium
DGTLPVTTPKAEPLL

SEQ ID NO: 31821 - protein, 12 aa, Mycobacterium avium
DGTPDKSRLGGN

SEQ ID NO: 31822 - protein, 8 aa, Mycobacterium avium
DGTPIPSC

SEQ ID NO: 31823 - protein, 10 aa, Mycobacterium avium
DGTQDPYTAA

SEQ ID NO: 31824 - protein, 6 aa, Mycobacterium avium
DGTREF

SEQ ID NO: 31825 - protein, 6 aa, Mycobacterium avium
DGTRHT

SEQ ID NO: 31826 - protein, 6 aa, Mycobacterium avium
DGTRTE

SEQ ID NO: 31827 - protein, 4 aa, Mycobacterium avium
DGTS

SEQ ID NO: 31828 - protein, 4 aa, Mycobacterium avium
DGTT

SEQ ID NO: 31829 - protein, 7 aa, Mycobacterium avium
DGTTSST

SEQ ID NO: 31830 - protein, 6 aa, Mycobacterium avium
DGTVAE

SEQ ID NO: 31831 - protein, 10 aa, Mycobacterium avium
DGTVAEADRD

SEQ ID NO: 31832 - protein, 10 aa, Mycobacterium avium
DGTVQASTVG

SEQ ID NO: 31833 - protein, 37 aa, Mycobacterium avium
DGTVRGNRTSRSEEWRDPEPPADDDPDVPTAGPSRRE

SEQ ID NO: 31834 - protein, 9 aa, Mycobacterium avium
DGTYARPEE

SEQ ID NO: 31835 - protein, 5 aa, Mycobacterium avium
DGVAD

SEQ ID NO: 31836 - protein, 13 aa, Mycobacterium avium
DGVAPASPAQQAA

SEQ ID NO: 31837 - protein, 4 aa, Mycobacterium avium
DGVE

SEQ ID NO: 31838 - protein, 5 aa, Mycobacterium avium
DGVEL

SEQ ID NO: 31839 - protein, 5 aa, Mycobacterium avium
DGVGG

SEQ ID NO: 31840 - protein, 4 aa, Mycobacterium avium
DGVR

SEQ ID NO: 31841 - protein, 6 aa, Mycobacterium avium
DGVRST

SEQ ID NO: 31842 - protein, 5 aa, Mycobacterium avium
DGVSG

SEQ ID NO: 31843 - protein, 5 aa, Mycobacterium avium
DGVTA

SEQ ID NO: 31844 - protein, 4 aa, Mycobacterium avium
DGWD

SEQ ID NO: 31845 - protein, 12 aa, Mycobacterium avium
DGWQGGSVTAPV

SEQ ID NO: 31846 - protein, 7 aa, Mycobacterium avium
DGWSPPA

SEQ ID NO: 31847 - protein, 4 aa, Mycobacterium avium
DGYA

SEQ ID NO: 31848 - protein, 6 aa, Mycobacterium avium
DGYEQL

SEQ ID NO: 31849 - protein, 6 aa, Mycobacterium avium
DGYERT

SEQ ID NO: 31850 - protein, 4 aa, Mycobacterium avium
DGYP

SEQ ID NO: 31851 - protein, 4 aa, Mycobacterium avium
DGYT

SEQ ID NO: 31852 - protein, 6 aa, Mycobacterium avium
DGYVRG

SEQ ID NO: 31853 - protein, 5 aa, Mycobacterium avium
DHAAA

SEQ ID NO: 31854 - protein, 9 aa, Mycobacterium avium
DHAARAADA

SEQ ID NO: 31855 - protein, 5 aa, Mycobacterium avium
DHADI

SEQ ID NO: 31856 - protein, 12 aa, Mycobacterium avium
DHDINGERRGYK

SEQ ID NO: 31857 - protein, 7 aa, Mycobacterium avium
DHDQTER

SEQ ID NO: 31858 - protein, 4 aa, Mycobacterium avium
DHDY

SEQ ID NO: 31859 - protein, 8 aa, Mycobacterium avium
DHDYETKK

SEQ ID NO: 31860 - protein, 8 aa, Mycobacterium avium
DHENTDTG

SEQ ID NO: 31861 - protein, 5 aa, Mycobacterium avium
DHGEV

SEQ ID NO: 31862 - protein, 9 aa, Mycobacterium avium
DHGVPAGRR

SEQ ID NO: 31863 - protein, 5 aa, Mycobacterium avium
DHHSR

SEQ ID NO: 31864 - protein, 4 aa, Mycobacterium avium
DHHT

SEQ ID NO: 31865 - protein, 9 aa, Mycobacterium avium
DHKATPEQI

SEQ ID NO: 31866 - protein, 6 aa, Mycobacterium avium
DHKGDR

SEQ ID NO: 31867 - protein, 7 aa, Mycobacterium avium
DHKGQPT

SEQ ID NO: 31868 - protein, 7 aa, Mycobacterium avium
DHPAPSQ

SEQ ID NO: 31869 - protein, 5 aa, Mycobacterium avium
DHPDE

SEQ ID NO: 31870 - protein, 16 aa, Mycobacterium avium
DHPDQRRELAADPSLI

SEQ ID NO: 31871 - protein, 7 aa, Mycobacterium avium
DHPPHGD

SEQ ID NO: 31872 - protein, 6 aa, Mycobacterium avium
DHPSDD

SEQ ID NO: 31873 - protein, 10 aa, Mycobacterium avium
DHPSDEESVA

SEQ ID NO: 31874 - protein, 13 aa, Mycobacterium avium
DHRDGHHQAGLPP

SEQ ID NO: 31875 - protein, 12 aa, Mycobacterium avium
DHREGETGRGRG

SEQ ID NO: 31876 - protein, 11 aa, Mycobacterium avium
DHRGRTDPGQD

SEQ ID NO: 31877 - protein, 5 aa, Mycobacterium avium
DHRQA

SEQ ID NO: 31878 - protein, 8 aa, Mycobacterium avium
DHRSTPAE

SEQ ID NO: 31879 - protein, 11 aa, Mycobacterium avium
DHTASARATLG

SEQ ID NO: 31880 - protein, 8 aa, Mycobacterium avium
DHTGLRDD

SEQ ID NO: 31881 - protein, 5 aa, Mycobacterium avium
DIAKG

SEQ ID NO: 31882 - protein, 7 aa, Mycobacterium avium
DIDAGTV

SEQ ID NO: 31883 - protein, 5 aa, Mycobacterium avium
DIDDP

SEQ ID NO: 31884 - protein, 6 aa, Mycobacterium avium
DIDGGL

SEQ ID NO: 31885 - protein, 22 aa, Mycobacterium avium
DIEPQGPYGGYKQSGFGRTGGV

SEQ ID NO: 31886 - protein, 8 aa, Mycobacterium avium
DIGQPASV

SEQ ID NO: 31887 - protein, 6 aa, Mycobacterium avium
DIGSSE

SEQ ID NO: 31888 - protein, 7 aa, Mycobacterium avium
DIHTSGE

SEQ ID NO: 31889 - protein, 7 aa, Mycobacterium avium
DIPDGGT

SEQ ID NO: 31890 - protein, 5 aa, Mycobacterium avium
DIPDT

SEQ ID NO: 31891 - protein, 7 aa, Mycobacterium avium
DIPGTAL

SEQ ID NO: 31892 - protein, 13 aa, Mycobacterium avium
DIPSALTTPEAPA

SEQ ID NO: 31893 - protein, 7 aa, Mycobacterium avium
DIQGGGS

SEQ ID NO: 31894 - protein, 5 aa, Mycobacterium avium
DIRNT

SEQ ID NO: 31895 - protein, 8 aa, Mycobacterium avium
DIRQSPGL

SEQ ID NO: 31896 - protein, 9 aa, Mycobacterium avium
DISGPPRAH

SEQ ID NO: 31897 - protein, 10 aa, Mycobacterium avium
DISPGTPGAT

SEQ ID NO: 31898 - protein, 6 aa, Mycobacterium avium
DISSTD

SEQ ID NO: 31899 - protein, 7 aa, Mycobacterium avium
DITDDDE

SEQ ID NO: 31900 - protein, 11 aa, Mycobacterium avium
DIYNPNRDAPG

SEQ ID NO: 31901 - protein, 7 aa, Mycobacterium avium
DKANTKD

SEQ ID NO: 31902 - protein, 8 aa, Mycobacterium avium
DKDAPLPD

SEQ ID NO: 31903 - protein, 7 aa, Mycobacterium avium
DKDGGAL

SEQ ID NO: 31904 - protein, 16 aa, Mycobacterium avium
DKDGRPFPPWTDPESA

SEQ ID NO: 31905 - protein, 8 aa, Mycobacterium avium
DKEDGSLT

SEQ ID NO: 31906 - protein, 5 aa, Mycobacterium avium
DKEGT

SEQ ID NO: 31907 - protein, 4 aa, Mycobacterium avium
DKGA

SEQ ID NO: 31908 - protein, 7 aa, Mycobacterium avium
DKGEKEQ

SEQ ID NO: 31909 - protein, 5 aa, Mycobacterium avium
DKGKL

SEQ ID NO: 31910 - protein, 5 aa, Mycobacterium avium
DKGMR

SEQ ID NO: 31911 - protein, 4 aa, Mycobacterium avium
DKGR

SEQ ID NO: 31912 - protein, 6 aa, Mycobacterium avium
DKGRLT

SEQ ID NO: 31913 - protein, 7 aa, Mycobacterium avium
DKGTATF

SEQ ID NO: 31914 - protein, 4 aa, Mycobacterium avium
DKGV

SEQ ID NO: 31915 - protein, 5 aa, Mycobacterium avium
DKGVR

SEQ ID NO: 31916 - protein, 15 aa, Mycobacterium avium
DKLAQPGAATPSRIA

SEQ ID NO: 31917 - protein, 8 aa, Mycobacterium avium
DKLLGGPQ

SEQ ID NO: 31918 - protein, 4 aa, Mycobacterium avium
DKMG

SEQ ID NO: 31919 - protein, 7 aa, Mycobacterium avium
DKMGGAY

SEQ ID NO: 31920 - protein, 7 aa, Mycobacterium avium
DKNDLRK

SEQ ID NO: 31921 - protein, 16 aa, Mycobacterium avium
DKPAEEADDHGHGHHH

SEQ ID NO: 31922 - protein, 5 aa, Mycobacterium avium
DKPAV

SEQ ID NO: 31923 - protein, 4 aa, Mycobacterium avium
DKPF

SEQ ID NO: 31924 - protein, 8 aa, Mycobacterium avium
DKPGAAQT

SEQ ID NO: 31925 - protein, 7 aa, Mycobacterium avium
DKPGEGH

SEQ ID NO: 31926 - protein, 6 aa, Mycobacterium avium
DKPGVA

SEQ ID NO: 31927 - protein, 6 aa, Mycobacterium avium
DKPGVL

SEQ ID NO: 31928 - protein, 8 aa, Mycobacterium avium
DKPNNGEA

SEQ ID NO: 31929 - protein, 7 aa, Mycobacterium avium
DKPTGAV

SEQ ID NO: 31930 - protein, 4 aa, Mycobacterium avium
DKQL

SEQ ID NO: 31931 - protein, 7 aa, Mycobacterium avium
DKQRPAL

SEQ ID NO: 31932 - protein, 7 aa, Mycobacterium avium
DKRPEVR

SEQ ID NO: 31933 - protein, 9 aa, Mycobacterium avium
DKRRNPTGD

SEQ ID NO: 31934 - protein, 18 aa, Mycobacterium avium
DKRSARKRNALAARSRKR

SEQ ID NO: 31935 - protein, 6 aa, Mycobacterium avium
DKSDLR

SEQ ID NO: 31936 - protein, 8 aa, Mycobacterium avium
DKSGDPDI

SEQ ID NO: 31937 - protein, 8 aa, Mycobacterium avium
DKSGTTAN

SEQ ID NO: 31938 - protein, 18 aa, Mycobacterium avium
DKSREFAEHGNRVYLPLA

SEQ ID NO: 31939 - protein, 11 aa, Mycobacterium avium
DKVNVSGSGCS

SEQ ID NO: 31940 - protein, 6 aa, Mycobacterium avium
DKVSVN

SEQ ID NO: 31941 - protein, 6 aa, Mycobacterium avium
DLAAGG

SEQ ID NO: 31942 - protein, 9 aa, Mycobacterium avium
DLADAGERA

SEQ ID NO: 31943 - protein, 12 aa, Mycobacterium avium
DLADGPDAVDRD

SEQ ID NO: 31944 - protein, 8 aa, Mycobacterium avium
DLADRRNR

SEQ ID NO: 31945 - protein, 4 aa, Mycobacterium avium
DLAE

SEQ ID NO: 31946 - protein, 12 aa, Mycobacterium avium
DLAERHGRHNPH

SEQ ID NO: 31947 - protein, 4 aa, Mycobacterium avium
DLAN

SEQ ID NO: 31948 - protein, 7 aa, Mycobacterium avium
DLANNQH

SEQ ID NO: 31949 - protein, 7 aa, Mycobacterium avium
DLAPGQV

SEQ ID NO: 31950 - protein, 8 aa, Mycobacterium avium
DLAPPEPF

SEQ ID NO: 31951 - protein, 7 aa, Mycobacterium avium
DLASEAG

SEQ ID NO: 31952 - protein, 13 aa, Mycobacterium avium
DLDATSKAQLDRG

SEQ ID NO: 31953 - protein, 13 aa, Mycobacterium avium
DLDDDTHADRTGD

SEQ ID NO: 31954 - protein, 12 aa, Mycobacterium avium
DLDDEAAKAAEH

SEQ ID NO: 31955 - protein, 6 aa, Mycobacterium avium
DLDGDG

SEQ ID NO: 31956 - protein, 15 aa, Mycobacterium avium
DLDGPGRATLAARLG

SEQ ID NO: 31957 - protein, 15 aa, Mycobacterium avium
DLDGVTDAEDRVSEL

SEQ ID NO: 31958 - protein, 7 aa, Mycobacterium avium
DLDRGPF

SEQ ID NO: 31959 - protein, 10 aa, Mycobacterium avium
DLDRPPTRAE

SEQ ID NO: 31960 - protein, 16 aa, Mycobacterium avium
DLDSGLAGLGQGAAGL

SEQ ID NO: 31961 - protein, 6 aa, Mycobacterium avium
DLEGTV

SEQ ID NO: 31962 - protein, 11 aa, Mycobacterium avium
DLENTANRRPA

SEQ ID NO: 31963 - protein, 8 aa, Mycobacterium avium
DLGAPYQP

SEQ ID NO: 31964 - protein, 7 aa, Mycobacterium avium
DLGATEN

SEQ ID NO: 31965 - protein, 4 aa, Mycobacterium avium
DLGD

SEQ ID NO: 31966 - protein, 10 aa, Mycobacterium avium
DLGEKESRGL

SEQ ID NO: 31967 - protein, 5 aa, Mycobacterium avium
DLGGA

SEQ ID NO: 31968 - protein, 14 aa, Mycobacterium avium
DLGPGTSTSEATRA

SEQ ID NO: 31969 - protein, 6 aa, Mycobacterium avium
DLGQQD

SEQ ID NO: 31970 - protein, 13 aa, Mycobacterium avium
DLGTKGGLRTDTA

SEQ ID NO: 31971 - protein, 12 aa, Mycobacterium avium
DLKDGEGSVGTF

SEQ ID NO: 31972 - protein, 8 aa, Mycobacterium avium
DLKDKAPR

SEQ ID NO: 31973 - protein, 5 aa, Mycobacterium avium
DLNDP

SEQ ID NO: 31974 - protein, 7 aa, Mycobacterium avium
DLNETDD

SEQ ID NO: 31975 - protein, 9 aa, Mycobacterium avium
DLNYDNPAV

SEQ ID NO: 31976 - protein, 13 aa, Mycobacterium avium
DLPADADPGETLS

SEQ ID NO: 31977 - protein, 7 aa, Mycobacterium avium
DLPAKAR

SEQ ID NO: 31978 - protein, 9 aa, Mycobacterium avium
DLPDSVPAV

SEQ ID NO: 31979 - protein, 13 aa, Mycobacterium avium
DLPEPKKVKPPRT

SEQ ID NO: 31980 - protein, 7 aa, Mycobacterium avium
DLPGEPP

SEQ ID NO: 31981 - protein, 11 aa, Mycobacterium avium
DLPGGATSGLR

SEQ ID NO: 31982 - protein, 6 aa, Mycobacterium avium
DLPGND

SEQ ID NO: 31983 - protein, 8 aa, Mycobacterium avium
DLPGPGAI

SEQ ID NO: 31984 - protein, 5 aa, Mycobacterium avium
DLPPA

SEQ ID NO: 31985 - protein, 7 aa, Mycobacterium avium
DLPPEHS

SEQ ID NO: 31986 - protein, 6 aa, Mycobacterium avium
DLPPSA

SEQ ID NO: 31987 - protein, 6 aa, Mycobacterium avium
DLPPSH

SEQ ID NO: 31988 - protein, 11 aa, Mycobacterium avium
DLPPSSWGSGK

SEQ ID NO: 31989 - protein, 12 aa, Mycobacterium avium
DLPSRELNPNET

SEQ ID NO: 31990 - protein, 11 aa, Mycobacterium avium
DLPTAEGSGSM

SEQ ID NO: 31991 - protein, 9 aa, Mycobacterium avium
DLPTPAGFA

SEQ ID NO: 31992 - protein, 14 aa, Mycobacterium avium
DLPTPTRADPDTER

SEQ ID NO: 31993 - protein, 8 aa, Mycobacterium avium
DLQEDKEP

SEQ ID NO: 31994 - protein, 10 aa, Mycobacterium avium
DLQPGSSIMP

SEQ ID NO: 31995 - protein, 13 aa, Mycobacterium avium
DLRDHPDAASQQE

SEQ ID NO: 31996 - protein, 7 aa, Mycobacterium avium
DLRGPER

SEQ ID NO: 31997 - protein, 6 aa, Mycobacterium avium
DLRPAR

SEQ ID NO: 31998 - protein, 5 aa, Mycobacterium avium
DLRPG

SEQ ID NO: 31999 - protein, 5 aa, Mycobacterium avium
DLRPS

SEQ ID NO: 32000 - protein, 5 aa, Mycobacterium avium
DLSAP

SEQ ID NO: 32001 - protein, 13 aa, Mycobacterium avium
DLSDDGVLPAPVD

SEQ ID NO: 32002 - protein, 7 aa, Mycobacterium avium
DLSEGGL

SEQ ID NO: 32003 - protein, 8 aa, Mycobacterium avium
DLSGGQRR

SEQ ID NO: 32004 - protein, 7 aa, Mycobacterium avium
DLSGPDI

SEQ ID NO: 32005 - protein, 19 aa, Mycobacterium avium
DLSGTGRPWTRNKPTTPAF

SEQ ID NO: 32006 - protein, 9 aa, Mycobacterium avium
DLSPKARDL

SEQ ID NO: 32007 - protein, 9 aa, Mycobacterium avium
DLSQPDERE

SEQ ID NO: 32008 - protein, 21 aa, Mycobacterium avium
DLSTGNSSADRAIREAEAEAY

SEQ ID NO: 32009 - protein, 4 aa, Mycobacterium avium
DLTD

SEQ ID NO: 32010 - protein, 6 aa, Mycobacterium avium
DLTGSR

SEQ ID NO: 32011 - protein, 7 aa, Mycobacterium avium
DLTPRNQ

SEQ ID NO: 32012 - protein, 10 aa, Mycobacterium avium
DLVDGAPKPL

SEQ ID NO: 32013 - protein, 12 aa, Mycobacterium avium
DLVPEDRAGDHA

SEQ ID NO: 32014 - protein, 7 aa, Mycobacterium avium
DMDNSAI

SEQ ID NO: 32015 - protein, 7 aa, Mycobacterium avium
DMGDTTA

SEQ ID NO: 32016 - protein, 5 aa, Mycobacterium avium
DMSRK

SEQ ID NO: 32017 - protein, 9 aa, Mycobacterium avium
DNADASTRE

SEQ ID NO: 32018 - protein, 7 aa, Mycobacterium avium
DNAGTVE

SEQ ID NO: 32019 - protein, 10 aa, Mycobacterium avium
DNAPEERQRG

SEQ ID NO: 32020 - protein, 11 aa, Mycobacterium avium
DNAPYDPAAAE

SEQ ID NO: 32021 - protein, 6 aa, Mycobacterium avium
DNAQLE

SEQ ID NO: 32022 - protein, 32 aa, Mycobacterium avium
DNATLSAANTDLRSTNRALREAAKTADGDAAT

SEQ ID NO: 32023 - protein, 6 aa, Mycobacterium avium
DNCPQR

SEQ ID NO: 32024 - protein, 9 aa, Mycobacterium avium
DNDGTPEAY

SEQ ID NO: 32025 - protein, 4 aa, Mycobacterium avium
DNDR

SEQ ID NO: 32026 - protein, 11 aa, Mycobacterium avium
DNDSARRTPDL

SEQ ID NO: 32027 - protein, 9 aa, Mycobacterium avium
DNEDQNDLI

SEQ ID NO: 32028 - protein, 7 aa, Mycobacterium avium
DNEHDEA

SEQ ID NO: 32029 - protein, 7 aa, Mycobacterium avium
DNEPGVG

SEQ ID NO: 32030 - protein, 4 aa, Mycobacterium avium
DNET

SEQ ID NO: 32031 - protein, 14 aa, Mycobacterium avium
DNEVPGATDRDRGY

SEQ ID NO: 32032 - protein, 11 aa, Mycobacterium avium
DNFDPTRRSGR

SEQ ID NO: 32033 - protein, 9 aa, Mycobacterium avium
DNGDGTSVE

SEQ ID NO: 32034 - protein, 8 aa, Mycobacterium avium
DNGDTTYG

SEQ ID NO: 32035 - protein, 7 aa, Mycobacterium avium
DNGGTLP

SEQ ID NO: 32036 - protein, 12 aa, Mycobacterium avium
DNGVNGGVGSAV

SEQ ID NO: 32037 - protein, 7 aa, Mycobacterium avium
DNKPVDL

SEQ ID NO: 32038 - protein, 7 aa, Mycobacterium avium
DNLSAER

SEQ ID NO: 32039 - protein, 15 aa, Mycobacterium avium
DNLSAPSAGEPGSDV

SEQ ID NO: 32040 - protein, 8 aa, Mycobacterium avium
DNNLHSRG

SEQ ID NO: 32041 - protein, 5 aa, Mycobacterium avium
DNPAL

SEQ ID NO: 32042 - protein, 10 aa, Mycobacterium avium
DNPDAAAEYQ

SEQ ID NO: 32043 - protein, 6 aa, Mycobacterium avium
DNPDDV

SEQ ID NO: 32044 - protein, 6 aa, Mycobacterium avium
DNPDEI

SEQ ID NO: 32045 - protein, 5 aa, Mycobacterium avium
DNPDQ

SEQ ID NO: 32046 - protein, 26 aa, Mycobacterium avium
DNPDYEPDPSTSIAARARARGVDPME

SEQ ID NO: 32047 - protein, 5 aa, Mycobacterium avium
DNPEV

SEQ ID NO: 32048 - protein, 8 aa, Mycobacterium avium
DNPGDRYG

SEQ ID NO: 32049 - protein, 9 aa, Mycobacterium avium
DNPGGAAEV

SEQ ID NO: 32050 - protein, 4 aa, Mycobacterium avium
DNPN

SEQ ID NO: 32051 - protein, 15 aa, Mycobacterium avium
DNPNATGSCACGDSF

SEQ ID NO: 32052 - protein, 9 aa, Mycobacterium avium
DNPPATRQA

SEQ ID NO: 32053 - protein, 6 aa, Mycobacterium avium
DNRDEM

SEQ ID NO: 32054 - protein, 15 aa, Mycobacterium avium
DNRPSSDPWNPHGTS

SEQ ID NO: 32055 - protein, 13 aa, Mycobacterium avium
DNRSSLAQTETFG

SEQ ID NO: 32056 - protein, 7 aa, Mycobacterium avium
DNSDAAL

SEQ ID NO: 32057 - protein, 4 aa, Mycobacterium avium
DNST

SEQ ID NO: 32058 - protein, 10 aa, Mycobacterium avium
DNSTAAPPLT

SEQ ID NO: 32059 - protein, 7 aa, Mycobacterium avium
DNSTTWN

SEQ ID NO: 32060 - protein, 6 aa, Mycobacterium avium
DNSYPG

SEQ ID NO: 32061 - protein, 6 aa, Mycobacterium avium
DNTGAK

SEQ ID NO: 32062 - protein, 5 aa, Mycobacterium avium
DNTIE

SEQ ID NO: 32063 - protein, 4 aa, Mycobacterium avium
DNTN

SEQ ID NO: 32064 - protein, 8 aa, Mycobacterium avium
DNTSTVPG

SEQ ID NO: 32065 - protein, 19 aa, Mycobacterium avium
DNYTGHVDPGTAARRTLPG

SEQ ID NO: 32066 - protein, 10 aa, Mycobacterium avium
DPAAADPVTT

SEQ ID NO: 32067 - protein, 6 aa, Mycobacterium avium
DPAAER

SEQ ID NO: 32068 - protein, 7 aa, Mycobacterium avium
DPAAHVG

SEQ ID NO: 32069 - protein, 5 aa, Mycobacterium avium
DPAAL

SEQ ID NO: 32070 - protein, 6 aa, Mycobacterium avium
DPAATL

SEQ ID NO: 32071 - protein, 5 aa, Mycobacterium avium
DPAAV

SEQ ID NO: 32072 - protein, 7 aa, Mycobacterium avium
DPACDGQ

SEQ ID NO: 32073 - protein, 9 aa, Mycobacterium avium
DPADKRAQW

SEQ ID NO: 32074 - protein, 6 aa, Mycobacterium avium
DPADRA

SEQ ID NO: 32075 - protein, 7 aa, Mycobacterium avium
DPADRAR

SEQ ID NO: 32076 - protein, 10 aa, Mycobacterium avium
DPADTDEASA

SEQ ID NO: 32077 - protein, 6 aa, Mycobacterium avium
DPADTR

SEQ ID NO: 32078 - protein, 5 aa, Mycobacterium avium
DPADV

SEQ ID NO: 32079 - protein, 10 aa, Mycobacterium avium
DPADVPTGRS

SEQ ID NO: 32080 - protein, 11 aa, Mycobacterium avium
DPAGAPHGGES

SEQ ID NO: 32081 - protein, 5 aa, Mycobacterium avium
DPAGE

SEQ ID NO: 32082 - protein, 9 aa, Mycobacterium avium
DPAGGYGHP

SEQ ID NO: 32083 - protein, 9 aa, Mycobacterium avium
DPAGLSGMG

SEQ ID NO: 32084 - protein, 5 aa, Mycobacterium avium
DPAGY

SEQ ID NO: 32085 - protein, 5 aa, Mycobacterium avium
DPAHQ

SEQ ID NO: 32086 - protein, 4 aa, Mycobacterium avium
DPAI

SEQ ID NO: 32087 - protein, 9 aa, Mycobacterium avium
DPAKGDQAV

SEQ ID NO: 32088 - protein, 9 aa, Mycobacterium avium
DPAKQQDEL

SEQ ID NO: 32089 - protein, 5 aa, Mycobacterium avium
DPANS

SEQ ID NO: 32090 - protein, 4 aa, Mycobacterium avium
DPAP

SEQ ID NO: 32091 - protein, 5 aa, Mycobacterium avium
DPAPA

SEQ ID NO: 32092 - protein, 8 aa, Mycobacterium avium
DPAPAARS

SEQ ID NO: 32093 - protein, 7 aa, Mycobacterium avium
DPAPRAA

SEQ ID NO: 32094 - protein, 4 aa, Mycobacterium avium
DPAR

SEQ ID NO: 32095 - protein, 7 aa, Mycobacterium avium
DPARGGV

SEQ ID NO: 32096 - protein, 9 aa, Mycobacterium avium
DPARRGETL

SEQ ID NO: 32097 - protein, 5 aa, Mycobacterium avium
DPART

SEQ ID NO: 32098 - protein, 8 aa, Mycobacterium avium
DPASARGS

SEQ ID NO: 32099 - protein, 5 aa, Mycobacterium avium
DPASI

SEQ ID NO: 32100 - protein, 5 aa, Mycobacterium avium
DPATA

SEQ ID NO: 32101 - protein, 6 aa, Mycobacterium avium
DPATGH

SEQ ID NO: 32102 - protein, 6 aa, Mycobacterium avium
DPATIE

SEQ ID NO: 32103 - protein, 6 aa, Mycobacterium avium
DPATSA

SEQ ID NO: 32104 - protein, 17 aa, Mycobacterium avium
DPATYSSVTGGERPYGG

SEQ ID NO: 32105 - protein, 7 aa, Mycobacterium avium
DPAVKPL

SEQ ID NO: 32106 - protein, 5 aa, Mycobacterium avium
DPDAD

SEQ ID NO: 32107 - protein, 9 aa, Mycobacterium avium
DPDADDPHI

SEQ ID NO: 32108 - protein, 8 aa, Mycobacterium avium
DPDAPTAS

SEQ ID NO: 32109 - protein, 8 aa, Mycobacterium avium
DPDASAAA

SEQ ID NO: 32110 - protein, 9 aa, Mycobacterium avium
DPDATAAAI

SEQ ID NO: 32111 - protein, 9 aa, Mycobacterium avium
DPDDFADPQ

SEQ ID NO: 32112 - protein, 8 aa, Mycobacterium avium
DPDDGSRR

SEQ ID NO: 32113 - protein, 5 aa, Mycobacterium avium
DPDDL

SEQ ID NO: 32114 - protein, 6 aa, Mycobacterium avium
DPDDLD

SEQ ID NO: 32115 - protein, 10 aa, Mycobacterium avium
DPDDPSESQA

SEQ ID NO: 32116 - protein, 6 aa, Mycobacterium avium
DPDDVS

SEQ ID NO: 32117 - protein, 8 aa, Mycobacterium avium
DPDEPVES

SEQ ID NO: 32118 - protein, 7 aa, Mycobacterium avium
DPDESGQ

SEQ ID NO: 32119 - protein, 5 aa, Mycobacterium avium
DPDGA

SEQ ID NO: 32120 - protein, 9 aa, Mycobacterium avium
DPDGGEPQC

SEQ ID NO: 32121 - protein, 13 aa, Mycobacterium avium
DPDGNNVEAVWHG

SEQ ID NO: 32122 - protein, 13 aa, Mycobacterium avium
DPDGNVIEFAQKL

SEQ ID NO: 32123 - protein, 8 aa, Mycobacterium avium
DPDGSGEV

SEQ ID NO: 32124 - protein, 13 aa, Mycobacterium avium
DPDGTAHRVGSPR

SEQ ID NO: 32125 - protein, 10 aa, Mycobacterium avium
DPDPDAPGKV

SEQ ID NO: 32126 - protein, 8 aa, Mycobacterium avium
DPDPDGPL

SEQ ID NO: 32127 - protein, 10 aa, Mycobacterium avium
DPDPDTAVKR

SEQ ID NO: 32128 - protein, 10 aa, Mycobacterium avium
DPDPETPGKM

SEQ ID NO: 32129 - protein, 14 aa, Mycobacterium avium
DPDRARRDDPRGPL

SEQ ID NO: 32130 - protein, 5 aa, Mycobacterium avium
DPDRD

SEQ ID NO: 32131 - protein, 8 aa, Mycobacterium avium
DPDRDKPS

SEQ ID NO: 32132 - protein, 8 aa, Mycobacterium avium
DPDRPLSD

SEQ ID NO: 32133 - protein, 13 aa, Mycobacterium avium
DPDRSRAAAATQA

SEQ ID NO: 32134 - protein, 4 aa, Mycobacterium avium
DPDS

SEQ ID NO: 32135 - protein, 4 aa, Mycobacterium avium
DPDT

SEQ ID NO: 32136 - protein, 9 aa, Mycobacterium avium
DPDTAREYH

SEQ ID NO: 32137 - protein, 7 aa, Mycobacterium avium
DPDTVTE

SEQ ID NO: 32138 - protein, 4 aa, Mycobacterium avium
DPDV

SEQ ID NO: 32139 - protein, 6 aa, Mycobacterium avium
DPEAAA

SEQ ID NO: 32140 - protein, 8 aa, Mycobacterium avium
DPEAPPYQ

SEQ ID NO: 32141 - protein, 8 aa, Mycobacterium avium
DPEATAER

SEQ ID NO: 32142 - protein, 4 aa, Mycobacterium avium
DPEF

SEQ ID NO: 32143 - protein, 5 aa, Mycobacterium avium
DPEGG

SEQ ID NO: 32144 - protein, 11 aa, Mycobacterium avium
DPEGKGHRGRA

SEQ ID NO: 32145 - protein, 6 aa, Mycobacterium avium
DPELPE

SEQ ID NO: 32146 - protein, 5 aa, Mycobacterium avium
DPELR

SEQ ID NO: 32147 - protein, 11 aa, Mycobacterium avium
DPEPGVPGRSV

SEQ ID NO: 32148 - protein, 13 aa, Mycobacterium avium
DPEPPEDARDEVE

SEQ ID NO: 32149 - protein, 4 aa, Mycobacterium avium
DPEQ

SEQ ID NO: 32150 - protein, 5 aa, Mycobacterium avium
DPEQL

SEQ ID NO: 32151 - protein, 13 aa, Mycobacterium avium
DPEQRADYQQRAN

SEQ ID NO: 32152 - protein, 8 aa, Mycobacterium avium
DPESIDRA

SEQ ID NO: 32153 - protein, 6 aa, Mycobacterium avium
DPESQK

SEQ ID NO: 32154 - protein, 11 aa, Mycobacterium avium
DPETGQYDTSS

SEQ ID NO: 32155 - protein, 7 aa, Mycobacterium avium
DPETKTL

SEQ ID NO: 32156 - protein, 8 aa, Mycobacterium avium
DPGAAALA

SEQ ID NO: 32157 - protein, 10 aa, Mycobacterium avium
DPGAAEALDP

SEQ ID NO: 32158 - protein, 10 aa, Mycobacterium avium
DPGAQSPRES

SEQ ID NO: 32159 - protein, 17 aa, Mycobacterium avium
DPGARRPGEINHNDGGR

SEQ ID NO: 32160 - protein, 5 aa, Mycobacterium avium
DPGAY

SEQ ID NO: 32161 - protein, 4 aa, Mycobacterium avium
DPGD

SEQ ID NO: 32162 - protein, 8 aa, Mycobacterium avium
DPGDSASV

SEQ ID NO: 32163 - protein, 11 aa, Mycobacterium avium
DPGEGTQAKRR

SEQ ID NO: 32164 - protein, 4 aa, Mycobacterium avium
DPGF

SEQ ID NO: 32165 - protein, 6 aa, Mycobacterium avium
DPGFSG

SEQ ID NO: 32166 - protein, 6 aa, Mycobacterium avium
DPGGVD

SEQ ID NO: 32167 - protein, 5 aa, Mycobacterium avium
DPGLD

SEQ ID NO: 32168 - protein, 10 aa, Mycobacterium avium
DPGPCGPASR

SEQ ID NO: 32169 - protein, 9 aa, Mycobacterium avium
DPGPDDDEH

SEQ ID NO: 32170 - protein, 11 aa, Mycobacterium avium
DPGPLTPLTDE

SEQ ID NO: 32171 - protein, 13 aa, Mycobacterium avium
DPGPRTSSATTIT

SEQ ID NO: 32172 - protein, 8 aa, Mycobacterium avium
DPGPRTST

SEQ ID NO: 32173 - protein, 7 aa, Mycobacterium avium
DPGPVTG

SEQ ID NO: 32174 - protein, 5 aa, Mycobacterium avium
DPGQG

SEQ ID NO: 32175 - protein, 11 aa, Mycobacterium avium
DPGRPPRTGAD

SEQ ID NO: 32176 - protein, 7 aa, Mycobacterium avium
DPGSRGA

SEQ ID NO: 32177 - protein, 8 aa, Mycobacterium avium
DPHNKPGR

SEQ ID NO: 32178 - protein, 9 aa, Mycobacterium avium
DPHQSGTAV

SEQ ID NO: 32179 - protein, 6 aa, Mycobacterium avium
DPHTPQ

SEQ ID NO: 32180 - protein, 6 aa, Mycobacterium avium
DPIDRR

SEQ ID NO: 32181 - protein, 4 aa, Mycobacterium avium
DPIE

SEQ ID NO: 32182 - protein, 8 aa, Mycobacterium avium
DPIPGNDA

SEQ ID NO: 32183 - protein, 8 aa, Mycobacterium avium
DPKAEPSI

SEQ ID NO: 32184 - protein, 6 aa, Mycobacterium avium
DPKLTA

SEQ ID NO: 32185 - protein, 12 aa, Mycobacterium avium
DPKNQAPGPAVA

SEQ ID NO: 32186 - protein, 9 aa, Mycobacterium avium
DPKSNVRHT

SEQ ID NO: 32187 - protein, 8 aa, Mycobacterium avium
DPKTGQYL

SEQ ID NO: 32188 - protein, 15 aa, Mycobacterium avium
DPLDGATPSGASSVT

SEQ ID NO: 32189 - protein, 19 aa, Mycobacterium avium
DPLGHPNSEVGADPERPYA

SEQ ID NO: 32190 - protein, 4 aa, Mycobacterium avium
DPLR

SEQ ID NO: 32191 - protein, 8 aa, Mycobacterium avium
DPLSEDDW

SEQ ID NO: 32192 - protein, 6 aa, Mycobacterium avium
DPMPTR

SEQ ID NO: 32193 - protein, 15 aa, Mycobacterium avium
DPMTGAELADTLEKL

SEQ ID NO: 32194 - protein, 8 aa, Mycobacterium avium
DPNAPKHK

SEQ ID NO: 32195 - protein, 16 aa, Mycobacterium avium
DPNPQAAGGAGRLQEA

SEQ ID NO: 32196 - protein, 6 aa, Mycobacterium avium
DPPAAP

SEQ ID NO: 32197 - protein, 7 aa, Mycobacterium avium
DPPAGDI

SEQ ID NO: 32198 - protein, 10 aa, Mycobacterium avium
DPPDAAQDSL

SEQ ID NO: 32199 - protein, 5 aa, Mycobacterium avium
DPPDH

SEQ ID NO: 32200 - protein, 9 aa, Mycobacterium avium
DPPEHTKAR

SEQ ID NO: 32201 - protein, 7 aa, Mycobacterium avium
DPPPRTG

SEQ ID NO: 32202 - protein, 7 aa, Mycobacterium avium
DPPPTTR

SEQ ID NO: 32203 - protein, 10 aa, Mycobacterium avium
DPPRAGAGRE

SEQ ID NO: 32204 - protein, 16 aa, Mycobacterium avium
DPPRRTPGEPGAHTER

SEQ ID NO: 32205 - protein, 4 aa, Mycobacterium avium
DPPV

SEQ ID NO: 32206 - protein, 10 aa, Mycobacterium avium
DPPVTPEEPL

SEQ ID NO: 32207 - protein, 15 aa, Mycobacterium avium
DPPYPAQAAGFIAGR

SEQ ID NO: 32208 - protein, 9 aa, Mycobacterium avium
DPQAPKRQA

SEQ ID NO: 32209 - protein, 5 aa, Mycobacterium avium
DPQDQ

SEQ ID NO: 32210 - protein, 7 aa, Mycobacterium avium
DPQGAVS

SEQ ID NO: 32211 - protein, 4 aa, Mycobacterium avium
DPQL

SEQ ID NO: 32212 - protein, 6 aa, Mycobacterium avium
DPQPGV

SEQ ID NO: 32213 - protein, 9 aa, Mycobacterium avium
DPQPPFDSG

SEQ ID NO: 32214 - protein, 17 aa, Mycobacterium avium
DPQPRAGRQRPPRPGVH

SEQ ID NO: 32215 - protein, 7 aa, Mycobacterium avium
DPQRPGR

SEQ ID NO: 32216 - protein, 8 aa, Mycobacterium avium
DPQRPGSL

SEQ ID NO: 32217 - protein, 8 aa, Mycobacterium avium
DPQTARPV

SEQ ID NO: 32218 - protein, 6 aa, Mycobacterium avium
DPQVPA

SEQ ID NO: 32219 - protein, 5 aa, Mycobacterium avium
DPQVT

SEQ ID NO: 32220 - protein, 6 aa, Mycobacterium avium
DPQWGR

SEQ ID NO: 32221 - protein, 4 aa, Mycobacterium avium
DPRA

SEQ ID NO: 32222 - protein, 11 aa, Mycobacterium avium
DPRAAVDPSGE

SEQ ID NO: 32223 - protein, 8 aa, Mycobacterium avium
DPRAVPPE

SEQ ID NO: 32224 - protein, 11 aa, Mycobacterium avium
DPRDPAGYQAG

SEQ ID NO: 32225 - protein, 7 aa, Mycobacterium avium
DPRETRD

SEQ ID NO: 32226 - protein, 13 aa, Mycobacterium avium
DPRIGDGGRGYRR

SEQ ID NO: 32227 - protein, 8 aa, Mycobacterium avium
DPRKADQM

SEQ ID NO: 32228 - protein, 4 aa, Mycobacterium avium
DPRL

SEQ ID NO: 32229 - protein, 14 aa, Mycobacterium avium
DPRLPQVPATPEQI

SEQ ID NO: 32230 - protein, 6 aa, Mycobacterium avium
DPRPSV

SEQ ID NO: 32231 - protein, 7 aa, Mycobacterium avium
DPRQYPE

SEQ ID NO: 32232 - protein, 6 aa, Mycobacterium avium
DPRRDA

SEQ ID NO: 32233 - protein, 6 aa, Mycobacterium avium
DPRRGT

SEQ ID NO: 32234 - protein, 5 aa, Mycobacterium avium
DPRSE

SEQ ID NO: 32235 - protein, 8 aa, Mycobacterium avium
DPRSGPAV

SEQ ID NO: 32236 - protein, 9 aa, Mycobacterium avium
DPRSPRPRR

SEQ ID NO: 32237 - protein, 6 aa, Mycobacterium avium
DPRTAA

SEQ ID NO: 32238 - protein, 21 aa, Mycobacterium avium
DPRTGAHTPDVDDPYYGDSKD

SEQ ID NO: 32239 - protein, 8 aa, Mycobacterium avium
DPRTSALR

SEQ ID NO: 32240 - protein, 6 aa, Mycobacterium avium
DPRTVN

SEQ ID NO: 32241 - protein, 5 aa, Mycobacterium avium
DPSDT

SEQ ID NO: 32242 - protein, 6 aa, Mycobacterium avium
DPSETL

SEQ ID NO: 32243 - protein, 7 aa, Mycobacterium avium
DPSFSEK

SEQ ID NO: 32244 - protein, 5 aa, Mycobacterium avium
DPSGN

SEQ ID NO: 32245 - protein, 21 aa, Mycobacterium avium
DPSIATDESGTRHRSAERAAI

SEQ ID NO: 32246 - protein, 13 aa, Mycobacterium avium
DPSPTNAATARLA

SEQ ID NO: 32247 - protein, 15 aa, Mycobacterium avium
DPSQKADDVSGSGSY

SEQ ID NO: 32248 - protein, 8 aa, Mycobacterium avium
DPSRGRAD

SEQ ID NO: 32249 - protein, 12 aa, Mycobacterium avium
DPSSTRTGGSIL

SEQ ID NO: 32250 - protein, 8 aa, Mycobacterium avium
DPSTGAVQ

SEQ ID NO: 32251 - protein, 7 aa, Mycobacterium avium
DPSVPCG

SEQ ID NO: 32252 - protein, 10 aa, Mycobacterium avium
DPTAPGNAAM

SEQ ID NO: 32253 - protein, 7 aa, Mycobacterium avium
DPTAPSL

SEQ ID NO: 32254 - protein, 5 aa, Mycobacterium avium
DPTFD

SEQ ID NO: 32255 - protein, 6 aa, Mycobacterium avium
DPTGIE

SEQ ID NO: 32256 - protein, 8 aa, Mycobacterium avium
DPTHKQSR

SEQ ID NO: 32257 - protein, 12 aa, Mycobacterium avium
DPTLDPWRPPGD

SEQ ID NO: 32258 - protein, 6 aa, Mycobacterium avium
DPTLQP

SEQ ID NO: 32259 - protein, 7 aa, Mycobacterium avium
DPTLRDE

SEQ ID NO: 32260 - protein, 9 aa, Mycobacterium avium
DPTNDAEIT

SEQ ID NO: 32261 - protein, 6 aa, Mycobacterium avium
DPTPVA

SEQ ID NO: 32262 - protein, 6 aa, Mycobacterium avium
DPTRAV

SEQ ID NO: 32263 - protein, 5 aa, Mycobacterium avium
DPTRF

SEQ ID NO: 32264 - protein, 5 aa, Mycobacterium avium
DPTRQ

SEQ ID NO: 32265 - protein, 9 aa, Mycobacterium avium
DPTTDADKL

SEQ ID NO: 32266 - protein, 4 aa, Mycobacterium avium
DPTV

SEQ ID NO: 32267 - protein, 8 aa, Mycobacterium avium
DPTVGPVD

SEQ ID NO: 32268 - protein, 5 aa, Mycobacterium avium
DPTVK

SEQ ID NO: 32269 - protein, 12 aa, Mycobacterium avium
DPTVKGGTSNPW

SEQ ID NO: 32270 - protein, 5 aa, Mycobacterium avium
DPTVS

SEQ ID NO: 32271 - protein, 26 aa, Mycobacterium avium
DPVDPAQLADSARNAPLTRPRPGHAD

SEQ ID NO: 32272 - protein, 6 aa, Mycobacterium avium
DPVKPS

SEQ ID NO: 32273 - protein, 5 aa, Mycobacterium avium
DPVPE

SEQ ID NO: 32274 - protein, 6 aa, Mycobacterium avium
DPVPQF

SEQ ID NO: 32275 - protein, 5 aa, Mycobacterium avium
DPVPT

SEQ ID NO: 32276 - protein, 8 aa, Mycobacterium avium
DPVRATSD

SEQ ID NO: 32277 - protein, 4 aa, Mycobacterium avium
DPWT

SEQ ID NO: 32278 - protein, 8 aa, Mycobacterium avium
DPYPTPGH

SEQ ID NO: 32279 - protein, 5 aa, Mycobacterium avium
DPYQV

SEQ ID NO: 32280 - protein, 10 aa, Mycobacterium avium
DQAAAAGHSL

SEQ ID NO: 32281 - protein, 5 aa, Mycobacterium avium
DQAAE

SEQ ID NO: 32282 - protein, 9 aa, Mycobacterium avium
DQAAESERM

SEQ ID NO: 32283 - protein, 12 aa, Mycobacterium avium
DQADRDGVRPTG

SEQ ID NO: 32284 - protein, 12 aa, Mycobacterium avium
DQAEPIPDDADF

SEQ ID NO: 32285 - protein, 8 aa, Mycobacterium avium
DQAERDEL

SEQ ID NO: 32286 - protein, 5 aa, Mycobacterium avium
DQAHS

SEQ ID NO: 32287 - protein, 6 aa, Mycobacterium avium
DQAIDY

SEQ ID NO: 32288 - protein, 10 aa, Mycobacterium avium
DQAKRAQDAG

SEQ ID NO: 32289 - protein, 8 aa, Mycobacterium avium
DQALRSAA

SEQ ID NO: 32290 - protein, 5 aa, Mycobacterium avium
DQAQR

SEQ ID NO: 32291 - protein, 5 aa, Mycobacterium avium
DQATA

SEQ ID NO: 32292 - protein, 19 aa, Mycobacterium avium
DQATAAGDTAKATEYNNAA

SEQ ID NO: 32293 - protein, 6 aa, Mycobacterium avium
DQDSGE

SEQ ID NO: 32294 - protein, 4 aa, Mycobacterium avium
DQED

SEQ ID NO: 32295 - protein, 11 aa, Mycobacterium avium
DQERGLSAGEK

SEQ ID NO: 32296 - protein, 12 aa, Mycobacterium avium
DQGDRANLPPGH

SEQ ID NO: 32297 - protein, 4 aa, Mycobacterium avium
DQGG

SEQ ID NO: 32298 - protein, 21 aa, Mycobacterium avium
DQGTRKVRDHPDFPAAAAGLG

SEQ ID NO: 32299 - protein, 7 aa, Mycobacterium avium
DQGTTST

SEQ ID NO: 32300 - protein, 6 aa, Mycobacterium avium
DQGVSA

SEQ ID NO: 32301 - protein, 6 aa, Mycobacterium avium
DQIAPE

SEQ ID NO: 32302 - protein, 6 aa, Mycobacterium avium
DQIEPG

SEQ ID NO: 32303 - protein, 28 aa, Mycobacterium avium
DQLAPGERCAATSNRNFEGRQGKGGRTH

SEQ ID NO: 32304 - protein, 8 aa, Mycobacterium avium
DQLPSTHP

SEQ ID NO: 32305 - protein, 5 aa, Mycobacterium avium
DQLSA

SEQ ID NO: 32306 - protein, 4 aa, Mycobacterium avium
DQNL

SEQ ID NO: 32307 - protein, 14 aa, Mycobacterium avium
DQNQPPGSRDIPDN

SEQ ID NO: 32308 - protein, 7 aa, Mycobacterium avium
DQNQQRV

SEQ ID NO: 32309 - protein, 6 aa, Mycobacterium avium
DQPALE

SEQ ID NO: 32310 - protein, 6 aa, Mycobacterium avium
DQPELQ

SEQ ID NO: 32311 - protein, 5 aa, Mycobacterium avium
DQPGL

SEQ ID NO: 32312 - protein, 9 aa, Mycobacterium avium
DQPLADTAN

SEQ ID NO: 32313 - protein, 5 aa, Mycobacterium avium
DQPMP

SEQ ID NO: 32314 - protein, 12 aa, Mycobacterium avium
DQPNLGGSGGYS

SEQ ID NO: 32315 - protein, 9 aa, Mycobacterium avium
DQPSSSALT

SEQ ID NO: 32316 - protein, 5 aa, Mycobacterium avium
DQPWM

SEQ ID NO: 32317 - protein, 6 aa, Mycobacterium avium
DQQERN

SEQ ID NO: 32318 - protein, 7 aa, Mycobacterium avium
DQQRETA

SEQ ID NO: 32319 - protein, 4 aa, Mycobacterium avium
DQQV

SEQ ID NO: 32320 - protein, 5 aa, Mycobacterium avium
DQRGA

SEQ ID NO: 32321 - protein, 14 aa, Mycobacterium avium
DQRGYGGSDRPDAV

SEQ ID NO: 32322 - protein, 14 aa, Mycobacterium avium
DQRPGTKKCGHQGG

SEQ ID NO: 32323 - protein, 8 aa, Mycobacterium avium
DQRTNACA

SEQ ID NO: 32324 - protein, 6 aa, Mycobacterium avium
DQRTVD

SEQ ID NO: 32325 - protein, 8 aa, Mycobacterium avium
DQSDADGL

SEQ ID NO: 32326 - protein, 8 aa, Mycobacterium avium
DQSEGSGP

SEQ ID NO: 32327 - protein, 6 aa, Mycobacterium avium
DQSERM

SEQ ID NO: 32328 - protein, 6 aa, Mycobacterium avium
DQSPTA

SEQ ID NO: 32329 - protein, 11 aa, Mycobacterium avium
DQVADYAKRKG

SEQ ID NO: 32330 - protein, 20 aa, Mycobacterium avium
DQVDDERLGRPRADAGVGPR

SEQ ID NO: 32331 - protein, 18 aa, Mycobacterium avium
DQVGNRALGDRPSQNLTA

SEQ ID NO: 32332 - protein, 12 aa, Mycobacterium avium
DQVSADVTAGEY

SEQ ID NO: 32333 - protein, 7 aa, Mycobacterium avium
DQYRSTN

SEQ ID NO: 32334 - protein, 8 aa, Mycobacterium avium
DQYTGGAS

SEQ ID NO: 32335 - protein, 26 aa, Mycobacterium avium
DQYYSPDFGQATGAAVPLDDYGYSDY

SEQ ID NO: 32336 - protein, 7 aa, Mycobacterium avium
DRADGTT

SEQ ID NO: 32337 - protein, 9 aa, Mycobacterium avium
DRADWSERD

SEQ ID NO: 32338 - protein, 4 aa, Mycobacterium avium
DRAG

SEQ ID NO: 32339 - protein, 8 aa, Mycobacterium avium
DRAGRATG

SEQ ID NO: 32340 - protein, 6 aa, Mycobacterium avium
DRAGTI

SEQ ID NO: 32341 - protein, 7 aa, Mycobacterium avium
DRAGVSK

SEQ ID NO: 32342 - protein, 10 aa, Mycobacterium avium
DRAKNPGEDL

SEQ ID NO: 32343 - protein, 4 aa, Mycobacterium avium
DRAP

SEQ ID NO: 32344 - protein, 8 aa, Mycobacterium avium
DRAPITGA

SEQ ID NO: 32345 - protein, 7 aa, Mycobacterium avium
DRAPLTP

SEQ ID NO: 32346 - protein, 7 aa, Mycobacterium avium
DRAQREL

SEQ ID NO: 32347 - protein, 8 aa, Mycobacterium avium
DRARELRE

SEQ ID NO: 32348 - protein, 8 aa, Mycobacterium avium
DRASSPLT

SEQ ID NO: 32349 - protein, 20 aa, Mycobacterium avium
DRATGSKARFRTSPAFDGEA

SEQ ID NO: 32350 - protein, 13 aa, Mycobacterium avium
DRATKQTFTDSER

SEQ ID NO: 32351 - protein, 9 aa, Mycobacterium avium
DRAVSDDRH

SEQ ID NO: 32352 - protein, 7 aa, Mycobacterium avium
DRDDSAS

SEQ ID NO: 32353 - protein, 5 aa, Mycobacterium avium
DRDEQ

SEQ ID NO: 32354 - protein, 7 aa, Mycobacterium avium
DRDGDGL

SEQ ID NO: 32355 - protein, 5 aa, Mycobacterium avium
DRDGG

SEQ ID NO: 32356 - protein, 6 aa, Mycobacterium avium
DRDGSD

SEQ ID NO: 32357 - protein, 12 aa, Mycobacterium avium
DRDGSVTQGGYS

SEQ ID NO: 32358 - protein, 6 aa, Mycobacterium avium
DRDGTR

SEQ ID NO: 32359 - protein, 7 aa, Mycobacterium avium
DRDGVSV

SEQ ID NO: 32360 - protein, 7 aa, Mycobacterium avium
DRDHPAV

SEQ ID NO: 32361 - protein, 12 aa, Mycobacterium avium
DRDKAQAKGSKD

SEQ ID NO: 32362 - protein, 5 aa, Mycobacterium avium
DRDPE

SEQ ID NO: 32363 - protein, 4 aa, Mycobacterium avium
DRDQ

SEQ ID NO: 32364 - protein, 4 aa, Mycobacterium avium
DRDS

SEQ ID NO: 32365 - protein, 5 aa, Mycobacterium avium
DREAM

SEQ ID NO: 32366 - protein, 14 aa, Mycobacterium avium
DREDQPYKESYGMA

SEQ ID NO: 32367 - protein, 6 aa, Mycobacterium avium
DREGRA

SEQ ID NO: 32368 - protein, 9 aa, Mycobacterium avium
DREKHGALR

SEQ ID NO: 32369 - protein, 9 aa, Mycobacterium avium
DREPLNDTE

SEQ ID NO: 32370 - protein, 8 aa, Mycobacterium avium
DREQRPRS

SEQ ID NO: 32371 - protein, 4 aa, Mycobacterium avium
DRGA

SEQ ID NO: 32372 - protein, 10 aa, Mycobacterium avium
DRGAGGEVQL

SEQ ID NO: 32373 - protein, 16 aa, Mycobacterium avium
DRGDRSVTLRPEGTAG

SEQ ID NO: 32374 - protein, 19 aa, Mycobacterium avium
DRGESGRRGPNPDTFDYIP

SEQ ID NO: 32375 - protein, 5 aa, Mycobacterium avium
DRGGT

SEQ ID NO: 32376 - protein, 4 aa, Mycobacterium avium
DRGI

SEQ ID NO: 32377 - protein, 8 aa, Mycobacterium avium
DRGLTERR

SEQ ID NO: 32378 - protein, 7 aa, Mycobacterium avium
DRGNSYL

SEQ ID NO: 32379 - protein, 7 aa, Mycobacterium avium
DRGPRVG

SEQ ID NO: 32380 - protein, 11 aa, Mycobacterium avium
DRGQDSARRSF

SEQ ID NO: 32381 - protein, 11 aa, Mycobacterium avium
DRGQGGGRTAR

SEQ ID NO: 32382 - protein, 4 aa, Mycobacterium avium
DRGR

SEQ ID NO: 32383 - protein, 5 aa, Mycobacterium avium
DRGRD

SEQ ID NO: 32384 - protein, 9 aa, Mycobacterium avium
DRGREAHQK

SEQ ID NO: 32385 - protein, 9 aa, Mycobacterium avium
DRGSDGQWR

SEQ ID NO: 32386 - protein, 6 aa, Mycobacterium avium
DRGSSV

SEQ ID NO: 32387 - protein, 6 aa, Mycobacterium avium
DRHGQR

SEQ ID NO: 32388 - protein, 4 aa, Mycobacterium avium
DRHN

SEQ ID NO: 32389 - protein, 6 aa, Mycobacterium avium
DRIPGA

SEQ ID NO: 32390 - protein, 8 aa, Mycobacterium avium
DRKSGRFS

SEQ ID NO: 32391 - protein, 17 aa, Mycobacterium avium
DRLAVQGRKDAKLQKRL

SEQ ID NO: 32392 - protein, 8 aa, Mycobacterium avium
DRNDDGLA

SEQ ID NO: 32393 - protein, 8 aa, Mycobacterium avium
DRNGCPTV

SEQ ID NO: 32394 - protein, 7 aa, Mycobacterium avium
DRNITAG

SEQ ID NO: 32395 - protein, 6 aa, Mycobacterium avium
DRNPLH

SEQ ID NO: 32396 - protein, 4 aa, Mycobacterium avium
DRNQ

SEQ ID NO: 32397 - protein, 4 aa, Mycobacterium avium
DRNR

SEQ ID NO: 32398 - protein, 6 aa, Mycobacterium avium
DRPAQR

SEQ ID NO: 32399 - protein, 6 aa, Mycobacterium avium
DRPATE

SEQ ID NO: 32400 - protein, 8 aa, Mycobacterium avium
DRPDDAVR

SEQ ID NO: 32401 - protein, 9 aa, Mycobacterium avium
DRPDIQQQL

SEQ ID NO: 32402 - protein, 5 aa, Mycobacterium avium
DRPDV

SEQ ID NO: 32403 - protein, 6 aa, Mycobacterium avium
DRPGAL

SEQ ID NO: 32404 - protein, 5 aa, Mycobacterium avium
DRPGR

SEQ ID NO: 32405 - protein, 7 aa, Mycobacterium avium
DRPHPRG

SEQ ID NO: 32406 - protein, 12 aa, Mycobacterium avium
DRPISKADAVEG

SEQ ID NO: 32407 - protein, 7 aa, Mycobacterium avium
DRPLHGT

SEQ ID NO: 32408 - protein, 8 aa, Mycobacterium avium
DRPNRGRR

SEQ ID NO: 32409 - protein, 7 aa, Mycobacterium avium
DRPPLSK

SEQ ID NO: 32410 - protein, 12 aa, Mycobacterium avium
DRPPQTNEVGRS

SEQ ID NO: 32411 - protein, 11 aa, Mycobacterium avium
DRPPTAGESAT

SEQ ID NO: 32412 - protein, 10 aa, Mycobacterium avium
DRPSGAPGGV

SEQ ID NO: 32413 - protein, 9 aa, Mycobacterium avium
DRPSGGRIE

SEQ ID NO: 32414 - protein, 4 aa, Mycobacterium avium
DRPT

SEQ ID NO: 32415 - protein, 14 aa, Mycobacterium avium
DRQARDDLESNSKE

SEQ ID NO: 32416 - protein, 15 aa, Mycobacterium avium
DRQEVDNALNQAAKE

SEQ ID NO: 32417 - protein, 6 aa, Mycobacterium avium
DRQGRV

SEQ ID NO: 32418 - protein, 13 aa, Mycobacterium avium
DRQLPSEGTTRGA

SEQ ID NO: 32419 - protein, 20 aa, Mycobacterium avium
DRQRLAQEESERINARLAVL

SEQ ID NO: 32420 - protein, 6 aa, Mycobacterium avium
DRRDDF

SEQ ID NO: 32421 - protein, 7 aa, Mycobacterium avium
DRRDIPD

SEQ ID NO: 32422 - protein, 5 aa, Mycobacterium avium
DRRGD

SEQ ID NO: 32423 - protein, 6 aa, Mycobacterium avium
DRRGND

SEQ ID NO: 32424 - protein, 7 aa, Mycobacterium avium
DRRQRAK

SEQ ID NO: 32425 - protein, 5 aa, Mycobacterium avium
DRRRG

SEQ ID NO: 32426 - protein, 19 aa, Mycobacterium avium
DRRRRGERSGEGGDAELRE

SEQ ID NO: 32427 - protein, 4 aa, Mycobacterium avium
DRRS

SEQ ID NO: 32428 - protein, 8 aa, Mycobacterium avium
DRRSTQGN

SEQ ID NO: 32429 - protein, 5 aa, Mycobacterium avium
DRRTT

SEQ ID NO: 32430 - protein, 8 aa, Mycobacterium avium
DRRVAPSA

SEQ ID NO: 32431 - protein, 17 aa, Mycobacterium avium
DRSASVDREALWRLTAA

SEQ ID NO: 32432 - protein, 6 aa, Mycobacterium avium
DRSDRV

SEQ ID NO: 32433 - protein, 5 aa, Mycobacterium avium
DRSER

SEQ ID NO: 32434 - protein, 4 aa, Mycobacterium avium
DRSG

SEQ ID NO: 32435 - protein, 5 aa, Mycobacterium avium
DRSGQ

SEQ ID NO: 32436 - protein, 6 aa, Mycobacterium avium
DRSGRF

SEQ ID NO: 32437 - protein, 7 aa, Mycobacterium avium
DRSPEQL

SEQ ID NO: 32438 - protein, 7 aa, Mycobacterium avium
DRSRGDK

SEQ ID NO: 32439 - protein, 8 aa, Mycobacterium avium
DRSRHDPR

SEQ ID NO: 32440 - protein, 10 aa, Mycobacterium avium
DRSRKVAEGR

SEQ ID NO: 32441 - protein, 5 aa, Mycobacterium avium
DRSRR

SEQ ID NO: 32442 - protein, 12 aa, Mycobacterium avium
DRSSDTAPSPNY

SEQ ID NO: 32443 - protein, 5 aa, Mycobacterium avium
DRSSS

SEQ ID NO: 32444 - protein, 5 aa, Mycobacterium avium
DRSVP

SEQ ID NO: 32445 - protein, 10 aa, Mycobacterium avium
DRSYRRPRPV

SEQ ID NO: 32446 - protein, 6 aa, Mycobacterium avium
DRTDGD

SEQ ID NO: 32447 - protein, 8 aa, Mycobacterium avium
DRTGALSP

SEQ ID NO: 32448 - protein, 34 aa, Mycobacterium avium
DRTPAPAETVPAKPRTRRGKAAQPEEPDPQAAAT

SEQ ID NO: 32449 - protein, 9 aa, Mycobacterium avium
DRTPHPNSV

SEQ ID NO: 32450 - protein, 7 aa, Mycobacterium avium
DRTPREL

SEQ ID NO: 32451 - protein, 8 aa, Mycobacterium avium
DRTPTADR

SEQ ID NO: 32452 - protein, 9 aa, Mycobacterium avium
DRTRAQRPE

SEQ ID NO: 32453 - protein, 10 aa, Mycobacterium avium
DRTTQRGNGS

SEQ ID NO: 32454 - protein, 10 aa, Mycobacterium avium
DRTYKPPPDA

SEQ ID NO: 32455 - protein, 16 aa, Mycobacterium avium
DRTYTTPDGQGELTLP

SEQ ID NO: 32456 - protein, 5 aa, Mycobacterium avium
DRVDE

SEQ ID NO: 32457 - protein, 8 aa, Mycobacterium avium
DRVEAGAQ

SEQ ID NO: 32458 - protein, 11 aa, Mycobacterium avium
DRVGGRSFTGS

SEQ ID NO: 32459 - protein, 7 aa, Mycobacterium avium
DRVSPPD

SEQ ID NO: 32460 - protein, 5 aa, Mycobacterium avium
DRVTH

SEQ ID NO: 32461 - protein, 8 aa, Mycobacterium avium
DRYTPTPA

SEQ ID NO: 32462 - protein, 7 aa, Mycobacterium avium
DSAADYA

SEQ ID NO: 32463 - protein, 7 aa, Mycobacterium avium
DSAEGRV

SEQ ID NO: 32464 - protein, 6 aa, Mycobacterium avium
DSAGGH

SEQ ID NO: 32465 - protein, 8 aa, Mycobacterium avium
DSAGGSLA

SEQ ID NO: 32466 - protein, 6 aa, Mycobacterium avium
DSAGGY

SEQ ID NO: 32467 - protein, 13 aa, Mycobacterium avium
DSAGNISKRQSAT

SEQ ID NO: 32468 - protein, 12 aa, Mycobacterium avium
DSAKADDLAATP

SEQ ID NO: 32469 - protein, 9 aa, Mycobacterium avium
DSAPSGAAA

SEQ ID NO: 32470 - protein, 5 aa, Mycobacterium avium
DSASN

SEQ ID NO: 32471 - protein, 7 aa, Mycobacterium avium
DSASVEH

SEQ ID NO: 32472 - protein, 10 aa, Mycobacterium avium
DSAWPGRSTH

SEQ ID NO: 32473 - protein, 19 aa, Mycobacterium avium
DSAYEYEKTHSPAESWPPT

SEQ ID NO: 32474 - protein, 8 aa, Mycobacterium avium
DSAYSSEK

SEQ ID NO: 32475 - protein, 6 aa, Mycobacterium avium
DSCDSA

SEQ ID NO: 32476 - protein, 9 aa, Mycobacterium avium
DSDAGEPQL

SEQ ID NO: 32477 - protein, 6 aa, Mycobacterium avium
DSDDHA

SEQ ID NO: 32478 - protein, 10 aa, Mycobacterium avium
DSDEIPEDGA

SEQ ID NO: 32479 - protein, 11 aa, Mycobacterium avium
DSDGHADKRTR

SEQ ID NO: 32480 - protein, 8 aa, Mycobacterium avium
DSDGQAVG

SEQ ID NO: 32481 - protein, 5 aa, Mycobacterium avium
DSDPF

SEQ ID NO: 32482 - protein, 7 aa, Mycobacterium avium
DSDRAGL

SEQ ID NO: 32483 - protein, 9 aa, Mycobacterium avium
DSDRDTARD

SEQ ID NO: 32484 - protein, 6 aa, Mycobacterium avium
DSDSFN

SEQ ID NO: 32485 - protein, 12 aa, Mycobacterium avium
DSDSMEISCRTS

SEQ ID NO: 32486 - protein, 6 aa, Mycobacterium avium
DSDTGA

SEQ ID NO: 32487 - protein, 8 aa, Mycobacterium avium
DSEADGTA

SEQ ID NO: 32488 - protein, 9 aa, Mycobacterium avium
DSEAPGGGP

SEQ ID NO: 32489 - protein, 10 aa, Mycobacterium avium
DSEPPDSLAE

SEQ ID NO: 32490 - protein, 13 aa, Mycobacterium avium
DSESGNGRLKSER

SEQ ID NO: 32491 - protein, 5 aa, Mycobacterium avium
DSFDE

SEQ ID NO: 32492 - protein, 6 aa, Mycobacterium avium
DSGDDA

SEQ ID NO: 32493 - protein, 8 aa, Mycobacterium avium
DSGDRYAD

SEQ ID NO: 32494 - protein, 5 aa, Mycobacterium avium
DSGDW

SEQ ID NO: 32495 - protein, 11 aa, Mycobacterium avium
DSGEAPAGASA

SEQ ID NO: 32496 - protein, 8 aa, Mycobacterium avium
DSGGARIQ

SEQ ID NO: 32497 - protein, 8 aa, Mycobacterium avium
DSGSRMSR

SEQ ID NO: 32498 - protein, 8 aa, Mycobacterium avium
DSGTAPSM

SEQ ID NO: 32499 - protein, 5 aa, Mycobacterium avium
DSGYG

SEQ ID NO: 32500 - protein, 14 aa, Mycobacterium avium
DSHEVTRAGEPISL

SEQ ID NO: 32501 - protein, 4 aa, Mycobacterium avium
DSHK

SEQ ID NO: 32502 - protein, 16 aa, Mycobacterium avium
DSHVTGPAGPGHPTGG

SEQ ID NO: 32503 - protein, 7 aa, Mycobacterium avium
DSIAREE

SEQ ID NO: 32504 - protein, 6 aa, Mycobacterium avium
DSIQQG

SEQ ID NO: 32505 - protein, 11 aa, Mycobacterium avium
DSKATNPHAAE

SEQ ID NO: 32506 - protein, 5 aa, Mycobacterium avium
DSKLE

SEQ ID NO: 32507 - protein, 6 aa, Mycobacterium avium
DSLQDK

SEQ ID NO: 32508 - protein, 7 aa, Mycobacterium avium
DSLSPTY

SEQ ID NO: 32509 - protein, 4 aa, Mycobacterium avium
DSMT

SEQ ID NO: 32510 - protein, 20 aa, Mycobacterium avium
DSNAYGPAQLDGGPLHATRG

SEQ ID NO: 32511 - protein, 19 aa, Mycobacterium avium
DSNGSDGNGDAPELNGGSS

SEQ ID NO: 32512 - protein, 6 aa, Mycobacterium avium
DSNKTQ

SEQ ID NO: 32513 - protein, 4 aa, Mycobacterium avium
DSNY

SEQ ID NO: 32514 - protein, 16 aa, Mycobacterium avium
DSPEKRRSLGRAGRTR

SEQ ID NO: 32515 - protein, 7 aa, Mycobacterium avium
DSPEQLA

SEQ ID NO: 32516 - protein, 7 aa, Mycobacterium avium
DSPGITV

SEQ ID NO: 32517 - protein, 9 aa, Mycobacterium avium
DSPKPPPQR

SEQ ID NO: 32518 - protein, 8 aa, Mycobacterium avium
DSPLAERR

SEQ ID NO: 32519 - protein, 5 aa, Mycobacterium avium
DSPLS

SEQ ID NO: 32520 - protein, 6 aa, Mycobacterium avium
DSPNSA

SEQ ID NO: 32521 - protein, 5 aa, Mycobacterium avium
DSPPA

SEQ ID NO: 32522 - protein, 9 aa, Mycobacterium avium
DSPQPATYD

SEQ ID NO: 32523 - protein, 7 aa, Mycobacterium avium
DSPTQLV

SEQ ID NO: 32524 - protein, 5 aa, Mycobacterium avium
DSPVG

SEQ ID NO: 32525 - protein, 5 aa, Mycobacterium avium
DSPYE

SEQ ID NO: 32526 - protein, 11 aa, Mycobacterium avium
DSQAAESAEPR

SEQ ID NO: 32527 - protein, 11 aa, Mycobacterium avium
DSQRPWKDEPS

SEQ ID NO: 32528 - protein, 8 aa, Mycobacterium avium
DSQTEGLW

SEQ ID NO: 32529 - protein, 4 aa, Mycobacterium avium
DSRA

SEQ ID NO: 32530 - protein, 22 aa, Mycobacterium avium
DSRDAAGSGADRHANFGTGQID

SEQ ID NO: 32531 - protein, 11 aa, Mycobacterium avium
DSRESFGDNGL

SEQ ID NO: 32532 - protein, 13 aa, Mycobacterium avium
DSRGCGRSEGTGN

SEQ ID NO: 32533 - protein, 8 aa, Mycobacterium avium
DSRGNPTV

SEQ ID NO: 32534 - protein, 9 aa, Mycobacterium avium
DSRRSFSTT

SEQ ID NO: 32535 - protein, 9 aa, Mycobacterium avium
DSRTGEMDK

SEQ ID NO: 32536 - protein, 6 aa, Mycobacterium avium
DSRYGS

SEQ ID NO: 32537 - protein, 4 aa, Mycobacterium avium
DSSA

SEQ ID NO: 32538 - protein, 6 aa, Mycobacterium avium
DSSANR

SEQ ID NO: 32539 - protein, 17 aa, Mycobacterium avium
DSSEYDDEAAGLTDEQL

SEQ ID NO: 32540 - protein, 6 aa, Mycobacterium avium
DSSGDW

SEQ ID NO: 32541 - protein, 32 aa, Mycobacterium avium
DSSGRHLKPGSLARKPTRPPPAVPPCPGPLGQ

SEQ ID NO: 32542 - protein, 10 aa, Mycobacterium avium
DSSPDGTGRL

SEQ ID NO: 32543 - protein, 6 aa, Mycobacterium avium
DSSPEM

SEQ ID NO: 32544 - protein, 7 aa, Mycobacterium avium
DSSPRSS

SEQ ID NO: 32545 - protein, 8 aa, Mycobacterium avium
DSSRSAEQ

SEQ ID NO: 32546 - protein, 5 aa, Mycobacterium avium
DSTAF

SEQ ID NO: 32547 - protein, 11 aa, Mycobacterium avium
DSTGADYDTAL

SEQ ID NO: 32548 - protein, 5 aa, Mycobacterium avium
DSTGG

SEQ ID NO: 32549 - protein, 10 aa, Mycobacterium avium
DSTGLPDSPV

SEQ ID NO: 32550 - protein, 9 aa, Mycobacterium avium
DSTLSRDDG

SEQ ID NO: 32551 - protein, 7 aa, Mycobacterium avium
DSTQSAK

SEQ ID NO: 32552 - protein, 8 aa, Mycobacterium avium
DSTSRRPF

SEQ ID NO: 32553 - protein, 19 aa, Mycobacterium avium
DSTTLSGSAINAARTQARQ

SEQ ID NO: 32554 - protein, 7 aa, Mycobacterium avium
DSTVPDA

SEQ ID NO: 32555 - protein, 11 aa, Mycobacterium avium
DSVASEDEYDE

SEQ ID NO: 32556 - protein, 6 aa, Mycobacterium avium
DSVDDA

SEQ ID NO: 32557 - protein, 19 aa, Mycobacterium avium
DSVRAKDEALQRLHGKVTG

SEQ ID NO: 32558 - protein, 5 aa, Mycobacterium avium
DSVRG

SEQ ID NO: 32559 - protein, 9 aa, Mycobacterium avium
DSVRGEDNL

SEQ ID NO: 32560 - protein, 6 aa, Mycobacterium avium
DSVSER

SEQ ID NO: 32561 - protein, 12 aa, Mycobacterium avium
DSVTKSKFDNKY

SEQ ID NO: 32562 - protein, 7 aa, Mycobacterium avium
DSVTQAA

SEQ ID NO: 32563 - protein, 12 aa, Mycobacterium avium
DSYAENANLREA

SEQ ID NO: 32564 - protein, 6 aa, Mycobacterium avium
DSYGPY

SEQ ID NO: 32565 - protein, 6 aa, Mycobacterium avium
DSYLTP

SEQ ID NO: 32566 - protein, 23 aa, Mycobacterium avium
DTAAEIGAADGDAVTVSTPRGSI

SEQ ID NO: 32567 - protein, 9 aa, Mycobacterium avium
DTADITDRE

SEQ ID NO: 32568 - protein, 4 aa, Mycobacterium avium
DTAE

SEQ ID NO: 32569 - protein, 5 aa, Mycobacterium avium
DTAGY

SEQ ID NO: 32570 - protein, 23 aa, Mycobacterium avium
DTAHETRVEGAADPLDAQGAGDQ

SEQ ID NO: 32571 - protein, 11 aa, Mycobacterium avium
DTAKEKPQEGT

SEQ ID NO: 32572 - protein, 5 aa, Mycobacterium avium
DTALG

SEQ ID NO: 32573 - protein, 4 aa, Mycobacterium avium
DTAP

SEQ ID NO: 32574 - protein, 5 aa, Mycobacterium avium
DTAQA

SEQ ID NO: 32575 - protein, 7 aa, Mycobacterium avium
DTARRQL

SEQ ID NO: 32576 - protein, 13 aa, Mycobacterium avium
DTASCADDPAESL

SEQ ID NO: 32577 - protein, 8 aa, Mycobacterium avium
DTASESLH

SEQ ID NO: 32578 - protein, 5 aa, Mycobacterium avium
DTAYD

SEQ ID NO: 32579 - protein, 7 aa, Mycobacterium avium
DTDADVR

SEQ ID NO: 32580 - protein, 6 aa, Mycobacterium avium
DTDAGA

SEQ ID NO: 32581 - protein, 7 aa, Mycobacterium avium
DTDAPEQ

SEQ ID NO: 32582 - protein, 6 aa, Mycobacterium avium
DTDAVA

SEQ ID NO: 32583 - protein, 11 aa, Mycobacterium avium
DTDDATARDQL

SEQ ID NO: 32584 - protein, 7 aa, Mycobacterium avium
DTDGAGV

SEQ ID NO: 32585 - protein, 6 aa, Mycobacterium avium
DTDGAV

SEQ ID NO: 32586 - protein, 7 aa, Mycobacterium avium
DTDGDSY

SEQ ID NO: 32587 - protein, 7 aa, Mycobacterium avium
DTDGDWP

SEQ ID NO: 32588 - protein, 5 aa, Mycobacterium avium
DTDGK

SEQ ID NO: 32589 - protein, 9 aa, Mycobacterium avium
DTDGTDDQA

SEQ ID NO: 32590 - protein, 5 aa, Mycobacterium avium
DTDGY

SEQ ID NO: 32591 - protein, 8 aa, Mycobacterium avium
DTDIQRAE

SEQ ID NO: 32592 - protein, 9 aa, Mycobacterium avium
DTDKIEANY

SEQ ID NO: 32593 - protein, 7 aa, Mycobacterium avium
DTDNEFP

SEQ ID NO: 32594 - protein, 14 aa, Mycobacterium avium
DTDNPYTPGTGRRA

SEQ ID NO: 32595 - protein, 6 aa, Mycobacterium avium
DTDPDG

SEQ ID NO: 32596 - protein, 6 aa, Mycobacterium avium
DTDPDL

SEQ ID NO: 32597 - protein, 13 aa, Mycobacterium avium
DTDPGWAGGDARR

SEQ ID NO: 32598 - protein, 6 aa, Mycobacterium avium
DTDRTG

SEQ ID NO: 32599 - protein, 5 aa, Mycobacterium avium
DTDSE

SEQ ID NO: 32600 - protein, 10 aa, Mycobacterium avium
DTDTGSPEAQ

SEQ ID NO: 32601 - protein, 8 aa, Mycobacterium avium
DTDTSTRQ

SEQ ID NO: 32602 - protein, 6 aa, Mycobacterium avium
DTEAAI

SEQ ID NO: 32603 - protein, 8 aa, Mycobacterium avium
DTEAEQQL

SEQ ID NO: 32604 - protein, 6 aa, Mycobacterium avium
DTEEDA

SEQ ID NO: 32605 - protein, 8 aa, Mycobacterium avium
DTEEGPDA

SEQ ID NO: 32606 - protein, 4 aa, Mycobacterium avium
DTEN

SEQ ID NO: 32607 - protein, 4 aa, Mycobacterium avium
DTEP

SEQ ID NO: 32608 - protein, 6 aa, Mycobacterium avium
DTEPYH

SEQ ID NO: 32609 - protein, 12 aa, Mycobacterium avium
DTESFTAADGPL

SEQ ID NO: 32610 - protein, 6 aa, Mycobacterium avium
DTFSAA

SEQ ID NO: 32611 - protein, 14 aa, Mycobacterium avium
DTGADLDKTNVNGG

SEQ ID NO: 32612 - protein, 6 aa, Mycobacterium avium
DTGAGD

SEQ ID NO: 32613 - protein, 8 aa, Mycobacterium avium
DTGDTPTI

SEQ ID NO: 32614 - protein, 12 aa, Mycobacterium avium
DTGFGEDPATLA

SEQ ID NO: 32615 - protein, 7 aa, Mycobacterium avium
DTGGAVD

SEQ ID NO: 32616 - protein, 5 aa, Mycobacterium avium
DTGGF

SEQ ID NO: 32617 - protein, 6 aa, Mycobacterium avium
DTGHDA

SEQ ID NO: 32618 - protein, 9 aa, Mycobacterium avium
DTGHGGDPH

SEQ ID NO: 32619 - protein, 10 aa, Mycobacterium avium
DTGIECPEGT

SEQ ID NO: 32620 - protein, 11 aa, Mycobacterium avium
DTGIGRRDQHL

SEQ ID NO: 32621 - protein, 8 aa, Mycobacterium avium
DTGPGDVT

SEQ ID NO: 32622 - protein, 6 aa, Mycobacterium avium
DTGRFD

SEQ ID NO: 32623 - protein, 10 aa, Mycobacterium avium
DTGRQAVDDG

SEQ ID NO: 32624 - protein, 6 aa, Mycobacterium avium
DTGRTN

SEQ ID NO: 32625 - protein, 5 aa, Mycobacterium avium
DTGSP

SEQ ID NO: 32626 - protein, 4 aa, Mycobacterium avium
DTGT

SEQ ID NO: 32627 - protein, 9 aa, Mycobacterium avium
DTGTATADY

SEQ ID NO: 32628 - protein, 7 aa, Mycobacterium avium
DTHAGAD

SEQ ID NO: 32629 - protein, 4 aa, Mycobacterium avium
DTHD

SEQ ID NO: 32630 - protein, 27 aa, Mycobacterium avium
DTIAAPAPKTRRGSGAPFGAGGDPLVD

SEQ ID NO: 32631 - protein, 7 aa, Mycobacterium avium
DTIPGTA

SEQ ID NO: 32632 - protein, 7 aa, Mycobacterium avium
DTIRNGY

SEQ ID NO: 32633 - protein, 6 aa, Mycobacterium avium
DTKAVA

SEQ ID NO: 32634 - protein, 14 aa, Mycobacterium avium
DTKYSSAATPGGQV

SEQ ID NO: 32635 - protein, 5 aa, Mycobacterium avium
DTLRG

SEQ ID NO: 32636 - protein, 5 aa, Mycobacterium avium
DTMEE

SEQ ID NO: 32637 - protein, 4 aa, Mycobacterium avium
DTMM

SEQ ID NO: 32638 - protein, 14 aa, Mycobacterium avium
DTNEPTGRKEGAEP

SEQ ID NO: 32639 - protein, 9 aa, Mycobacterium avium
DTNRRNPGA

SEQ ID NO: 32640 - protein, 7 aa, Mycobacterium avium
DTPAGST

SEQ ID NO: 32641 - protein, 14 aa, Mycobacterium avium
DTPEGAKNALGRTR

SEQ ID NO: 32642 - protein, 6 aa, Mycobacterium avium
DTPERA

SEQ ID NO: 32643 - protein, 6 aa, Mycobacterium avium
DTPESP

SEQ ID NO: 32644 - protein, 10 aa, Mycobacterium avium
DTPGEADYYR

SEQ ID NO: 32645 - protein, 8 aa, Mycobacterium avium
DTPGEHAR

SEQ ID NO: 32646 - protein, 9 aa, Mycobacterium avium
DTPGFGRGR

SEQ ID NO: 32647 - protein, 5 aa, Mycobacterium avium
DTPGY

SEQ ID NO: 32648 - protein, 9 aa, Mycobacterium avium
DTPHTRPVP

SEQ ID NO: 32649 - protein, 8 aa, Mycobacterium avium
DTPQGPQV

SEQ ID NO: 32650 - protein, 12 aa, Mycobacterium avium
DTPRRADGTEPR

SEQ ID NO: 32651 - protein, 5 aa, Mycobacterium avium
DTPRS

SEQ ID NO: 32652 - protein, 7 aa, Mycobacterium avium
DTPTDAS

SEQ ID NO: 32653 - protein, 7 aa, Mycobacterium avium
DTPTDLA

SEQ ID NO: 32654 - protein, 13 aa, Mycobacterium avium
DTQKLSDEAAEEL

SEQ ID NO: 32655 - protein, 7 aa, Mycobacterium avium
DTQNDLP

SEQ ID NO: 32656 - protein, 14 aa, Mycobacterium avium
DTQSAVDREPTTDA

SEQ ID NO: 32657 - protein, 8 aa, Mycobacterium avium
DTQSGDLR

SEQ ID NO: 32658 - protein, 6 aa, Mycobacterium avium
DTQTED

SEQ ID NO: 32659 - protein, 8 aa, Mycobacterium avium
DTRAFDGN

SEQ ID NO: 32660 - protein, 8 aa, Mycobacterium avium
DTRASGQF

SEQ ID NO: 32661 - protein, 14 aa, Mycobacterium avium
DTRAVDNAMPGWIG

SEQ ID NO: 32662 - protein, 6 aa, Mycobacterium avium
DTRDQQ

SEQ ID NO: 32663 - protein, 4 aa, Mycobacterium avium
DTRE

SEQ ID NO: 32664 - protein, 5 aa, Mycobacterium avium
DTREA

SEQ ID NO: 32665 - protein, 12 aa, Mycobacterium avium
DTRKGEAAARTM

SEQ ID NO: 32666 - protein, 10 aa, Mycobacterium avium
DTRKPVPIPD

SEQ ID NO: 32667 - protein, 12 aa, Mycobacterium avium
DTRSVEGAYGFS

SEQ ID NO: 32668 - protein, 6 aa, Mycobacterium avium
DTRTRA

SEQ ID NO: 32669 - protein, 7 aa, Mycobacterium avium
DTSLRGD

SEQ ID NO: 32670 - protein, 7 aa, Mycobacterium avium
DTSNRTH

SEQ ID NO: 32671 - protein, 12 aa, Mycobacterium avium
DTSRASTRAARA

SEQ ID NO: 32672 - protein, 5 aa, Mycobacterium avium
DTSTG

SEQ ID NO: 32673 - protein, 7 aa, Mycobacterium avium
DTSTPDW

SEQ ID NO: 32674 - protein, 9 aa, Mycobacterium avium
DTSTSTTTT

SEQ ID NO: 32675 - protein, 10 aa, Mycobacterium avium
DTSTTGNSAL

SEQ ID NO: 32676 - protein, 4 aa, Mycobacterium avium
DTTA

SEQ ID NO: 32677 - protein, 7 aa, Mycobacterium avium
DTTAEDL

SEQ ID NO: 32678 - protein, 6 aa, Mycobacterium avium
DTTPTE

SEQ ID NO: 32679 - protein, 6 aa, Mycobacterium avium
DTTRGN

SEQ ID NO: 32680 - protein, 7 aa, Mycobacterium avium
DTTSRAA

SEQ ID NO: 32681 - protein, 8 aa, Mycobacterium avium
DTTSRPAR

SEQ ID NO: 32682 - protein, 6 aa, Mycobacterium avium
DTTTAE

SEQ ID NO: 32683 - protein, 6 aa, Mycobacterium avium
DTTTGE

SEQ ID NO: 32684 - protein, 6 aa, Mycobacterium avium
DTTTRT

SEQ ID NO: 32685 - protein, 10 aa, Mycobacterium avium
DTTVGDDQRD

SEQ ID NO: 32686 - protein, 5 aa, Mycobacterium avium
DTTYG

SEQ ID NO: 32687 - protein, 5 aa, Mycobacterium avium
DTVHP

SEQ ID NO: 32688 - protein, 12 aa, Mycobacterium avium
DTVNDSLPGDTE

SEQ ID NO: 32689 - protein, 6 aa, Mycobacterium avium
DTVTAG

SEQ ID NO: 32690 - protein, 5 aa, Mycobacterium avium
DTVTE

SEQ ID NO: 32691 - protein, 4 aa, Mycobacterium avium
DTWS

SEQ ID NO: 32692 - protein, 13 aa, Mycobacterium avium
DTYIEKDSSINDD

SEQ ID NO: 32693 - protein, 7 aa, Mycobacterium avium
DTYPGRI

SEQ ID NO: 32694 - protein, 8 aa, Mycobacterium avium
DVAESASV

SEQ ID NO: 32695 - protein, 7 aa, Mycobacterium avium
DVAESEE

SEQ ID NO: 32696 - protein, 6 aa, Mycobacterium avium
DVANEA

SEQ ID NO: 32697 - protein, 16 aa, Mycobacterium avium
DVAPDGTYSSPIENPN

SEQ ID NO: 32698 - protein, 5 aa, Mycobacterium avium
DVARS

SEQ ID NO: 32699 - protein, 9 aa, Mycobacterium avium
DVASTGATL

SEQ ID NO: 32700 - protein, 5 aa, Mycobacterium avium
DVATA

SEQ ID NO: 32701 - protein, 8 aa, Mycobacterium avium
DVDERDQP

SEQ ID NO: 32702 - protein, 12 aa, Mycobacterium avium
DVDGAESDEAGA

SEQ ID NO: 32703 - protein, 6 aa, Mycobacterium avium
DVDPLD

SEQ ID NO: 32704 - protein, 11 aa, Mycobacterium avium
DVDSNTASTLD

SEQ ID NO: 32705 - protein, 6 aa, Mycobacterium avium
DVEGSP

SEQ ID NO: 32706 - protein, 45 aa, Mycobacterium avium
DVEPEKHQARSRAGKGKDDGSYVGAAGSDDSFDAGETGAEARSER

SEQ ID NO: 32707 - protein, 14 aa, Mycobacterium avium
DVEPGGRGQEPRPW

SEQ ID NO: 32708 - protein, 12 aa, Mycobacterium avium
DVEPGTPTPQAR

SEQ ID NO: 32709 - protein, 9 aa, Mycobacterium avium
DVEQGNPDA

SEQ ID NO: 32710 - protein, 5 aa, Mycobacterium avium
DVERE

SEQ ID NO: 32711 - protein, 8 aa, Mycobacterium avium
DVGAGKSL

SEQ ID NO: 32712 - protein, 8 aa, Mycobacterium avium
DVGAPPGV

SEQ ID NO: 32713 - protein, 19 aa, Mycobacterium avium
DVGGPTSYPDQAPLSAFQP

SEQ ID NO: 32714 - protein, 8 aa, Mycobacterium avium
DVGGSGLR

SEQ ID NO: 32715 - protein, 16 aa, Mycobacterium avium
DVGKGSVESLAGQGAR

SEQ ID NO: 32716 - protein, 17 aa, Mycobacterium avium
DVGLSSKTEHRSSGQPL

SEQ ID NO: 32717 - protein, 7 aa, Mycobacterium avium
DVGPGGP

SEQ ID NO: 32718 - protein, 4 aa, Mycobacterium avium
DVGQ

SEQ ID NO: 32719 - protein, 6 aa, Mycobacterium avium
DVGRID

SEQ ID NO: 32720 - protein, 6 aa, Mycobacterium avium
DVGRLD

SEQ ID NO: 32721 - protein, 4 aa, Mycobacterium avium
DVKE

SEQ ID NO: 32722 - protein, 6 aa, Mycobacterium avium
DVPADV

SEQ ID NO: 32723 - protein, 6 aa, Mycobacterium avium
DVPDGG

SEQ ID NO: 32724 - protein, 26 aa, Mycobacterium avium
DVPDGPGGSAGSGVSPALGGPGRTEQ

SEQ ID NO: 32725 - protein, 11 aa, Mycobacterium avium
DVPDPVPTPDE

SEQ ID NO: 32726 - protein, 8 aa, Mycobacterium avium
DVPENEHD

SEQ ID NO: 32727 - protein, 4 aa, Mycobacterium avium
DVPG

SEQ ID NO: 32728 - protein, 12 aa, Mycobacterium avium
DVPGQGTPGAPT

SEQ ID NO: 32729 - protein, 7 aa, Mycobacterium avium
DVPGTGA

SEQ ID NO: 32730 - protein, 8 aa, Mycobacterium avium
DVPNETQV

SEQ ID NO: 32731 - protein, 6 aa, Mycobacterium avium
DVPPDE

SEQ ID NO: 32732 - protein, 7 aa, Mycobacterium avium
DVPSANG

SEQ ID NO: 32733 - protein, 12 aa, Mycobacterium avium
DVPTELESAAQE

SEQ ID NO: 32734 - protein, 5 aa, Mycobacterium avium
DVQRG

SEQ ID NO: 32735 - protein, 8 aa, Mycobacterium avium
DVRDRESL

SEQ ID NO: 32736 - protein, 9 aa, Mycobacterium avium
DVRPPGSDR

SEQ ID NO: 32737 - protein, 9 aa, Mycobacterium avium
DVRRTTPRS

SEQ ID NO: 32738 - protein, 4 aa, Mycobacterium avium
DVSA

SEQ ID NO: 32739 - protein, 19 aa, Mycobacterium avium
DVSARDQQRSDGQWTRAKG

SEQ ID NO: 32740 - protein, 10 aa, Mycobacterium avium
DVSDGAPREA

SEQ ID NO: 32741 - protein, 13 aa, Mycobacterium avium
DVSGGPGTVATPI

SEQ ID NO: 32742 - protein, 4 aa, Mycobacterium avium
DVSP

SEQ ID NO: 32743 - protein, 7 aa, Mycobacterium avium
DVSPDGR

SEQ ID NO: 32744 - protein, 7 aa, Mycobacterium avium
DVSSNRV

SEQ ID NO: 32745 - protein, 9 aa, Mycobacterium avium
DVTAEEAER

SEQ ID NO: 32746 - protein, 14 aa, Mycobacterium avium
DVTDAGSDTVATRG

SEQ ID NO: 32747 - protein, 7 aa, Mycobacterium avium
DVTDRAA

SEQ ID NO: 32748 - protein, 8 aa, Mycobacterium avium
DVTGPGRQ

SEQ ID NO: 32749 - protein, 14 aa, Mycobacterium avium
DVTGTSKGKGFAGT

SEQ ID NO: 32750 - protein, 17 aa, Mycobacterium avium
DVTPQPHNGVRPPKRRR

SEQ ID NO: 32751 - protein, 10 aa, Mycobacterium avium
DVTTQSYSPL

SEQ ID NO: 32752 - protein, 8 aa, Mycobacterium avium
DWAPQPSD

SEQ ID NO: 32753 - protein, 13 aa, Mycobacterium avium
DWDEHAGDLTAQQ

SEQ ID NO: 32754 - protein, 13 aa, Mycobacterium avium
DWDPSSATLPRPL

SEQ ID NO: 32755 - protein, 8 aa, Mycobacterium avium
DWGTETGA

SEQ ID NO: 32756 - protein, 5 aa, Mycobacterium avium
DWPGS

SEQ ID NO: 32757 - protein, 9 aa, Mycobacterium avium
DWPNPGASI

SEQ ID NO: 32758 - protein, 8 aa, Mycobacterium avium
DWQGAPTR

SEQ ID NO: 32759 - protein, 5 aa, Mycobacterium avium
DWTEP

SEQ ID NO: 32760 - protein, 8 aa, Mycobacterium avium
DWTPSYQR

SEQ ID NO: 32761 - protein, 10 aa, Mycobacterium avium
DYAASDADDP

SEQ ID NO: 32762 - protein, 8 aa, Mycobacterium avium
DYADHKAA

SEQ ID NO: 32763 - protein, 11 aa, Mycobacterium avium
DYAKESRETLG

SEQ ID NO: 32764 - protein, 10 aa, Mycobacterium avium
DYAKKQGSPN

SEQ ID NO: 32765 - protein, 12 aa, Mycobacterium avium
DYDGPPGSVGDR

SEQ ID NO: 32766 - protein, 4 aa, Mycobacterium avium
DYDR

SEQ ID NO: 32767 - protein, 6 aa, Mycobacterium avium
DYEEGG

SEQ ID NO: 32768 - protein, 5 aa, Mycobacterium avium
DYGRR

SEQ ID NO: 32769 - protein, 6 aa, Mycobacterium avium
DYPDRE

SEQ ID NO: 32770 - protein, 17 aa, Mycobacterium avium
DYQGRDRNGHYSNDQDA

SEQ ID NO: 32771 - protein, 11 aa, Mycobacterium avium
DYQPGEPRGTD

SEQ ID NO: 32772 - protein, 18 aa, Mycobacterium avium
DYSEDSTVDKALEPGRPL

SEQ ID NO: 32773 - protein, 5 aa, Mycobacterium avium
DYSPE

SEQ ID NO: 32774 - protein, 11 aa, Mycobacterium avium
DYTDGAAEDEL

SEQ ID NO: 32775 - protein, 4 aa, Mycobacterium avium
DYTG

SEQ ID NO: 32776 - protein, 8 aa, Mycobacterium avium
DYTREPGV

SEQ ID NO: 32777 - protein, 8 aa, Mycobacterium avium
DYVPPDSA

SEQ ID NO: 32778 - protein, 7 aa, Mycobacterium avium
EAAADDA

SEQ ID NO: 32779 - protein, 8 aa, Mycobacterium avium
EAAARQAG

SEQ ID NO: 32780 - protein, 7 aa, Mycobacterium avium
EAADDPR

SEQ ID NO: 32781 - protein, 8 aa, Mycobacterium avium
EAADKAGF

SEQ ID NO: 32782 - protein, 7 aa, Mycobacterium avium
EAADPGE

SEQ ID NO: 32783 - protein, 10 aa, Mycobacterium avium
EAADRGRRGP

SEQ ID NO: 32784 - protein, 5 aa, Mycobacterium avium
EAAEA

SEQ ID NO: 32785 - protein, 16 aa, Mycobacterium avium
EAAEEIARRSRGTPRI

SEQ ID NO: 32786 - protein, 18 aa, Mycobacterium avium
EAAEKAKIELSSSQSTSI

SEQ ID NO: 32787 - protein, 9 aa, Mycobacterium avium
EAAERDPGL

SEQ ID NO: 32788 - protein, 7 aa, Mycobacterium avium
EAAGADR

SEQ ID NO: 32789 - protein, 8 aa, Mycobacterium avium
EAAGGRAV

SEQ ID NO: 32790 - protein, 13 aa, Mycobacterium avium
EAAGGTSSGVTGG

SEQ ID NO: 32791 - protein, 9 aa, Mycobacterium avium
EAAGIGPED

SEQ ID NO: 32792 - protein, 10 aa, Mycobacterium avium
EAAGLSPQNG

SEQ ID NO: 32793 - protein, 10 aa, Mycobacterium avium
EAAGQDPRLG

SEQ ID NO: 32794 - protein, 7 aa, Mycobacterium avium
EAAGQSV

SEQ ID NO: 32795 - protein, 15 aa, Mycobacterium avium
EAAGREMTGPNGEVG

SEQ ID NO: 32796 - protein, 8 aa, Mycobacterium avium
EAAKPGSY

SEQ ID NO: 32797 - protein, 8 aa, Mycobacterium avium
EAAKPRKI

SEQ ID NO: 32798 - protein, 4 aa, Mycobacterium avium
EAAN

SEQ ID NO: 32799 - protein, 12 aa, Mycobacterium avium
EAANGSGNISYE

SEQ ID NO: 32800 - protein, 9 aa, Mycobacterium avium
EAAPTAGLM

SEQ ID NO: 32801 - protein, 17 aa, Mycobacterium avium
EAAQKARESRRNQQQTV

SEQ ID NO: 32802 - protein, 13 aa, Mycobacterium avium
EAAQKGKGYSEKL

SEQ ID NO: 32803 - protein, 14 aa, Mycobacterium avium
EAARAARALSADGP

SEQ ID NO: 32804 - protein, 6 aa, Mycobacterium avium
EAARDA

SEQ ID NO: 32805 - protein, 8 aa, Mycobacterium avium
EAARKAGH

SEQ ID NO: 32806 - protein, 7 aa, Mycobacterium avium
EAARTSY

SEQ ID NO: 32807 - protein, 6 aa, Mycobacterium avium
EAASDI

SEQ ID NO: 32808 - protein, 6 aa, Mycobacterium avium
EAASPG

SEQ ID NO: 32809 - protein, 9 aa, Mycobacterium avium
EAASTEEGW

SEQ ID NO: 32810 - protein, 6 aa, Mycobacterium avium
EAATVS

SEQ ID NO: 32811 - protein, 6 aa, Mycobacterium avium
EAAVSA

SEQ ID NO: 32812 - protein, 4 aa, Mycobacterium avium
EADA

SEQ ID NO: 32813 - protein, 4 aa, Mycobacterium avium
EADD

SEQ ID NO: 32814 - protein, 7 aa, Mycobacterium avium
EADDAPL

SEQ ID NO: 32815 - protein, 7 aa, Mycobacterium avium
EADDEEA

SEQ ID NO: 32816 - protein, 9 aa, Mycobacterium avium
EADDGDWPS

SEQ ID NO: 32817 - protein, 8 aa, Mycobacterium avium
EADDPATY

SEQ ID NO: 32818 - protein, 7 aa, Mycobacterium avium
EADEEAT

SEQ ID NO: 32819 - protein, 17 aa, Mycobacterium avium
EADEGAAPAGRTPGLPG

SEQ ID NO: 32820 - protein, 9 aa, Mycobacterium avium
EADESGRRD

SEQ ID NO: 32821 - protein, 11 aa, Mycobacterium avium
EADETRLPTDD

SEQ ID NO: 32822 - protein, 7 aa, Mycobacterium avium
EADGRRP

SEQ ID NO: 32823 - protein, 7 aa, Mycobacterium avium
EADGTIT

SEQ ID NO: 32824 - protein, 9 aa, Mycobacterium avium
EADKAEGGE

SEQ ID NO: 32825 - protein, 7 aa, Mycobacterium avium
EADNQSV

SEQ ID NO: 32826 - protein, 7 aa, Mycobacterium avium
EADPERP

SEQ ID NO: 32827 - protein, 9 aa, Mycobacterium avium
EADQSPGVR

SEQ ID NO: 32828 - protein, 4 aa, Mycobacterium avium
EADR

SEQ ID NO: 32829 - protein, 7 aa, Mycobacterium avium
EADRETT

SEQ ID NO: 32830 - protein, 5 aa, Mycobacterium avium
EADRL

SEQ ID NO: 32831 - protein, 11 aa, Mycobacterium avium
EADSKATGPGV

SEQ ID NO: 32832 - protein, 4 aa, Mycobacterium avium
EAEA

SEQ ID NO: 32833 - protein, 13 aa, Mycobacterium avium
EAEAHDDGPQARD

SEQ ID NO: 32834 - protein, 13 aa, Mycobacterium avium
EAEAQAAERKRDE

SEQ ID NO: 32835 - protein, 6 aa, Mycobacterium avium
EAEDPK

SEQ ID NO: 32836 - protein, 5 aa, Mycobacterium avium
EAEEL

SEQ ID NO: 32837 - protein, 8 aa, Mycobacterium avium
EAEESDAE

SEQ ID NO: 32838 - protein, 4 aa, Mycobacterium avium
EAEG

SEQ ID NO: 32839 - protein, 7 aa, Mycobacterium avium
EAEGETV

SEQ ID NO: 32840 - protein, 7 aa, Mycobacterium avium
EAEGRGC

SEQ ID NO: 32841 - protein, 10 aa, Mycobacterium avium
EAEKPSRVGE

SEQ ID NO: 32842 - protein, 9 aa, Mycobacterium avium
EAEPPEQPQ

SEQ ID NO: 32843 - protein, 13 aa, Mycobacterium avium
EAEQQQLQSYITQ

SEQ ID NO: 32844 - protein, 18 aa, Mycobacterium avium
EAERDGGDVDKAIMAAAH

SEQ ID NO: 32845 - protein, 10 aa, Mycobacterium avium
EAERDKGGKV

SEQ ID NO: 32846 - protein, 5 aa, Mycobacterium avium
EAETT

SEQ ID NO: 32847 - protein, 5 aa, Mycobacterium avium
EAFGE

SEQ ID NO: 32848 - protein, 8 aa, Mycobacterium avium
EAFTEKDR

SEQ ID NO: 32849 - protein, 8 aa, Mycobacterium avium
EAGAESMP

SEQ ID NO: 32850 - protein, 5 aa, Mycobacterium avium
EAGAG

SEQ ID NO: 32851 - protein, 7 aa, Mycobacterium avium
EAGATAD

SEQ ID NO: 32852 - protein, 6 aa, Mycobacterium avium
EAGDAA

SEQ ID NO: 32853 - protein, 9 aa, Mycobacterium avium
EAGDGQEAV

SEQ ID NO: 32854 - protein, 9 aa, Mycobacterium avium
EAGDSGTPL

SEQ ID NO: 32855 - protein, 12 aa, Mycobacterium avium
EAGERSGTSTPF

SEQ ID NO: 32856 - protein, 5 aa, Mycobacterium avium
EAGGK

SEQ ID NO: 32857 - protein, 9 aa, Mycobacterium avium
EAGGTERLQ

SEQ ID NO: 32858 - protein, 4 aa, Mycobacterium avium
EAGH

SEQ ID NO: 32859 - protein, 5 aa, Mycobacterium avium
EAGIG

SEQ ID NO: 32860 - protein, 6 aa, Mycobacterium avium
EAGIPS

SEQ ID NO: 32861 - protein, 5 aa, Mycobacterium avium
EAGLN

SEQ ID NO: 32862 - protein, 4 aa, Mycobacterium avium
EAGM

SEQ ID NO: 32863 - protein, 9 aa, Mycobacterium avium
EAGPAFQGT

SEQ ID NO: 32864 - protein, 13 aa, Mycobacterium avium
EAGPDTETHPPGT

SEQ ID NO: 32865 - protein, 6 aa, Mycobacterium avium
EAGPGH

SEQ ID NO: 32866 - protein, 8 aa, Mycobacterium avium
EAGPPDAP

SEQ ID NO: 32867 - protein, 6 aa, Mycobacterium avium
EAGPRV

SEQ ID NO: 32868 - protein, 16 aa, Mycobacterium avium
EAGQGRCAVLDVRLPQ

SEQ ID NO: 32869 - protein, 7 aa, Mycobacterium avium
EAGQISD

SEQ ID NO: 32870 - protein, 5 aa, Mycobacterium avium
EAGQR

SEQ ID NO: 32871 - protein, 23 aa, Mycobacterium avium
EAGREMAARAGDAVTVSAEGQPA

SEQ ID NO: 32872 - protein, 9 aa, Mycobacterium avium
EAGRTSAPN

SEQ ID NO: 32873 - protein, 8 aa, Mycobacterium avium
EAGSHGRA

SEQ ID NO: 32874 - protein, 13 aa, Mycobacterium avium
EAGSRTPSRLQPR

SEQ ID NO: 32875 - protein, 11 aa, Mycobacterium avium
EAGSYGKDTRG

SEQ ID NO: 32876 - protein, 5 aa, Mycobacterium avium
EAGTA

SEQ ID NO: 32877 - protein, 14 aa, Mycobacterium avium
EAGTDYDTDADSRN

SEQ ID NO: 32878 - protein, 10 aa, Mycobacterium avium
EAGTNAAHRT

SEQ ID NO: 32879 - protein, 9 aa, Mycobacterium avium
EAGTPPKSL

SEQ ID NO: 32880 - protein, 6 aa, Mycobacterium avium
EAGTQK

SEQ ID NO: 32881 - protein, 7 aa, Mycobacterium avium
EAGTRPV

SEQ ID NO: 32882 - protein, 8 aa, Mycobacterium avium
EAGVAPED

SEQ ID NO: 32883 - protein, 10 aa, Mycobacterium avium
EAGVPPPRRS

SEQ ID NO: 32884 - protein, 8 aa, Mycobacterium avium
EAGYSNRG

SEQ ID NO: 32885 - protein, 20 aa, Mycobacterium avium
EAHAEEDRKRREEADVRNQA

SEQ ID NO: 32886 - protein, 4 aa, Mycobacterium avium
EAHG

SEQ ID NO: 32887 - protein, 9 aa, Mycobacterium avium
EAHRRPHGH

SEQ ID NO: 32888 - protein, 4 aa, Mycobacterium avium
EAIE

SEQ ID NO: 32889 - protein, 7 aa, Mycobacterium avium
EAIGPGD

SEQ ID NO: 32890 - protein, 5 aa, Mycobacterium avium
EAIGT

SEQ ID NO: 32891 - protein, 10 aa, Mycobacterium avium
EAIKATGETF

SEQ ID NO: 32892 - protein, 13 aa, Mycobacterium avium
EAKEGIETTETGE

SEQ ID NO: 32893 - protein, 13 aa, Mycobacterium avium
EAKFADKLAGIPR

SEQ ID NO: 32894 - protein, 13 aa, Mycobacterium avium
EAKNAQNEAASEE

SEQ ID NO: 32895 - protein, 18 aa, Mycobacterium avium
EAKRTRKPVFGPKPAGMP

SEQ ID NO: 32896 - protein, 11 aa, Mycobacterium avium
EAKTAASRDKH

SEQ ID NO: 32897 - protein, 14 aa, Mycobacterium avium
EALASGDPETLKPK

SEQ ID NO: 32898 - protein, 12 aa, Mycobacterium avium
EALDRGDQENAG

SEQ ID NO: 32899 - protein, 7 aa, Mycobacterium avium
EALGPQT

SEQ ID NO: 32900 - protein, 12 aa, Mycobacterium avium
EALGSNGSTSMG

SEQ ID NO: 32901 - protein, 7 aa, Mycobacterium avium
EALPGEI

SEQ ID NO: 32902 - protein, 10 aa, Mycobacterium avium
EALPGTDIDP

SEQ ID NO: 32903 - protein, 9 aa, Mycobacterium avium
EALRNSAGR

SEQ ID NO: 32904 - protein, 14 aa, Mycobacterium avium
EALRPMGRATSGVQ

SEQ ID NO: 32905 - protein, 4 aa, Mycobacterium avium
EANA

SEQ ID NO: 32906 - protein, 4 aa, Mycobacterium avium
EANG

SEQ ID NO: 32907 - protein, 11 aa, Mycobacterium avium
EANGPLEQQIP

SEQ ID NO: 32908 - protein, 8 aa, Mycobacterium avium
EANPRTRS

SEQ ID NO: 32909 - protein, 6 aa, Mycobacterium avium
EAPARA

SEQ ID NO: 32910 - protein, 9 aa, Mycobacterium avium
EAPDAPTRD

SEQ ID NO: 32911 - protein, 5 aa, Mycobacterium avium
EAPDN

SEQ ID NO: 32912 - protein, 9 aa, Mycobacterium avium
EAPGGSGIT

SEQ ID NO: 32913 - protein, 10 aa, Mycobacterium avium
EAPGNPKPLG

SEQ ID NO: 32914 - protein, 7 aa, Mycobacterium avium
EAPGPDF

SEQ ID NO: 32915 - protein, 5 aa, Mycobacterium avium
EAPLR

SEQ ID NO: 32916 - protein, 5 aa, Mycobacterium avium
EAPLT

SEQ ID NO: 32917 - protein, 5 aa, Mycobacterium avium
EAPLY

SEQ ID NO: 32918 - protein, 7 aa, Mycobacterium avium
EAPNGAH

SEQ ID NO: 32919 - protein, 6 aa, Mycobacterium avium
EAPPWV

SEQ ID NO: 32920 - protein, 11 aa, Mycobacterium avium
EAPQEGTPPFR

SEQ ID NO: 32921 - protein, 7 aa, Mycobacterium avium
EAPSPLV

SEQ ID NO: 32922 - protein, 5 aa, Mycobacterium avium
EAPTH

SEQ ID NO: 32923 - protein, 16 aa, Mycobacterium avium
EAQAAIDEARRAAERE

SEQ ID NO: 32924 - protein, 8 aa, Mycobacterium avium
EAQDRYGR

SEQ ID NO: 32925 - protein, 21 aa, Mycobacterium avium
EAQPADSVQTYPKPAGGAPDF

SEQ ID NO: 32926 - protein, 9 aa, Mycobacterium avium
EAQRDTSTS

SEQ ID NO: 32927 - protein, 4 aa, Mycobacterium avium
EAQY

SEQ ID NO: 32928 - protein, 4 aa, Mycobacterium avium
EARA

SEQ ID NO: 32929 - protein, 7 aa, Mycobacterium avium
EARADAH

SEQ ID NO: 32930 - protein, 6 aa, Mycobacterium avium
EARDVT

SEQ ID NO: 32931 - protein, 4 aa, Mycobacterium avium
EARE

SEQ ID NO: 32932 - protein, 8 aa, Mycobacterium avium
EAREETGI

SEQ ID NO: 32933 - protein, 8 aa, Mycobacterium avium
EARGEDPL

SEQ ID NO: 32934 - protein, 6 aa, Mycobacterium avium
EARGHD

SEQ ID NO: 32935 - protein, 9 aa, Mycobacterium avium
EARGKRTDE

SEQ ID NO: 32936 - protein, 5 aa, Mycobacterium avium
EARHR

SEQ ID NO: 32937 - protein, 6 aa, Mycobacterium avium
EARNGA

SEQ ID NO: 32938 - protein, 4 aa, Mycobacterium avium
EARP

SEQ ID NO: 32939 - protein, 9 aa, Mycobacterium avium
EARPPGKKI

SEQ ID NO: 32940 - protein, 7 aa, Mycobacterium avium
EARPTAE

SEQ ID NO: 32941 - protein, 6 aa, Mycobacterium avium
EARQEP

SEQ ID NO: 32942 - protein, 7 aa, Mycobacterium avium
EARQHSE

SEQ ID NO: 32943 - protein, 14 aa, Mycobacterium avium
EARRPKSTAPQFDE

SEQ ID NO: 32944 - protein, 17 aa, Mycobacterium avium
EARSTAETTVAEARQRA

SEQ ID NO: 32945 - protein, 5 aa, Mycobacterium avium
EARTV

SEQ ID NO: 32946 - protein, 14 aa, Mycobacterium avium
EARWRDSAGEEHAA

SEQ ID NO: 32947 - protein, 10 aa, Mycobacterium avium
EASAGNAAAA

SEQ ID NO: 32948 - protein, 23 aa, Mycobacterium avium
EASASGSSVMAGRKNKGAAAYGE

SEQ ID NO: 32949 - protein, 6 aa, Mycobacterium avium
EASDEQ

SEQ ID NO: 32950 - protein, 8 aa, Mycobacterium avium
EASDGITE

SEQ ID NO: 32951 - protein, 4 aa, Mycobacterium avium
EASE

SEQ ID NO: 32952 - protein, 9 aa, Mycobacterium avium
EASEPARVN

SEQ ID NO: 32953 - protein, 7 aa, Mycobacterium avium
EASHEPG

SEQ ID NO: 32954 - protein, 7 aa, Mycobacterium avium
EASPGNM

SEQ ID NO: 32955 - protein, 6 aa, Mycobacterium avium
EASQRF

SEQ ID NO: 32956 - protein, 5 aa, Mycobacterium avium
EASQV

SEQ ID NO: 32957 - protein, 7 aa, Mycobacterium avium
EASRRRQ

SEQ ID NO: 32958 - protein, 9 aa, Mycobacterium avium
EASSSRAGL

SEQ ID NO: 32959 - protein, 5 aa, Mycobacterium avium
EASYF

SEQ ID NO: 32960 - protein, 6 aa, Mycobacterium avium
EASYIS

SEQ ID NO: 32961 - protein, 15 aa, Mycobacterium avium
EATDSAGKITKRGAE

SEQ ID NO: 32962 - protein, 11 aa, Mycobacterium avium
EATEDPGDDRK

SEQ ID NO: 32963 - protein, 9 aa, Mycobacterium avium
EATEESGID

SEQ ID NO: 32964 - protein, 5 aa, Mycobacterium avium
EATEF

SEQ ID NO: 32965 - protein, 8 aa, Mycobacterium avium
EATGTDTF

SEQ ID NO: 32966 - protein, 10 aa, Mycobacterium avium
EATPEERREA

SEQ ID NO: 32967 - protein, 8 aa, Mycobacterium avium
EATPNQER

SEQ ID NO: 32968 - protein, 10 aa, Mycobacterium avium
EATQAELRGR

SEQ ID NO: 32969 - protein, 14 aa, Mycobacterium avium
EATQTAAKQLGGDQ

SEQ ID NO: 32970 - protein, 7 aa, Mycobacterium avium
EATRDRT

SEQ ID NO: 32971 - protein, 13 aa, Mycobacterium avium
EATRERHGQANSW

SEQ ID NO: 32972 - protein, 7 aa, Mycobacterium avium
EATSLPV

SEQ ID NO: 32973 - protein, 11 aa, Mycobacterium avium
EATSPLATDPA

SEQ ID NO: 32974 - protein, 10 aa, Mycobacterium avium
EATYRGVPPP

SEQ ID NO: 32975 - protein, 10 aa, Mycobacterium avium
EAVEGSETVT

SEQ ID NO: 32976 - protein, 6 aa, Mycobacterium avium
EAVGDV

SEQ ID NO: 32977 - protein, 12 aa, Mycobacterium avium
EAVGGSCASGGG

SEQ ID NO: 32978 - protein, 7 aa, Mycobacterium avium
ECDEDDD

SEQ ID NO: 32979 - protein, 8 aa, Mycobacterium avium
ECDEDPGL

SEQ ID NO: 32980 - protein, 15 aa, Mycobacterium avium
ECPPDAARQAITDPE

SEQ ID NO: 32981 - protein, 6 aa, Mycobacterium avium
ECTGAA

SEQ ID NO: 32982 - protein, 8 aa, Mycobacterium avium
EDAAEGPR

SEQ ID NO: 32983 - protein, 9 aa, Mycobacterium avium
EDAAPSDAE

SEQ ID NO: 32984 - protein, 6 aa, Mycobacterium avium
EDAAQG

SEQ ID NO: 32985 - protein, 7 aa, Mycobacterium avium
EDAARTS

SEQ ID NO: 32986 - protein, 10 aa, Mycobacterium avium
EDAATADPTG

SEQ ID NO: 32987 - protein, 8 aa, Mycobacterium avium
EDADPQAA

SEQ ID NO: 32988 - protein, 8 aa, Mycobacterium avium
EDADQRDG

SEQ ID NO: 32989 - protein, 8 aa, Mycobacterium avium
EDADRDAI

SEQ ID NO: 32990 - protein, 10 aa, Mycobacterium avium
EDAEPGTQFT

SEQ ID NO: 32991 - protein, 9 aa, Mycobacterium avium
EDAETEREL

SEQ ID NO: 32992 - protein, 8 aa, Mycobacterium avium
EDANSDSN

SEQ ID NO: 32993 - protein, 7 aa, Mycobacterium avium
EDAPERL

SEQ ID NO: 32994 - protein, 5 aa, Mycobacterium avium
EDAPK

SEQ ID NO: 32995 - protein, 7 aa, Mycobacterium avium
EDAPQRI

SEQ ID NO: 32996 - protein, 7 aa, Mycobacterium avium
EDAVREL

SEQ ID NO: 32997 - protein, 8 aa, Mycobacterium avium
EDDDARDV

SEQ ID NO: 32998 - protein, 11 aa, Mycobacterium avium
EDDDGNSFTDD

SEQ ID NO: 32999 - protein, 4 aa, Mycobacterium avium
EDDE

SEQ ID NO: 33000 - protein, 6 aa, Mycobacterium avium
EDDGPD

SEQ ID NO: 33001 - protein, 4 aa, Mycobacterium avium
EDDP

SEQ ID NO: 33002 - protein, 8 aa, Mycobacterium avium
EDDPRVAA

SEQ ID NO: 33003 - protein, 4 aa, Mycobacterium avium
EDDT

SEQ ID NO: 33004 - protein, 13 aa, Mycobacterium avium
EDEAPNAKGKMEK

SEQ ID NO: 33005 - protein, 14 aa, Mycobacterium avium
EDEGIRANTTAESL

SEQ ID NO: 33006 - protein, 8 aa, Mycobacterium avium
EDEGPGIA

SEQ ID NO: 33007 - protein, 11 aa, Mycobacterium avium
EDEPAADPADH

SEQ ID NO: 33008 - protein, 6 aa, Mycobacterium avium
EDEPGL

SEQ ID NO: 33009 - protein, 8 aa, Mycobacterium avium
EDETSGHA

SEQ ID NO: 33010 - protein, 8 aa, Mycobacterium avium
EDGAETDL

SEQ ID NO: 33011 - protein, 9 aa, Mycobacterium avium
EDGAHGDTS

SEQ ID NO: 33012 - protein, 16 aa, Mycobacterium avium
EDGAQQDRFPGGTQQI

SEQ ID NO: 33013 - protein, 6 aa, Mycobacterium avium
EDGEIT

SEQ ID NO: 33014 - protein, 8 aa, Mycobacterium avium
EDGGGIPW

SEQ ID NO: 33015 - protein, 6 aa, Mycobacterium avium
EDGGPI

SEQ ID NO: 33016 - protein, 13 aa, Mycobacterium avium
EDGIAGVEKIIDK

SEQ ID NO: 33017 - protein, 28 aa, Mycobacterium avium
EDGKAPFANPRNSAAGSLRQKNPAVTAR

SEQ ID NO: 33018 - protein, 7 aa, Mycobacterium avium
EDGKPVR

SEQ ID NO: 33019 - protein, 8 aa, Mycobacterium avium
EDGQTIES

SEQ ID NO: 33020 - protein, 6 aa, Mycobacterium avium
EDGRAH

SEQ ID NO: 33021 - protein, 5 aa, Mycobacterium avium
EDGRE

SEQ ID NO: 33022 - protein, 9 aa, Mycobacterium avium
EDGSERVLS

SEQ ID NO: 33023 - protein, 15 aa, Mycobacterium avium
EDGSPVRGVSGGTAR

SEQ ID NO: 33024 - protein, 8 aa, Mycobacterium avium
EDGTITKG

SEQ ID NO: 33025 - protein, 5 aa, Mycobacterium avium
EDGTV

SEQ ID NO: 33026 - protein, 4 aa, Mycobacterium avium
EDGV

SEQ ID NO: 33027 - protein, 9 aa, Mycobacterium avium
EDGYSTGRG

SEQ ID NO: 33028 - protein, 9 aa, Mycobacterium avium
EDIAQTDAA

SEQ ID NO: 33029 - protein, 7 aa, Mycobacterium avium
EDKGMRD

SEQ ID NO: 33030 - protein, 5 aa, Mycobacterium avium
EDKPE

SEQ ID NO: 33031 - protein, 6 aa, Mycobacterium avium
EDLAPA

SEQ ID NO: 33032 - protein, 18 aa, Mycobacterium avium
EDLETARELAADDDSFTA

SEQ ID NO: 33033 - protein, 7 aa, Mycobacterium avium
EDLGDPE

SEQ ID NO: 33034 - protein, 5 aa, Mycobacterium avium
EDLPA

SEQ ID NO: 33035 - protein, 15 aa, Mycobacterium avium
EDLPAHGEAIRRRFE

SEQ ID NO: 33036 - protein, 8 aa, Mycobacterium avium
EDNLYQTS

SEQ ID NO: 33037 - protein, 5 aa, Mycobacterium avium
EDNPD

SEQ ID NO: 33038 - protein, 8 aa, Mycobacterium avium
EDNPQTRG

SEQ ID NO: 33039 - protein, 6 aa, Mycobacterium avium
EDNSKI

SEQ ID NO: 33040 - protein, 10 aa, Mycobacterium avium
EDPARGWQPQ

SEQ ID NO: 33041 - protein, 10 aa, Mycobacterium avium
EDPATQAHSI

SEQ ID NO: 33042 - protein, 6 aa, Mycobacterium avium
EDPDIA

SEQ ID NO: 33043 - protein, 9 aa, Mycobacterium avium
EDPDRGREL

SEQ ID NO: 33044 - protein, 7 aa, Mycobacterium avium
EDPEGAV

SEQ ID NO: 33045 - protein, 17 aa, Mycobacterium avium
EDPEPVAEQPDADKDPV

SEQ ID NO: 33046 - protein, 9 aa, Mycobacterium avium
EDPGEALSP

SEQ ID NO: 33047 - protein, 5 aa, Mycobacterium avium
EDPIG

SEQ ID NO: 33048 - protein, 10 aa, Mycobacterium avium
EDPQPGRPEM

SEQ ID NO: 33049 - protein, 4 aa, Mycobacterium avium
EDPR

SEQ ID NO: 33050 - protein, 6 aa, Mycobacterium avium
EDPTKD

SEQ ID NO: 33051 - protein, 5 aa, Mycobacterium avium
EDPYA

SEQ ID NO: 33052 - protein, 5 aa, Mycobacterium avium
EDPYE

SEQ ID NO: 33053 - protein, 6 aa, Mycobacterium avium
EDPYGY

SEQ ID NO: 33054 - protein, 7 aa, Mycobacterium avium
EDQGRKA

SEQ ID NO: 33055 - protein, 7 aa, Mycobacterium avium
EDQRRDG

SEQ ID NO: 33056 - protein, 7 aa, Mycobacterium avium
EDQSRSA

SEQ ID NO: 33057 - protein, 17 aa, Mycobacterium avium
EDQTRRATTGSDDTLAG

SEQ ID NO: 33058 - protein, 8 aa, Mycobacterium avium
EDRAPAAY

SEQ ID NO: 33059 - protein, 10 aa, Mycobacterium avium
EDRDATDPLE

SEQ ID NO: 33060 - protein, 7 aa, Mycobacterium avium
EDRENEG

SEQ ID NO: 33061 - protein, 8 aa, Mycobacterium avium
EDRGDKGI

SEQ ID NO: 33062 - protein, 7 aa, Mycobacterium avium
EDRGPEL

SEQ ID NO: 33063 - protein, 7 aa, Mycobacterium avium
EDRGSFG

SEQ ID NO: 33064 - protein, 6 aa, Mycobacterium avium
EDRPAD

SEQ ID NO: 33065 - protein, 5 aa, Mycobacterium avium
EDRPR

SEQ ID NO: 33066 - protein, 8 aa, Mycobacterium avium
EDSATARH

SEQ ID NO: 33067 - protein, 7 aa, Mycobacterium avium
EDSDDVQ

SEQ ID NO: 33068 - protein, 8 aa, Mycobacterium avium
EDSGLDPH

SEQ ID NO: 33069 - protein, 8 aa, Mycobacterium avium
EDSGYRGM

SEQ ID NO: 33070 - protein, 11 aa, Mycobacterium avium
EDSQSAEARED

SEQ ID NO: 33071 - protein, 11 aa, Mycobacterium avium
EDSRPTTHDDP

SEQ ID NO: 33072 - protein, 13 aa, Mycobacterium avium
EDTAEGDEPPATA

SEQ ID NO: 33073 - protein, 8 aa, Mycobacterium avium
EDTDDEIR

SEQ ID NO: 33074 - protein, 7 aa, Mycobacterium avium
EDTDGGV

SEQ ID NO: 33075 - protein, 9 aa, Mycobacterium avium
EDTGELTPT

SEQ ID NO: 33076 - protein, 4 aa, Mycobacterium avium
EDTI

SEQ ID NO: 33077 - protein, 6 aa, Mycobacterium avium
EDTSAY

SEQ ID NO: 33078 - protein, 15 aa, Mycobacterium avium
EDTVRAAGSPEVPSH

SEQ ID NO: 33079 - protein, 8 aa, Mycobacterium avium
EDVADGSF

SEQ ID NO: 33080 - protein, 7 aa, Mycobacterium avium
EDVERGQ

SEQ ID NO: 33081 - protein, 7 aa, Mycobacterium avium
EDVPPGA

SEQ ID NO: 33082 - protein, 8 aa, Mycobacterium avium
EDVQRSQE

SEQ ID NO: 33083 - protein, 12 aa, Mycobacterium avium
EDVSDADDADAA

SEQ ID NO: 33084 - protein, 6 aa, Mycobacterium avium
EDYAEL

SEQ ID NO: 33085 - protein, 5 aa, Mycobacterium avium
EDYDT

SEQ ID NO: 33086 - protein, 4 aa, Mycobacterium avium
EDYS

SEQ ID NO: 33087 - protein, 4 aa, Mycobacterium avium
EEAA

SEQ ID NO: 33088 - protein, 12 aa, Mycobacterium avium
EEAAEARLAQGN

SEQ ID NO: 33089 - protein, 10 aa, Mycobacterium avium
EEAAQQGNSS

SEQ ID NO: 33090 - protein, 6 aa, Mycobacterium avium
EEAATV

SEQ ID NO: 33091 - protein, 15 aa, Mycobacterium avium
EEAEAENRASYGGPL

SEQ ID NO: 33092 - protein, 8 aa, Mycobacterium avium
EEAEARAY

SEQ ID NO: 33093 - protein, 7 aa, Mycobacterium avium
EEAETVP

SEQ ID NO: 33094 - protein, 25 aa, Mycobacterium avium
EEAKAAMAKTHADSQSGERAPKHSY

SEQ ID NO: 33095 - protein, 11 aa, Mycobacterium avium
EEAPGAGSTPP

SEQ ID NO: 33096 - protein, 8 aa, Mycobacterium avium
EEAQHDPE

SEQ ID NO: 33097 - protein, 11 aa, Mycobacterium avium
EEAQRTHQALT

SEQ ID NO: 33098 - protein, 8 aa, Mycobacterium avium
EEARANED

SEQ ID NO: 33099 - protein, 8 aa, Mycobacterium avium
EEARHSTA

SEQ ID NO: 33100 - protein, 4 aa, Mycobacterium avium
EEDA

SEQ ID NO: 33101 - protein, 6 aa, Mycobacterium avium
EEDAEG

SEQ ID NO: 33102 - protein, 9 aa, Mycobacterium avium
EEDEPLEGG

SEQ ID NO: 33103 - protein, 4 aa, Mycobacterium avium
EEDG

SEQ ID NO: 33104 - protein, 4 aa, Mycobacterium avium
EEDP

SEQ ID NO: 33105 - protein, 10 aa, Mycobacterium avium
EEDQEKIRDR

SEQ ID NO: 33106 - protein, 8 aa, Mycobacterium avium
EEDSRGRT

SEQ ID NO: 33107 - protein, 6 aa, Mycobacterium avium
EEDTIG

SEQ ID NO: 33108 - protein, 16 aa, Mycobacterium avium
EEEADGSGMFQPANAP

SEQ ID NO: 33109 - protein, 4 aa, Mycobacterium avium
EEEL

SEQ ID NO: 33110 - protein, 9 aa, Mycobacterium avium
EEELEKESV

SEQ ID NO: 33111 - protein, 10 aa, Mycobacterium avium
EEENPEAAEA

SEQ ID NO: 33112 - protein, 4 aa, Mycobacterium avium
EEEQ

SEQ ID NO: 33113 - protein, 11 aa, Mycobacterium avium
EEESGAGPTNN

SEQ ID NO: 33114 - protein, 5 aa, Mycobacterium avium
EEFGE

SEQ ID NO: 33115 - protein, 7 aa, Mycobacterium avium
EEFGEPY

SEQ ID NO: 33116 - protein, 8 aa, Mycobacterium avium
EEFGGSAV

SEQ ID NO: 33117 - protein, 4 aa, Mycobacterium avium
EEGA

SEQ ID NO: 33118 - protein, 12 aa, Mycobacterium avium
EEGDRLAGTDPD

SEQ ID NO: 33119 - protein, 7 aa, Mycobacterium avium
EEGEDAE

SEQ ID NO: 33120 - protein, 9 aa, Mycobacterium avium
EEGGQLTEK

SEQ ID NO: 33121 - protein, 12 aa, Mycobacterium avium
EEGNEVKPGSGV

SEQ ID NO: 33122 - protein, 8 aa, Mycobacterium avium
EEGQEVSA

SEQ ID NO: 33123 - protein, 10 aa, Mycobacterium avium
EEGRRLAGTH

SEQ ID NO: 33124 - protein, 5 aa, Mycobacterium avium
EEGSD

SEQ ID NO: 33125 - protein, 9 aa, Mycobacterium avium
EEGSGSSLT

SEQ ID NO: 33126 - protein, 10 aa, Mycobacterium avium
EEGYQSVGSG

SEQ ID NO: 33127 - protein, 18 aa, Mycobacterium avium
EEHDEAARTLAAKTGDRF

SEQ ID NO: 33128 - protein, 6 aa, Mycobacterium avium
EEHQGP

SEQ ID NO: 33129 - protein, 5 aa, Mycobacterium avium
EEHSA

SEQ ID NO: 33130 - protein, 12 aa, Mycobacterium avium
EEIGAPPSLAAG

SEQ ID NO: 33131 - protein, 8 aa, Mycobacterium avium
EEIRTTNP

SEQ ID NO: 33132 - protein, 10 aa, Mycobacterium avium
EEKAGSDAGA

SEQ ID NO: 33133 - protein, 5 aa, Mycobacterium avium
EEKAN

SEQ ID NO: 33134 - protein, 13 aa, Mycobacterium avium
EEKPKTPKSNYAV

SEQ ID NO: 33135 - protein, 11 aa, Mycobacterium avium
EELAGKKRTTI

SEQ ID NO: 33136 - protein, 7 aa, Mycobacterium avium
EELGGGD

SEQ ID NO: 33137 - protein, 11 aa, Mycobacterium avium
EELPDEPEPGT

SEQ ID NO: 33138 - protein, 5 aa, Mycobacterium avium
EELPP

SEQ ID NO: 33139 - protein, 8 aa, Mycobacterium avium
EELPRKTR

SEQ ID NO: 33140 - protein, 14 aa, Mycobacterium avium
EELSGSTDWTATSA

SEQ ID NO: 33141 - protein, 11 aa, Mycobacterium avium
EELTDAEAAPM

SEQ ID NO: 33142 - protein, 4 aa, Mycobacterium avium
EENA

SEQ ID NO: 33143 - protein, 5 aa, Mycobacterium avium
EENGG

SEQ ID NO: 33144 - protein, 7 aa, Mycobacterium avium
EENPNSA

SEQ ID NO: 33145 - protein, 5 aa, Mycobacterium avium
EENPQ

SEQ ID NO: 33146 - protein, 9 aa, Mycobacterium avium
EENPTTGDI

SEQ ID NO: 33147 - protein, 7 aa, Mycobacterium avium
EEPARRL

SEQ ID NO: 33148 - protein, 4 aa, Mycobacterium avium
EEPE

SEQ ID NO: 33149 - protein, 4 aa, Mycobacterium avium
EEPG

SEQ ID NO: 33150 - protein, 4 aa, Mycobacterium avium
EEPP

SEQ ID NO: 33151 - protein, 6 aa, Mycobacterium avium
EEPPEV

SEQ ID NO: 33152 - protein, 5 aa, Mycobacterium avium
EEPPY

SEQ ID NO: 33153 - protein, 8 aa, Mycobacterium avium
EEQDRTRW

SEQ ID NO: 33154 - protein, 5 aa, Mycobacterium avium
EEQGL

SEQ ID NO: 33155 - protein, 15 aa, Mycobacterium avium
EEQGVPPEKLAGTIQ

SEQ ID NO: 33156 - protein, 5 aa, Mycobacterium avium
EEQRK

SEQ ID NO: 33157 - protein, 7 aa, Mycobacterium avium
EEQRVPD

SEQ ID NO: 33158 - protein, 6 aa, Mycobacterium avium
EEQSQW

SEQ ID NO: 33159 - protein, 12 aa, Mycobacterium avium
EERAEKVEKQFQ

SEQ ID NO: 33160 - protein, 11 aa, Mycobacterium avium
EERAKNPGDDI

SEQ ID NO: 33161 - protein, 6 aa, Mycobacterium avium
EERARR

SEQ ID NO: 33162 - protein, 5 aa, Mycobacterium avium
EERLG

SEQ ID NO: 33163 - protein, 4 aa, Mycobacterium avium
EERR

SEQ ID NO: 33164 - protein, 6 aa, Mycobacterium avium
EERSAI

SEQ ID NO: 33165 - protein, 7 aa, Mycobacterium avium
EERSGAR

SEQ ID NO: 33166 - protein, 6 aa, Mycobacterium avium
EERTPV

SEQ ID NO: 33167 - protein, 5 aa, Mycobacterium avium
EERVA

SEQ ID NO: 33168 - protein, 10 aa, Mycobacterium avium
EESGDQLTEE

SEQ ID NO: 33169 - protein, 5 aa, Mycobacterium avium
EESGV

SEQ ID NO: 33170 - protein, 5 aa, Mycobacterium avium
EESLP

SEQ ID NO: 33171 - protein, 19 aa, Mycobacterium avium
EESNERIPAPESFDTPTGH

SEQ ID NO: 33172 - protein, 5 aa, Mycobacterium avium
EESNL

SEQ ID NO: 33173 - protein, 7 aa, Mycobacterium avium
EESPSGM

SEQ ID NO: 33174 - protein, 7 aa, Mycobacterium avium
EESQKAT

SEQ ID NO: 33175 - protein, 7 aa, Mycobacterium avium
EESSTLN

SEQ ID NO: 33176 - protein, 10 aa, Mycobacterium avium
EESTPEREFE

SEQ ID NO: 33177 - protein, 7 aa, Mycobacterium avium
EESVTQD

SEQ ID NO: 33178 - protein, 7 aa, Mycobacterium avium
EETAKTF

SEQ ID NO: 33179 - protein, 13 aa, Mycobacterium avium
EETDDGLSGEEGT

SEQ ID NO: 33180 - protein, 4 aa, Mycobacterium avium
EETH

SEQ ID NO: 33181 - protein, 14 aa, Mycobacterium avium
EETPQIDPDLTTPS

SEQ ID NO: 33182 - protein, 7 aa, Mycobacterium avium
EETRRRA

SEQ ID NO: 33183 - protein, 9 aa, Mycobacterium avium
EETTRARAP

SEQ ID NO: 33184 - protein, 9 aa, Mycobacterium avium
EETTRGRYS

SEQ ID NO: 33185 - protein, 11 aa, Mycobacterium avium
EEVGNGDGPEC

SEQ ID NO: 33186 - protein, 9 aa, Mycobacterium avium
EEYGGAGGD

SEQ ID NO: 33187 - protein, 10 aa, Mycobacterium avium
EEYGGQGADS

SEQ ID NO: 33188 - protein, 8 aa, Mycobacterium avium
EEYGGSGF

SEQ ID NO: 33189 - protein, 5 aa, Mycobacterium avium
EEYSR

SEQ ID NO: 33190 - protein, 5 aa, Mycobacterium avium
EFAPE

SEQ ID NO: 33191 - protein, 16 aa, Mycobacterium avium
EFAPGGPTAAVPPGSW

SEQ ID NO: 33192 - protein, 5 aa, Mycobacterium avium
EFARR

SEQ ID NO: 33193 - protein, 9 aa, Mycobacterium avium
EFDPERAGP

SEQ ID NO: 33194 - protein, 5 aa, Mycobacterium avium
EFEGP

SEQ ID NO: 33195 - protein, 4 aa, Mycobacterium avium
EFER

SEQ ID NO: 33196 - protein, 8 aa, Mycobacterium avium
EFGGDPDN

SEQ ID NO: 33197 - protein, 6 aa, Mycobacterium avium
EFGGDR

SEQ ID NO: 33198 - protein, 14 aa, Mycobacterium avium
EFGKHGPGRPRLDD

SEQ ID NO: 33199 - protein, 17 aa, Mycobacterium avium
EFGPAPKTTNEAAQPMQ

SEQ ID NO: 33200 - protein, 10 aa, Mycobacterium avium
EFGPRALGGR

SEQ ID NO: 33201 - protein, 11 aa, Mycobacterium avium
EFGRTQNGNNN

SEQ ID NO: 33202 - protein, 13 aa, Mycobacterium avium
EFGTGESSSVGEL

SEQ ID NO: 33203 - protein, 9 aa, Mycobacterium avium
EFNATKRRL

SEQ ID NO: 33204 - protein, 10 aa, Mycobacterium avium
EFRPGDDLGA

SEQ ID NO: 33205 - protein, 8 aa, Mycobacterium avium
EFSGGATS

SEQ ID NO: 33206 - protein, 13 aa, Mycobacterium avium
EFTDATPDPQLAL

SEQ ID NO: 33207 - protein, 5 aa, Mycobacterium avium
EFTGP

SEQ ID NO: 33208 - protein, 8 aa, Mycobacterium avium
EFYGPRGA

SEQ ID NO: 33209 - protein, 20 aa, Mycobacterium avium
EFYSDGTGYKFEGSTRTAEQ

SEQ ID NO: 33210 - protein, 4 aa, Mycobacterium avium
EGAA

SEQ ID NO: 33211 - protein, 17 aa, Mycobacterium avium
EGAAADASGLGLGTSEH

SEQ ID NO: 33212 - protein, 6 aa, Mycobacterium avium
EGADGV

SEQ ID NO: 33213 - protein, 11 aa, Mycobacterium avium
EGADKLPTDER

SEQ ID NO: 33214 - protein, 4 aa, Mycobacterium avium
EGAE

SEQ ID NO: 33215 - protein, 5 aa, Mycobacterium avium
EGAEE

SEQ ID NO: 33216 - protein, 8 aa, Mycobacterium avium
EGAFRPGA

SEQ ID NO: 33217 - protein, 8 aa, Mycobacterium avium
EGAGSDEW

SEQ ID NO: 33218 - protein, 6 aa, Mycobacterium avium
EGDDDR

SEQ ID NO: 33219 - protein, 6 aa, Mycobacterium avium
EGDDGE

SEQ ID NO: 33220 - protein, 8 aa, Mycobacterium avium
EGDDTVRP

SEQ ID NO: 33221 - protein, 6 aa, Mycobacterium avium
EGDGSY

SEQ ID NO: 33222 - protein, 6 aa, Mycobacterium avium
EGDGTT

SEQ ID NO: 33223 - protein, 10 aa, Mycobacterium avium
EGDPDSPISR

SEQ ID NO: 33224 - protein, 18 aa, Mycobacterium avium
EGDPNPNIEHANRGKRSI

SEQ ID NO: 33225 - protein, 8 aa, Mycobacterium avium
EGDQVNEQ

SEQ ID NO: 33226 - protein, 10 aa, Mycobacterium avium
EGDRNPPVFD

SEQ ID NO: 33227 - protein, 18 aa, Mycobacterium avium
EGDRYGGGQKDDLHPDPQ

SEQ ID NO: 33228 - protein, 4 aa, Mycobacterium avium
EGDT

SEQ ID NO: 33229 - protein, 7 aa, Mycobacterium avium
EGDTVEL

SEQ ID NO: 33230 - protein, 4 aa, Mycobacterium avium
EGED

SEQ ID NO: 33231 - protein, 5 aa, Mycobacterium avium
EGEGF

SEQ ID NO: 33232 - protein, 8 aa, Mycobacterium avium
EGEGGSVP

SEQ ID NO: 33233 - protein, 7 aa, Mycobacterium avium
EGEKDHA

SEQ ID NO: 33234 - protein, 6 aa, Mycobacterium avium
EGEPGD

SEQ ID NO: 33235 - protein, 5 aa, Mycobacterium avium
EGETL

SEQ ID NO: 33236 - protein, 14 aa, Mycobacterium avium
EGETSEQFDELQAA

SEQ ID NO: 33237 - protein, 13 aa, Mycobacterium avium
EGFTAPVSRRPER

SEQ ID NO: 33238 - protein, 6 aa, Mycobacterium avium
EGGAGL

SEQ ID NO: 33239 - protein, 9 aa, Mycobacterium avium
EGGALDDPA

SEQ ID NO: 33240 - protein, 11 aa, Mycobacterium avium
EGGATGSGSAT

SEQ ID NO: 33241 - protein, 5 aa, Mycobacterium avium
EGGEN

SEQ ID NO: 33242 - protein, 6 aa, Mycobacterium avium
EGGERV

SEQ ID NO: 33243 - protein, 13 aa, Mycobacterium avium
EGGGQANATIVEL

SEQ ID NO: 33244 - protein, 8 aa, Mycobacterium avium
EGGGQQVA

SEQ ID NO: 33245 - protein, 13 aa, Mycobacterium avium
EGGGTANVTIIER

SEQ ID NO: 33246 - protein, 8 aa, Mycobacterium avium
EGGPQRVA

SEQ ID NO: 33247 - protein, 10 aa, Mycobacterium avium
EGGPSRHHAR

SEQ ID NO: 33248 - protein, 9 aa, Mycobacterium avium
EGGQGLSRD

SEQ ID NO: 33249 - protein, 12 aa, Mycobacterium avium
EGGRAHYRTVLT

SEQ ID NO: 33250 - protein, 6 aa, Mycobacterium avium
EGGRGG

SEQ ID NO: 33251 - protein, 11 aa, Mycobacterium avium
EGGRTRTGKLR

SEQ ID NO: 33252 - protein, 14 aa, Mycobacterium avium
EGGSAVTTGERVSA

SEQ ID NO: 33253 - protein, 8 aa, Mycobacterium avium
EGGYQPPL

SEQ ID NO: 33254 - protein, 10 aa, Mycobacterium avium
EGGYRDPEGP

SEQ ID NO: 33255 - protein, 6 aa, Mycobacterium avium
EGHATM

SEQ ID NO: 33256 - protein, 10 aa, Mycobacterium avium
EGHDPDAAAL

SEQ ID NO: 33257 - protein, 5 aa, Mycobacterium avium
EGHDQ

SEQ ID NO: 33258 - protein, 14 aa, Mycobacterium avium
EGHGDSTVASPVDA

SEQ ID NO: 33259 - protein, 4 aa, Mycobacterium avium
EGIA

SEQ ID NO: 33260 - protein, 6 aa, Mycobacterium avium
EGIAAG

SEQ ID NO: 33261 - protein, 4 aa, Mycobacterium avium
EGIQ

SEQ ID NO: 33262 - protein, 11 aa, Mycobacterium avium
EGISDGGIAPA

SEQ ID NO: 33263 - protein, 6 aa, Mycobacterium avium
EGISTE

SEQ ID NO: 33264 - protein, 10 aa, Mycobacterium avium
EGKAFSSGGS

SEQ ID NO: 33265 - protein, 6 aa, Mycobacterium avium
EGKIGG

SEQ ID NO: 33266 - protein, 9 aa, Mycobacterium avium
EGKPPREVP

SEQ ID NO: 33267 - protein, 9 aa, Mycobacterium avium
EGKSVGSAA

SEQ ID NO: 33268 - protein, 7 aa, Mycobacterium avium
EGLPGAE

SEQ ID NO: 33269 - protein, 8 aa, Mycobacterium avium
EGLPGQTS

SEQ ID NO: 33270 - protein, 4 aa, Mycobacterium avium
EGLQ

SEQ ID NO: 33271 - protein, 7 aa, Mycobacterium avium
EGNDRDH

SEQ ID NO: 33272 - protein, 7 aa, Mycobacterium avium
EGNGNRR

SEQ ID NO: 33273 - protein, 6 aa, Mycobacterium avium
EGPAHG

SEQ ID NO: 33274 - protein, 5 aa, Mycobacterium avium
EGPDT

SEQ ID NO: 33275 - protein, 7 aa, Mycobacterium avium
EGPDYGA

SEQ ID NO: 33276 - protein, 7 aa, Mycobacterium avium
EGPEVEA

SEQ ID NO: 33277 - protein, 20 aa, Mycobacterium avium
EGPEVGGPYGPYRQSQRGEI

SEQ ID NO: 33278 - protein, 14 aa, Mycobacterium avium
EGPGITDDTRTGAT

SEQ ID NO: 33279 - protein, 7 aa, Mycobacterium avium
EGPGLTP

SEQ ID NO: 33280 - protein, 10 aa, Mycobacterium avium
EGPGTDPELT

SEQ ID NO: 33281 - protein, 4 aa, Mycobacterium avium
EGPI

SEQ ID NO: 33282 - protein, 9 aa, Mycobacterium avium
EGPKGGPGM

SEQ ID NO: 33283 - protein, 12 aa, Mycobacterium avium
EGPLRDSTAGRA

SEQ ID NO: 33284 - protein, 7 aa, Mycobacterium avium
EGPNGLE

SEQ ID NO: 33285 - protein, 8 aa, Mycobacterium avium
EGPNGPVQ

SEQ ID NO: 33286 - protein, 4 aa, Mycobacterium avium
EGPR

SEQ ID NO: 33287 - protein, 7 aa, Mycobacterium avium
EGPRGLY

SEQ ID NO: 33288 - protein, 10 aa, Mycobacterium avium
EGPSSASALA

SEQ ID NO: 33289 - protein, 5 aa, Mycobacterium avium
EGPVT

SEQ ID NO: 33290 - protein, 39 aa, Mycobacterium avium
EGQAQQDKAEAQREAAQKEAEAESARKAAEINEARQKAE

SEQ ID NO: 33291 - protein, 19 aa, Mycobacterium avium
EGQPSWSGKPEVAAAAEAR

SEQ ID NO: 33292 - protein, 8 aa, Mycobacterium avium
EGQRAGRI

SEQ ID NO: 33293 - protein, 7 aa, Mycobacterium avium
EGQRPRA

SEQ ID NO: 33294 - protein, 5 aa, Mycobacterium avium
EGQVN

SEQ ID NO: 33295 - protein, 4 aa, Mycobacterium avium
EGRA

SEQ ID NO: 33296 - protein, 8 aa, Mycobacterium avium
EGRAANPD

SEQ ID NO: 33297 - protein, 9 aa, Mycobacterium avium
EGRAATAGA

SEQ ID NO: 33298 - protein, 9 aa, Mycobacterium avium
EGRAEAAER

SEQ ID NO: 33299 - protein, 9 aa, Mycobacterium avium
EGRAKRDDT

SEQ ID NO: 33300 - protein, 5 aa, Mycobacterium avium
EGRAR

SEQ ID NO: 33301 - protein, 6 aa, Mycobacterium avium
EGRDDV

SEQ ID NO: 33302 - protein, 5 aa, Mycobacterium avium
EGRDG

SEQ ID NO: 33303 - protein, 10 aa, Mycobacterium avium
EGRDTTNMPR

SEQ ID NO: 33304 - protein, 6 aa, Mycobacterium avium
EGRDVD

SEQ ID NO: 33305 - protein, 8 aa, Mycobacterium avium
EGRFDEQS

SEQ ID NO: 33306 - protein, 9 aa, Mycobacterium avium
EGRGEPRDD

SEQ ID NO: 33307 - protein, 5 aa, Mycobacterium avium
EGRGV

SEQ ID NO: 33308 - protein, 4 aa, Mycobacterium avium
EGRL

SEQ ID NO: 33309 - protein, 5 aa, Mycobacterium avium
EGRPF

SEQ ID NO: 33310 - protein, 8 aa, Mycobacterium avium
EGRPSTDA

SEQ ID NO: 33311 - protein, 5 aa, Mycobacterium avium
EGRPV

SEQ ID NO: 33312 - protein, 8 aa, Mycobacterium avium
EGRQRRPL

SEQ ID NO: 33313 - protein, 13 aa, Mycobacterium avium
EGRRGQPRLRPPF

SEQ ID NO: 33314 - protein, 10 aa, Mycobacterium avium
EGRSLGDPET

SEQ ID NO: 33315 - protein, 7 aa, Mycobacterium avium
EGRSTAT

SEQ ID NO: 33316 - protein, 5 aa, Mycobacterium avium
EGRYP

SEQ ID NO: 33317 - protein, 7 aa, Mycobacterium avium
EGSADPH

SEQ ID NO: 33318 - protein, 7 aa, Mycobacterium avium
EGSARAR

SEQ ID NO: 33319 - protein, 18 aa, Mycobacterium avium
EGSEDKRISYADTQARPV

SEQ ID NO: 33320 - protein, 6 aa, Mycobacterium avium
EGSEGL

SEQ ID NO: 33321 - protein, 6 aa, Mycobacterium avium
EGSGDS

SEQ ID NO: 33322 - protein, 11 aa, Mycobacterium avium
EGSHDRVSTTY

SEQ ID NO: 33323 - protein, 5 aa, Mycobacterium avium
EGSPS

SEQ ID NO: 33324 - protein, 4 aa, Mycobacterium avium
EGSR

SEQ ID NO: 33325 - protein, 8 aa, Mycobacterium avium
EGSTAAWE

SEQ ID NO: 33326 - protein, 5 aa, Mycobacterium avium
EGTAE

SEQ ID NO: 33327 - protein, 18 aa, Mycobacterium avium
EGTAELTPPAAAPDDDTV

SEQ ID NO: 33328 - protein, 14 aa, Mycobacterium avium
EGTDDLIADIDRAL

SEQ ID NO: 33329 - protein, 13 aa, Mycobacterium avium
EGTGDAAALPAGK

SEQ ID NO: 33330 - protein, 4 aa, Mycobacterium avium
EGTK

SEQ ID NO: 33331 - protein, 7 aa, Mycobacterium avium
EGTLPPA

SEQ ID NO: 33332 - protein, 5 aa, Mycobacterium avium
EGTPE

SEQ ID NO: 33333 - protein, 5 aa, Mycobacterium avium
EGTRG

SEQ ID NO: 33334 - protein, 10 aa, Mycobacterium avium
EGTRSRTGKM

SEQ ID NO: 33335 - protein, 8 aa, Mycobacterium avium
EGTSTITN

SEQ ID NO: 33336 - protein, 5 aa, Mycobacterium avium
EGTTA

SEQ ID NO: 33337 - protein, 7 aa, Mycobacterium avium
EGVDEPT

SEQ ID NO: 33338 - protein, 10 aa, Mycobacterium avium
EGVDEQGRPI

SEQ ID NO: 33339 - protein, 6 aa, Mycobacterium avium
EGVEQS

SEQ ID NO: 33340 - protein, 5 aa, Mycobacterium avium
EGVGK

SEQ ID NO: 33341 - protein, 11 aa, Mycobacterium avium
EGVLGDADRDH

SEQ ID NO: 33342 - protein, 7 aa, Mycobacterium avium
EGVPEDI

SEQ ID NO: 33343 - protein, 6 aa, Mycobacterium avium
EGVPTP

SEQ ID NO: 33344 - protein, 8 aa, Mycobacterium avium
EGVRDGEP

SEQ ID NO: 33345 - protein, 8 aa, Mycobacterium avium
EGVRGTGP

SEQ ID NO: 33346 - protein, 5 aa, Mycobacterium avium
EGVTP

SEQ ID NO: 33347 - protein, 7 aa, Mycobacterium avium
EGYGKTS

SEQ ID NO: 33348 - protein, 9 aa, Mycobacterium avium
EGYPTPTDQ

SEQ ID NO: 33349 - protein, 10 aa, Mycobacterium avium
EHAKARGAKP

SEQ ID NO: 33350 - protein, 4 aa, Mycobacterium avium
EHDG

SEQ ID NO: 33351 - protein, 13 aa, Mycobacterium avium
EHDGQPQYRTRKH

SEQ ID NO: 33352 - protein, 7 aa, Mycobacterium avium
EHDHPGP

SEQ ID NO: 33353 - protein, 16 aa, Mycobacterium avium
EHDRGAPSYRPDRPRT

SEQ ID NO: 33354 - protein, 5 aa, Mycobacterium avium
EHDTE

SEQ ID NO: 33355 - protein, 12 aa, Mycobacterium avium
EHEAEHGALPPR

SEQ ID NO: 33356 - protein, 13 aa, Mycobacterium avium
EHEAGTDDQAPHE

SEQ ID NO: 33357 - protein, 8 aa, Mycobacterium avium
EHEAKTAL

SEQ ID NO: 33358 - protein, 9 aa, Mycobacterium avium
EHEASDPQL

SEQ ID NO: 33359 - protein, 6 aa, Mycobacterium avium
EHEEHD

SEQ ID NO: 33360 - protein, 18 aa, Mycobacterium avium
EHELGTKGPGQDGPGRET

SEQ ID NO: 33361 - protein, 8 aa, Mycobacterium avium
EHGAQGDR

SEQ ID NO: 33362 - protein, 6 aa, Mycobacterium avium
EHGGTF

SEQ ID NO: 33363 - protein, 13 aa, Mycobacterium avium
EHGKGSVALRGGA

SEQ ID NO: 33364 - protein, 7 aa, Mycobacterium avium
EHGNERV

SEQ ID NO: 33365 - protein, 5 aa, Mycobacterium avium
EHGRS

SEQ ID NO: 33366 - protein, 9 aa, Mycobacterium avium
EHHSESTES

SEQ ID NO: 33367 - protein, 7 aa, Mycobacterium avium
EHLDGAP

SEQ ID NO: 33368 - protein, 14 aa, Mycobacterium avium
EHNERQYNPYDPAE

SEQ ID NO: 33369 - protein, 7 aa, Mycobacterium avium
EHNLPDA

SEQ ID NO: 33370 - protein, 4 aa, Mycobacterium avium
EHPA

SEQ ID NO: 33371 - protein, 5 aa, Mycobacterium avium
EHPAH

SEQ ID NO: 33372 - protein, 4 aa, Mycobacterium avium
EHPD

SEQ ID NO: 33373 - protein, 15 aa, Mycobacterium avium
EHPDGRLRSADRGWS

SEQ ID NO: 33374 - protein, 9 aa, Mycobacterium avium
EHPDQRREV

SEQ ID NO: 33375 - protein, 6 aa, Mycobacterium avium
EHPEPD

SEQ ID NO: 33376 - protein, 5 aa, Mycobacterium avium
EHPGH

SEQ ID NO: 33377 - protein, 14 aa, Mycobacterium avium
EHPGPVETSNRPAL

SEQ ID NO: 33378 - protein, 6 aa, Mycobacterium avium
EHPGYG

SEQ ID NO: 33379 - protein, 5 aa, Mycobacterium avium
EHPRP

SEQ ID NO: 33380 - protein, 7 aa, Mycobacterium avium
EHPSTAR

SEQ ID NO: 33381 - protein, 7 aa, Mycobacterium avium
EHPYPAP

SEQ ID NO: 33382 - protein, 12 aa, Mycobacterium avium
EHQDHRSYAGTV

SEQ ID NO: 33383 - protein, 10 aa, Mycobacterium avium
EHQWAGDPRV

SEQ ID NO: 33384 - protein, 14 aa, Mycobacterium avium
EHRARIAEEYRAAD

SEQ ID NO: 33385 - protein, 14 aa, Mycobacterium avium
EHRPDGTAVVLAGR

SEQ ID NO: 33386 - protein, 7 aa, Mycobacterium avium
EHRPESL

SEQ ID NO: 33387 - protein, 4 aa, Mycobacterium avium
EHRR

SEQ ID NO: 33388 - protein, 13 aa, Mycobacterium avium
EHRSTVSPYLVKQ

SEQ ID NO: 33389 - protein, 14 aa, Mycobacterium avium
EHSHAGGGLPSYPH

SEQ ID NO: 33390 - protein, 8 aa, Mycobacterium avium
EHTDGPVW

SEQ ID NO: 33391 - protein, 6 aa, Mycobacterium avium
EHTGGP

SEQ ID NO: 33392 - protein, 11 aa, Mycobacterium avium
EHTGNTSAASI

SEQ ID NO: 33393 - protein, 9 aa, Mycobacterium avium
EHTVAEQDE

SEQ ID NO: 33394 - protein, 7 aa, Mycobacterium avium
EIAAASS

SEQ ID NO: 33395 - protein, 7 aa, Mycobacterium avium
EIAGAPA

SEQ ID NO: 33396 - protein, 5 aa, Mycobacterium avium
EIAPH

SEQ ID NO: 33397 - protein, 18 aa, Mycobacterium avium
EIDRATKSVVTADGQRHH

SEQ ID NO: 33398 - protein, 14 aa, Mycobacterium avium
EIENSDSDYDREKL

SEQ ID NO: 33399 - protein, 8 aa, Mycobacterium avium
EIGERPSM

SEQ ID NO: 33400 - protein, 6 aa, Mycobacterium avium
EIGKSS

SEQ ID NO: 33401 - protein, 9 aa, Mycobacterium avium
EIGSGSVPQ

SEQ ID NO: 33402 - protein, 10 aa, Mycobacterium avium
EIGTTPLSDL

SEQ ID NO: 33403 - protein, 7 aa, Mycobacterium avium
EIPATPV

SEQ ID NO: 33404 - protein, 5 aa, Mycobacterium avium
EIPEE

SEQ ID NO: 33405 - protein, 8 aa, Mycobacterium avium
EIPGPSGT

SEQ ID NO: 33406 - protein, 16 aa, Mycobacterium avium
EIPSFAPPKDLQPGEY

SEQ ID NO: 33407 - protein, 7 aa, Mycobacterium avium
EIQPGVT

SEQ ID NO: 33408 - protein, 5 aa, Mycobacterium avium
EIQQN

SEQ ID NO: 33409 - protein, 4 aa, Mycobacterium avium
EIRD

SEQ ID NO: 33410 - protein, 4 aa, Mycobacterium avium
EIRE

SEQ ID NO: 33411 - protein, 4 aa, Mycobacterium avium
EIRG

SEQ ID NO: 33412 - protein, 4 aa, Mycobacterium avium
EIRR

SEQ ID NO: 33413 - protein, 5 aa, Mycobacterium avium
EISDE

SEQ ID NO: 33414 - protein, 5 aa, Mycobacterium avium
EISET

SEQ ID NO: 33415 - protein, 11 aa, Mycobacterium avium
EISPDGTTRSV

SEQ ID NO: 33416 - protein, 6 aa, Mycobacterium avium
EISSTG

SEQ ID NO: 33417 - protein, 6 aa, Mycobacterium avium
EITDDD

SEQ ID NO: 33418 - protein, 9 aa, Mycobacterium avium
EITRPGSDR

SEQ ID NO: 33419 - protein, 6 aa, Mycobacterium avium
EKAAGA

SEQ ID NO: 33420 - protein, 10 aa, Mycobacterium avium
EKAARRGLTS

SEQ ID NO: 33421 - protein, 6 aa, Mycobacterium avium
EKADRT

SEQ ID NO: 33422 - protein, 7 aa, Mycobacterium avium
EKAGAMR

SEQ ID NO: 33423 - protein, 8 aa, Mycobacterium avium
EKAKPRKI

SEQ ID NO: 33424 - protein, 8 aa, Mycobacterium avium
EKAKPRRI

SEQ ID NO: 33425 - protein, 7 aa, Mycobacterium avium
EKDGSAR

SEQ ID NO: 33426 - protein, 6 aa, Mycobacterium avium
EKDPDT

SEQ ID NO: 33427 - protein, 20 aa, Mycobacterium avium
EKDPTLAYGPGRGAIGSPAT

SEQ ID NO: 33428 - protein, 8 aa, Mycobacterium avium
EKEAGPRR

SEQ ID NO: 33429 - protein, 16 aa, Mycobacterium avium
EKEESGVSGSKDTNGT

SEQ ID NO: 33430 - protein, 8 aa, Mycobacterium avium
EKEGQRAI

SEQ ID NO: 33431 - protein, 9 aa, Mycobacterium avium
EKENLAPGL

SEQ ID NO: 33432 - protein, 5 aa, Mycobacterium avium
EKFSG

SEQ ID NO: 33433 - protein, 8 aa, Mycobacterium avium
EKGAPTPV

SEQ ID NO: 33434 - protein, 4 aa, Mycobacterium avium
EKGD

SEQ ID NO: 33435 - protein, 8 aa, Mycobacterium avium
EKGLASKP

SEQ ID NO: 33436 - protein, 6 aa, Mycobacterium avium
EKGNAA

SEQ ID NO: 33437 - protein, 6 aa, Mycobacterium avium
EKGPRL

SEQ ID NO: 33438 - protein, 15 aa, Mycobacterium avium
EKGSPERDFGPRSAD

SEQ ID NO: 33439 - protein, 14 aa, Mycobacterium avium
EKGTGHELFTDHVD

SEQ ID NO: 33440 - protein, 6 aa, Mycobacterium avium
EKHGPP

SEQ ID NO: 33441 - protein, 5 aa, Mycobacterium avium
EKHPV

SEQ ID NO: 33442 - protein, 8 aa, Mycobacterium avium
EKIAGGVD

SEQ ID NO: 33443 - protein, 7 aa, Mycobacterium avium
EKIEEGS

SEQ ID NO: 33444 - protein, 6 aa, Mycobacterium avium
EKIGPA

SEQ ID NO: 33445 - protein, 12 aa, Mycobacterium avium
EKLDTGNHDAAR

SEQ ID NO: 33446 - protein, 7 aa, Mycobacterium avium
EKMSKSV

SEQ ID NO: 33447 - protein, 13 aa, Mycobacterium avium
EKNAAAKEHAAAM

SEQ ID NO: 33448 - protein, 9 aa, Mycobacterium avium
EKNKLERSL

SEQ ID NO: 33449 - protein, 7 aa, Mycobacterium avium
EKPEAVD

SEQ ID NO: 33450 - protein, 9 aa, Mycobacterium avium
EKPGRREGW

SEQ ID NO: 33451 - protein, 10 aa, Mycobacterium avium
EKPKAEDAPS

SEQ ID NO: 33452 - protein, 5 aa, Mycobacterium avium
EKPVK

SEQ ID NO: 33453 - protein, 4 aa, Mycobacterium avium
EKQG

SEQ ID NO: 33454 - protein, 7 aa, Mycobacterium avium
EKQGRSG

SEQ ID NO: 33455 - protein, 11 aa, Mycobacterium avium
EKQKEGKKRMK

SEQ ID NO: 33456 - protein, 10 aa, Mycobacterium avium
EKQPQGPRIT

SEQ ID NO: 33457 - protein, 7 aa, Mycobacterium avium
EKQRARV

SEQ ID NO: 33458 - protein, 7 aa, Mycobacterium avium
EKQRQRV

SEQ ID NO: 33459 - protein, 18 aa, Mycobacterium avium
EKRDSDAVGAATRRAGEV

SEQ ID NO: 33460 - protein, 13 aa, Mycobacterium avium
EKRQAYEARARGE

SEQ ID NO: 33461 - protein, 6 aa, Mycobacterium avium
EKSDQI

SEQ ID NO: 33462 - protein, 11 aa, Mycobacterium avium
EKTRNALAGTG

SEQ ID NO: 33463 - protein, 5 aa, Mycobacterium avium
ELAEQ

SEQ ID NO: 33464 - protein, 4 aa, Mycobacterium avium
ELAG

SEQ ID NO: 33465 - protein, 5 aa, Mycobacterium avium
ELAGA

SEQ ID NO: 33466 - protein, 9 aa, Mycobacterium avium
ELAGENGVR

SEQ ID NO: 33467 - protein, 6 aa, Mycobacterium avium
ELAPEG

SEQ ID NO: 33468 - protein, 7 aa, Mycobacterium avium
ELAPPEP

SEQ ID NO: 33469 - protein, 11 aa, Mycobacterium avium
ELAQRDGLRGQ

SEQ ID NO: 33470 - protein, 6 aa, Mycobacterium avium
ELASED

SEQ ID NO: 33471 - protein, 7 aa, Mycobacterium avium
ELASPDA

SEQ ID NO: 33472 - protein, 11 aa, Mycobacterium avium
ELASTTAKLAN

SEQ ID NO: 33473 - protein, 11 aa, Mycobacterium avium
ELDAHGDNPAN

SEQ ID NO: 33474 - protein, 5 aa, Mycobacterium avium
ELDGG

SEQ ID NO: 33475 - protein, 13 aa, Mycobacterium avium
ELDGGPSWHEGPA

SEQ ID NO: 33476 - protein, 6 aa, Mycobacterium avium
ELDNPA

SEQ ID NO: 33477 - protein, 4 aa, Mycobacterium avium
ELDP

SEQ ID NO: 33478 - protein, 9 aa, Mycobacterium avium
ELDPATQAA

SEQ ID NO: 33479 - protein, 7 aa, Mycobacterium avium
ELDSAAG

SEQ ID NO: 33480 - protein, 8 aa, Mycobacterium avium
ELEEGKRR

SEQ ID NO: 33481 - protein, 6 aa, Mycobacterium avium
ELEGAT

SEQ ID NO: 33482 - protein, 13 aa, Mycobacterium avium
ELEPDRDAANNAL

SEQ ID NO: 33483 - protein, 7 aa, Mycobacterium avium
ELGARGQ

SEQ ID NO: 33484 - protein, 6 aa, Mycobacterium avium
ELGDTP

SEQ ID NO: 33485 - protein, 10 aa, Mycobacterium avium
ELGEPSHYGR

SEQ ID NO: 33486 - protein, 12 aa, Mycobacterium avium
ELGGGSVSESGL

SEQ ID NO: 33487 - protein, 5 aa, Mycobacterium avium
ELGGL

SEQ ID NO: 33488 - protein, 8 aa, Mycobacterium avium
ELGGPKAP

SEQ ID NO: 33489 - protein, 8 aa, Mycobacterium avium
ELGGQGGR

SEQ ID NO: 33490 - protein, 11 aa, Mycobacterium avium
ELGGSDAQARY

SEQ ID NO: 33491 - protein, 12 aa, Mycobacterium avium
ELGGSSALPDIS

SEQ ID NO: 33492 - protein, 4 aa, Mycobacterium avium
ELGI

SEQ ID NO: 33493 - protein, 8 aa, Mycobacterium avium
ELGPDGKD

SEQ ID NO: 33494 - protein, 7 aa, Mycobacterium avium
ELGPEPE

SEQ ID NO: 33495 - protein, 6 aa, Mycobacterium avium
ELGPHG

SEQ ID NO: 33496 - protein, 27 aa, Mycobacterium avium
ELGQRGSAAPVDSSADAGGFDQFNRGN

SEQ ID NO: 33497 - protein, 6 aa, Mycobacterium avium
ELGREA

SEQ ID NO: 33498 - protein, 16 aa, Mycobacterium avium
ELGREKSALAAAVTAH

SEQ ID NO: 33499 - protein, 7 aa, Mycobacterium avium
ELGRSGS

SEQ ID NO: 33500 - protein, 4 aa, Mycobacterium avium
ELGT

SEQ ID NO: 33501 - protein, 9 aa, Mycobacterium avium
ELKPGAPDG

SEQ ID NO: 33502 - protein, 5 aa, Mycobacterium avium
ELNGA

SEQ ID NO: 33503 - protein, 6 aa, Mycobacterium avium
ELNRQG

SEQ ID NO: 33504 - protein, 15 aa, Mycobacterium avium
ELPAAPASRATVPQD

SEQ ID NO: 33505 - protein, 15 aa, Mycobacterium avium
ELPAGAGDGSNLPGD

SEQ ID NO: 33506 - protein, 14 aa, Mycobacterium avium
ELPDGRRGTSEKTR

SEQ ID NO: 33507 - protein, 13 aa, Mycobacterium avium
ELPEASRTARGQH

SEQ ID NO: 33508 - protein, 4 aa, Mycobacterium avium
ELPG

SEQ ID NO: 33509 - protein, 6 aa, Mycobacterium avium
ELPGAD

SEQ ID NO: 33510 - protein, 6 aa, Mycobacterium avium
ELPGDP

SEQ ID NO: 33511 - protein, 10 aa, Mycobacterium avium
ELPGPNGSVV

SEQ ID NO: 33512 - protein, 7 aa, Mycobacterium avium
ELPPEEW

SEQ ID NO: 33513 - protein, 5 aa, Mycobacterium avium
ELPPG

SEQ ID NO: 33514 - protein, 6 aa, Mycobacterium avium
ELPPSQ

SEQ ID NO: 33515 - protein, 7 aa, Mycobacterium avium
ELPREER

SEQ ID NO: 33516 - protein, 6 aa, Mycobacterium avium
ELPRND

SEQ ID NO: 33517 - protein, 4 aa, Mycobacterium avium
ELPT

SEQ ID NO: 33518 - protein, 9 aa, Mycobacterium avium
ELQSTNDEL

SEQ ID NO: 33519 - protein, 14 aa, Mycobacterium avium
ELRGPGKTRALAQS

SEQ ID NO: 33520 - protein, 4 aa, Mycobacterium avium
ELRP

SEQ ID NO: 33521 - protein, 9 aa, Mycobacterium avium
ELRPDAEQR

SEQ ID NO: 33522 - protein, 4 aa, Mycobacterium avium
ELRR

SEQ ID NO: 33523 - protein, 7 aa, Mycobacterium avium
ELRSKPG

SEQ ID NO: 33524 - protein, 5 aa, Mycobacterium avium
ELSEL

SEQ ID NO: 33525 - protein, 8 aa, Mycobacterium avium
ELSELGRA

SEQ ID NO: 33526 - protein, 7 aa, Mycobacterium avium
ELSESTL

SEQ ID NO: 33527 - protein, 8 aa, Mycobacterium avium
ELSPEAQR

SEQ ID NO: 33528 - protein, 10 aa, Mycobacterium avium
ELSTDDSPGF

SEQ ID NO: 33529 - protein, 7 aa, Mycobacterium avium
ELTARRG

SEQ ID NO: 33530 - protein, 8 aa, Mycobacterium avium
ELTDGSSK

SEQ ID NO: 33531 - protein, 6 aa, Mycobacterium avium
ELTETE

SEQ ID NO: 33532 - protein, 8 aa, Mycobacterium avium
ELTSAPYG

SEQ ID NO: 33533 - protein, 11 aa, Mycobacterium avium
ELVGPDDAQPW

SEQ ID NO: 33534 - protein, 8 aa, Mycobacterium avium
EMDEPESR

SEQ ID NO: 33535 - protein, 14 aa, Mycobacterium avium
EMGEAGTNAHHGSG

SEQ ID NO: 33536 - protein, 8 aa, Mycobacterium avium
EMGSPRSF

SEQ ID NO: 33537 - protein, 8 aa, Mycobacterium avium
EMRDRPGQ

SEQ ID NO: 33538 - protein, 8 aa, Mycobacterium avium
EMSEEARV

SEQ ID NO: 33539 - protein, 7 aa, Mycobacterium avium
EMTGTTE

SEQ ID NO: 33540 - protein, 4 aa, Mycobacterium avium
EMTP

SEQ ID NO: 33541 - protein, 6 aa, Mycobacterium avium
ENADAV

SEQ ID NO: 33542 - protein, 4 aa, Mycobacterium avium
ENAE

SEQ ID NO: 33543 - protein, 6 aa, Mycobacterium avium
ENAGQC

SEQ ID NO: 33544 - protein, 7 aa, Mycobacterium avium
ENAPDSA

SEQ ID NO: 33545 - protein, 6 aa, Mycobacterium avium
ENAPLG

SEQ ID NO: 33546 - protein, 8 aa, Mycobacterium avium
ENAPQGTS

SEQ ID NO: 33547 - protein, 9 aa, Mycobacterium avium
ENDPDPPLY

SEQ ID NO: 33548 - protein, 7 aa, Mycobacterium avium
ENDQRPI

SEQ ID NO: 33549 - protein, 14 aa, Mycobacterium avium
ENEDLPNTTNPDDW

SEQ ID NO: 33550 - protein, 7 aa, Mycobacterium avium
ENEIGKD

SEQ ID NO: 33551 - protein, 5 aa, Mycobacterium avium
ENGAR

SEQ ID NO: 33552 - protein, 14 aa, Mycobacterium avium
ENGKVTGERETDDG

SEQ ID NO: 33553 - protein, 4 aa, Mycobacterium avium
ENGL

SEQ ID NO: 33554 - protein, 15 aa, Mycobacterium avium
ENGRSISGQLSPDGL

SEQ ID NO: 33555 - protein, 5 aa, Mycobacterium avium
ENGRV

SEQ ID NO: 33556 - protein, 7 aa, Mycobacterium avium
ENGVGTV

SEQ ID NO: 33557 - protein, 9 aa, Mycobacterium avium
ENGVPVTPA

SEQ ID NO: 33558 - protein, 6 aa, Mycobacterium avium
ENGVTA

SEQ ID NO: 33559 - protein, 4 aa, Mycobacterium avium
ENHA

SEQ ID NO: 33560 - protein, 9 aa, Mycobacterium avium
ENIPEPGIP

SEQ ID NO: 33561 - protein, 8 aa, Mycobacterium avium
ENIPERGG

SEQ ID NO: 33562 - protein, 5 aa, Mycobacterium avium
ENKEF

SEQ ID NO: 33563 - protein, 4 aa, Mycobacterium avium
ENLS

SEQ ID NO: 33564 - protein, 16 aa, Mycobacterium avium
ENPANPAIHRSTTAEE

SEQ ID NO: 33565 - protein, 5 aa, Mycobacterium avium
ENPDL

SEQ ID NO: 33566 - protein, 4 aa, Mycobacterium avium
ENPE

SEQ ID NO: 33567 - protein, 8 aa, Mycobacterium avium
ENPHQQAS

SEQ ID NO: 33568 - protein, 12 aa, Mycobacterium avium
ENPPAGSAQAAV

SEQ ID NO: 33569 - protein, 6 aa, Mycobacterium avium
ENPRPG

SEQ ID NO: 33570 - protein, 5 aa, Mycobacterium avium
ENPTV

SEQ ID NO: 33571 - protein, 7 aa, Mycobacterium avium
ENQAEHV

SEQ ID NO: 33572 - protein, 7 aa, Mycobacterium avium
ENQHDET

SEQ ID NO: 33573 - protein, 4 aa, Mycobacterium avium
ENQP

SEQ ID NO: 33574 - protein, 11 aa, Mycobacterium avium
ENREGLPDEYR

SEQ ID NO: 33575 - protein, 10 aa, Mycobacterium avium
ENRELGDTST

SEQ ID NO: 33576 - protein, 15 aa, Mycobacterium avium
ENRLDTGGHGPQPCA

SEQ ID NO: 33577 - protein, 5 aa, Mycobacterium avium
ENRRP

SEQ ID NO: 33578 - protein, 5 aa, Mycobacterium avium
ENRYP

SEQ ID NO: 33579 - protein, 9 aa, Mycobacterium avium
ENSDGVDGR

SEQ ID NO: 33580 - protein, 8 aa, Mycobacterium avium
ENSGRERT

SEQ ID NO: 33581 - protein, 5 aa, Mycobacterium avium
ENSSN

SEQ ID NO: 33582 - protein, 5 aa, Mycobacterium avium
ENTGA

SEQ ID NO: 33583 - protein, 7 aa, Mycobacterium avium
ENTGASF

SEQ ID NO: 33584 - protein, 10 aa, Mycobacterium avium
ENVAESLTRG

SEQ ID NO: 33585 - protein, 4 aa, Mycobacterium avium
ENVG

SEQ ID NO: 33586 - protein, 4 aa, Mycobacterium avium
ENVP

SEQ ID NO: 33587 - protein, 7 aa, Mycobacterium avium
ENYDDPA

SEQ ID NO: 33588 - protein, 5 aa, Mycobacterium avium
EPAAA

SEQ ID NO: 33589 - protein, 10 aa, Mycobacterium avium
EPAAGELGVR

SEQ ID NO: 33590 - protein, 12 aa, Mycobacterium avium
EPAAPLDGDAVL

SEQ ID NO: 33591 - protein, 5 aa, Mycobacterium avium
EPAAR

SEQ ID NO: 33592 - protein, 10 aa, Mycobacterium avium
EPAEDTGGAR

SEQ ID NO: 33593 - protein, 6 aa, Mycobacterium avium
EPAEGF

SEQ ID NO: 33594 - protein, 6 aa, Mycobacterium avium
EPAGEE

SEQ ID NO: 33595 - protein, 7 aa, Mycobacterium avium
EPAGEGR

SEQ ID NO: 33596 - protein, 6 aa, Mycobacterium avium
EPAGFE

SEQ ID NO: 33597 - protein, 6 aa, Mycobacterium avium
EPAGGR

SEQ ID NO: 33598 - protein, 8 aa, Mycobacterium avium
EPAGLPES

SEQ ID NO: 33599 - protein, 7 aa, Mycobacterium avium
EPAHARA

SEQ ID NO: 33600 - protein, 12 aa, Mycobacterium avium
EPAKPEPEQARL

SEQ ID NO: 33601 - protein, 4 aa, Mycobacterium avium
EPAM

SEQ ID NO: 33602 - protein, 15 aa, Mycobacterium avium
EPAPIRHGDAETAAR

SEQ ID NO: 33603 - protein, 4 aa, Mycobacterium avium
EPAS

SEQ ID NO: 33604 - protein, 4 aa, Mycobacterium avium
EPCR

SEQ ID NO: 33605 - protein, 6 aa, Mycobacterium avium
EPCTDS

SEQ ID NO: 33606 - protein, 4 aa, Mycobacterium avium
EPDA

SEQ ID NO: 33607 - protein, 19 aa, Mycobacterium avium
EPDAGSDAASIKTRATRVE

SEQ ID NO: 33608 - protein, 21 aa, Mycobacterium avium
EPDAGSDVGAGRAKAIEQPDG

SEQ ID NO: 33609 - protein, 23 aa, Mycobacterium avium
EPDAGSDVGAGRTKAVKQDDGSW

SEQ ID NO: 33610 - protein, 20 aa, Mycobacterium avium
EPDAGSNSHKITTTARRDGS

SEQ ID NO: 33611 - protein, 9 aa, Mycobacterium avium
EPDERPELA

SEQ ID NO: 33612 - protein, 4 aa, Mycobacterium avium
EPDG

SEQ ID NO: 33613 - protein, 9 aa, Mycobacterium avium
EPDGKRTVT

SEQ ID NO: 33614 - protein, 4 aa, Mycobacterium avium
EPDI

SEQ ID NO: 33615 - protein, 10 aa, Mycobacterium avium
EPDKVEGGMR

SEQ ID NO: 33616 - protein, 18 aa, Mycobacterium avium
EPDNPADAYASVERTDKL

SEQ ID NO: 33617 - protein, 9 aa, Mycobacterium avium
EPDNPARQY

SEQ ID NO: 33618 - protein, 5 aa, Mycobacterium avium
EPDPE

SEQ ID NO: 33619 - protein, 7 aa, Mycobacterium avium
EPDPGEM

SEQ ID NO: 33620 - protein, 8 aa, Mycobacterium avium
EPDRDIPD

SEQ ID NO: 33621 - protein, 5 aa, Mycobacterium avium
EPDRP

SEQ ID NO: 33622 - protein, 20 aa, Mycobacterium avium
EPDVGSDPAAMKTRARRDGS

SEQ ID NO: 33623 - protein, 4 aa, Mycobacterium avium
EPDY

SEQ ID NO: 33624 - protein, 6 aa, Mycobacterium avium
EPEDES

SEQ ID NO: 33625 - protein, 4 aa, Mycobacterium avium
EPEE

SEQ ID NO: 33626 - protein, 5 aa, Mycobacterium avium
EPEHQ

SEQ ID NO: 33627 - protein, 8 aa, Mycobacterium avium
EPEITPTD

SEQ ID NO: 33628 - protein, 5 aa, Mycobacterium avium
EPELT

SEQ ID NO: 33629 - protein, 6 aa, Mycobacterium avium
EPEREQ

SEQ ID NO: 33630 - protein, 7 aa, Mycobacterium avium
EPETDLD

SEQ ID NO: 33631 - protein, 5 aa, Mycobacterium avium
EPEVD

SEQ ID NO: 33632 - protein, 12 aa, Mycobacterium avium
EPFPADDESTAA

SEQ ID NO: 33633 - protein, 4 aa, Mycobacterium avium
EPFT

SEQ ID NO: 33634 - protein, 8 aa, Mycobacterium avium
EPFTDDAR

SEQ ID NO: 33635 - protein, 7 aa, Mycobacterium avium
EPFTPED

SEQ ID NO: 33636 - protein, 8 aa, Mycobacterium avium
EPGAGSDL

SEQ ID NO: 33637 - protein, 22 aa, Mycobacterium avium
EPGAGSDLAGLSTKATRTDGGW

SEQ ID NO: 33638 - protein, 11 aa, Mycobacterium avium
EPGAGSDLASL

SEQ ID NO: 33639 - protein, 10 aa, Mycobacterium avium
EPGENPADCA

SEQ ID NO: 33640 - protein, 8 aa, Mycobacterium avium
EPGETAGF

SEQ ID NO: 33641 - protein, 7 aa, Mycobacterium avium
EPGETRE

SEQ ID NO: 33642 - protein, 19 aa, Mycobacterium avium
EPGFGSDSAAVSTTATLDG

SEQ ID NO: 33643 - protein, 8 aa, Mycobacterium avium
EPGPDAAR

SEQ ID NO: 33644 - protein, 8 aa, Mycobacterium avium
EPGPPNAL

SEQ ID NO: 33645 - protein, 6 aa, Mycobacterium avium
EPGQPV

SEQ ID NO: 33646 - protein, 5 aa, Mycobacterium avium
EPGRP

SEQ ID NO: 33647 - protein, 9 aa, Mycobacterium avium
EPGSITPTT

SEQ ID NO: 33648 - protein, 6 aa, Mycobacterium avium
EPGTDH

SEQ ID NO: 33649 - protein, 8 aa, Mycobacterium avium
EPGTNGQH

SEQ ID NO: 33650 - protein, 12 aa, Mycobacterium avium
EPGTPRGSIGRG

SEQ ID NO: 33651 - protein, 5 aa, Mycobacterium avium
EPGTV

SEQ ID NO: 33652 - protein, 7 aa, Mycobacterium avium
EPGVGKT

SEQ ID NO: 33653 - protein, 9 aa, Mycobacterium avium
EPHAEGQPA

SEQ ID NO: 33654 - protein, 11 aa, Mycobacterium avium
EPHEYSAQRTG

SEQ ID NO: 33655 - protein, 4 aa, Mycobacterium avium
EPHP

SEQ ID NO: 33656 - protein, 7 aa, Mycobacterium avium
EPHPTRE

SEQ ID NO: 33657 - protein, 4 aa, Mycobacterium avium
EPID

SEQ ID NO: 33658 - protein, 9 aa, Mycobacterium avium
EPIRSGDEV

SEQ ID NO: 33659 - protein, 4 aa, Mycobacterium avium
EPKN

SEQ ID NO: 33660 - protein, 4 aa, Mycobacterium avium
EPKP

SEQ ID NO: 33661 - protein, 8 aa, Mycobacterium avium
EPKPDWKN

SEQ ID NO: 33662 - protein, 11 aa, Mycobacterium avium
EPKPQGAPQYA

SEQ ID NO: 33663 - protein, 8 aa, Mycobacterium avium
EPKPVQKP

SEQ ID NO: 33664 - protein, 7 aa, Mycobacterium avium
EPKTGAV

SEQ ID NO: 33665 - protein, 11 aa, Mycobacterium avium
EPKTKSDQEKL

SEQ ID NO: 33666 - protein, 12 aa, Mycobacterium avium
EPLDAKKNAMTT

SEQ ID NO: 33667 - protein, 22 aa, Mycobacterium avium
EPLDDGPVLPRQERIQQVLARA

SEQ ID NO: 33668 - protein, 4 aa, Mycobacterium avium
EPLG

SEQ ID NO: 33669 - protein, 11 aa, Mycobacterium avium
EPLGPDEAGLT

SEQ ID NO: 33670 - protein, 14 aa, Mycobacterium avium
EPLGTQSSSEARIA

SEQ ID NO: 33671 - protein, 8 aa, Mycobacterium avium
EPLSAAAA

SEQ ID NO: 33672 - protein, 4 aa, Mycobacterium avium
EPLT

SEQ ID NO: 33673 - protein, 12 aa, Mycobacterium avium
EPLTGGTELRPI

SEQ ID NO: 33674 - protein, 15 aa, Mycobacterium avium
EPMPESAAARVATAA

SEQ ID NO: 33675 - protein, 4 aa, Mycobacterium avium
EPNE

SEQ ID NO: 33676 - protein, 7 aa, Mycobacterium avium
EPNGPTH

SEQ ID NO: 33677 - protein, 7 aa, Mycobacterium avium
EPNLSDG

SEQ ID NO: 33678 - protein, 8 aa, Mycobacterium avium
EPPAGDPL

SEQ ID NO: 33679 - protein, 6 aa, Mycobacterium avium
EPPHTA

SEQ ID NO: 33680 - protein, 18 aa, Mycobacterium avium
EPPLNEEKTVRGNVEEGL

SEQ ID NO: 33681 - protein, 8 aa, Mycobacterium avium
EPPPDAGP

SEQ ID NO: 33682 - protein, 23 aa, Mycobacterium avium
EPPPSLTKARREGPAEHKHSPDE

SEQ ID NO: 33683 - protein, 9 aa, Mycobacterium avium
EPPQGDPLR

SEQ ID NO: 33684 - protein, 7 aa, Mycobacterium avium
EPPSPVQ

SEQ ID NO: 33685 - protein, 8 aa, Mycobacterium avium
EPPTGDPA

SEQ ID NO: 33686 - protein, 5 aa, Mycobacterium avium
EPPVM

SEQ ID NO: 33687 - protein, 6 aa, Mycobacterium avium
EPQDGE

SEQ ID NO: 33688 - protein, 10 aa, Mycobacterium avium
EPQGGADPKV

SEQ ID NO: 33689 - protein, 10 aa, Mycobacterium avium
EPQGGADPRV

SEQ ID NO: 33690 - protein, 6 aa, Mycobacterium avium
EPQHFT

SEQ ID NO: 33691 - protein, 8 aa, Mycobacterium avium
EPQHGSDA

SEQ ID NO: 33692 - protein, 5 aa, Mycobacterium avium
EPQKR

SEQ ID NO: 33693 - protein, 7 aa, Mycobacterium avium
EPQYGAP

SEQ ID NO: 33694 - protein, 17 aa, Mycobacterium avium
EPRAKPRRRSKKAPTRR

SEQ ID NO: 33695 - protein, 8 aa, Mycobacterium avium
EPREAEQL

SEQ ID NO: 33696 - protein, 6 aa, Mycobacterium avium
EPRGRR

SEQ ID NO: 33697 - protein, 6 aa, Mycobacterium avium
EPRGTA

SEQ ID NO: 33698 - protein, 5 aa, Mycobacterium avium
EPRKG

SEQ ID NO: 33699 - protein, 4 aa, Mycobacterium avium
EPRV

SEQ ID NO: 33700 - protein, 4 aa, Mycobacterium avium
EPSA

SEQ ID NO: 33701 - protein, 6 aa, Mycobacterium avium
EPSAAS

SEQ ID NO: 33702 - protein, 6 aa, Mycobacterium avium
EPSATQ

SEQ ID NO: 33703 - protein, 7 aa, Mycobacterium avium
EPSDVAD

SEQ ID NO: 33704 - protein, 9 aa, Mycobacterium avium
EPSLSRGGD

SEQ ID NO: 33705 - protein, 6 aa, Mycobacterium avium
EPSSGF

SEQ ID NO: 33706 - protein, 8 aa, Mycobacterium avium
EPSSGHGV

SEQ ID NO: 33707 - protein, 5 aa, Mycobacterium avium
EPSVA

SEQ ID NO: 33708 - protein, 5 aa, Mycobacterium avium
EPTAA

SEQ ID NO: 33709 - protein, 8 aa, Mycobacterium avium
EPTAATAY

SEQ ID NO: 33710 - protein, 9 aa, Mycobacterium avium
EPTALENPR

SEQ ID NO: 33711 - protein, 4 aa, Mycobacterium avium
EPTD

SEQ ID NO: 33712 - protein, 8 aa, Mycobacterium avium
EPTDTGTR

SEQ ID NO: 33713 - protein, 4 aa, Mycobacterium avium
EPTG

SEQ ID NO: 33714 - protein, 5 aa, Mycobacterium avium
EPTGG

SEQ ID NO: 33715 - protein, 13 aa, Mycobacterium avium
EPTGNLDPDTSKD

SEQ ID NO: 33716 - protein, 5 aa, Mycobacterium avium
EPTGP

SEQ ID NO: 33717 - protein, 6 aa, Mycobacterium avium
EPTRGR

SEQ ID NO: 33718 - protein, 6 aa, Mycobacterium avium
EPTSAL

SEQ ID NO: 33719 - protein, 11 aa, Mycobacterium avium
EPTTRRAEWDD

SEQ ID NO: 33720 - protein, 13 aa, Mycobacterium avium
EPTYEDGIGDRGK

SEQ ID NO: 33721 - protein, 8 aa, Mycobacterium avium
EPVAPPAV

SEQ ID NO: 33722 - protein, 7 aa, Mycobacterium avium
EPVAPSR

SEQ ID NO: 33723 - protein, 6 aa, Mycobacterium avium
EPVSTA

SEQ ID NO: 33724 - protein, 5 aa, Mycobacterium avium
EPVTP

SEQ ID NO: 33725 - protein, 4 aa, Mycobacterium avium
EPWR

SEQ ID NO: 33726 - protein, 5 aa, Mycobacterium avium
EPYFD

SEQ ID NO: 33727 - protein, 5 aa, Mycobacterium avium
EQAAD

SEQ ID NO: 33728 - protein, 9 aa, Mycobacterium avium
EQAGAAGGA

SEQ ID NO: 33729 - protein, 13 aa, Mycobacterium avium
EQAGDSLRARTRA

SEQ ID NO: 33730 - protein, 6 aa, Mycobacterium avium
EQAGPD

SEQ ID NO: 33731 - protein, 9 aa, Mycobacterium avium
EQAKERGEQ

SEQ ID NO: 33732 - protein, 16 aa, Mycobacterium avium
EQAKKATGATETGDQQ

SEQ ID NO: 33733 - protein, 4 aa, Mycobacterium avium
EQAM

SEQ ID NO: 33734 - protein, 6 aa, Mycobacterium avium
EQAPTE

SEQ ID NO: 33735 - protein, 9 aa, Mycobacterium avium
EQASLQDSN

SEQ ID NO: 33736 - protein, 6 aa, Mycobacterium avium
EQATGA

SEQ ID NO: 33737 - protein, 6 aa, Mycobacterium avium
EQATVG

SEQ ID NO: 33738 - protein, 10 aa, Mycobacterium avium
EQDATPAEIG

SEQ ID NO: 33739 - protein, 7 aa, Mycobacterium avium
EQDPSTD

SEQ ID NO: 33740 - protein, 8 aa, Mycobacterium avium
EQDRNPEA

SEQ ID NO: 33741 - protein, 7 aa, Mycobacterium avium
EQDRQAV

SEQ ID NO: 33742 - protein, 6 aa, Mycobacterium avium
EQDYPQ

SEQ ID NO: 33743 - protein, 15 aa, Mycobacterium avium
EQEAADKFGSIVDRG

SEQ ID NO: 33744 - protein, 4 aa, Mycobacterium avium
EQEM

SEQ ID NO: 33745 - protein, 7 aa, Mycobacterium avium
EQERGIT

SEQ ID NO: 33746 - protein, 6 aa, Mycobacterium avium
EQFARE

SEQ ID NO: 33747 - protein, 15 aa, Mycobacterium avium
EQFGPDRVSTAENLS

SEQ ID NO: 33748 - protein, 14 aa, Mycobacterium avium
EQGAKGPQAVGVST

SEQ ID NO: 33749 - protein, 14 aa, Mycobacterium avium
EQGEPGRNFGADHE

SEQ ID NO: 33750 - protein, 8 aa, Mycobacterium avium
EQGFNSGD

SEQ ID NO: 33751 - protein, 10 aa, Mycobacterium avium
EQGQADNLER

SEQ ID NO: 33752 - protein, 4 aa, Mycobacterium avium
EQGR

SEQ ID NO: 33753 - protein, 12 aa, Mycobacterium avium
EQGRAELRKLLA

SEQ ID NO: 33754 - protein, 8 aa, Mycobacterium avium
EQHGAGTA

SEQ ID NO: 33755 - protein, 13 aa, Mycobacterium avium
EQHPLATKDSDGR

SEQ ID NO: 33756 - protein, 4 aa, Mycobacterium avium
EQHR

SEQ ID NO: 33757 - protein, 11 aa, Mycobacterium avium
EQHVDSRHAET

SEQ ID NO: 33758 - protein, 6 aa, Mycobacterium avium
EQIPDE

SEQ ID NO: 33759 - protein, 6 aa, Mycobacterium avium
EQKPGL

SEQ ID NO: 33760 - protein, 6 aa, Mycobacterium avium
EQKRAQ

SEQ ID NO: 33761 - protein, 13 aa, Mycobacterium avium
EQLADDPHPEHAG

SEQ ID NO: 33762 - protein, 11 aa, Mycobacterium avium
EQLGQGKENAR

SEQ ID NO: 33763 - protein, 4 aa, Mycobacterium avium
EQLH

SEQ ID NO: 33764 - protein, 5 aa, Mycobacterium avium
EQLPF

SEQ ID NO: 33765 - protein, 8 aa, Mycobacterium avium
EQMDGGPA

SEQ ID NO: 33766 - protein, 7 aa, Mycobacterium avium
EQNCSTS

SEQ ID NO: 33767 - protein, 7 aa, Mycobacterium avium
EQNPEAA

SEQ ID NO: 33768 - protein, 6 aa, Mycobacterium avium
EQPAAV

SEQ ID NO: 33769 - protein, 11 aa, Mycobacterium avium
EQPDSGTVKVG

SEQ ID NO: 33770 - protein, 16 aa, Mycobacterium avium
EQPGDQEDRAGAPFVG

SEQ ID NO: 33771 - protein, 11 aa, Mycobacterium avium
EQPHGSPRNTV

SEQ ID NO: 33772 - protein, 4 aa, Mycobacterium avium
EQQA

SEQ ID NO: 33773 - protein, 9 aa, Mycobacterium avium
EQQAADHAD

SEQ ID NO: 33774 - protein, 9 aa, Mycobacterium avium
EQQARDEGH

SEQ ID NO: 33775 - protein, 10 aa, Mycobacterium avium
EQQRAATKEY

SEQ ID NO: 33776 - protein, 8 aa, Mycobacterium avium
EQQRRAAG

SEQ ID NO: 33777 - protein, 11 aa, Mycobacterium avium
EQQSGAGGPGV

SEQ ID NO: 33778 - protein, 10 aa, Mycobacterium avium
EQRDDPTLRG

SEQ ID NO: 33779 - protein, 6 aa, Mycobacterium avium
EQRGDA

SEQ ID NO: 33780 - protein, 9 aa, Mycobacterium avium
EQRGDAEVD

SEQ ID NO: 33781 - protein, 7 aa, Mycobacterium avium
EQRGGRY

SEQ ID NO: 33782 - protein, 20 aa, Mycobacterium avium
EQRGRPKLVESSAQSHDEQL

SEQ ID NO: 33783 - protein, 6 aa, Mycobacterium avium
EQRHAN

SEQ ID NO: 33784 - protein, 4 aa, Mycobacterium avium
EQRQ

SEQ ID NO: 33785 - protein, 16 aa, Mycobacterium avium
EQRSSQVSYARTRGEL

SEQ ID NO: 33786 - protein, 7 aa, Mycobacterium avium
EQSESAQ

SEQ ID NO: 33787 - protein, 8 aa, Mycobacterium avium
EQSGGGRS

SEQ ID NO: 33788 - protein, 5 aa, Mycobacterium avium
EQTAA

SEQ ID NO: 33789 - protein, 17 aa, Mycobacterium avium
EQTEARPADDVHAAHVS

SEQ ID NO: 33790 - protein, 6 aa, Mycobacterium avium
EQTERF

SEQ ID NO: 33791 - protein, 8 aa, Mycobacterium avium
EQTGETRV

SEQ ID NO: 33792 - protein, 9 aa, Mycobacterium avium
EQTGSTNAD

SEQ ID NO: 33793 - protein, 7 aa, Mycobacterium avium
EQTHGAD

SEQ ID NO: 33794 - protein, 8 aa, Mycobacterium avium
EQTPQSHR

SEQ ID NO: 33795 - protein, 5 aa, Mycobacterium avium
EQTRT

SEQ ID NO: 33796 - protein, 5 aa, Mycobacterium avium
EQTSR

SEQ ID NO: 33797 - protein, 5 aa, Mycobacterium avium
EQTTI

SEQ ID NO: 33798 - protein, 7 aa, Mycobacterium avium
EQTTTFK

SEQ ID NO: 33799 - protein, 8 aa, Mycobacterium avium
EQVEASAE

SEQ ID NO: 33800 - protein, 5 aa, Mycobacterium avium
EQVNP

SEQ ID NO: 33801 - protein, 10 aa, Mycobacterium avium
EQWDDGNNTL

SEQ ID NO: 33802 - protein, 9 aa, Mycobacterium avium
EQYGNPIGS

SEQ ID NO: 33803 - protein, 13 aa, Mycobacterium avium
EQYGPDVLELVRG

SEQ ID NO: 33804 - protein, 5 aa, Mycobacterium avium
EQYRG

SEQ ID NO: 33805 - protein, 9 aa, Mycobacterium avium
ERAAGAGAT

SEQ ID NO: 33806 - protein, 14 aa, Mycobacterium avium
ERAATRGDGRVGED

SEQ ID NO: 33807 - protein, 14 aa, Mycobacterium avium
ERAATTPDEPQPFG

SEQ ID NO: 33808 - protein, 4 aa, Mycobacterium avium
ERAD

SEQ ID NO: 33809 - protein, 9 aa, Mycobacterium avium
ERADTYPQD

SEQ ID NO: 33810 - protein, 8 aa, Mycobacterium avium
ERAEEAER

SEQ ID NO: 33811 - protein, 6 aa, Mycobacterium avium
ERAEEK

SEQ ID NO: 33812 - protein, 10 aa, Mycobacterium avium
ERAGGPGGRR

SEQ ID NO: 33813 - protein, 7 aa, Mycobacterium avium
ERAGLTK

SEQ ID NO: 33814 - protein, 9 aa, Mycobacterium avium
ERAGTTKSA

SEQ ID NO: 33815 - protein, 5 aa, Mycobacterium avium
ERAGV

SEQ ID NO: 33816 - protein, 10 aa, Mycobacterium avium
ERAHDTATPQ

SEQ ID NO: 33817 - protein, 6 aa, Mycobacterium avium
ERAHRK

SEQ ID NO: 33818 - protein, 4 aa, Mycobacterium avium
ERAK

SEQ ID NO: 33819 - protein, 16 aa, Mycobacterium avium
ERAKGAEVSGALNPAQ

SEQ ID NO: 33820 - protein, 7 aa, Mycobacterium avium
ERARQAG

SEQ ID NO: 33821 - protein, 9 aa, Mycobacterium avium
ERARQVSDD

SEQ ID NO: 33822 - protein, 13 aa, Mycobacterium avium
ERARTRPAGSATV

SEQ ID NO: 33823 - protein, 7 aa, Mycobacterium avium
ERASGFR

SEQ ID NO: 33824 - protein, 5 aa, Mycobacterium avium
ERDAR

SEQ ID NO: 33825 - protein, 6 aa, Mycobacterium avium
ERDDRD

SEQ ID NO: 33826 - protein, 8 aa, Mycobacterium avium
ERDERGRM

SEQ ID NO: 33827 - protein, 10 aa, Mycobacterium avium
ERDGDRVTAG

SEQ ID NO: 33828 - protein, 8 aa, Mycobacterium avium
ERDIRSED

SEQ ID NO: 33829 - protein, 9 aa, Mycobacterium avium
ERDPAPNPE

SEQ ID NO: 33830 - protein, 8 aa, Mycobacterium avium
ERDQTEAQ

SEQ ID NO: 33831 - protein, 8 aa, Mycobacterium avium
ERDRLTPI

SEQ ID NO: 33832 - protein, 7 aa, Mycobacterium avium
EREGEDD

SEQ ID NO: 33833 - protein, 9 aa, Mycobacterium avium
EREGGEGSV

SEQ ID NO: 33834 - protein, 10 aa, Mycobacterium avium
EREGRLESAR

SEQ ID NO: 33835 - protein, 7 aa, Mycobacterium avium
EREPSTL

SEQ ID NO: 33836 - protein, 10 aa, Mycobacterium avium
ERERSGRGQV

SEQ ID NO: 33837 - protein, 12 aa, Mycobacterium avium
ERESSSPADELE

SEQ ID NO: 33838 - protein, 14 aa, Mycobacterium avium
ERGARNEPATPDDI

SEQ ID NO: 33839 - protein, 12 aa, Mycobacterium avium
ERGDKTLPGPNQ

SEQ ID NO: 33840 - protein, 10 aa, Mycobacterium avium
ERGEGTSKTD

SEQ ID NO: 33841 - protein, 11 aa, Mycobacterium avium
ERGGDRVRGAV

SEQ ID NO: 33842 - protein, 9 aa, Mycobacterium avium
ERGGTPLRS

SEQ ID NO: 33843 - protein, 4 aa, Mycobacterium avium
ERGH

SEQ ID NO: 33844 - protein, 14 aa, Mycobacterium avium
ERGNVARGADFDTS

SEQ ID NO: 33845 - protein, 8 aa, Mycobacterium avium
ERGPNDPI

SEQ ID NO: 33846 - protein, 5 aa, Mycobacterium avium
ERGQE

SEQ ID NO: 33847 - protein, 8 aa, Mycobacterium avium
ERGQGKTR

SEQ ID NO: 33848 - protein, 9 aa, Mycobacterium avium
ERGQSTPSI

SEQ ID NO: 33849 - protein, 19 aa, Mycobacterium avium
ERGRELASTAAERGAPYAE

SEQ ID NO: 33850 - protein, 36 aa, Mycobacterium avium
ERGRELASTAAERGRPLAKKARKRGEELADEAAERA

SEQ ID NO: 33851 - protein, 10 aa, Mycobacterium avium
ERGRKEPSSE

SEQ ID NO: 33852 - protein, 8 aa, Mycobacterium avium
ERGRQAGQ

SEQ ID NO: 33853 - protein, 4 aa, Mycobacterium avium
ERGT

SEQ ID NO: 33854 - protein, 5 aa, Mycobacterium avium
ERGTD

SEQ ID NO: 33855 - protein, 8 aa, Mycobacterium avium
ERGTTTTP

SEQ ID NO: 33856 - protein, 8 aa, Mycobacterium avium
ERGVDPQA

SEQ ID NO: 33857 - protein, 10 aa, Mycobacterium avium
ERHAQKNERP

SEQ ID NO: 33858 - protein, 8 aa, Mycobacterium avium
ERHESRRI

SEQ ID NO: 33859 - protein, 5 aa, Mycobacterium avium
ERHHR

SEQ ID NO: 33860 - protein, 4 aa, Mycobacterium avium
ERID

SEQ ID NO: 33861 - protein, 8 aa, Mycobacterium avium
ERKLTDGD

SEQ ID NO: 33862 - protein, 6 aa, Mycobacterium avium
ERKPSA

SEQ ID NO: 33863 - protein, 10 aa, Mycobacterium avium
ERLEEGIEKG

SEQ ID NO: 33864 - protein, 9 aa, Mycobacterium avium
ERLEPSERP

SEQ ID NO: 33865 - protein, 7 aa, Mycobacterium avium
ERLGEPY

SEQ ID NO: 33866 - protein, 10 aa, Mycobacterium avium
ERLGGDGVGL

SEQ ID NO: 33867 - protein, 9 aa, Mycobacterium avium
ERNSHADRL

SEQ ID NO: 33868 - protein, 7 aa, Mycobacterium avium
ERNSPGS

SEQ ID NO: 33869 - protein, 4 aa, Mycobacterium avium
ERPA

SEQ ID NO: 33870 - protein, 6 aa, Mycobacterium avium
ERPAEV

SEQ ID NO: 33871 - protein, 19 aa, Mycobacterium avium
ERPAIDEDRNGVVSERPRG

SEQ ID NO: 33872 - protein, 6 aa, Mycobacterium avium
ERPASY

SEQ ID NO: 33873 - protein, 8 aa, Mycobacterium avium
ERPATAAD

SEQ ID NO: 33874 - protein, 4 aa, Mycobacterium avium
ERPD

SEQ ID NO: 33875 - protein, 9 aa, Mycobacterium avium
ERPDAEAAQ

SEQ ID NO: 33876 - protein, 5 aa, Mycobacterium avium
ERPDL

SEQ ID NO: 33877 - protein, 5 aa, Mycobacterium avium
ERPDN

SEQ ID NO: 33878 - protein, 16 aa, Mycobacterium avium
ERPEPRYRAQRSVEEY

SEQ ID NO: 33879 - protein, 8 aa, Mycobacterium avium
ERPETAPD

SEQ ID NO: 33880 - protein, 10 aa, Mycobacterium avium
ERPLGTGGGI

SEQ ID NO: 33881 - protein, 6 aa, Mycobacterium avium
ERPMPG

SEQ ID NO: 33882 - protein, 5 aa, Mycobacterium avium
ERPPL

SEQ ID NO: 33883 - protein, 9 aa, Mycobacterium avium
ERPRGTGDA

SEQ ID NO: 33884 - protein, 4 aa, Mycobacterium avium
ERPT

SEQ ID NO: 33885 - protein, 6 aa, Mycobacterium avium
ERPVAE

SEQ ID NO: 33886 - protein, 5 aa, Mycobacterium avium
ERQLS

SEQ ID NO: 33887 - protein, 7 aa, Mycobacterium avium
ERQPDGT

SEQ ID NO: 33888 - protein, 10 aa, Mycobacterium avium
ERQPGPGQHP

SEQ ID NO: 33889 - protein, 8 aa, Mycobacterium avium
ERQRDKVD

SEQ ID NO: 33890 - protein, 7 aa, Mycobacterium avium
ERQRSHG

SEQ ID NO: 33891 - protein, 15 aa, Mycobacterium avium
ERRAEQLDAAGPSVL

SEQ ID NO: 33892 - protein, 9 aa, Mycobacterium avium
ERRAGDGPC

SEQ ID NO: 33893 - protein, 10 aa, Mycobacterium avium
ERRAHNDAKM

SEQ ID NO: 33894 - protein, 9 aa, Mycobacterium avium
ERRAKDTVE

SEQ ID NO: 33895 - protein, 9 aa, Mycobacterium avium
ERRAPDAVT

SEQ ID NO: 33896 - protein, 4 aa, Mycobacterium avium
ERRD

SEQ ID NO: 33897 - protein, 4 aa, Mycobacterium avium
ERRE

SEQ ID NO: 33898 - protein, 7 aa, Mycobacterium avium
ERRGEYL

SEQ ID NO: 33899 - protein, 6 aa, Mycobacterium avium
ERRGGR

SEQ ID NO: 33900 - protein, 8 aa, Mycobacterium avium
ERRGSGLS

SEQ ID NO: 33901 - protein, 11 aa, Mycobacterium avium
ERRKKPTGDLT

SEQ ID NO: 33902 - protein, 6 aa, Mycobacterium avium
ERRNAR

SEQ ID NO: 33903 - protein, 5 aa, Mycobacterium avium
ERRPG

SEQ ID NO: 33904 - protein, 8 aa, Mycobacterium avium
ERRPLPPA

SEQ ID NO: 33905 - protein, 5 aa, Mycobacterium avium
ERRRL

SEQ ID NO: 33906 - protein, 8 aa, Mycobacterium avium
ERRRPDGS

SEQ ID NO: 33907 - protein, 4 aa, Mycobacterium avium
ERRT

SEQ ID NO: 33908 - protein, 9 aa, Mycobacterium avium
ERRTAADAV

SEQ ID NO: 33909 - protein, 7 aa, Mycobacterium avium
ERRTKAK

SEQ ID NO: 33910 - protein, 7 aa, Mycobacterium avium
ERRTTED

SEQ ID NO: 33911 - protein, 6 aa, Mycobacterium avium
ERRTTV

SEQ ID NO: 33912 - protein, 9 aa, Mycobacterium avium
ERRTYHNED

SEQ ID NO: 33913 - protein, 7 aa, Mycobacterium avium
ERRYADR

SEQ ID NO: 33914 - protein, 5 aa, Mycobacterium avium
ERSAE

SEQ ID NO: 33915 - protein, 8 aa, Mycobacterium avium
ERSASDVG

SEQ ID NO: 33916 - protein, 16 aa, Mycobacterium avium
ERSCSGASALWLGPSR

SEQ ID NO: 33917 - protein, 4 aa, Mycobacterium avium
ERSD

SEQ ID NO: 33918 - protein, 7 aa, Mycobacterium avium
ERSDQTT

SEQ ID NO: 33919 - protein, 11 aa, Mycobacterium avium
ERSDSADTSHR

SEQ ID NO: 33920 - protein, 7 aa, Mycobacterium avium
ERSEPAR

SEQ ID NO: 33921 - protein, 8 aa, Mycobacterium avium
ERSGELPR

SEQ ID NO: 33922 - protein, 8 aa, Mycobacterium avium
ERSGPSRA

SEQ ID NO: 33923 - protein, 5 aa, Mycobacterium avium
ERSGV

SEQ ID NO: 33924 - protein, 4 aa, Mycobacterium avium
ERSI

SEQ ID NO: 33925 - protein, 11 aa, Mycobacterium avium
ERSPFHDPDRR

SEQ ID NO: 33926 - protein, 5 aa, Mycobacterium avium
ERSPI

SEQ ID NO: 33927 - protein, 12 aa, Mycobacterium avium
ERSPQAAAEHDR

SEQ ID NO: 33928 - protein, 4 aa, Mycobacterium avium
ERTA

SEQ ID NO: 33929 - protein, 19 aa, Mycobacterium avium
ERTDSDCAATGLGSRAGNY

SEQ ID NO: 33930 - protein, 6 aa, Mycobacterium avium
ERTDTT

SEQ ID NO: 33931 - protein, 7 aa, Mycobacterium avium
ERTGAGQ

SEQ ID NO: 33932 - protein, 11 aa, Mycobacterium avium
ERTGAPYASTM

SEQ ID NO: 33933 - protein, 7 aa, Mycobacterium avium
ERTGDAK

SEQ ID NO: 33934 - protein, 8 aa, Mycobacterium avium
ERTGDARG

SEQ ID NO: 33935 - protein, 7 aa, Mycobacterium avium
ERTGEAV

SEQ ID NO: 33936 - protein, 10 aa, Mycobacterium avium
ERTGIAGVGR

SEQ ID NO: 33937 - protein, 6 aa, Mycobacterium avium
ERTGIE

SEQ ID NO: 33938 - protein, 5 aa, Mycobacterium avium
ERTGK

SEQ ID NO: 33939 - protein, 7 aa, Mycobacterium avium
ERTGTGQ

SEQ ID NO: 33940 - protein, 4 aa, Mycobacterium avium
ERTH

SEQ ID NO: 33941 - protein, 5 aa, Mycobacterium avium
ERTPG

SEQ ID NO: 33942 - protein, 4 aa, Mycobacterium avium
ERTR

SEQ ID NO: 33943 - protein, 5 aa, Mycobacterium avium
ERTRA

SEQ ID NO: 33944 - protein, 5 aa, Mycobacterium avium
ERTRD

SEQ ID NO: 33945 - protein, 5 aa, Mycobacterium avium
ERTRP

SEQ ID NO: 33946 - protein, 7 aa, Mycobacterium avium
ERTRPTV

SEQ ID NO: 33947 - protein, 7 aa, Mycobacterium avium
ERTTGAV

SEQ ID NO: 33948 - protein, 5 aa, Mycobacterium avium
ERTTR

SEQ ID NO: 33949 - protein, 6 aa, Mycobacterium avium
ERVEPA

SEQ ID NO: 33950 - protein, 4 aa, Mycobacterium avium
ERVH

SEQ ID NO: 33951 - protein, 13 aa, Mycobacterium avium
ERVPADEPNPEEI

SEQ ID NO: 33952 - protein, 16 aa, Mycobacterium avium
ERVPERQPHAKGTGAF

SEQ ID NO: 33953 - protein, 7 aa, Mycobacterium avium
ERVRPQS

SEQ ID NO: 33954 - protein, 7 aa, Mycobacterium avium
ERVTNEE

SEQ ID NO: 33955 - protein, 9 aa, Mycobacterium avium
ERYDSGERC

SEQ ID NO: 33956 - protein, 7 aa, Mycobacterium avium
ERYPGDA

SEQ ID NO: 33957 - protein, 4 aa, Mycobacterium avium
ERYR

SEQ ID NO: 33958 - protein, 14 aa, Mycobacterium avium
ERYTPTGPADSRGA

SEQ ID NO: 33959 - protein, 8 aa, Mycobacterium avium
ESAEAERA

SEQ ID NO: 33960 - protein, 4 aa, Mycobacterium avium
ESAG

SEQ ID NO: 33961 - protein, 25 aa, Mycobacterium avium
ESAGGQLAHKGKSTERAAAQSARGK

SEQ ID NO: 33962 - protein, 14 aa, Mycobacterium avium
ESAIAYGPSDIPPE

SEQ ID NO: 33963 - protein, 5 aa, Mycobacterium avium
ESALP

SEQ ID NO: 33964 - protein, 11 aa, Mycobacterium avium
ESAPEPARDEV

SEQ ID NO: 33965 - protein, 13 aa, Mycobacterium avium
ESATRNLPTHRIS

SEQ ID NO: 33966 - protein, 6 aa, Mycobacterium avium
ESDAVT

SEQ ID NO: 33967 - protein, 6 aa, Mycobacterium avium
ESDDLR

SEQ ID NO: 33968 - protein, 5 aa, Mycobacterium avium
ESDDV

SEQ ID NO: 33969 - protein, 10 aa, Mycobacterium avium
ESDEAAPARQ

SEQ ID NO: 33970 - protein, 10 aa, Mycobacterium avium
ESDEQAEDPE

SEQ ID NO: 33971 - protein, 6 aa, Mycobacterium avium
ESDGGL

SEQ ID NO: 33972 - protein, 5 aa, Mycobacterium avium
ESDGR

SEQ ID NO: 33973 - protein, 9 aa, Mycobacterium avium
ESDHQPDIE

SEQ ID NO: 33974 - protein, 6 aa, Mycobacterium avium
ESDQRE

SEQ ID NO: 33975 - protein, 6 aa, Mycobacterium avium
ESEDES

SEQ ID NO: 33976 - protein, 8 aa, Mycobacterium avium
ESEGGFDP

SEQ ID NO: 33977 - protein, 6 aa, Mycobacterium avium
ESEITA

SEQ ID NO: 33978 - protein, 8 aa, Mycobacterium avium
ESEKEELR

SEQ ID NO: 33979 - protein, 21 aa, Mycobacterium avium
ESEPGRSTIDTDNSLGDLTGD

SEQ ID NO: 33980 - protein, 7 aa, Mycobacterium avium
ESERGYD

SEQ ID NO: 33981 - protein, 23 aa, Mycobacterium avium
ESERRSDALDQREKALARREADV

SEQ ID NO: 33982 - protein, 4 aa, Mycobacterium avium
ESEW

SEQ ID NO: 33983 - protein, 7 aa, Mycobacterium avium
ESGAEQS

SEQ ID NO: 33984 - protein, 7 aa, Mycobacterium avium
ESGAKDL

SEQ ID NO: 33985 - protein, 9 aa, Mycobacterium avium
ESGAKSNVI

SEQ ID NO: 33986 - protein, 9 aa, Mycobacterium avium
ESGAMSPYP

SEQ ID NO: 33987 - protein, 8 aa, Mycobacterium avium
ESGAPGRG

SEQ ID NO: 33988 - protein, 11 aa, Mycobacterium avium
ESGASTPTDAI

SEQ ID NO: 33989 - protein, 8 aa, Mycobacterium avium
ESGDGAAQ

SEQ ID NO: 33990 - protein, 23 aa, Mycobacterium avium
ESGDGAETTVDLGSPAARAIWVT

SEQ ID NO: 33991 - protein, 4 aa, Mycobacterium avium
ESGG

SEQ ID NO: 33992 - protein, 6 aa, Mycobacterium avium
ESGKMT

SEQ ID NO: 33993 - protein, 4 aa, Mycobacterium avium
ESGP

SEQ ID NO: 33994 - protein, 9 aa, Mycobacterium avium
ESGPKTNEL

SEQ ID NO: 33995 - protein, 7 aa, Mycobacterium avium
ESGPSVA

SEQ ID NO: 33996 - protein, 4 aa, Mycobacterium avium
ESGQ

SEQ ID NO: 33997 - protein, 6 aa, Mycobacterium avium
ESGQLD

SEQ ID NO: 33998 - protein, 8 aa, Mycobacterium avium
ESGQREEL

SEQ ID NO: 33999 - protein, 7 aa, Mycobacterium avium
ESGQYRR

SEQ ID NO: 34000 - protein, 7 aa, Mycobacterium avium
ESGRGRT

SEQ ID NO: 34001 - protein, 8 aa, Mycobacterium avium
ESGSLEQD

SEQ ID NO: 34002 - protein, 7 aa, Mycobacterium avium
ESGTEVP

SEQ ID NO: 34003 - protein, 7 aa, Mycobacterium avium
ESGTGLG

SEQ ID NO: 34004 - protein, 8 aa, Mycobacterium avium
ESHPGVDV

SEQ ID NO: 34005 - protein, 6 aa, Mycobacterium avium
ESIGRS

SEQ ID NO: 34006 - protein, 11 aa, Mycobacterium avium
ESIPDPVRETD

SEQ ID NO: 34007 - protein, 14 aa, Mycobacterium avium
ESKEQARAELAGEP

SEQ ID NO: 34008 - protein, 4 aa, Mycobacterium avium
ESLD

SEQ ID NO: 34009 - protein, 7 aa, Mycobacterium avium
ESLGPDF

SEQ ID NO: 34010 - protein, 9 aa, Mycobacterium avium
ESLGSEPAL

SEQ ID NO: 34011 - protein, 5 aa, Mycobacterium avium
ESLGT

SEQ ID NO: 34012 - protein, 4 aa, Mycobacterium avium
ESLP

SEQ ID NO: 34013 - protein, 17 aa, Mycobacterium avium
ESLRNDSAKVSIQDGPW

SEQ ID NO: 34014 - protein, 6 aa, Mycobacterium avium
ESLRQA

SEQ ID NO: 34015 - protein, 5 aa, Mycobacterium avium
ESLSG

SEQ ID NO: 34016 - protein, 6 aa, Mycobacterium avium
ESMDPA

SEQ ID NO: 34017 - protein, 6 aa, Mycobacterium avium
ESMKPG

SEQ ID NO: 34018 - protein, 34 aa, Mycobacterium avium
ESMSRQAGGRAGGSGGGVGLRGPGETKIETDRRR

SEQ ID NO: 34019 - protein, 9 aa, Mycobacterium avium
ESMSRTPMG

SEQ ID NO: 34020 - protein, 18 aa, Mycobacterium avium
ESNGKSTRADGSPVTTDT

SEQ ID NO: 34021 - protein, 7 aa, Mycobacterium avium
ESNLDTP

SEQ ID NO: 34022 - protein, 14 aa, Mycobacterium avium
ESNMASTKRHWPTS

SEQ ID NO: 34023 - protein, 12 aa, Mycobacterium avium
ESNPDRRHGADR

SEQ ID NO: 34024 - protein, 5 aa, Mycobacterium avium
ESNPV

SEQ ID NO: 34025 - protein, 12 aa, Mycobacterium avium
ESNSVDQRSGVS

SEQ ID NO: 34026 - protein, 4 aa, Mycobacterium avium
ESNT

SEQ ID NO: 34027 - protein, 6 aa, Mycobacterium avium
ESNTSG

SEQ ID NO: 34028 - protein, 9 aa, Mycobacterium avium
ESPETWQSQ

SEQ ID NO: 34029 - protein, 14 aa, Mycobacterium avium
ESPPPGVHGAPNNP

SEQ ID NO: 34030 - protein, 10 aa, Mycobacterium avium
ESPPSGARAS

SEQ ID NO: 34031 - protein, 13 aa, Mycobacterium avium
ESPRRPDGTRAGN

SEQ ID NO: 34032 - protein, 4 aa, Mycobacterium avium
ESQE

SEQ ID NO: 34033 - protein, 6 aa, Mycobacterium avium
ESQEAL

SEQ ID NO: 34034 - protein, 6 aa, Mycobacterium avium
ESQRTS

SEQ ID NO: 34035 - protein, 7 aa, Mycobacterium avium
ESQTERF

SEQ ID NO: 34036 - protein, 23 aa, Mycobacterium avium
ESRAAERTATARSTIAADGSADY

SEQ ID NO: 34037 - protein, 5 aa, Mycobacterium avium
ESREF

SEQ ID NO: 34038 - protein, 5 aa, Mycobacterium avium
ESRER

SEQ ID NO: 34039 - protein, 8 aa, Mycobacterium avium
ESRPTRTG

SEQ ID NO: 34040 - protein, 15 aa, Mycobacterium avium
ESRRRSAATGGESRI

SEQ ID NO: 34041 - protein, 8 aa, Mycobacterium avium
ESRSGVAP

SEQ ID NO: 34042 - protein, 9 aa, Mycobacterium avium
ESRYEGPTG

SEQ ID NO: 34043 - protein, 9 aa, Mycobacterium avium
ESSAAQRAE

SEQ ID NO: 34044 - protein, 6 aa, Mycobacterium avium
ESSAKF

SEQ ID NO: 34045 - protein, 4 aa, Mycobacterium avium
ESSL

SEQ ID NO: 34046 - protein, 10 aa, Mycobacterium avium
ESSSEERRAA

SEQ ID NO: 34047 - protein, 11 aa, Mycobacterium avium
ESTDAYEQGRA

SEQ ID NO: 34048 - protein, 7 aa, Mycobacterium avium
ESTGDLT

SEQ ID NO: 34049 - protein, 28 aa, Mycobacterium avium
ESTPSGTNPGPIYAPRNDPSHSGPNAGI

SEQ ID NO: 34050 - protein, 8 aa, Mycobacterium avium
ESTPVDGK

SEQ ID NO: 34051 - protein, 6 aa, Mycobacterium avium
ESTSAA

SEQ ID NO: 34052 - protein, 15 aa, Mycobacterium avium
ESTSWPGVTRPTNLG

SEQ ID NO: 34053 - protein, 25 aa, Mycobacterium avium
ESTTNARRAHATSRTSLEIGKESEV

SEQ ID NO: 34054 - protein, 7 aa, Mycobacterium avium
ESTWGTG

SEQ ID NO: 34055 - protein, 4 aa, Mycobacterium avium
ESVG

SEQ ID NO: 34056 - protein, 12 aa, Mycobacterium avium
ESVSDEKKTALG

SEQ ID NO: 34057 - protein, 7 aa, Mycobacterium avium
ESVTEGT

SEQ ID NO: 34058 - protein, 6 aa, Mycobacterium avium
ESVTPG

SEQ ID NO: 34059 - protein, 10 aa, Mycobacterium avium
ESWGSHERRD

SEQ ID NO: 34060 - protein, 8 aa, Mycobacterium avium
ESWSGSAS

SEQ ID NO: 34061 - protein, 5 aa, Mycobacterium avium
ESYEP

SEQ ID NO: 34062 - protein, 5 aa, Mycobacterium avium
ESYGV

SEQ ID NO: 34063 - protein, 6 aa, Mycobacterium avium
ETAARG

SEQ ID NO: 34064 - protein, 5 aa, Mycobacterium avium
ETADV

SEQ ID NO: 34065 - protein, 9 aa, Mycobacterium avium
ETAGDRPVP

SEQ ID NO: 34066 - protein, 10 aa, Mycobacterium avium
ETAPGANGEC

SEQ ID NO: 34067 - protein, 6 aa, Mycobacterium avium
ETAQQV

SEQ ID NO: 34068 - protein, 9 aa, Mycobacterium avium
ETASELPDG

SEQ ID NO: 34069 - protein, 8 aa, Mycobacterium avium
ETCPSSDG

SEQ ID NO: 34070 - protein, 5 aa, Mycobacterium avium
ETDAD

SEQ ID NO: 34071 - protein, 5 aa, Mycobacterium avium
ETDDA

SEQ ID NO: 34072 - protein, 11 aa, Mycobacterium avium
ETDDVSEDSLE

SEQ ID NO: 34073 - protein, 8 aa, Mycobacterium avium
ETDELDQV

SEQ ID NO: 34074 - protein, 4 aa, Mycobacterium avium
ETDH

SEQ ID NO: 34075 - protein, 4 aa, Mycobacterium avium
ETDQ

SEQ ID NO: 34076 - protein, 7 aa, Mycobacterium avium
ETDSGLD

SEQ ID NO: 34077 - protein, 11 aa, Mycobacterium avium
ETDTDADELPE

SEQ ID NO: 34078 - protein, 6 aa, Mycobacterium avium
ETDYGA

SEQ ID NO: 34079 - protein, 7 aa, Mycobacterium avium
ETERGER

SEQ ID NO: 34080 - protein, 15 aa, Mycobacterium avium
ETEWSKTGRHTGRTE

SEQ ID NO: 34081 - protein, 5 aa, Mycobacterium avium
ETFEE

SEQ ID NO: 34082 - protein, 6 aa, Mycobacterium avium
ETGDDN

SEQ ID NO: 34083 - protein, 10 aa, Mycobacterium avium
ETGGERRAVR

SEQ ID NO: 34084 - protein, 12 aa, Mycobacterium avium
ETGHVASAKNPR

SEQ ID NO: 34085 - protein, 10 aa, Mycobacterium avium
ETGKGTAEDI

SEQ ID NO: 34086 - protein, 7 aa, Mycobacterium avium
ETGQPAW

SEQ ID NO: 34087 - protein, 6 aa, Mycobacterium avium
ETGQPG

SEQ ID NO: 34088 - protein, 9 aa, Mycobacterium avium
ETGQPPTSV

SEQ ID NO: 34089 - protein, 10 aa, Mycobacterium avium
ETGRAEAGGG

SEQ ID NO: 34090 - protein, 10 aa, Mycobacterium avium
ETGRAEYRPI

SEQ ID NO: 34091 - protein, 5 aa, Mycobacterium avium
ETGRE

SEQ ID NO: 34092 - protein, 8 aa, Mycobacterium avium
ETGSTGDT

SEQ ID NO: 34093 - protein, 5 aa, Mycobacterium avium
ETGVP

SEQ ID NO: 34094 - protein, 5 aa, Mycobacterium avium
ETGVR

SEQ ID NO: 34095 - protein, 10 aa, Mycobacterium avium
ETHDNPEHRA

SEQ ID NO: 34096 - protein, 13 aa, Mycobacterium avium
ETHPEQPDRPVEL

SEQ ID NO: 34097 - protein, 4 aa, Mycobacterium avium
ETKT

SEQ ID NO: 34098 - protein, 10 aa, Mycobacterium avium
ETLPAEPAKT

SEQ ID NO: 34099 - protein, 13 aa, Mycobacterium avium
ETLQRHGATPAAV

SEQ ID NO: 34100 - protein, 4 aa, Mycobacterium avium
ETLY

SEQ ID NO: 34101 - protein, 9 aa, Mycobacterium avium
ETNATTTQT

SEQ ID NO: 34102 - protein, 4 aa, Mycobacterium avium
ETNG

SEQ ID NO: 34103 - protein, 9 aa, Mycobacterium avium
ETPATPGQV

SEQ ID NO: 34104 - protein, 8 aa, Mycobacterium avium
ETPDAGWD

SEQ ID NO: 34105 - protein, 7 aa, Mycobacterium avium
ETPDEVR

SEQ ID NO: 34106 - protein, 5 aa, Mycobacterium avium
ETPGI

SEQ ID NO: 34107 - protein, 6 aa, Mycobacterium avium
ETPLSN

SEQ ID NO: 34108 - protein, 6 aa, Mycobacterium avium
ETPRGG

SEQ ID NO: 34109 - protein, 6 aa, Mycobacterium avium
ETPTDE

SEQ ID NO: 34110 - protein, 7 aa, Mycobacterium avium
ETPTNPA

SEQ ID NO: 34111 - protein, 5 aa, Mycobacterium avium
ETPVP

SEQ ID NO: 34112 - protein, 8 aa, Mycobacterium avium
ETQDPESF

SEQ ID NO: 34113 - protein, 14 aa, Mycobacterium avium
ETQTAKWRDPTGTV

SEQ ID NO: 34114 - protein, 6 aa, Mycobacterium avium
ETRAER

SEQ ID NO: 34115 - protein, 5 aa, Mycobacterium avium
ETRIG

SEQ ID NO: 34116 - protein, 6 aa, Mycobacterium avium
ETRPRE

SEQ ID NO: 34117 - protein, 7 aa, Mycobacterium avium
ETRTRGR

SEQ ID NO: 34118 - protein, 18 aa, Mycobacterium avium
ETRTSGPGPARTFPADSA

SEQ ID NO: 34119 - protein, 7 aa, Mycobacterium avium
ETSENGW

SEQ ID NO: 34120 - protein, 4 aa, Mycobacterium avium
ETSL

SEQ ID NO: 34121 - protein, 5 aa, Mycobacterium avium
ETSPD

SEQ ID NO: 34122 - protein, 7 aa, Mycobacterium avium
ETSPREY

SEQ ID NO: 34123 - protein, 4 aa, Mycobacterium avium
ETSR

SEQ ID NO: 34124 - protein, 4 aa, Mycobacterium avium
ETST

SEQ ID NO: 34125 - protein, 4 aa, Mycobacterium avium
ETSV

SEQ ID NO: 34126 - protein, 9 aa, Mycobacterium avium
ETSVAGEPI

SEQ ID NO: 34127 - protein, 12 aa, Mycobacterium avium
ETSYGPDGIGTT

SEQ ID NO: 34128 - protein, 10 aa, Mycobacterium avium
ETTEYEPDRR

SEQ ID NO: 34129 - protein, 6 aa, Mycobacterium avium
ETTGES

SEQ ID NO: 34130 - protein, 5 aa, Mycobacterium avium
ETTHE

SEQ ID NO: 34131 - protein, 4 aa, Mycobacterium avium
ETTL

SEQ ID NO: 34132 - protein, 17 aa, Mycobacterium avium
ETTLTEEAYAKNPKRAR

SEQ ID NO: 34133 - protein, 8 aa, Mycobacterium avium
ETTPDRLT

SEQ ID NO: 34134 - protein, 6 aa, Mycobacterium avium
ETTPPG

SEQ ID NO: 34135 - protein, 10 aa, Mycobacterium avium
ETTQVRDQGM

SEQ ID NO: 34136 - protein, 7 aa, Mycobacterium avium
ETTTDEM

SEQ ID NO: 34137 - protein, 10 aa, Mycobacterium avium
ETTTELGPGL

SEQ ID NO: 34138 - protein, 4 aa, Mycobacterium avium
ETVQ

SEQ ID NO: 34139 - protein, 4 aa, Mycobacterium avium
ETVS

SEQ ID NO: 34140 - protein, 10 aa, Mycobacterium avium
ETVSAKTATH

SEQ ID NO: 34141 - protein, 4 aa, Mycobacterium avium
ETWS

SEQ ID NO: 34142 - protein, 4 aa, Mycobacterium avium
ETYD

SEQ ID NO: 34143 - protein, 14 aa, Mycobacterium avium
ETYGRNSDESLPPE

SEQ ID NO: 34144 - protein, 5 aa, Mycobacterium avium
EVAES

SEQ ID NO: 34145 - protein, 13 aa, Mycobacterium avium
EVAPADPQRGERD

SEQ ID NO: 34146 - protein, 11 aa, Mycobacterium avium
EVDASNARDLT

SEQ ID NO: 34147 - protein, 6 aa, Mycobacterium avium
EVDETT

SEQ ID NO: 34148 - protein, 9 aa, Mycobacterium avium
EVDTEKAQE

SEQ ID NO: 34149 - protein, 9 aa, Mycobacterium avium
EVEEDRDED

SEQ ID NO: 34150 - protein, 12 aa, Mycobacterium avium
EVELGSRNERPM

SEQ ID NO: 34151 - protein, 7 aa, Mycobacterium avium
EVEPRRD

SEQ ID NO: 34152 - protein, 5 aa, Mycobacterium avium
EVERQ

SEQ ID NO: 34153 - protein, 7 aa, Mycobacterium avium
EVGAAGD

SEQ ID NO: 34154 - protein, 4 aa, Mycobacterium avium
EVGR

SEQ ID NO: 34155 - protein, 7 aa, Mycobacterium avium
EVGSGKT

SEQ ID NO: 34156 - protein, 7 aa, Mycobacterium avium
EVGTGEH

SEQ ID NO: 34157 - protein, 7 aa, Mycobacterium avium
EVGTPEI

SEQ ID NO: 34158 - protein, 12 aa, Mycobacterium avium
EVGTTNRTGLRD

SEQ ID NO: 34159 - protein, 7 aa, Mycobacterium avium
EVKPTQK

SEQ ID NO: 34160 - protein, 8 aa, Mycobacterium avium
EVNGEQQK

SEQ ID NO: 34161 - protein, 12 aa, Mycobacterium avium
EVNGEVKQRSRT

SEQ ID NO: 34162 - protein, 7 aa, Mycobacterium avium
EVPATSR

SEQ ID NO: 34163 - protein, 13 aa, Mycobacterium avium
EVPEPRSDRPHAE

SEQ ID NO: 34164 - protein, 7 aa, Mycobacterium avium
EVPGGQA

SEQ ID NO: 34165 - protein, 4 aa, Mycobacterium avium
EVPI

SEQ ID NO: 34166 - protein, 11 aa, Mycobacterium avium
EVQDSGPDRGA

SEQ ID NO: 34167 - protein, 6 aa, Mycobacterium avium
EVQGQD

SEQ ID NO: 34168 - protein, 15 aa, Mycobacterium avium
EVRDGDPSPDGAGPL

SEQ ID NO: 34169 - protein, 10 aa, Mycobacterium avium
EVRRGTPTAN

SEQ ID NO: 34170 - protein, 14 aa, Mycobacterium avium
EVRRRDRETGDNFD

SEQ ID NO: 34171 - protein, 14 aa, Mycobacterium avium
EVRRRDRETGENFS

SEQ ID NO: 34172 - protein, 9 aa, Mycobacterium avium
EVSAPSAAT

SEQ ID NO: 34173 - protein, 9 aa, Mycobacterium avium
EVSDEDPVA

SEQ ID NO: 34174 - protein, 5 aa, Mycobacterium avium
EVSES

SEQ ID NO: 34175 - protein, 9 aa, Mycobacterium avium
EVSGAGESA

SEQ ID NO: 34176 - protein, 7 aa, Mycobacterium avium
EVSGGPL

SEQ ID NO: 34177 - protein, 8 aa, Mycobacterium avium
EVSGRGAQ

SEQ ID NO: 34178 - protein, 5 aa, Mycobacterium avium
EVSGY

SEQ ID NO: 34179 - protein, 5 aa, Mycobacterium avium
EVSPA

SEQ ID NO: 34180 - protein, 6 aa, Mycobacterium avium
EVSPNY

SEQ ID NO: 34181 - protein, 5 aa, Mycobacterium avium
EVSPV

SEQ ID NO: 34182 - protein, 12 aa, Mycobacterium avium
EVTADGRSDRGN

SEQ ID NO: 34183 - protein, 7 aa, Mycobacterium avium
EVTLQDG

SEQ ID NO: 34184 - protein, 10 aa, Mycobacterium avium
EVTPENEHDV

SEQ ID NO: 34185 - protein, 7 aa, Mycobacterium avium
EVTRGQR

SEQ ID NO: 34186 - protein, 8 aa, Mycobacterium avium
EWAAPPAD

SEQ ID NO: 34187 - protein, 7 aa, Mycobacterium avium
EWAGPRS

SEQ ID NO: 34188 - protein, 9 aa, Mycobacterium avium
EWASPSGRR

SEQ ID NO: 34189 - protein, 8 aa, Mycobacterium avium
EWGRDPAG

SEQ ID NO: 34190 - protein, 8 aa, Mycobacterium avium
EWPESTKH

SEQ ID NO: 34191 - protein, 11 aa, Mycobacterium avium
EWSPKSESSRE

SEQ ID NO: 34192 - protein, 11 aa, Mycobacterium avium
EWTPDDRLRQS

SEQ ID NO: 34193 - protein, 5 aa, Mycobacterium avium
EYAEA

SEQ ID NO: 34194 - protein, 6 aa, Mycobacterium avium
EYAGSR

SEQ ID NO: 34195 - protein, 4 aa, Mycobacterium avium
EYDA

SEQ ID NO: 34196 - protein, 15 aa, Mycobacterium avium
EYDDDGTVRKPGQDY

SEQ ID NO: 34197 - protein, 10 aa, Mycobacterium avium
EYDESPERQA

SEQ ID NO: 34198 - protein, 5 aa, Mycobacterium avium
EYDKY

SEQ ID NO: 34199 - protein, 5 aa, Mycobacterium avium
EYEAH

SEQ ID NO: 34200 - protein, 8 aa, Mycobacterium avium
EYEVGNPA

SEQ ID NO: 34201 - protein, 6 aa, Mycobacterium avium
EYGGMG

SEQ ID NO: 34202 - protein, 10 aa, Mycobacterium avium
EYGGSGGSLD

SEQ ID NO: 34203 - protein, 5 aa, Mycobacterium avium
EYGPD

SEQ ID NO: 34204 - protein, 13 aa, Mycobacterium avium
EYHPDATGTTMAQ

SEQ ID NO: 34205 - protein, 7 aa, Mycobacterium avium
EYNPGRE

SEQ ID NO: 34206 - protein, 6 aa, Mycobacterium avium
EYPHPK

SEQ ID NO: 34207 - protein, 7 aa, Mycobacterium avium
EYQARAT

SEQ ID NO: 34208 - protein, 18 aa, Mycobacterium avium
EYQTKTDRQIPVFVLTPV

SEQ ID NO: 34209 - protein, 4 aa, Mycobacterium avium
EYSG

SEQ ID NO: 34210 - protein, 16 aa, Mycobacterium avium
EYTDDNVPASQAAFDD

SEQ ID NO: 34211 - protein, 14 aa, Mycobacterium avium
EYYDPEPGVPGRSV

SEQ ID NO: 34212 - protein, 11 aa, Mycobacterium avium
FAATGGASVVP

SEQ ID NO: 34213 - protein, 15 aa, Mycobacterium avium
FAATQSSSQPRELPP

SEQ ID NO: 34214 - protein, 10 aa, Mycobacterium avium
FADDAARQTL

SEQ ID NO: 34215 - protein, 5 aa, Mycobacterium avium
FADGA

SEQ ID NO: 34216 - protein, 4 aa, Mycobacterium avium
FADP

SEQ ID NO: 34217 - protein, 11 aa, Mycobacterium avium
FADPGLGASPS

SEQ ID NO: 34218 - protein, 7 aa, Mycobacterium avium
FADQPSA

SEQ ID NO: 34219 - protein, 9 aa, Mycobacterium avium
FADRESPKS

SEQ ID NO: 34220 - protein, 9 aa, Mycobacterium avium
FAEESPEAY

SEQ ID NO: 34221 - protein, 11 aa, Mycobacterium avium
FAGPGSVDVDN

SEQ ID NO: 34222 - protein, 6 aa, Mycobacterium avium
FAGPRR

SEQ ID NO: 34223 - protein, 7 aa, Mycobacterium avium
FAGPSRR

SEQ ID NO: 34224 - protein, 4 aa, Mycobacterium avium
FAGQ

SEQ ID NO: 34225 - protein, 7 aa, Mycobacterium avium
FANDPKG

SEQ ID NO: 34226 - protein, 6 aa, Mycobacterium avium
FANPRY

SEQ ID NO: 34227 - protein, 11 aa, Mycobacterium avium
FAPAAEDSTGA

SEQ ID NO: 34228 - protein, 10 aa, Mycobacterium avium
FAPASDTPGL

SEQ ID NO: 34229 - protein, 7 aa, Mycobacterium avium
FAPDPDF

SEQ ID NO: 34230 - protein, 6 aa, Mycobacterium avium
FAPGPG

SEQ ID NO: 34231 - protein, 5 aa, Mycobacterium avium
FAPTR

SEQ ID NO: 34232 - protein, 11 aa, Mycobacterium avium
FARPGARRSRA

SEQ ID NO: 34233 - protein, 11 aa, Mycobacterium avium
FASGTSSRSSK

SEQ ID NO: 34234 - protein, 19 aa, Mycobacterium avium
FASTPLAPATPIVSRLVAR

SEQ ID NO: 34235 - protein, 12 aa, Mycobacterium avium
FATQPSDAFKAA

SEQ ID NO: 34236 - protein, 7 aa, Mycobacterium avium
FDDADAA

SEQ ID NO: 34237 - protein, 9 aa, Mycobacterium avium
FDDDDDDFP

SEQ ID NO: 34238 - protein, 16 aa, Mycobacterium avium
FDDSGDRVTYWCPSCQ

SEQ ID NO: 34239 - protein, 5 aa, Mycobacterium avium
FDDTT

SEQ ID NO: 34240 - protein, 5 aa, Mycobacterium avium
FDEDA

SEQ ID NO: 34241 - protein, 7 aa, Mycobacterium avium
FDENPDL

SEQ ID NO: 34242 - protein, 12 aa, Mycobacterium avium
FDESESAAAGYP

SEQ ID NO: 34243 - protein, 5 aa, Mycobacterium avium
FDETA

SEQ ID NO: 34244 - protein, 4 aa, Mycobacterium avium
FDGD

SEQ ID NO: 34245 - protein, 8 aa, Mycobacterium avium
FDGGDDQR

SEQ ID NO: 34246 - protein, 15 aa, Mycobacterium avium
FDNGPWPTTPPKERA

SEQ ID NO: 34247 - protein, 11 aa, Mycobacterium avium
FDNQSRRQTSF

SEQ ID NO: 34248 - protein, 9 aa, Mycobacterium avium
FDPAESPRL

SEQ ID NO: 34249 - protein, 8 aa, Mycobacterium avium
FDPAKGPS

SEQ ID NO: 34250 - protein, 5 aa, Mycobacterium avium
FDPAT

SEQ ID NO: 34251 - protein, 6 aa, Mycobacterium avium
FDPATG

SEQ ID NO: 34252 - protein, 5 aa, Mycobacterium avium
FDPEA

SEQ ID NO: 34253 - protein, 6 aa, Mycobacterium avium
FDPETN

SEQ ID NO: 34254 - protein, 8 aa, Mycobacterium avium
FDPQAKGL

SEQ ID NO: 34255 - protein, 12 aa, Mycobacterium avium
FDPQHDSLSGPR

SEQ ID NO: 34256 - protein, 4 aa, Mycobacterium avium
FDPR

SEQ ID NO: 34257 - protein, 11 aa, Mycobacterium avium
FDRDPDGSWRR

SEQ ID NO: 34258 - protein, 5 aa, Mycobacterium avium
FDRPP

SEQ ID NO: 34259 - protein, 10 aa, Mycobacterium avium
FDRPPSDHTS

SEQ ID NO: 34260 - protein, 17 aa, Mycobacterium avium
FDRPTQERRAKRAEREL

SEQ ID NO: 34261 - protein, 6 aa, Mycobacterium avium
FDSATQ

SEQ ID NO: 34262 - protein, 4 aa, Mycobacterium avium
FDSG

SEQ ID NO: 34263 - protein, 4 aa, Mycobacterium avium
FDSP

SEQ ID NO: 34264 - protein, 21 aa, Mycobacterium avium
FDSPPPAADPAPAGVTSPSRN

SEQ ID NO: 34265 - protein, 12 aa, Mycobacterium avium
FDTDGPPPARPS

SEQ ID NO: 34266 - protein, 4 aa, Mycobacterium avium
FDTG

SEQ ID NO: 34267 - protein, 9 aa, Mycobacterium avium
FEARTPDAL

SEQ ID NO: 34268 - protein, 5 aa, Mycobacterium avium
FEDPD

SEQ ID NO: 34269 - protein, 4 aa, Mycobacterium avium
FEGD

SEQ ID NO: 34270 - protein, 19 aa, Mycobacterium avium
FEGTTARIREKQKAGDYAG

SEQ ID NO: 34271 - protein, 4 aa, Mycobacterium avium
FEHN

SEQ ID NO: 34272 - protein, 8 aa, Mycobacterium avium
FEPAKDKQ

SEQ ID NO: 34273 - protein, 11 aa, Mycobacterium avium
FEPSAGHRCDP

SEQ ID NO: 34274 - protein, 16 aa, Mycobacterium avium
FERAAGRVRGERWGPR

SEQ ID NO: 34275 - protein, 7 aa, Mycobacterium avium
FERPGPR

SEQ ID NO: 34276 - protein, 17 aa, Mycobacterium avium
FESDSKYPYTPDGSREF

SEQ ID NO: 34277 - protein, 10 aa, Mycobacterium avium
FESGEEGREQ

SEQ ID NO: 34278 - protein, 11 aa, Mycobacterium avium
FESSNTPGYSG

SEQ ID NO: 34279 - protein, 6 aa, Mycobacterium avium
FETDPA

SEQ ID NO: 34280 - protein, 20 aa, Mycobacterium avium
FGADPAALAATAEHAETPEF

SEQ ID NO: 34281 - protein, 5 aa, Mycobacterium avium
FGASA

SEQ ID NO: 34282 - protein, 6 aa, Mycobacterium avium
FGASGG

SEQ ID NO: 34283 - protein, 11 aa, Mycobacterium avium
FGDDPNRYTTA

SEQ ID NO: 34284 - protein, 5 aa, Mycobacterium avium
FGDGD

SEQ ID NO: 34285 - protein, 7 aa, Mycobacterium avium
FGDGSKL

SEQ ID NO: 34286 - protein, 8 aa, Mycobacterium avium
FGDRPDRW

SEQ ID NO: 34287 - protein, 5 aa, Mycobacterium avium
FGDTP

SEQ ID NO: 34288 - protein, 10 aa, Mycobacterium avium
FGEDPDVDEV

SEQ ID NO: 34289 - protein, 6 aa, Mycobacterium avium
FGGDPR

SEQ ID NO: 34290 - protein, 10 aa, Mycobacterium avium
FGGEESAGAS

SEQ ID NO: 34291 - protein, 8 aa, Mycobacterium avium
FGGGGKGM

SEQ ID NO: 34292 - protein, 8 aa, Mycobacterium avium
FGGPGNNY

SEQ ID NO: 34293 - protein, 7 aa, Mycobacterium avium
FGGPPAV

SEQ ID NO: 34294 - protein, 6 aa, Mycobacterium avium
FGGPRE

SEQ ID NO: 34295 - protein, 4 aa, Mycobacterium avium
FGGS

SEQ ID NO: 34296 - protein, 10 aa, Mycobacterium avium
FGGVNGPRGW

SEQ ID NO: 34297 - protein, 13 aa, Mycobacterium avium
FGGYKRSGNGREW

SEQ ID NO: 34298 - protein, 11 aa, Mycobacterium avium
FGHAQAASGAL

SEQ ID NO: 34299 - protein, 4 aa, Mycobacterium avium
FGKP

SEQ ID NO: 34300 - protein, 5 aa, Mycobacterium avium
FGKPE

SEQ ID NO: 34301 - protein, 9 aa, Mycobacterium avium
FGNPGERAQ

SEQ ID NO: 34302 - protein, 6 aa, Mycobacterium avium
FGNPTA

SEQ ID NO: 34303 - protein, 5 aa, Mycobacterium avium
FGPAD

SEQ ID NO: 34304 - protein, 5 aa, Mycobacterium avium
FGPEE

SEQ ID NO: 34305 - protein, 4 aa, Mycobacterium avium
FGPP

SEQ ID NO: 34306 - protein, 8 aa, Mycobacterium avium
FGPPAGEA

SEQ ID NO: 34307 - protein, 7 aa, Mycobacterium avium
FGPQART

SEQ ID NO: 34308 - protein, 9 aa, Mycobacterium avium
FGPREPSPW

SEQ ID NO: 34309 - protein, 15 aa, Mycobacterium avium
FGPRPASEHGREIPL

SEQ ID NO: 34310 - protein, 10 aa, Mycobacterium avium
FGPSGSGKST

SEQ ID NO: 34311 - protein, 6 aa, Mycobacterium avium
FGQPDR

SEQ ID NO: 34312 - protein, 6 aa, Mycobacterium avium
FGRDDP

SEQ ID NO: 34313 - protein, 9 aa, Mycobacterium avium
FGRDGTDGY

SEQ ID NO: 34314 - protein, 9 aa, Mycobacterium avium
FGREGDQGV

SEQ ID NO: 34315 - protein, 12 aa, Mycobacterium avium
FGRGGATQSLQD

SEQ ID NO: 34316 - protein, 7 aa, Mycobacterium avium
FGRGSNR

SEQ ID NO: 34317 - protein, 9 aa, Mycobacterium avium
FGSEEAAAE

SEQ ID NO: 34318 - protein, 6 aa, Mycobacterium avium
FGSEEL

SEQ ID NO: 34319 - protein, 9 aa, Mycobacterium avium
FGSEGERYR

SEQ ID NO: 34320 - protein, 6 aa, Mycobacterium avium
FGSIPP

SEQ ID NO: 34321 - protein, 8 aa, Mycobacterium avium
FGSRASKT

SEQ ID NO: 34322 - protein, 10 aa, Mycobacterium avium
FGSTGGSPAL

SEQ ID NO: 34323 - protein, 8 aa, Mycobacterium avium
FGTDPDGN

SEQ ID NO: 34324 - protein, 7 aa, Mycobacterium avium
FGTEEQK

SEQ ID NO: 34325 - protein, 8 aa, Mycobacterium avium
FGTQEGGA

SEQ ID NO: 34326 - protein, 5 aa, Mycobacterium avium
FGTQV

SEQ ID NO: 34327 - protein, 11 aa, Mycobacterium avium
FGTYGDSLSHG

SEQ ID NO: 34328 - protein, 20 aa, Mycobacterium avium
FHPEKSGDAGAAVLRNWIER

SEQ ID NO: 34329 - protein, 5 aa, Mycobacterium avium
FHQPR

SEQ ID NO: 34330 - protein, 10 aa, Mycobacterium avium
FHSPDDPLQL

SEQ ID NO: 34331 - protein, 9 aa, Mycobacterium avium
FKDETETDL

SEQ ID NO: 34332 - protein, 9 aa, Mycobacterium avium
FKPAKAQQV

SEQ ID NO: 34333 - protein, 6 aa, Mycobacterium avium
FKPSHG

SEQ ID NO: 34334 - protein, 6 aa, Mycobacterium avium
FKTEEA

SEQ ID NO: 34335 - protein, 4 aa, Mycobacterium avium
FNER

SEQ ID NO: 34336 - protein, 15 aa, Mycobacterium avium
FNPDQPDAYAETGGW

SEQ ID NO: 34337 - protein, 10 aa, Mycobacterium avium
FNPKNPKSLS

SEQ ID NO: 34338 - protein, 8 aa, Mycobacterium avium
FNRPDQLS

SEQ ID NO: 34339 - protein, 4 aa, Mycobacterium avium
FNSA

SEQ ID NO: 34340 - protein, 13 aa, Mycobacterium avium
FNTAGRPMVDTPR

SEQ ID NO: 34341 - protein, 6 aa, Mycobacterium avium
FPAETR

SEQ ID NO: 34342 - protein, 9 aa, Mycobacterium avium
FPATPVPGV

SEQ ID NO: 34343 - protein, 4 aa, Mycobacterium avium
FPDG

SEQ ID NO: 34344 - protein, 13 aa, Mycobacterium avium
FPDQTSDPAANDI

SEQ ID NO: 34345 - protein, 5 aa, Mycobacterium avium
FPDSE

SEQ ID NO: 34346 - protein, 4 aa, Mycobacterium avium
FPEE

SEQ ID NO: 34347 - protein, 5 aa, Mycobacterium avium
FPENT

SEQ ID NO: 34348 - protein, 5 aa, Mycobacterium avium
FPEPR

SEQ ID NO: 34349 - protein, 4 aa, Mycobacterium avium
FPEQ

SEQ ID NO: 34350 - protein, 6 aa, Mycobacterium avium
FPESYN

SEQ ID NO: 34351 - protein, 11 aa, Mycobacterium avium
FPGERNDPASY

SEQ ID NO: 34352 - protein, 6 aa, Mycobacterium avium
FPGGEG

SEQ ID NO: 34353 - protein, 8 aa, Mycobacterium avium
FPGGPPPR

SEQ ID NO: 34354 - protein, 7 aa, Mycobacterium avium
FPGQQGG

SEQ ID NO: 34355 - protein, 9 aa, Mycobacterium avium
FPKGERRSI

SEQ ID NO: 34356 - protein, 4 aa, Mycobacterium avium
FPPT

SEQ ID NO: 34357 - protein, 15 aa, Mycobacterium avium
FPQPGPQRAPRPGIH

SEQ ID NO: 34358 - protein, 4 aa, Mycobacterium avium
FPQR

SEQ ID NO: 34359 - protein, 24 aa, Mycobacterium avium
FPQRDPHGDPIPATDGQVPTPPAR

SEQ ID NO: 34360 - protein, 5 aa, Mycobacterium avium
FPRNA

SEQ ID NO: 34361 - protein, 23 aa, Mycobacterium avium
FPRPAPRPTYSALGSRESAAAGL

SEQ ID NO: 34362 - protein, 7 aa, Mycobacterium avium
FPRPRTQ

SEQ ID NO: 34363 - protein, 4 aa, Mycobacterium avium
FPSF

SEQ ID NO: 34364 - protein, 4 aa, Mycobacterium avium
FPTD

SEQ ID NO: 34365 - protein, 21 aa, Mycobacterium avium
FPTEPPEAALPRYTGGTSPRA

SEQ ID NO: 34366 - protein, 14 aa, Mycobacterium avium
FPTSCGSRSLANDV

SEQ ID NO: 34367 - protein, 5 aa, Mycobacterium avium
FQETT

SEQ ID NO: 34368 - protein, 6 aa, Mycobacterium avium
FQGGQA

SEQ ID NO: 34369 - protein, 9 aa, Mycobacterium avium
FQGSYPSVG

SEQ ID NO: 34370 - protein, 4 aa, Mycobacterium avium
FQRG

SEQ ID NO: 34371 - protein, 8 aa, Mycobacterium avium
FQTDQEGI

SEQ ID NO: 34372 - protein, 9 aa, Mycobacterium avium
FRAPEADEL

SEQ ID NO: 34373 - protein, 9 aa, Mycobacterium avium
FRGASPATR

SEQ ID NO: 34374 - protein, 9 aa, Mycobacterium avium
FRGRTTGPW

SEQ ID NO: 34375 - protein, 5 aa, Mycobacterium avium
FRGTD

SEQ ID NO: 34376 - protein, 19 aa, Mycobacterium avium
FRKDGTITAGSASQISDGA

SEQ ID NO: 34377 - protein, 6 aa, Mycobacterium avium
FRPADA

SEQ ID NO: 34378 - protein, 4 aa, Mycobacterium avium
FRPD

SEQ ID NO: 34379 - protein, 17 aa, Mycobacterium avium
FRPDRSHAKSARSVAET

SEQ ID NO: 34380 - protein, 9 aa, Mycobacterium avium
FRPGKAPAK

SEQ ID NO: 34381 - protein, 9 aa, Mycobacterium avium
FRSDSNDSR

SEQ ID NO: 34382 - protein, 6 aa, Mycobacterium avium
FRSGDG

SEQ ID NO: 34383 - protein, 13 aa, Mycobacterium avium
FRSPTALPVTFDA

SEQ ID NO: 34384 - protein, 12 aa, Mycobacterium avium
FRTGYRDGETLR

SEQ ID NO: 34385 - protein, 11 aa, Mycobacterium avium
FRTSGDDIAAN

SEQ ID NO: 34386 - protein, 11 aa, Mycobacterium avium
FRVEPDPRQPG

SEQ ID NO: 34387 - protein, 9 aa, Mycobacterium avium
FSDEDKAKI

SEQ ID NO: 34388 - protein, 10 aa, Mycobacterium avium
FSDRPDYSSS

SEQ ID NO: 34389 - protein, 4 aa, Mycobacterium avium
FSEA

SEQ ID NO: 34390 - protein, 9 aa, Mycobacterium avium
FSEDDLSQV

SEQ ID NO: 34391 - protein, 10 aa, Mycobacterium avium
FSEQPQYENA

SEQ ID NO: 34392 - protein, 10 aa, Mycobacterium avium
FSGQALSDEG

SEQ ID NO: 34393 - protein, 18 aa, Mycobacterium avium
FSGSAREKITAAGGSVTE

SEQ ID NO: 34394 - protein, 5 aa, Mycobacterium avium
FSGSG

SEQ ID NO: 34395 - protein, 17 aa, Mycobacterium avium
FSNPSQKATEDYISGRF

SEQ ID NO: 34396 - protein, 11 aa, Mycobacterium avium
FSPAADPATVA

SEQ ID NO: 34397 - protein, 9 aa, Mycobacterium avium
FSPGRDTPI

SEQ ID NO: 34398 - protein, 6 aa, Mycobacterium avium
FSPGTP

SEQ ID NO: 34399 - protein, 7 aa, Mycobacterium avium
FSPKRRQ

SEQ ID NO: 34400 - protein, 10 aa, Mycobacterium avium
FSQPSPQPGV

SEQ ID NO: 34401 - protein, 9 aa, Mycobacterium avium
FSSAPTDHA

SEQ ID NO: 34402 - protein, 18 aa, Mycobacterium avium
FSTGETGRVGSPKRREIG

SEQ ID NO: 34403 - protein, 6 aa, Mycobacterium avium
FTDPDR

SEQ ID NO: 34404 - protein, 11 aa, Mycobacterium avium
FTEPAAALSAA

SEQ ID NO: 34405 - protein, 16 aa, Mycobacterium avium
FTEPPKTTNDAGIAAQ

SEQ ID NO: 34406 - protein, 6 aa, Mycobacterium avium
FTGEAA

SEQ ID NO: 34407 - protein, 7 aa, Mycobacterium avium
FTGEAAR

SEQ ID NO: 34408 - protein, 10 aa, Mycobacterium avium
FTGEDGATYE

SEQ ID NO: 34409 - protein, 5 aa, Mycobacterium avium
FTGGS

SEQ ID NO: 34410 - protein, 7 aa, Mycobacterium avium
FTGNAPR

SEQ ID NO: 34411 - protein, 11 aa, Mycobacterium avium
FTGQPGSTVPL

SEQ ID NO: 34412 - protein, 5 aa, Mycobacterium avium
FTGSN

SEQ ID NO: 34413 - protein, 13 aa, Mycobacterium avium
FTGSPPPTPPTLG

SEQ ID NO: 34414 - protein, 10 aa, Mycobacterium avium
FTGSTAAGRA

SEQ ID NO: 34415 - protein, 19 aa, Mycobacterium avium
FTPDDQKALSKTVRTYPKT

SEQ ID NO: 34416 - protein, 10 aa, Mycobacterium avium
FTPDPDDDEV

SEQ ID NO: 34417 - protein, 7 aa, Mycobacterium avium
FTPEATA

SEQ ID NO: 34418 - protein, 8 aa, Mycobacterium avium
FTPEGDDI

SEQ ID NO: 34419 - protein, 10 aa, Mycobacterium avium
FTPEQKARNV

SEQ ID NO: 34420 - protein, 18 aa, Mycobacterium avium
FTPGERRDASDKSSSAAR

SEQ ID NO: 34421 - protein, 8 aa, Mycobacterium avium
FTPPDEQA

SEQ ID NO: 34422 - protein, 4 aa, Mycobacterium avium
FTPR

SEQ ID NO: 34423 - protein, 5 aa, Mycobacterium avium
FTPRT

SEQ ID NO: 34424 - protein, 6 aa, Mycobacterium avium
FTPSGA

SEQ ID NO: 34425 - protein, 7 aa, Mycobacterium avium
FTPTDEP

SEQ ID NO: 34426 - protein, 8 aa, Mycobacterium avium
FTQDGGPQ

SEQ ID NO: 34427 - protein, 37 aa, Mycobacterium avium
FTQPDPTTNSGADQSQAVSKAAATAAGSTRNTVTQQP

SEQ ID NO: 34428 - protein, 6 aa, Mycobacterium avium
FTQSAE

SEQ ID NO: 34429 - protein, 4 aa, Mycobacterium avium
FTRP

SEQ ID NO: 34430 - protein, 5 aa, Mycobacterium avium
FTRPG

SEQ ID NO: 34431 - protein, 11 aa, Mycobacterium avium
FTSDTSREEVG

SEQ ID NO: 34432 - protein, 6 aa, Mycobacterium avium
FTTEEL

SEQ ID NO: 34433 - protein, 9 aa, Mycobacterium avium
FTTTTRAGG

SEQ ID NO: 34434 - protein, 12 aa, Mycobacterium avium
FVDKPDEKGSPP

SEQ ID NO: 34435 - protein, 5 aa, Mycobacterium avium
FVGGE

SEQ ID NO: 34436 - protein, 7 aa, Mycobacterium avium
FYGPGEV

SEQ ID NO: 34437 - protein, 5 aa, Mycobacterium avium
FYPEE

SEQ ID NO: 34438 - protein, 11 aa, Mycobacterium avium
FYPPSVGGWPS

SEQ ID NO: 34439 - protein, 8 aa, Mycobacterium avium
GAAAAGVT

SEQ ID NO: 34440 - protein, 14 aa, Mycobacterium avium
GAAAPAEGQVQPGE

SEQ ID NO: 34441 - protein, 10 aa, Mycobacterium avium
GAADADEGPA

SEQ ID NO: 34442 - protein, 9 aa, Mycobacterium avium
GAADDRTGF

SEQ ID NO: 34443 - protein, 11 aa, Mycobacterium avium
GAADGTSWSEG

SEQ ID NO: 34444 - protein, 6 aa, Mycobacterium avium
GAADPE

SEQ ID NO: 34445 - protein, 10 aa, Mycobacterium avium
GAADREQERY

SEQ ID NO: 34446 - protein, 5 aa, Mycobacterium avium
GAADT

SEQ ID NO: 34447 - protein, 7 aa, Mycobacterium avium
GAAEETL

SEQ ID NO: 34448 - protein, 7 aa, Mycobacterium avium
GAAEGAI

SEQ ID NO: 34449 - protein, 9 aa, Mycobacterium avium
GAAEGPDAR

SEQ ID NO: 34450 - protein, 5 aa, Mycobacterium avium
GAAGA

SEQ ID NO: 34451 - protein, 9 aa, Mycobacterium avium
GAAGGQGRA

SEQ ID NO: 34452 - protein, 5 aa, Mycobacterium avium
GAAGI

SEQ ID NO: 34453 - protein, 6 aa, Mycobacterium avium
GAAGIS

SEQ ID NO: 34454 - protein, 6 aa, Mycobacterium avium
GAAGQI

SEQ ID NO: 34455 - protein, 9 aa, Mycobacterium avium
GAAGQPHAR

SEQ ID NO: 34456 - protein, 8 aa, Mycobacterium avium
GAAGRGAG

SEQ ID NO: 34457 - protein, 6 aa, Mycobacterium avium
GAAGSG

SEQ ID NO: 34458 - protein, 11 aa, Mycobacterium avium
GAAGSSLAPRA

SEQ ID NO: 34459 - protein, 10 aa, Mycobacterium avium
GAAGTLAAST

SEQ ID NO: 34460 - protein, 13 aa, Mycobacterium avium
GAAITQGTVLAEI

SEQ ID NO: 34461 - protein, 8 aa, Mycobacterium avium
GAAKADLP

SEQ ID NO: 34462 - protein, 6 aa, Mycobacterium avium
GAAKAL

SEQ ID NO: 34463 - protein, 10 aa, Mycobacterium avium
GAAKDAETLA

SEQ ID NO: 34464 - protein, 14 aa, Mycobacterium avium
GAAKSDFEMVEVAR

SEQ ID NO: 34465 - protein, 12 aa, Mycobacterium avium
GAANGHNSLKPL

SEQ ID NO: 34466 - protein, 6 aa, Mycobacterium avium
GAAPAR

SEQ ID NO: 34467 - protein, 8 aa, Mycobacterium avium
GAAPESAA

SEQ ID NO: 34468 - protein, 8 aa, Mycobacterium avium
GAAPTAER

SEQ ID NO: 34469 - protein, 9 aa, Mycobacterium avium
GAAPTAERR

SEQ ID NO: 34470 - protein, 16 aa, Mycobacterium avium
GAAQSESLARQVDDNG

SEQ ID NO: 34471 - protein, 4 aa, Mycobacterium avium
GAAR

SEQ ID NO: 34472 - protein, 9 aa, Mycobacterium avium
GAARADATK

SEQ ID NO: 34473 - protein, 9 aa, Mycobacterium avium
GAASPRDPL

SEQ ID NO: 34474 - protein, 16 aa, Mycobacterium avium
GAASSGVAEGSAGNPV

SEQ ID NO: 34475 - protein, 9 aa, Mycobacterium avium
GAASSPERR

SEQ ID NO: 34476 - protein, 7 aa, Mycobacterium avium
GAATADA

SEQ ID NO: 34477 - protein, 7 aa, Mycobacterium avium
GAATEVE

SEQ ID NO: 34478 - protein, 8 aa, Mycobacterium avium
GAATKAEP

SEQ ID NO: 34479 - protein, 7 aa, Mycobacterium avium
GAATPTE

SEQ ID NO: 34480 - protein, 6 aa, Mycobacterium avium
GACHTG

SEQ ID NO: 34481 - protein, 4 aa, Mycobacterium avium
GACQ

SEQ ID NO: 34482 - protein, 7 aa, Mycobacterium avium
GADADDI

SEQ ID NO: 34483 - protein, 5 aa, Mycobacterium avium
GADAE

SEQ ID NO: 34484 - protein, 22 aa, Mycobacterium avium
GADAVDGAAAPLAGTTSQPALS

SEQ ID NO: 34485 - protein, 9 aa, Mycobacterium avium
GADDGVEES

SEQ ID NO: 34486 - protein, 10 aa, Mycobacterium avium
GADDQGDEKA

SEQ ID NO: 34487 - protein, 13 aa, Mycobacterium avium
GADEKKLNPNGGA

SEQ ID NO: 34488 - protein, 7 aa, Mycobacterium avium
GADEPGR

SEQ ID NO: 34489 - protein, 5 aa, Mycobacterium avium
GADGD

SEQ ID NO: 34490 - protein, 23 aa, Mycobacterium avium
GADGEYSVPSPDVDAVDTTGAGD

SEQ ID NO: 34491 - protein, 11 aa, Mycobacterium avium
GADGNNPRGYW

SEQ ID NO: 34492 - protein, 11 aa, Mycobacterium avium
GADGPPGSYQD

SEQ ID NO: 34493 - protein, 9 aa, Mycobacterium avium
GADGTPETA

SEQ ID NO: 34494 - protein, 4 aa, Mycobacterium avium
GADH

SEQ ID NO: 34495 - protein, 15 aa, Mycobacterium avium
GADLPDRAAVQAALR

SEQ ID NO: 34496 - protein, 8 aa, Mycobacterium avium
GADNSALA

SEQ ID NO: 34497 - protein, 16 aa, Mycobacterium avium
GADNTEELRYSPGERY

SEQ ID NO: 34498 - protein, 9 aa, Mycobacterium avium
GADPAGEGD

SEQ ID NO: 34499 - protein, 9 aa, Mycobacterium avium
GADPARVRP

SEQ ID NO: 34500 - protein, 9 aa, Mycobacterium avium
GADPATGKP

SEQ ID NO: 34501 - protein, 9 aa, Mycobacterium avium
GADPATQTM

SEQ ID NO: 34502 - protein, 9 aa, Mycobacterium avium
GADPGRAPA

SEQ ID NO: 34503 - protein, 10 aa, Mycobacterium avium
GADPQGAPGL

SEQ ID NO: 34504 - protein, 8 aa, Mycobacterium avium
GADPRGRM

SEQ ID NO: 34505 - protein, 6 aa, Mycobacterium avium
GADPSE

SEQ ID NO: 34506 - protein, 4 aa, Mycobacterium avium
GADR

SEQ ID NO: 34507 - protein, 8 aa, Mycobacterium avium
GADRDEAL

SEQ ID NO: 34508 - protein, 6 aa, Mycobacterium avium
GADRDG

SEQ ID NO: 34509 - protein, 10 aa, Mycobacterium avium
GADSEAVEEE

SEQ ID NO: 34510 - protein, 7 aa, Mycobacterium avium
GADSSRG

SEQ ID NO: 34511 - protein, 5 aa, Mycobacterium avium
GADTP

SEQ ID NO: 34512 - protein, 15 aa, Mycobacterium avium
GADVPGPAHDPTAQW

SEQ ID NO: 34513 - protein, 13 aa, Mycobacterium avium
GAEAGKPLASSNR

SEQ ID NO: 34514 - protein, 8 aa, Mycobacterium avium
GAEAVESG

SEQ ID NO: 34515 - protein, 4 aa, Mycobacterium avium
GAED

SEQ ID NO: 34516 - protein, 9 aa, Mycobacterium avium
GAEDGGNPV

SEQ ID NO: 34517 - protein, 17 aa, Mycobacterium avium
GAEDPDEDDNSASANHA

SEQ ID NO: 34518 - protein, 6 aa, Mycobacterium avium
GAEDTN

SEQ ID NO: 34519 - protein, 7 aa, Mycobacterium avium
GAEDYAQ

SEQ ID NO: 34520 - protein, 8 aa, Mycobacterium avium
GAEEVEDL

SEQ ID NO: 34521 - protein, 5 aa, Mycobacterium avium
GAEGD

SEQ ID NO: 34522 - protein, 7 aa, Mycobacterium avium
GAEGGHV

SEQ ID NO: 34523 - protein, 18 aa, Mycobacterium avium
GAEGLPAPLDDSVDDARD

SEQ ID NO: 34524 - protein, 11 aa, Mycobacterium avium
GAEGPTDDEQV

SEQ ID NO: 34525 - protein, 7 aa, Mycobacterium avium
GAEHERR

SEQ ID NO: 34526 - protein, 9 aa, Mycobacterium avium
GAELDDAAE

SEQ ID NO: 34527 - protein, 8 aa, Mycobacterium avium
GAELGGPE

SEQ ID NO: 34528 - protein, 7 aa, Mycobacterium avium
GAEPGSV

SEQ ID NO: 34529 - protein, 13 aa, Mycobacterium avium
GAEPIGSMGTDTP

SEQ ID NO: 34530 - protein, 8 aa, Mycobacterium avium
GAEPTAPV

SEQ ID NO: 34531 - protein, 9 aa, Mycobacterium avium
GAEPVEPAD

SEQ ID NO: 34532 - protein, 14 aa, Mycobacterium avium
GAEQGGIDAGQART

SEQ ID NO: 34533 - protein, 8 aa, Mycobacterium avium
GAEQIRTG

SEQ ID NO: 34534 - protein, 8 aa, Mycobacterium avium
GAERGKDD

SEQ ID NO: 34535 - protein, 4 aa, Mycobacterium avium
GAES

SEQ ID NO: 34536 - protein, 6 aa, Mycobacterium avium
GAESAL

SEQ ID NO: 34537 - protein, 6 aa, Mycobacterium avium
GAESGD

SEQ ID NO: 34538 - protein, 7 aa, Mycobacterium avium
GAESPRE

SEQ ID NO: 34539 - protein, 4 aa, Mycobacterium avium
GAET

SEQ ID NO: 34540 - protein, 9 aa, Mycobacterium avium
GAETTRNAV

SEQ ID NO: 34541 - protein, 6 aa, Mycobacterium avium
GAETVG

SEQ ID NO: 34542 - protein, 7 aa, Mycobacterium avium
GAEVTSA

SEQ ID NO: 34543 - protein, 5 aa, Mycobacterium avium
GAGAA

SEQ ID NO: 34544 - protein, 6 aa, Mycobacterium avium
GAGAAG

SEQ ID NO: 34545 - protein, 6 aa, Mycobacterium avium
GAGAGG

SEQ ID NO: 34546 - protein, 9 aa, Mycobacterium avium
GAGAGNAPV

SEQ ID NO: 34547 - protein, 10 aa, Mycobacterium avium
GAGAQNDARN

SEQ ID NO: 34548 - protein, 7 aa, Mycobacterium avium
GAGAYQA

SEQ ID NO: 34549 - protein, 7 aa, Mycobacterium avium
GAGDKSF

SEQ ID NO: 34550 - protein, 10 aa, Mycobacterium avium
GAGDSAADPT

SEQ ID NO: 34551 - protein, 17 aa, Mycobacterium avium
GAGEEYRCTCGDALTPV

SEQ ID NO: 34552 - protein, 9 aa, Mycobacterium avium
GAGERAPQI

SEQ ID NO: 34553 - protein, 7 aa, Mycobacterium avium
GAGERGL

SEQ ID NO: 34554 - protein, 4 aa, Mycobacterium avium
GAGG

SEQ ID NO: 34555 - protein, 11 aa, Mycobacterium avium
GAGGAPTASAV

SEQ ID NO: 34556 - protein, 7 aa, Mycobacterium avium
GAGGEAA

SEQ ID NO: 34557 - protein, 10 aa, Mycobacterium avium
GAGGGGIGTT

SEQ ID NO: 34558 - protein, 11 aa, Mycobacterium avium
GAGGGNPARTY

SEQ ID NO: 34559 - protein, 9 aa, Mycobacterium avium
GAGGNRDSP

SEQ ID NO: 34560 - protein, 13 aa, Mycobacterium avium
GAGGQGDALILRA

SEQ ID NO: 34561 - protein, 6 aa, Mycobacterium avium
GAGGSV

SEQ ID NO: 34562 - protein, 6 aa, Mycobacterium avium
GAGGVA

SEQ ID NO: 34563 - protein, 4 aa, Mycobacterium avium
GAGI

SEQ ID NO: 34564 - protein, 5 aa, Mycobacterium avium
GAGIP

SEQ ID NO: 34565 - protein, 6 aa, Mycobacterium avium
GAGKST

SEQ ID NO: 34566 - protein, 6 aa, Mycobacterium avium
GAGKTT

SEQ ID NO: 34567 - protein, 6 aa, Mycobacterium avium
GAGLPG

SEQ ID NO: 34568 - protein, 7 aa, Mycobacterium avium
GAGLTDD

SEQ ID NO: 34569 - protein, 10 aa, Mycobacterium avium
GAGNAPGARV

SEQ ID NO: 34570 - protein, 8 aa, Mycobacterium avium
GAGNETTA

SEQ ID NO: 34571 - protein, 9 aa, Mycobacterium avium
GAGNETTGR

SEQ ID NO: 34572 - protein, 11 aa, Mycobacterium avium
GAGNRAGDGFD

SEQ ID NO: 34573 - protein, 5 aa, Mycobacterium avium
GAGNT

SEQ ID NO: 34574 - protein, 4 aa, Mycobacterium avium
GAGP

SEQ ID NO: 34575 - protein, 7 aa, Mycobacterium avium
GAGPGKL

SEQ ID NO: 34576 - protein, 7 aa, Mycobacterium avium
GAGPLDT

SEQ ID NO: 34577 - protein, 6 aa, Mycobacterium avium
GAGPPV

SEQ ID NO: 34578 - protein, 7 aa, Mycobacterium avium
GAGPQGR

SEQ ID NO: 34579 - protein, 7 aa, Mycobacterium avium
GAGPSSM

SEQ ID NO: 34580 - protein, 6 aa, Mycobacterium avium
GAGPTG

SEQ ID NO: 34581 - protein, 9 aa, Mycobacterium avium
GAGQMPARQ

SEQ ID NO: 34582 - protein, 8 aa, Mycobacterium avium
GAGREASR

SEQ ID NO: 34583 - protein, 7 aa, Mycobacterium avium
GAGRGLG

SEQ ID NO: 34584 - protein, 10 aa, Mycobacterium avium
GAGSAPGPEA

SEQ ID NO: 34585 - protein, 8 aa, Mycobacterium avium
GAGSPAEI

SEQ ID NO: 34586 - protein, 5 aa, Mycobacterium avium
GAGTG

SEQ ID NO: 34587 - protein, 7 aa, Mycobacterium avium
GAGTGAT

SEQ ID NO: 34588 - protein, 7 aa, Mycobacterium avium
GAGTGRN

SEQ ID NO: 34589 - protein, 7 aa, Mycobacterium avium
GAGTHPN

SEQ ID NO: 34590 - protein, 13 aa, Mycobacterium avium
GAGTTVVDDDPDD

SEQ ID NO: 34591 - protein, 7 aa, Mycobacterium avium
GAHADTA

SEQ ID NO: 34592 - protein, 7 aa, Mycobacterium avium
GAHARSA

SEQ ID NO: 34593 - protein, 5 aa, Mycobacterium avium
GAHDG

SEQ ID NO: 34594 - protein, 26 aa, Mycobacterium avium
GAHGQAAAGIRRSGRWRGRPKNQDAY

SEQ ID NO: 34595 - protein, 14 aa, Mycobacterium avium
GAHSYPDAARTDAE

SEQ ID NO: 34596 - protein, 6 aa, Mycobacterium avium
GAIGRR

SEQ ID NO: 34597 - protein, 13 aa, Mycobacterium avium
GAIPPAASYEPKW

SEQ ID NO: 34598 - protein, 8 aa, Mycobacterium avium
GAKAPNLI

SEQ ID NO: 34599 - protein, 14 aa, Mycobacterium avium
GAKARQAKSKARLQ

SEQ ID NO: 34600 - protein, 7 aa, Mycobacterium avium
GAKEEEL

SEQ ID NO: 34601 - protein, 5 aa, Mycobacterium avium
GAKGK

SEQ ID NO: 34602 - protein, 8 aa, Mycobacterium avium
GAKSGKRR

SEQ ID NO: 34603 - protein, 9 aa, Mycobacterium avium
GAKSVPAQK

SEQ ID NO: 34604 - protein, 9 aa, Mycobacterium avium
GAKTGKLRR

SEQ ID NO: 34605 - protein, 12 aa, Mycobacterium avium
GAKTGKPRTTSL

SEQ ID NO: 34606 - protein, 6 aa, Mycobacterium avium
GAKVSG

SEQ ID NO: 34607 - protein, 15 aa, Mycobacterium avium
GALDGAGVDTGPAAQ

SEQ ID NO: 34608 - protein, 16 aa, Mycobacterium avium
GALDPAANRPDGTDAD

SEQ ID NO: 34609 - protein, 5 aa, Mycobacterium avium
GALEA

SEQ ID NO: 34610 - protein, 11 aa, Mycobacterium avium
GALGDQRDEVV

SEQ ID NO: 34611 - protein, 8 aa, Mycobacterium avium
GALGDSSR

SEQ ID NO: 34612 - protein, 14 aa, Mycobacterium avium
GALGGKLTGAGGGG

SEQ ID NO: 34613 - protein, 11 aa, Mycobacterium avium
GALGREQEVAD

SEQ ID NO: 34614 - protein, 5 aa, Mycobacterium avium
GALPD

SEQ ID NO: 34615 - protein, 7 aa, Mycobacterium avium
GALPPAA

SEQ ID NO: 34616 - protein, 8 aa, Mycobacterium avium
GALPPAAG

SEQ ID NO: 34617 - protein, 9 aa, Mycobacterium avium
GALPPGTRL

SEQ ID NO: 34618 - protein, 19 aa, Mycobacterium avium
GALPSGIGKPGSAPGHGQY

SEQ ID NO: 34619 - protein, 4 aa, Mycobacterium avium
GALT

SEQ ID NO: 34620 - protein, 9 aa, Mycobacterium avium
GALTNAGDL

SEQ ID NO: 34621 - protein, 8 aa, Mycobacterium avium
GAMGGPAT

SEQ ID NO: 34622 - protein, 10 aa, Mycobacterium avium
GAMGGSASEE

SEQ ID NO: 34623 - protein, 4 aa, Mycobacterium avium
GAMS

SEQ ID NO: 34624 - protein, 5 aa, Mycobacterium avium
GANAA

SEQ ID NO: 34625 - protein, 17 aa, Mycobacterium avium
GANAEQSQKSVGGNHRD

SEQ ID NO: 34626 - protein, 9 aa, Mycobacterium avium
GANAGPDHN

SEQ ID NO: 34627 - protein, 7 aa, Mycobacterium avium
GANDLGG

SEQ ID NO: 34628 - protein, 9 aa, Mycobacterium avium
GANGAGKST

SEQ ID NO: 34629 - protein, 10 aa, Mycobacterium avium
GANGTGKSSL

SEQ ID NO: 34630 - protein, 9 aa, Mycobacterium avium
GANHGGSKH

SEQ ID NO: 34631 - protein, 5 aa, Mycobacterium avium
GANNM

SEQ ID NO: 34632 - protein, 4 aa, Mycobacterium avium
GANP

SEQ ID NO: 34633 - protein, 6 aa, Mycobacterium avium
GANQTM

SEQ ID NO: 34634 - protein, 7 aa, Mycobacterium avium
GANSGLG

SEQ ID NO: 34635 - protein, 24 aa, Mycobacterium avium
GANTLTPAAPGGHHPGDAAAQQAL

SEQ ID NO: 34636 - protein, 7 aa, Mycobacterium avium
GAPAARS

SEQ ID NO: 34637 - protein, 7 aa, Mycobacterium avium
GAPAEND

SEQ ID NO: 34638 - protein, 22 aa, Mycobacterium avium
GAPAEQGGTATAARDEAPTQLR

SEQ ID NO: 34639 - protein, 5 aa, Mycobacterium avium
GAPAR

SEQ ID NO: 34640 - protein, 11 aa, Mycobacterium avium
GAPARTSKPKF

SEQ ID NO: 34641 - protein, 11 aa, Mycobacterium avium
GAPASPPSNSC

SEQ ID NO: 34642 - protein, 14 aa, Mycobacterium avium
GAPASQAAFAEANQ

SEQ ID NO: 34643 - protein, 5 aa, Mycobacterium avium
GAPAV

SEQ ID NO: 34644 - protein, 14 aa, Mycobacterium avium
GAPCRPPHCAAQAT

SEQ ID NO: 34645 - protein, 5 aa, Mycobacterium avium
GAPDA

SEQ ID NO: 34646 - protein, 15 aa, Mycobacterium avium
GAPDAHGLPASTPIT

SEQ ID NO: 34647 - protein, 7 aa, Mycobacterium avium
GAPDDRR

SEQ ID NO: 34648 - protein, 5 aa, Mycobacterium avium
GAPDE

SEQ ID NO: 34649 - protein, 8 aa, Mycobacterium avium
GAPDETNF

SEQ ID NO: 34650 - protein, 6 aa, Mycobacterium avium
GAPDGV

SEQ ID NO: 34651 - protein, 7 aa, Mycobacterium avium
GAPDTPL

SEQ ID NO: 34652 - protein, 5 aa, Mycobacterium avium
GAPDW

SEQ ID NO: 34653 - protein, 4 aa, Mycobacterium avium
GAPE

SEQ ID NO: 34654 - protein, 12 aa, Mycobacterium avium
GAPEPEQPEKTR

SEQ ID NO: 34655 - protein, 7 aa, Mycobacterium avium
GAPFSGA

SEQ ID NO: 34656 - protein, 6 aa, Mycobacterium avium
GAPGDG

SEQ ID NO: 34657 - protein, 7 aa, Mycobacterium avium
GAPGNAI

SEQ ID NO: 34658 - protein, 9 aa, Mycobacterium avium
GAPGNRDGR

SEQ ID NO: 34659 - protein, 8 aa, Mycobacterium avium
GAPGSETG

SEQ ID NO: 34660 - protein, 12 aa, Mycobacterium avium
GAPGTAAATILT

SEQ ID NO: 34661 - protein, 4 aa, Mycobacterium avium
GAPI

SEQ ID NO: 34662 - protein, 5 aa, Mycobacterium avium
GAPIA

SEQ ID NO: 34663 - protein, 6 aa, Mycobacterium avium
GAPITA

SEQ ID NO: 34664 - protein, 22 aa, Mycobacterium avium
GAPKDPTLKLGGSKTAKAVSKR

SEQ ID NO: 34665 - protein, 4 aa, Mycobacterium avium
GAPM

SEQ ID NO: 34666 - protein, 7 aa, Mycobacterium avium
GAPPGTI

SEQ ID NO: 34667 - protein, 16 aa, Mycobacterium avium
GAPPLPSTEDGFRSAG

SEQ ID NO: 34668 - protein, 22 aa, Mycobacterium avium
GAPPSPLDVPTDPGLPVVKAQV

SEQ ID NO: 34669 - protein, 7 aa, Mycobacterium avium
GAPPTSC

SEQ ID NO: 34670 - protein, 5 aa, Mycobacterium avium
GAPPV

SEQ ID NO: 34671 - protein, 4 aa, Mycobacterium avium
GAPQ

SEQ ID NO: 34672 - protein, 7 aa, Mycobacterium avium
GAPQGED

SEQ ID NO: 34673 - protein, 6 aa, Mycobacterium avium
GAPRAG

SEQ ID NO: 34674 - protein, 6 aa, Mycobacterium avium
GAPREA

SEQ ID NO: 34675 - protein, 10 aa, Mycobacterium avium
GAPSADPTAE

SEQ ID NO: 34676 - protein, 8 aa, Mycobacterium avium
GAPSEEGC

SEQ ID NO: 34677 - protein, 7 aa, Mycobacterium avium
GAPSGAY

SEQ ID NO: 34678 - protein, 5 aa, Mycobacterium avium
GAPTE

SEQ ID NO: 34679 - protein, 9 aa, Mycobacterium avium
GAPTITNDG

SEQ ID NO: 34680 - protein, 9 aa, Mycobacterium avium
GAPTPAESE

SEQ ID NO: 34681 - protein, 10 aa, Mycobacterium avium
GAPTSYPPEV

SEQ ID NO: 34682 - protein, 8 aa, Mycobacterium avium
GAPTVEEQ

SEQ ID NO: 34683 - protein, 7 aa, Mycobacterium avium
GAPVPDG

SEQ ID NO: 34684 - protein, 5 aa, Mycobacterium avium
GAPVS

SEQ ID NO: 34685 - protein, 9 aa, Mycobacterium avium
GAQAAKDAE

SEQ ID NO: 34686 - protein, 8 aa, Mycobacterium avium
GAQAPTET

SEQ ID NO: 34687 - protein, 4 aa, Mycobacterium avium
GAQC

SEQ ID NO: 34688 - protein, 11 aa, Mycobacterium avium
GAQDEPNEKYR

SEQ ID NO: 34689 - protein, 15 aa, Mycobacterium avium
GAQEFGGAPVPDTPG

SEQ ID NO: 34690 - protein, 9 aa, Mycobacterium avium
GAQGGSNGG

SEQ ID NO: 34691 - protein, 7 aa, Mycobacterium avium
GAQPADM

SEQ ID NO: 34692 - protein, 10 aa, Mycobacterium avium
GAQPTAERRT

SEQ ID NO: 34693 - protein, 9 aa, Mycobacterium avium
GAQPTAQRR

SEQ ID NO: 34694 - protein, 14 aa, Mycobacterium avium
GAQRAQDVAGKTVE

SEQ ID NO: 34695 - protein, 11 aa, Mycobacterium avium
GAQRPDRAAQQ

SEQ ID NO: 34696 - protein, 12 aa, Mycobacterium avium
GAQSGIGGGGRY

SEQ ID NO: 34697 - protein, 6 aa, Mycobacterium avium
GAQSGL

SEQ ID NO: 34698 - protein, 10 aa, Mycobacterium avium
GAQTGEPSAA

SEQ ID NO: 34699 - protein, 8 aa, Mycobacterium avium
GARADSVP

SEQ ID NO: 34700 - protein, 15 aa, Mycobacterium avium
GARAGSLTPGELRGS

SEQ ID NO: 34701 - protein, 5 aa, Mycobacterium avium
GARAV

SEQ ID NO: 34702 - protein, 18 aa, Mycobacterium avium
GARKGLADTALRTADSGY

SEQ ID NO: 34703 - protein, 6 aa, Mycobacterium avium
GARLRE

SEQ ID NO: 34704 - protein, 14 aa, Mycobacterium avium
GARNEPKGPQRPHP

SEQ ID NO: 34705 - protein, 17 aa, Mycobacterium avium
GARPASSPKEVADGAET

SEQ ID NO: 34706 - protein, 7 aa, Mycobacterium avium
GARPQRE

SEQ ID NO: 34707 - protein, 16 aa, Mycobacterium avium
GARPTKYSISSAPQLA

SEQ ID NO: 34708 - protein, 7 aa, Mycobacterium avium
GARQAVD

SEQ ID NO: 34709 - protein, 4 aa, Mycobacterium avium
GARR

SEQ ID NO: 34710 - protein, 5 aa, Mycobacterium avium
GARRI

SEQ ID NO: 34711 - protein, 4 aa, Mycobacterium avium
GARS

SEQ ID NO: 34712 - protein, 19 aa, Mycobacterium avium
GARSDGATLVTGGGRPAGL

SEQ ID NO: 34713 - protein, 9 aa, Mycobacterium avium
GARTGKNGK

SEQ ID NO: 34714 - protein, 7 aa, Mycobacterium avium
GARTPDA

SEQ ID NO: 34715 - protein, 6 aa, Mycobacterium avium
GARVAA

SEQ ID NO: 34716 - protein, 6 aa, Mycobacterium avium
GARVGA

SEQ ID NO: 34717 - protein, 10 aa, Mycobacterium avium
GASAARPEHT

SEQ ID NO: 34718 - protein, 11 aa, Mycobacterium avium
GASAESPVPDD

SEQ ID NO: 34719 - protein, 6 aa, Mycobacterium avium
GASAGA

SEQ ID NO: 34720 - protein, 8 aa, Mycobacterium avium
GASAGGGL

SEQ ID NO: 34721 - protein, 9 aa, Mycobacterium avium
GASAGVSGP

SEQ ID NO: 34722 - protein, 14 aa, Mycobacterium avium
GASFPYRKDPNDTN

SEQ ID NO: 34723 - protein, 5 aa, Mycobacterium avium
GASGA

SEQ ID NO: 34724 - protein, 6 aa, Mycobacterium avium
GASGEG

SEQ ID NO: 34725 - protein, 6 aa, Mycobacterium avium
GASGMG

SEQ ID NO: 34726 - protein, 6 aa, Mycobacterium avium
GASGYA

SEQ ID NO: 34727 - protein, 8 aa, Mycobacterium avium
GASLDGEQ

SEQ ID NO: 34728 - protein, 14 aa, Mycobacterium avium
GASNGAWGKGTSEM

SEQ ID NO: 34729 - protein, 9 aa, Mycobacterium avium
GASNGDRPE

SEQ ID NO: 34730 - protein, 14 aa, Mycobacterium avium
GASPAAEQVAATDA

SEQ ID NO: 34731 - protein, 8 aa, Mycobacterium avium
GASPGGDL

SEQ ID NO: 34732 - protein, 7 aa, Mycobacterium avium
GASPPAL

SEQ ID NO: 34733 - protein, 7 aa, Mycobacterium avium
GASPPGY

SEQ ID NO: 34734 - protein, 10 aa, Mycobacterium avium
GASPQGTPGA

SEQ ID NO: 34735 - protein, 7 aa, Mycobacterium avium
GASPRIL

SEQ ID NO: 34736 - protein, 7 aa, Mycobacterium avium
GASRGLG

SEQ ID NO: 34737 - protein, 10 aa, Mycobacterium avium
GASSGLGAET

SEQ ID NO: 34738 - protein, 7 aa, Mycobacterium avium
GASSRAL

SEQ ID NO: 34739 - protein, 8 aa, Mycobacterium avium
GASSRKAR

SEQ ID NO: 34740 - protein, 18 aa, Mycobacterium avium
GASSTGISRKLPDTERQR

SEQ ID NO: 34741 - protein, 6 aa, Mycobacterium avium
GASTFD

SEQ ID NO: 34742 - protein, 16 aa, Mycobacterium avium
GASTTEAQDRAGTDVA

SEQ ID NO: 34743 - protein, 8 aa, Mycobacterium avium
GASTTNEV

SEQ ID NO: 34744 - protein, 6 aa, Mycobacterium avium
GASTVT

SEQ ID NO: 34745 - protein, 7 aa, Mycobacterium avium
GASVDAD

SEQ ID NO: 34746 - protein, 11 aa, Mycobacterium avium
GASYTRDGEAF

SEQ ID NO: 34747 - protein, 6 aa, Mycobacterium avium
GATAAR

SEQ ID NO: 34748 - protein, 9 aa, Mycobacterium avium
GATAEGYAE

SEQ ID NO: 34749 - protein, 15 aa, Mycobacterium avium
GATAEVNDAVRGPGS

SEQ ID NO: 34750 - protein, 10 aa, Mycobacterium avium
GATCKDPHEV

SEQ ID NO: 34751 - protein, 10 aa, Mycobacterium avium
GATDGEPGLQ

SEQ ID NO: 34752 - protein, 8 aa, Mycobacterium avium
GATDPEIE

SEQ ID NO: 34753 - protein, 8 aa, Mycobacterium avium
GATEQKDM

SEQ ID NO: 34754 - protein, 5 aa, Mycobacterium avium
GATGD

SEQ ID NO: 34755 - protein, 5 aa, Mycobacterium avium
GATGK

SEQ ID NO: 34756 - protein, 7 aa, Mycobacterium avium
GATGLRG

SEQ ID NO: 34757 - protein, 11 aa, Mycobacterium avium
GATGLTDKQIR

SEQ ID NO: 34758 - protein, 12 aa, Mycobacterium avium
GATGPRSSWRAT

SEQ ID NO: 34759 - protein, 12 aa, Mycobacterium avium
GATGSRLVTGDT

SEQ ID NO: 34760 - protein, 8 aa, Mycobacterium avium
GATGSTEI

SEQ ID NO: 34761 - protein, 10 aa, Mycobacterium avium
GATGTGKTKT

SEQ ID NO: 34762 - protein, 25 aa, Mycobacterium avium
GATKKVAKGAASTAAAAEAGGLERP

SEQ ID NO: 34763 - protein, 9 aa, Mycobacterium avium
GATLDNEEN

SEQ ID NO: 34764 - protein, 4 aa, Mycobacterium avium
GATP

SEQ ID NO: 34765 - protein, 7 aa, Mycobacterium avium
GATPEWA

SEQ ID NO: 34766 - protein, 11 aa, Mycobacterium avium
GATPPSPAVAN

SEQ ID NO: 34767 - protein, 5 aa, Mycobacterium avium
GATPV

SEQ ID NO: 34768 - protein, 9 aa, Mycobacterium avium
GATPVPGRT

SEQ ID NO: 34769 - protein, 7 aa, Mycobacterium avium
GATQHGL

SEQ ID NO: 34770 - protein, 4 aa, Mycobacterium avium
GATS

SEQ ID NO: 34771 - protein, 8 aa, Mycobacterium avium
GATSRAPR

SEQ ID NO: 34772 - protein, 7 aa, Mycobacterium avium
GATSVGD

SEQ ID NO: 34773 - protein, 8 aa, Mycobacterium avium
GATTLGGR

SEQ ID NO: 34774 - protein, 6 aa, Mycobacterium avium
GATTRA

SEQ ID NO: 34775 - protein, 7 aa, Mycobacterium avium
GATVNAT

SEQ ID NO: 34776 - protein, 5 aa, Mycobacterium avium
GATVT

SEQ ID NO: 34777 - protein, 7 aa, Mycobacterium avium
GAVAGRD

SEQ ID NO: 34778 - protein, 6 aa, Mycobacterium avium
GAVHGG

SEQ ID NO: 34779 - protein, 6 aa, Mycobacterium avium
GAVPAD

SEQ ID NO: 34780 - protein, 12 aa, Mycobacterium avium
GAVPKDGPSAGV

SEQ ID NO: 34781 - protein, 7 aa, Mycobacterium avium
GAVPPTL

SEQ ID NO: 34782 - protein, 13 aa, Mycobacterium avium
GAVRGRGDVPTPR

SEQ ID NO: 34783 - protein, 6 aa, Mycobacterium avium
GAVTPA

SEQ ID NO: 34784 - protein, 5 aa, Mycobacterium avium
GAWQP

SEQ ID NO: 34785 - protein, 7 aa, Mycobacterium avium
GAWSASS

SEQ ID NO: 34786 - protein, 5 aa, Mycobacterium avium
GAYGD

SEQ ID NO: 34787 - protein, 8 aa, Mycobacterium avium
GAYGEKQM

SEQ ID NO: 34788 - protein, 14 aa, Mycobacterium avium
GAYGPDSPMARSTK

SEQ ID NO: 34789 - protein, 7 aa, Mycobacterium avium
GAYPPGK

SEQ ID NO: 34790 - protein, 5 aa, Mycobacterium avium
GCANP

SEQ ID NO: 34791 - protein, 12 aa, Mycobacterium avium
GCDGQPGSYTDV

SEQ ID NO: 34792 - protein, 4 aa, Mycobacterium avium
GCGE

SEQ ID NO: 34793 - protein, 4 aa, Mycobacterium avium
GCGG

SEQ ID NO: 34794 - protein, 7 aa, Mycobacterium avium
GCKPQDI

SEQ ID NO: 34795 - protein, 7 aa, Mycobacterium avium
GCPDEQA

SEQ ID NO: 34796 - protein, 6 aa, Mycobacterium avium
GCQPQA

SEQ ID NO: 34797 - protein, 7 aa, Mycobacterium avium
GCRPASR

SEQ ID NO: 34798 - protein, 9 aa, Mycobacterium avium
GCSPGNAET

SEQ ID NO: 34799 - protein, 4 aa, Mycobacterium avium
GCSR

SEQ ID NO: 34800 - protein, 11 aa, Mycobacterium avium
GDAAAPSERPR

SEQ ID NO: 34801 - protein, 10 aa, Mycobacterium avium
GDAAAPSGRP

SEQ ID NO: 34802 - protein, 5 aa, Mycobacterium avium
GDAAE

SEQ ID NO: 34803 - protein, 7 aa, Mycobacterium avium
GDAAKIQ

SEQ ID NO: 34804 - protein, 6 aa, Mycobacterium avium
GDAAKR

SEQ ID NO: 34805 - protein, 9 aa, Mycobacterium avium
GDAAPGSLV

SEQ ID NO: 34806 - protein, 5 aa, Mycobacterium avium
GDAAQ

SEQ ID NO: 34807 - protein, 8 aa, Mycobacterium avium
GDAARPGA

SEQ ID NO: 34808 - protein, 12 aa, Mycobacterium avium
GDADDAPPGSRL

SEQ ID NO: 34809 - protein, 8 aa, Mycobacterium avium
GDADEATL

SEQ ID NO: 34810 - protein, 7 aa, Mycobacterium avium
GDAEDVA

SEQ ID NO: 34811 - protein, 17 aa, Mycobacterium avium
GDAEDVGDTMAAGDESA

SEQ ID NO: 34812 - protein, 8 aa, Mycobacterium avium
GDAESIAP

SEQ ID NO: 34813 - protein, 4 aa, Mycobacterium avium
GDAG

SEQ ID NO: 34814 - protein, 9 aa, Mycobacterium avium
GDAGDRQFG

SEQ ID NO: 34815 - protein, 13 aa, Mycobacterium avium
GDAGERQVARRPQ

SEQ ID NO: 34816 - protein, 15 aa, Mycobacterium avium
GDAGGGAGATGGGRV

SEQ ID NO: 34817 - protein, 16 aa, Mycobacterium avium
GDAGNPALAADPKSLA

SEQ ID NO: 34818 - protein, 9 aa, Mycobacterium avium
GDAGPPTDP

SEQ ID NO: 34819 - protein, 9 aa, Mycobacterium avium
GDAGRPDRK

SEQ ID NO: 34820 - protein, 5 aa, Mycobacterium avium
GDAGV

SEQ ID NO: 34821 - protein, 4 aa, Mycobacterium avium
GDAI

SEQ ID NO: 34822 - protein, 8 aa, Mycobacterium avium
GDAMPSAA

SEQ ID NO: 34823 - protein, 8 aa, Mycobacterium avium
GDANAAGA

SEQ ID NO: 34824 - protein, 14 aa, Mycobacterium avium
GDANLSGHTYPDQS

SEQ ID NO: 34825 - protein, 7 aa, Mycobacterium avium
GDAPAAD

SEQ ID NO: 34826 - protein, 8 aa, Mycobacterium avium
GDAPAGTR

SEQ ID NO: 34827 - protein, 9 aa, Mycobacterium avium
GDAPGRRAG

SEQ ID NO: 34828 - protein, 7 aa, Mycobacterium avium
GDAQVPG

SEQ ID NO: 34829 - protein, 10 aa, Mycobacterium avium
GDARGLPATA

SEQ ID NO: 34830 - protein, 7 aa, Mycobacterium avium
GDARPDT

SEQ ID NO: 34831 - protein, 6 aa, Mycobacterium avium
GDARRA

SEQ ID NO: 34832 - protein, 7 aa, Mycobacterium avium
GDARTNI

SEQ ID NO: 34833 - protein, 16 aa, Mycobacterium avium
GDATMTAGNSTPLTDG

SEQ ID NO: 34834 - protein, 4 aa, Mycobacterium avium
GDDA

SEQ ID NO: 34835 - protein, 9 aa, Mycobacterium avium
GDDAAAGQL

SEQ ID NO: 34836 - protein, 9 aa, Mycobacterium avium
GDDAAPAAD

SEQ ID NO: 34837 - protein, 9 aa, Mycobacterium avium
GDDAAVGQA

SEQ ID NO: 34838 - protein, 10 aa, Mycobacterium avium
GDDADADEVA

SEQ ID NO: 34839 - protein, 7 aa, Mycobacterium avium
GDDDELG

SEQ ID NO: 34840 - protein, 7 aa, Mycobacterium avium
GDDDLEA

SEQ ID NO: 34841 - protein, 7 aa, Mycobacterium avium
GDDDNEA

SEQ ID NO: 34842 - protein, 6 aa, Mycobacterium avium
GDDERR

SEQ ID NO: 34843 - protein, 9 aa, Mycobacterium avium
GDDFAESAE

SEQ ID NO: 34844 - protein, 4 aa, Mycobacterium avium
GDDG

SEQ ID NO: 34845 - protein, 17 aa, Mycobacterium avium
GDDGQKIEDVNSGVQAI

SEQ ID NO: 34846 - protein, 5 aa, Mycobacterium avium
GDDGR

SEQ ID NO: 34847 - protein, 15 aa, Mycobacterium avium
GDDGRGEAQAPRRSH

SEQ ID NO: 34848 - protein, 9 aa, Mycobacterium avium
GDDGSHSAE

SEQ ID NO: 34849 - protein, 6 aa, Mycobacterium avium
GDDPEA

SEQ ID NO: 34850 - protein, 9 aa, Mycobacterium avium
GDDPGDPAL

SEQ ID NO: 34851 - protein, 10 aa, Mycobacterium avium
GDDPPSPPAL

SEQ ID NO: 34852 - protein, 7 aa, Mycobacterium avium
GDDPWPA

SEQ ID NO: 34853 - protein, 5 aa, Mycobacterium avium
GDDRE

SEQ ID NO: 34854 - protein, 6 aa, Mycobacterium avium
GDDRTS

SEQ ID NO: 34855 - protein, 8 aa, Mycobacterium avium
GDDSCRPQ

SEQ ID NO: 34856 - protein, 9 aa, Mycobacterium avium
GDDSERLTG

SEQ ID NO: 34857 - protein, 8 aa, Mycobacterium avium
GDDSRIGA

SEQ ID NO: 34858 - protein, 12 aa, Mycobacterium avium
GDEAKAVAAIFA

SEQ ID NO: 34859 - protein, 7 aa, Mycobacterium avium
GDECPQK

SEQ ID NO: 34860 - protein, 4 aa, Mycobacterium avium
GDEG

SEQ ID NO: 34861 - protein, 5 aa, Mycobacterium avium
GDEGE

SEQ ID NO: 34862 - protein, 11 aa, Mycobacterium avium
GDEGKGKATDL

SEQ ID NO: 34863 - protein, 5 aa, Mycobacterium avium
GDEIK

SEQ ID NO: 34864 - protein, 8 aa, Mycobacterium avium
GDERAARA

SEQ ID NO: 34865 - protein, 5 aa, Mycobacterium avium
GDERF

SEQ ID NO: 34866 - protein, 8 aa, Mycobacterium avium
GDFAGESY

SEQ ID NO: 34867 - protein, 7 aa, Mycobacterium avium
GDFSGLP

SEQ ID NO: 34868 - protein, 9 aa, Mycobacterium avium
GDGAAGLFS

SEQ ID NO: 34869 - protein, 6 aa, Mycobacterium avium
GDGADI

SEQ ID NO: 34870 - protein, 11 aa, Mycobacterium avium
GDGALTAAGRQ

SEQ ID NO: 34871 - protein, 11 aa, Mycobacterium avium
GDGAPRAVPAS

SEQ ID NO: 34872 - protein, 8 aa, Mycobacterium avium
GDGATSQE

SEQ ID NO: 34873 - protein, 10 aa, Mycobacterium avium
GDGAYTGAGT

SEQ ID NO: 34874 - protein, 6 aa, Mycobacterium avium
GDGDAL

SEQ ID NO: 34875 - protein, 7 aa, Mycobacterium avium
GDGDEQL

SEQ ID NO: 34876 - protein, 9 aa, Mycobacterium avium
GDGEAGPFV

SEQ ID NO: 34877 - protein, 7 aa, Mycobacterium avium
GDGGCTE

SEQ ID NO: 34878 - protein, 6 aa, Mycobacterium avium
GDGGDG

SEQ ID NO: 34879 - protein, 9 aa, Mycobacterium avium
GDGLGGSSF

SEQ ID NO: 34880 - protein, 8 aa, Mycobacterium avium
GDGPGVGA

SEQ ID NO: 34881 - protein, 5 aa, Mycobacterium avium
GDGRC

SEQ ID NO: 34882 - protein, 4 aa, Mycobacterium avium
GDGS

SEQ ID NO: 34883 - protein, 20 aa, Mycobacterium avium
GDGSGTLTGTQIPVDKGALK

SEQ ID NO: 34884 - protein, 7 aa, Mycobacterium avium
GDGSNAL

SEQ ID NO: 34885 - protein, 12 aa, Mycobacterium avium
GDGSSADDYYPQ

SEQ ID NO: 34886 - protein, 5 aa, Mycobacterium avium
GDGTA

SEQ ID NO: 34887 - protein, 8 aa, Mycobacterium avium
GDGTAGHA

SEQ ID NO: 34888 - protein, 6 aa, Mycobacterium avium
GDGTDA

SEQ ID NO: 34889 - protein, 8 aa, Mycobacterium avium
GDGTESRV

SEQ ID NO: 34890 - protein, 7 aa, Mycobacterium avium
GDGTLTV

SEQ ID NO: 34891 - protein, 7 aa, Mycobacterium avium
GDGTQAL

SEQ ID NO: 34892 - protein, 14 aa, Mycobacterium avium
GDGTSAAAQITAAD

SEQ ID NO: 34893 - protein, 5 aa, Mycobacterium avium
GDGTV

SEQ ID NO: 34894 - protein, 7 aa, Mycobacterium avium
GDGTVSG

SEQ ID NO: 34895 - protein, 12 aa, Mycobacterium avium
GDHGDAAEAIQR

SEQ ID NO: 34896 - protein, 9 aa, Mycobacterium avium
GDHHRTDRR

SEQ ID NO: 34897 - protein, 4 aa, Mycobacterium avium
GDHP

SEQ ID NO: 34898 - protein, 7 aa, Mycobacterium avium
GDHPDGQ

SEQ ID NO: 34899 - protein, 8 aa, Mycobacterium avium
GDHPGPAN

SEQ ID NO: 34900 - protein, 5 aa, Mycobacterium avium
GDHQV

SEQ ID NO: 34901 - protein, 7 aa, Mycobacterium avium
GDHTDGI

SEQ ID NO: 34902 - protein, 14 aa, Mycobacterium avium
GDIEEGVTSEASSL

SEQ ID NO: 34903 - protein, 8 aa, Mycobacterium avium
GDIPAATP

SEQ ID NO: 34904 - protein, 5 aa, Mycobacterium avium
GDIPK

SEQ ID NO: 34905 - protein, 15 aa, Mycobacterium avium
GDIPYQPAVGQGDRG

SEQ ID NO: 34906 - protein, 11 aa, Mycobacterium avium
GDISEGAYAGD

SEQ ID NO: 34907 - protein, 4 aa, Mycobacterium avium
GDIT

SEQ ID NO: 34908 - protein, 10 aa, Mycobacterium avium
GDKDGAAKVV

SEQ ID NO: 34909 - protein, 4 aa, Mycobacterium avium
GDKF

SEQ ID NO: 34910 - protein, 9 aa, Mycobacterium avium
GDKGEANLG

SEQ ID NO: 34911 - protein, 9 aa, Mycobacterium avium
GDKGRANLG

SEQ ID NO: 34912 - protein, 8 aa, Mycobacterium avium
GDKKSRAG

SEQ ID NO: 34913 - protein, 21 aa, Mycobacterium avium
GDLAKPDAGLREKAAAAVGAS

SEQ ID NO: 34914 - protein, 8 aa, Mycobacterium avium
GDLEKEKG

SEQ ID NO: 34915 - protein, 10 aa, Mycobacterium avium
GDLGSSAARK

SEQ ID NO: 34916 - protein, 5 aa, Mycobacterium avium
GDLPR

SEQ ID NO: 34917 - protein, 7 aa, Mycobacterium avium
GDLSAGM

SEQ ID NO: 34918 - protein, 9 aa, Mycobacterium avium
GDLSDPAEK

SEQ ID NO: 34919 - protein, 14 aa, Mycobacterium avium
GDLSEEVSKDGKTF

SEQ ID NO: 34920 - protein, 14 aa, Mycobacterium avium
GDLSPVTSDQFSGK

SEQ ID NO: 34921 - protein, 5 aa, Mycobacterium avium
GDNGG

SEQ ID NO: 34922 - protein, 8 aa, Mycobacterium avium
GDNGSGMH

SEQ ID NO: 34923 - protein, 12 aa, Mycobacterium avium
GDPAAAKPLSEG

SEQ ID NO: 34924 - protein, 9 aa, Mycobacterium avium
GDPAANAES

SEQ ID NO: 34925 - protein, 11 aa, Mycobacterium avium
GDPADPDTDLG

SEQ ID NO: 34926 - protein, 7 aa, Mycobacterium avium
GDPAPLA

SEQ ID NO: 34927 - protein, 9 aa, Mycobacterium avium
GDPARPGML

SEQ ID NO: 34928 - protein, 8 aa, Mycobacterium avium
GDPDAFPA

SEQ ID NO: 34929 - protein, 7 aa, Mycobacterium avium
GDPDRRV

SEQ ID NO: 34930 - protein, 6 aa, Mycobacterium avium
GDPETQ

SEQ ID NO: 34931 - protein, 8 aa, Mycobacterium avium
GDPGASLA

SEQ ID NO: 34932 - protein, 7 aa, Mycobacterium avium
GDPGDLD

SEQ ID NO: 34933 - protein, 7 aa, Mycobacterium avium
GDPGGRD

SEQ ID NO: 34934 - protein, 7 aa, Mycobacterium avium
GDPGVGK

SEQ ID NO: 34935 - protein, 10 aa, Mycobacterium avium
GDPGYRPNAA

SEQ ID NO: 34936 - protein, 8 aa, Mycobacterium avium
GDPKTLTG

SEQ ID NO: 34937 - protein, 4 aa, Mycobacterium avium
GDPL

SEQ ID NO: 34938 - protein, 5 aa, Mycobacterium avium
GDPNQ

SEQ ID NO: 34939 - protein, 16 aa, Mycobacterium avium
GDPNSTLRATTARSGS

SEQ ID NO: 34940 - protein, 4 aa, Mycobacterium avium
GDPP

SEQ ID NO: 34941 - protein, 13 aa, Mycobacterium avium
GDPPDYEPTPDRT

SEQ ID NO: 34942 - protein, 5 aa, Mycobacterium avium
GDPQA

SEQ ID NO: 34943 - protein, 5 aa, Mycobacterium avium
GDPQG

SEQ ID NO: 34944 - protein, 6 aa, Mycobacterium avium
GDPRAP

SEQ ID NO: 34945 - protein, 7 aa, Mycobacterium avium
GDPRFSD

SEQ ID NO: 34946 - protein, 19 aa, Mycobacterium avium
GDPSDGLPGVPGVGEKTAA

SEQ ID NO: 34947 - protein, 8 aa, Mycobacterium avium
GDPSLPSA

SEQ ID NO: 34948 - protein, 9 aa, Mycobacterium avium
GDPSTGGDE

SEQ ID NO: 34949 - protein, 9 aa, Mycobacterium avium
GDPSVPSGV

SEQ ID NO: 34950 - protein, 6 aa, Mycobacterium avium
GDPTDA

SEQ ID NO: 34951 - protein, 9 aa, Mycobacterium avium
GDPTLPNPN

SEQ ID NO: 34952 - protein, 13 aa, Mycobacterium avium
GDPTTATAAEGER

SEQ ID NO: 34953 - protein, 4 aa, Mycobacterium avium
GDQA

SEQ ID NO: 34954 - protein, 14 aa, Mycobacterium avium
GDQDPEFASNDAIT

SEQ ID NO: 34955 - protein, 8 aa, Mycobacterium avium
GDQIGKGD

SEQ ID NO: 34956 - protein, 4 aa, Mycobacterium avium
GDQQ

SEQ ID NO: 34957 - protein, 8 aa, Mycobacterium avium
GDQQRADA

SEQ ID NO: 34958 - protein, 4 aa, Mycobacterium avium
GDQR

SEQ ID NO: 34959 - protein, 6 aa, Mycobacterium avium
GDRAFS

SEQ ID NO: 34960 - protein, 6 aa, Mycobacterium avium
GDRAKN

SEQ ID NO: 34961 - protein, 11 aa, Mycobacterium avium
GDRAPQTGRQI

SEQ ID NO: 34962 - protein, 5 aa, Mycobacterium avium
GDRDP

SEQ ID NO: 34963 - protein, 16 aa, Mycobacterium avium
GDRGVAGRSDSPRASL

SEQ ID NO: 34964 - protein, 4 aa, Mycobacterium avium
GDRL

SEQ ID NO: 34965 - protein, 6 aa, Mycobacterium avium
GDRNGS

SEQ ID NO: 34966 - protein, 9 aa, Mycobacterium avium
GDRNVGDAE

SEQ ID NO: 34967 - protein, 8 aa, Mycobacterium avium
GDRPGRSI

SEQ ID NO: 34968 - protein, 9 aa, Mycobacterium avium
GDRSQTARL

SEQ ID NO: 34969 - protein, 7 aa, Mycobacterium avium
GDRTPPR

SEQ ID NO: 34970 - protein, 5 aa, Mycobacterium avium
GDRVA

SEQ ID NO: 34971 - protein, 7 aa, Mycobacterium avium
GDRVEAG

SEQ ID NO: 34972 - protein, 5 aa, Mycobacterium avium
GDRVT

SEQ ID NO: 34973 - protein, 14 aa, Mycobacterium avium
GDRYGHSDAQSTHN

SEQ ID NO: 34974 - protein, 6 aa, Mycobacterium avium
GDSAGG

SEQ ID NO: 34975 - protein, 8 aa, Mycobacterium avium
GDSAGGNL

SEQ ID NO: 34976 - protein, 14 aa, Mycobacterium avium
GDSAGGSAKSGRDS

SEQ ID NO: 34977 - protein, 8 aa, Mycobacterium avium
GDSASSPA

SEQ ID NO: 34978 - protein, 6 aa, Mycobacterium avium
GDSGFL

SEQ ID NO: 34979 - protein, 11 aa, Mycobacterium avium
GDSGPTGADDN

SEQ ID NO: 34980 - protein, 9 aa, Mycobacterium avium
GDSKARARL

SEQ ID NO: 34981 - protein, 10 aa, Mycobacterium avium
GDSNGKAPTA

SEQ ID NO: 34982 - protein, 7 aa, Mycobacterium avium
GDSPGAV

SEQ ID NO: 34983 - protein, 4 aa, Mycobacterium avium
GDSS

SEQ ID NO: 34984 - protein, 12 aa, Mycobacterium avium
GDSSDVEASRAD

SEQ ID NO: 34985 - protein, 6 aa, Mycobacterium avium
GDSSPV

SEQ ID NO: 34986 - protein, 6 aa, Mycobacterium avium
GDSTEL

SEQ ID NO: 34987 - protein, 9 aa, Mycobacterium avium
GDSTSGQRA

SEQ ID NO: 34988 - protein, 8 aa, Mycobacterium avium
GDTAPKAA

SEQ ID NO: 34989 - protein, 7 aa, Mycobacterium avium
GDTATGS

SEQ ID NO: 34990 - protein, 7 aa, Mycobacterium avium
GDTERSA

SEQ ID NO: 34991 - protein, 4 aa, Mycobacterium avium
GDTG

SEQ ID NO: 34992 - protein, 12 aa, Mycobacterium avium
GDTGVTVAGADG

SEQ ID NO: 34993 - protein, 13 aa, Mycobacterium avium
GDTIDGKPRSRSV

SEQ ID NO: 34994 - protein, 5 aa, Mycobacterium avium
GDTIT

SEQ ID NO: 34995 - protein, 5 aa, Mycobacterium avium
GDTKT

SEQ ID NO: 34996 - protein, 14 aa, Mycobacterium avium
GDTPAEAADNARHI

SEQ ID NO: 34997 - protein, 6 aa, Mycobacterium avium
GDTPGI

SEQ ID NO: 34998 - protein, 5 aa, Mycobacterium avium
GDTPL

SEQ ID NO: 34999 - protein, 6 aa, Mycobacterium avium
GDTPLL

SEQ ID NO: 35000 - protein, 9 aa, Mycobacterium avium
GDTPPGKRL

SEQ ID NO: 35001 - protein, 5 aa, Mycobacterium avium
GDTQT

SEQ ID NO: 35002 - protein, 11 aa, Mycobacterium avium
GDTRARTRTGA

SEQ ID NO: 35003 - protein, 5 aa, Mycobacterium avium
GDTRE

SEQ ID NO: 35004 - protein, 6 aa, Mycobacterium avium
GDTRNV

SEQ ID NO: 35005 - protein, 8 aa, Mycobacterium avium
GDTSGIDE

SEQ ID NO: 35006 - protein, 6 aa, Mycobacterium avium
GDTTDD

SEQ ID NO: 35007 - protein, 8 aa, Mycobacterium avium
GDTVDGRS

SEQ ID NO: 35008 - protein, 4 aa, Mycobacterium avium
GDTY

SEQ ID NO: 35009 - protein, 6 aa, Mycobacterium avium
GDTYDT

SEQ ID NO: 35010 - protein, 4 aa, Mycobacterium avium
GDVA

SEQ ID NO: 35011 - protein, 5 aa, Mycobacterium avium
GDVDA

SEQ ID NO: 35012 - protein, 5 aa, Mycobacterium avium
GDVDP

SEQ ID NO: 35013 - protein, 6 aa, Mycobacterium avium
GDVDTG

SEQ ID NO: 35014 - protein, 6 aa, Mycobacterium avium
GDVNES

SEQ ID NO: 35015 - protein, 12 aa, Mycobacterium avium
GDVPLRPGTTPE

SEQ ID NO: 35016 - protein, 7 aa, Mycobacterium avium
GDVPVGT

SEQ ID NO: 35017 - protein, 9 aa, Mycobacterium avium
GDYDSATTH

SEQ ID NO: 35018 - protein, 6 aa, Mycobacterium avium
GDYGTY

SEQ ID NO: 35019 - protein, 6 aa, Mycobacterium avium
GDYQDL

SEQ ID NO: 35020 - protein, 4 aa, Mycobacterium avium
GDYR

SEQ ID NO: 35021 - protein, 8 aa, Mycobacterium avium
GEAARASI

SEQ ID NO: 35022 - protein, 8 aa, Mycobacterium avium
GEAELRDG

SEQ ID NO: 35023 - protein, 14 aa, Mycobacterium avium
GEAEPLGNTGPTGW

SEQ ID NO: 35024 - protein, 6 aa, Mycobacterium avium
GEAGAL

SEQ ID NO: 35025 - protein, 6 aa, Mycobacterium avium
GEAGFG

SEQ ID NO: 35026 - protein, 6 aa, Mycobacterium avium
GEAGVT

SEQ ID NO: 35027 - protein, 9 aa, Mycobacterium avium
GEAKNTYGT

SEQ ID NO: 35028 - protein, 4 aa, Mycobacterium avium
GEAL

SEQ ID NO: 35029 - protein, 8 aa, Mycobacterium avium
GEALPTEQ

SEQ ID NO: 35030 - protein, 13 aa, Mycobacterium avium
GEANTGGADKSSI

SEQ ID NO: 35031 - protein, 6 aa, Mycobacterium avium
GEAPFP

SEQ ID NO: 35032 - protein, 6 aa, Mycobacterium avium
GEAPGQ

SEQ ID NO: 35033 - protein, 4 aa, Mycobacterium avium
GEAR

SEQ ID NO: 35034 - protein, 7 aa, Mycobacterium avium
GEARDRG

SEQ ID NO: 35035 - protein, 6 aa, Mycobacterium avium
GEASEA

SEQ ID NO: 35036 - protein, 9 aa, Mycobacterium avium
GEATGPVPA

SEQ ID NO: 35037 - protein, 9 aa, Mycobacterium avium
GEATPTGGM

SEQ ID NO: 35038 - protein, 5 aa, Mycobacterium avium
GEAVE

SEQ ID NO: 35039 - protein, 17 aa, Mycobacterium avium
GEAVPRTAGVIPHSPAA

SEQ ID NO: 35040 - protein, 8 aa, Mycobacterium avium
GEAVSDGT

SEQ ID NO: 35041 - protein, 6 aa, Mycobacterium avium
GEDAEA

SEQ ID NO: 35042 - protein, 8 aa, Mycobacterium avium
GEDAGMDA

SEQ ID NO: 35043 - protein, 7 aa, Mycobacterium avium
GEDAGRN

SEQ ID NO: 35044 - protein, 7 aa, Mycobacterium avium
GEDGKPV

SEQ ID NO: 35045 - protein, 9 aa, Mycobacterium avium
GEDGRYRPA

SEQ ID NO: 35046 - protein, 10 aa, Mycobacterium avium
GEDQHQDTGA

SEQ ID NO: 35047 - protein, 5 aa, Mycobacterium avium
GEDQV

SEQ ID NO: 35048 - protein, 9 aa, Mycobacterium avium
GEDSPAGRG

SEQ ID NO: 35049 - protein, 7 aa, Mycobacterium avium
GEEDRLR

SEQ ID NO: 35050 - protein, 4 aa, Mycobacterium avium
GEEF

SEQ ID NO: 35051 - protein, 7 aa, Mycobacterium avium
GEEGEEF

SEQ ID NO: 35052 - protein, 6 aa, Mycobacterium avium
GEEGEV

SEQ ID NO: 35053 - protein, 6 aa, Mycobacterium avium
GEEGSG

SEQ ID NO: 35054 - protein, 4 aa, Mycobacterium avium
GEEI

SEQ ID NO: 35055 - protein, 9 aa, Mycobacterium avium
GEEITPQTT

SEQ ID NO: 35056 - protein, 6 aa, Mycobacterium avium
GEENGG

SEQ ID NO: 35057 - protein, 5 aa, Mycobacterium avium
GEEPG

SEQ ID NO: 35058 - protein, 4 aa, Mycobacterium avium
GEER

SEQ ID NO: 35059 - protein, 6 aa, Mycobacterium avium
GEERQG

SEQ ID NO: 35060 - protein, 8 aa, Mycobacterium avium
GEESAGQI

SEQ ID NO: 35061 - protein, 11 aa, Mycobacterium avium
GEESSPVPDHD

SEQ ID NO: 35062 - protein, 6 aa, Mycobacterium avium
GEFPPA

SEQ ID NO: 35063 - protein, 6 aa, Mycobacterium avium
GEFRTG

SEQ ID NO: 35064 - protein, 9 aa, Mycobacterium avium
GEFSSQPSA

SEQ ID NO: 35065 - protein, 5 aa, Mycobacterium avium
GEGAD

SEQ ID NO: 35066 - protein, 4 aa, Mycobacterium avium
GEGD

SEQ ID NO: 35067 - protein, 4 aa, Mycobacterium avium
GEGE

SEQ ID NO: 35068 - protein, 12 aa, Mycobacterium avium
GEGEGRGHDGDY

SEQ ID NO: 35069 - protein, 13 aa, Mycobacterium avium
GEGGGTGTGGAPV

SEQ ID NO: 35070 - protein, 6 aa, Mycobacterium avium
GEGGNL

SEQ ID NO: 35071 - protein, 16 aa, Mycobacterium avium
GEGGPGDLNPGIDPTV

SEQ ID NO: 35072 - protein, 6 aa, Mycobacterium avium
GEGGYQ

SEQ ID NO: 35073 - protein, 6 aa, Mycobacterium avium
GEGIAG

SEQ ID NO: 35074 - protein, 11 aa, Mycobacterium avium
GEGQTAPESAP

SEQ ID NO: 35075 - protein, 5 aa, Mycobacterium avium
GEGRA

SEQ ID NO: 35076 - protein, 8 aa, Mycobacterium avium
GEGRARDD

SEQ ID NO: 35077 - protein, 5 aa, Mycobacterium avium
GEGRG

SEQ ID NO: 35078 - protein, 6 aa, Mycobacterium avium
GEGTGA

SEQ ID NO: 35079 - protein, 7 aa, Mycobacterium avium
GEGTGSV

SEQ ID NO: 35080 - protein, 15 aa, Mycobacterium avium
GEGTKKLSKRDPQSN

SEQ ID NO: 35081 - protein, 5 aa, Mycobacterium avium
GEGTL

SEQ ID NO: 35082 - protein, 6 aa, Mycobacterium avium
GEGTTE

SEQ ID NO: 35083 - protein, 4 aa, Mycobacterium avium
GEGV

SEQ ID NO: 35084 - protein, 10 aa, Mycobacterium avium
GEGVAAKSLE

SEQ ID NO: 35085 - protein, 9 aa, Mycobacterium avium
GEHAGQDAQ

SEQ ID NO: 35086 - protein, 5 aa, Mycobacterium avium
GEHGD

SEQ ID NO: 35087 - protein, 13 aa, Mycobacterium avium
GEHGPREDLGARG

SEQ ID NO: 35088 - protein, 11 aa, Mycobacterium avium
GEHGSTFGGNP

SEQ ID NO: 35089 - protein, 7 aa, Mycobacterium avium
GEHGYPT

SEQ ID NO: 35090 - protein, 6 aa, Mycobacterium avium
GEHPDW

SEQ ID NO: 35091 - protein, 13 aa, Mycobacterium avium
GEHPYSPITPESI

SEQ ID NO: 35092 - protein, 5 aa, Mycobacterium avium
GEHSD

SEQ ID NO: 35093 - protein, 16 aa, Mycobacterium avium
GEIAGAGHASATGRFD

SEQ ID NO: 35094 - protein, 5 aa, Mycobacterium avium
GEIDE

SEQ ID NO: 35095 - protein, 9 aa, Mycobacterium avium
GEIGAAGVS

SEQ ID NO: 35096 - protein, 7 aa, Mycobacterium avium
GEIPEPN

SEQ ID NO: 35097 - protein, 5 aa, Mycobacterium avium
GEIPT

SEQ ID NO: 35098 - protein, 12 aa, Mycobacterium avium
GEKGTAKSTAVR

SEQ ID NO: 35099 - protein, 9 aa, Mycobacterium avium
GEKHGGVKP

SEQ ID NO: 35100 - protein, 7 aa, Mycobacterium avium
GEKMSKS

SEQ ID NO: 35101 - protein, 8 aa, Mycobacterium avium
GEKTSDEA

SEQ ID NO: 35102 - protein, 9 aa, Mycobacterium avium
GELAAPDDD

SEQ ID NO: 35103 - protein, 13 aa, Mycobacterium avium
GELADPAAKPEAL

SEQ ID NO: 35104 - protein, 8 aa, Mycobacterium avium
GELAEQPV

SEQ ID NO: 35105 - protein, 7 aa, Mycobacterium avium
GELAGPW

SEQ ID NO: 35106 - protein, 6 aa, Mycobacterium avium
GELGER

SEQ ID NO: 35107 - protein, 5 aa, Mycobacterium avium
GELGG

SEQ ID NO: 35108 - protein, 8 aa, Mycobacterium avium
GELGGNAG

SEQ ID NO: 35109 - protein, 13 aa, Mycobacterium avium
GELPAGSALPSER

SEQ ID NO: 35110 - protein, 8 aa, Mycobacterium avium
GELPAGVT

SEQ ID NO: 35111 - protein, 9 aa, Mycobacterium avium
GELPDDPRY

SEQ ID NO: 35112 - protein, 8 aa, Mycobacterium avium
GELSDEDL

SEQ ID NO: 35113 - protein, 7 aa, Mycobacterium avium
GELTDGE

SEQ ID NO: 35114 - protein, 8 aa, Mycobacterium avium
GELTGSGR

SEQ ID NO: 35115 - protein, 6 aa, Mycobacterium avium
GELTPH

SEQ ID NO: 35116 - protein, 7 aa, Mycobacterium avium
GEMTPTE

SEQ ID NO: 35117 - protein, 5 aa, Mycobacterium avium
GENEN

SEQ ID NO: 35118 - protein, 5 aa, Mycobacterium avium
GENPR

SEQ ID NO: 35119 - protein, 8 aa, Mycobacterium avium
GENPREDG

SEQ ID NO: 35120 - protein, 11 aa, Mycobacterium avium
GENSYRGSGKL

SEQ ID NO: 35121 - protein, 8 aa, Mycobacterium avium
GEPADPVA

SEQ ID NO: 35122 - protein, 9 aa, Mycobacterium avium
GEPAEAARQ

SEQ ID NO: 35123 - protein, 9 aa, Mycobacterium avium
GEPAHDPDF

SEQ ID NO: 35124 - protein, 6 aa, Mycobacterium avium
GEPAPD

SEQ ID NO: 35125 - protein, 11 aa, Mycobacterium avium
GEPAPGGLDPR

SEQ ID NO: 35126 - protein, 9 aa, Mycobacterium avium
GEPASGPRR

SEQ ID NO: 35127 - protein, 11 aa, Mycobacterium avium
GEPDESGEEKI

SEQ ID NO: 35128 - protein, 5 aa, Mycobacterium avium
GEPDH

SEQ ID NO: 35129 - protein, 7 aa, Mycobacterium avium
GEPDPRH

SEQ ID NO: 35130 - protein, 4 aa, Mycobacterium avium
GEPE

SEQ ID NO: 35131 - protein, 6 aa, Mycobacterium avium
GEPEAD

SEQ ID NO: 35132 - protein, 6 aa, Mycobacterium avium
GEPERN

SEQ ID NO: 35133 - protein, 14 aa, Mycobacterium avium
GEPEWGDPDGPDRP

SEQ ID NO: 35134 - protein, 4 aa, Mycobacterium avium
GEPG

SEQ ID NO: 35135 - protein, 8 aa, Mycobacterium avium
GEPGAGTR

SEQ ID NO: 35136 - protein, 6 aa, Mycobacterium avium
GEPGDD

SEQ ID NO: 35137 - protein, 10 aa, Mycobacterium avium
GEPGKPVSPG

SEQ ID NO: 35138 - protein, 18 aa, Mycobacterium avium
GEPGQPLEERRAPDSPLR

SEQ ID NO: 35139 - protein, 10 aa, Mycobacterium avium
GEPGSVSANR

SEQ ID NO: 35140 - protein, 7 aa, Mycobacterium avium
GEPGTGF

SEQ ID NO: 35141 - protein, 6 aa, Mycobacterium avium
GEPGTP

SEQ ID NO: 35142 - protein, 6 aa, Mycobacterium avium
GEPGVD

SEQ ID NO: 35143 - protein, 9 aa, Mycobacterium avium
GEPGVGKTR

SEQ ID NO: 35144 - protein, 6 aa, Mycobacterium avium
GEPINP

SEQ ID NO: 35145 - protein, 12 aa, Mycobacterium avium
GEPITSSTLTEE

SEQ ID NO: 35146 - protein, 4 aa, Mycobacterium avium
GEPL

SEQ ID NO: 35147 - protein, 10 aa, Mycobacterium avium
GEPQQNPDRP

SEQ ID NO: 35148 - protein, 8 aa, Mycobacterium avium
GEPRSGTT

SEQ ID NO: 35149 - protein, 7 aa, Mycobacterium avium
GEPRYGD

SEQ ID NO: 35150 - protein, 14 aa, Mycobacterium avium
GEPTDGAASDGKGL

SEQ ID NO: 35151 - protein, 7 aa, Mycobacterium avium
GEPTGGY

SEQ ID NO: 35152 - protein, 5 aa, Mycobacterium avium
GEPTQ

SEQ ID NO: 35153 - protein, 9 aa, Mycobacterium avium
GEPTSAGDV

SEQ ID NO: 35154 - protein, 5 aa, Mycobacterium avium
GEPTV

SEQ ID NO: 35155 - protein, 5 aa, Mycobacterium avium
GEPVD

SEQ ID NO: 35156 - protein, 6 aa, Mycobacterium avium
GEPYGP

SEQ ID NO: 35157 - protein, 5 aa, Mycobacterium avium
GEQAA

SEQ ID NO: 35158 - protein, 18 aa, Mycobacterium avium
GEQAADAELTGLSTPAAG

SEQ ID NO: 35159 - protein, 6 aa, Mycobacterium avium
GEQAPG

SEQ ID NO: 35160 - protein, 4 aa, Mycobacterium avium
GEQG

SEQ ID NO: 35161 - protein, 19 aa, Mycobacterium avium
GEQLTAAGKPWSAEEEEAF

SEQ ID NO: 35162 - protein, 9 aa, Mycobacterium avium
GERAAEEVD

SEQ ID NO: 35163 - protein, 6 aa, Mycobacterium avium
GERADG

SEQ ID NO: 35164 - protein, 6 aa, Mycobacterium avium
GERAES

SEQ ID NO: 35165 - protein, 6 aa, Mycobacterium avium
GERAQV

SEQ ID NO: 35166 - protein, 6 aa, Mycobacterium avium
GEREQL

SEQ ID NO: 35167 - protein, 7 aa, Mycobacterium avium
GERKLKT

SEQ ID NO: 35168 - protein, 4 aa, Mycobacterium avium
GERL

SEQ ID NO: 35169 - protein, 5 aa, Mycobacterium avium
GERLP

SEQ ID NO: 35170 - protein, 11 aa, Mycobacterium avium
GERPASSGETL

SEQ ID NO: 35171 - protein, 10 aa, Mycobacterium avium
GERPKDDPMG

SEQ ID NO: 35172 - protein, 15 aa, Mycobacterium avium
GERPVGETLVEVRDE

SEQ ID NO: 35173 - protein, 7 aa, Mycobacterium avium
GERRARP

SEQ ID NO: 35174 - protein, 5 aa, Mycobacterium avium
GERSL

SEQ ID NO: 35175 - protein, 34 aa, Mycobacterium avium
GERTAPSHRPPLAEATDPAEHLKTEENEAEWGFT

SEQ ID NO: 35176 - protein, 5 aa, Mycobacterium avium
GERTG

SEQ ID NO: 35177 - protein, 8 aa, Mycobacterium avium
GERTREGN

SEQ ID NO: 35178 - protein, 11 aa, Mycobacterium avium
GERTTPAGAEA

SEQ ID NO: 35179 - protein, 5 aa, Mycobacterium avium
GESAA

SEQ ID NO: 35180 - protein, 14 aa, Mycobacterium avium
GESAANVGRGYGLP

SEQ ID NO: 35181 - protein, 6 aa, Mycobacterium avium
GESADY

SEQ ID NO: 35182 - protein, 5 aa, Mycobacterium avium
GESAN

SEQ ID NO: 35183 - protein, 10 aa, Mycobacterium avium
GESDSGRAHA

SEQ ID NO: 35184 - protein, 12 aa, Mycobacterium avium
GESEETSKLSRE

SEQ ID NO: 35185 - protein, 9 aa, Mycobacterium avium
GESFPTGRA

SEQ ID NO: 35186 - protein, 12 aa, Mycobacterium avium
GESGSGKSSTAA

SEQ ID NO: 35187 - protein, 12 aa, Mycobacterium avium
GESGSGKSTTAK

SEQ ID NO: 35188 - protein, 11 aa, Mycobacterium avium
GESGSGKSTTL

SEQ ID NO: 35189 - protein, 11 aa, Mycobacterium avium
GESGSGKTTLA

SEQ ID NO: 35190 - protein, 8 aa, Mycobacterium avium
GESGTRMY

SEQ ID NO: 35191 - protein, 6 aa, Mycobacterium avium
GESGYF

SEQ ID NO: 35192 - protein, 5 aa, Mycobacterium avium
GESID

SEQ ID NO: 35193 - protein, 5 aa, Mycobacterium avium
GESMT

SEQ ID NO: 35194 - protein, 25 aa, Mycobacterium avium
GESPAGAPDRPRPYEPGDPVAPQGV

SEQ ID NO: 35195 - protein, 10 aa, Mycobacterium avium
GESPGDQRSL

SEQ ID NO: 35196 - protein, 7 aa, Mycobacterium avium
GESPLDP

SEQ ID NO: 35197 - protein, 7 aa, Mycobacterium avium
GESPQWS

SEQ ID NO: 35198 - protein, 8 aa, Mycobacterium avium
GESPRAAR

SEQ ID NO: 35199 - protein, 8 aa, Mycobacterium avium
GESSGYDL

SEQ ID NO: 35200 - protein, 13 aa, Mycobacterium avium
GETAEAVGGDEPF

SEQ ID NO: 35201 - protein, 8 aa, Mycobacterium avium
GETAEHPG

SEQ ID NO: 35202 - protein, 8 aa, Mycobacterium avium
GETAEQTA

SEQ ID NO: 35203 - protein, 8 aa, Mycobacterium avium
GETAPMRQ

SEQ ID NO: 35204 - protein, 6 aa, Mycobacterium avium
GETAPY

SEQ ID NO: 35205 - protein, 5 aa, Mycobacterium avium
GETEA

SEQ ID NO: 35206 - protein, 9 aa, Mycobacterium avium
GETEAKTNA

SEQ ID NO: 35207 - protein, 6 aa, Mycobacterium avium
GETGGK

SEQ ID NO: 35208 - protein, 8 aa, Mycobacterium avium
GETGRTDF

SEQ ID NO: 35209 - protein, 11 aa, Mycobacterium avium
GETGSGKTTQL

SEQ ID NO: 35210 - protein, 7 aa, Mycobacterium avium
GETIRAG

SEQ ID NO: 35211 - protein, 4 aa, Mycobacterium avium
GETL

SEQ ID NO: 35212 - protein, 11 aa, Mycobacterium avium
GETPPKSPTEF

SEQ ID NO: 35213 - protein, 5 aa, Mycobacterium avium
GETPT

SEQ ID NO: 35214 - protein, 10 aa, Mycobacterium avium
GETPTQGIGP

SEQ ID NO: 35215 - protein, 6 aa, Mycobacterium avium
GETRQQ

SEQ ID NO: 35216 - protein, 8 aa, Mycobacterium avium
GETSVGKY

SEQ ID NO: 35217 - protein, 4 aa, Mycobacterium avium
GETV

SEQ ID NO: 35218 - protein, 16 aa, Mycobacterium avium
GEVEAARREAQSAFGD

SEQ ID NO: 35219 - protein, 6 aa, Mycobacterium avium
GEVEYV

SEQ ID NO: 35220 - protein, 10 aa, Mycobacterium avium
GEVGNAEQAN

SEQ ID NO: 35221 - protein, 10 aa, Mycobacterium avium
GEVQRADGSV

SEQ ID NO: 35222 - protein, 7 aa, Mycobacterium avium
GEVSTPD

SEQ ID NO: 35223 - protein, 4 aa, Mycobacterium avium
GEVV

SEQ ID NO: 35224 - protein, 5 aa, Mycobacterium avium
GEYAA

SEQ ID NO: 35225 - protein, 8 aa, Mycobacterium avium
GEYDDSEG

SEQ ID NO: 35226 - protein, 6 aa, Mycobacterium avium
GEYDER

SEQ ID NO: 35227 - protein, 6 aa, Mycobacterium avium
GEYGEV

SEQ ID NO: 35228 - protein, 5 aa, Mycobacterium avium
GEYGP

SEQ ID NO: 35229 - protein, 4 aa, Mycobacterium avium
GEYK

SEQ ID NO: 35230 - protein, 6 aa, Mycobacterium avium
GEYSSY

SEQ ID NO: 35231 - protein, 8 aa, Mycobacterium avium
GFADTDPQ

SEQ ID NO: 35232 - protein, 15 aa, Mycobacterium avium
GFAEASADSGSGFDE

SEQ ID NO: 35233 - protein, 9 aa, Mycobacterium avium
GFAKDSITE

SEQ ID NO: 35234 - protein, 4 aa, Mycobacterium avium
GFDG

SEQ ID NO: 35235 - protein, 9 aa, Mycobacterium avium
GFDPAAPTA

SEQ ID NO: 35236 - protein, 11 aa, Mycobacterium avium
GFDPPSPFNQQ

SEQ ID NO: 35237 - protein, 7 aa, Mycobacterium avium
GFDPTQR

SEQ ID NO: 35238 - protein, 11 aa, Mycobacterium avium
GFDSIDKSDLR

SEQ ID NO: 35239 - protein, 6 aa, Mycobacterium avium
GFDSPS

SEQ ID NO: 35240 - protein, 5 aa, Mycobacterium avium
GFERG

SEQ ID NO: 35241 - protein, 25 aa, Mycobacterium avium
GFERPRPVDSPWQDRPTAFPARKAG

SEQ ID NO: 35242 - protein, 15 aa, Mycobacterium avium
GFGAPPGQPPAPAPG

SEQ ID NO: 35243 - protein, 8 aa, Mycobacterium avium
GFGATSTV

SEQ ID NO: 35244 - protein, 6 aa, Mycobacterium avium
GFGGRR

SEQ ID NO: 35245 - protein, 5 aa, Mycobacterium avium
GFGGT

SEQ ID NO: 35246 - protein, 5 aa, Mycobacterium avium
GFGPE

SEQ ID NO: 35247 - protein, 5 aa, Mycobacterium avium
GFGRT

SEQ ID NO: 35248 - protein, 5 aa, Mycobacterium avium
GFGTD

SEQ ID NO: 35249 - protein, 12 aa, Mycobacterium avium
GFKGSRKSTPFA

SEQ ID NO: 35250 - protein, 5 aa, Mycobacterium avium
GFNGA

SEQ ID NO: 35251 - protein, 16 aa, Mycobacterium avium
GFPDGPPCNPQGPADP

SEQ ID NO: 35252 - protein, 14 aa, Mycobacterium avium
GFPEYGPASPGPGF

SEQ ID NO: 35253 - protein, 5 aa, Mycobacterium avium
GFPGP

SEQ ID NO: 35254 - protein, 14 aa, Mycobacterium avium
GFPGTKPNPYRERS

SEQ ID NO: 35255 - protein, 9 aa, Mycobacterium avium
GFPNANGRI

SEQ ID NO: 35256 - protein, 5 aa, Mycobacterium avium
GFPPV

SEQ ID NO: 35257 - protein, 7 aa, Mycobacterium avium
GFPSGKH

SEQ ID NO: 35258 - protein, 15 aa, Mycobacterium avium
GFRPTGGHYGRTPTD

SEQ ID NO: 35259 - protein, 11 aa, Mycobacterium avium
GFSEDPKALEP

SEQ ID NO: 35260 - protein, 5 aa, Mycobacterium avium
GFSES

SEQ ID NO: 35261 - protein, 9 aa, Mycobacterium avium
GFSPDSGST

SEQ ID NO: 35262 - protein, 8 aa, Mycobacterium avium
GFSPEDAK

SEQ ID NO: 35263 - protein, 9 aa, Mycobacterium avium
GFSPGQNHQ

SEQ ID NO: 35264 - protein, 11 aa, Mycobacterium avium
GFSPGQNQQGD

SEQ ID NO: 35265 - protein, 9 aa, Mycobacterium avium
GFSRDDAKE

SEQ ID NO: 35266 - protein, 10 aa, Mycobacterium avium
GFSSAQPEVV

SEQ ID NO: 35267 - protein, 7 aa, Mycobacterium avium
GFTSDGL

SEQ ID NO: 35268 - protein, 9 aa, Mycobacterium avium
GFTTPDPSY

SEQ ID NO: 35269 - protein, 7 aa, Mycobacterium avium
GGAAAEA

SEQ ID NO: 35270 - protein, 6 aa, Mycobacterium avium
GGAAAR

SEQ ID NO: 35271 - protein, 9 aa, Mycobacterium avium
GGAADDAVE

SEQ ID NO: 35272 - protein, 5 aa, Mycobacterium avium
GGAAH

SEQ ID NO: 35273 - protein, 8 aa, Mycobacterium avium
GGAAYGPA

SEQ ID NO: 35274 - protein, 4 aa, Mycobacterium avium
GGAD

SEQ ID NO: 35275 - protein, 16 aa, Mycobacterium avium
GGADAPGEISGYGPIP

SEQ ID NO: 35276 - protein, 7 aa, Mycobacterium avium
GGADEGA

SEQ ID NO: 35277 - protein, 7 aa, Mycobacterium avium
GGAEAGA

SEQ ID NO: 35278 - protein, 9 aa, Mycobacterium avium
GGAEGEGAG

SEQ ID NO: 35279 - protein, 8 aa, Mycobacterium avium
GGAEMSKT

SEQ ID NO: 35280 - protein, 11 aa, Mycobacterium avium
GGAEPGAPARR

SEQ ID NO: 35281 - protein, 8 aa, Mycobacterium avium
GGAEPSTW

SEQ ID NO: 35282 - protein, 13 aa, Mycobacterium avium
GGAETATVYAGTG

SEQ ID NO: 35283 - protein, 4 aa, Mycobacterium avium
GGAG

SEQ ID NO: 35284 - protein, 15 aa, Mycobacterium avium
GGAGDERTQRANREA

SEQ ID NO: 35285 - protein, 8 aa, Mycobacterium avium
GGAGGIGR

SEQ ID NO: 35286 - protein, 6 aa, Mycobacterium avium
GGAGRT

SEQ ID NO: 35287 - protein, 12 aa, Mycobacterium avium
GGAGVDAARGDA

SEQ ID NO: 35288 - protein, 7 aa, Mycobacterium avium
GGAGYTA

SEQ ID NO: 35289 - protein, 14 aa, Mycobacterium avium
GGAGYTAAKHGQGA

SEQ ID NO: 35290 - protein, 4 aa, Mycobacterium avium
GGAH

SEQ ID NO: 35291 - protein, 5 aa, Mycobacterium avium
GGAHG

SEQ ID NO: 35292 - protein, 4 aa, Mycobacterium avium
GGAI

SEQ ID NO: 35293 - protein, 4 aa, Mycobacterium avium
GGAN

SEQ ID NO: 35294 - protein, 5 aa, Mycobacterium avium
GGAND

SEQ ID NO: 35295 - protein, 10 aa, Mycobacterium avium
GGANTTDRDR

SEQ ID NO: 35296 - protein, 8 aa, Mycobacterium avium
GGAPGASS

SEQ ID NO: 35297 - protein, 13 aa, Mycobacterium avium
GGAPMYQRPPDRR

SEQ ID NO: 35298 - protein, 8 aa, Mycobacterium avium
GGAPQVNA

SEQ ID NO: 35299 - protein, 6 aa, Mycobacterium avium
GGAPYY

SEQ ID NO: 35300 - protein, 9 aa, Mycobacterium avium
GGAQAAFDK

SEQ ID NO: 35301 - protein, 17 aa, Mycobacterium avium
GGAQDDASFTTDHAEQL

SEQ ID NO: 35302 - protein, 5 aa, Mycobacterium avium
GGAQL

SEQ ID NO: 35303 - protein, 20 aa, Mycobacterium avium
GGAQSGPASSSGGTGQLPHG

SEQ ID NO: 35304 - protein, 13 aa, Mycobacterium avium
GGARDGTGAGHNM

SEQ ID NO: 35305 - protein, 6 aa, Mycobacterium avium
GGARNA

SEQ ID NO: 35306 - protein, 14 aa, Mycobacterium avium
GGARRDEEKARAKE

SEQ ID NO: 35307 - protein, 5 aa, Mycobacterium avium
GGARS

SEQ ID NO: 35308 - protein, 7 aa, Mycobacterium avium
GGARSGV

SEQ ID NO: 35309 - protein, 7 aa, Mycobacterium avium
GGARSTY

SEQ ID NO: 35310 - protein, 6 aa, Mycobacterium avium
GGASAE

SEQ ID NO: 35311 - protein, 8 aa, Mycobacterium avium
GGASGIGR

SEQ ID NO: 35312 - protein, 9 aa, Mycobacterium avium
GGASGLGLA

SEQ ID NO: 35313 - protein, 5 aa, Mycobacterium avium
GGATA

SEQ ID NO: 35314 - protein, 8 aa, Mycobacterium avium
GGATETPV

SEQ ID NO: 35315 - protein, 7 aa, Mycobacterium avium
GGATGQL

SEQ ID NO: 35316 - protein, 7 aa, Mycobacterium avium
GGATSVL

SEQ ID NO: 35317 - protein, 10 aa, Mycobacterium avium
GGAVTSPGVR

SEQ ID NO: 35318 - protein, 10 aa, Mycobacterium avium
GGAYTPDPAA

SEQ ID NO: 35319 - protein, 23 aa, Mycobacterium avium
GGDAATLAQYGPGWDRNPTAAQM

SEQ ID NO: 35320 - protein, 10 aa, Mycobacterium avium
GGDAEERAAD

SEQ ID NO: 35321 - protein, 11 aa, Mycobacterium avium
GGDAHAGHTET

SEQ ID NO: 35322 - protein, 9 aa, Mycobacterium avium
GGDAKTWGD

SEQ ID NO: 35323 - protein, 7 aa, Mycobacterium avium
GGDDDTS

SEQ ID NO: 35324 - protein, 6 aa, Mycobacterium avium
GGDDPA

SEQ ID NO: 35325 - protein, 16 aa, Mycobacterium avium
GGDDPEYTAATRGAAA

SEQ ID NO: 35326 - protein, 5 aa, Mycobacterium avium
GGDLD

SEQ ID NO: 35327 - protein, 11 aa, Mycobacterium avium
GGDLPPGPPFS

SEQ ID NO: 35328 - protein, 8 aa, Mycobacterium avium
GGDLPQAK

SEQ ID NO: 35329 - protein, 4 aa, Mycobacterium avium
GGDP

SEQ ID NO: 35330 - protein, 7 aa, Mycobacterium avium
GGDPDSA

SEQ ID NO: 35331 - protein, 9 aa, Mycobacterium avium
GGDPGASAK

SEQ ID NO: 35332 - protein, 8 aa, Mycobacterium avium
GGDPGSLL

SEQ ID NO: 35333 - protein, 15 aa, Mycobacterium avium
GGDPTGTGRGGPGYK

SEQ ID NO: 35334 - protein, 7 aa, Mycobacterium avium
GGDQLQG

SEQ ID NO: 35335 - protein, 11 aa, Mycobacterium avium
GGDRDGNPNVT

SEQ ID NO: 35336 - protein, 6 aa, Mycobacterium avium
GGDRFT

SEQ ID NO: 35337 - protein, 7 aa, Mycobacterium avium
GGDRRGA

SEQ ID NO: 35338 - protein, 7 aa, Mycobacterium avium
GGDSAME

SEQ ID NO: 35339 - protein, 7 aa, Mycobacterium avium
GGDSEET

SEQ ID NO: 35340 - protein, 5 aa, Mycobacterium avium
GGDSL

SEQ ID NO: 35341 - protein, 6 aa, Mycobacterium avium
GGDTAA

SEQ ID NO: 35342 - protein, 7 aa, Mycobacterium avium
GGDTGAD

SEQ ID NO: 35343 - protein, 8 aa, Mycobacterium avium
GGDTGKDI

SEQ ID NO: 35344 - protein, 7 aa, Mycobacterium avium
GGDTQER

SEQ ID NO: 35345 - protein, 9 aa, Mycobacterium avium
GGDVGDTAE

SEQ ID NO: 35346 - protein, 9 aa, Mycobacterium avium
GGEAGGHCG

SEQ ID NO: 35347 - protein, 5 aa, Mycobacterium avium
GGEAR

SEQ ID NO: 35348 - protein, 6 aa, Mycobacterium avium
GGECPL

SEQ ID NO: 35349 - protein, 4 aa, Mycobacterium avium
GGEG

SEQ ID NO: 35350 - protein, 9 aa, Mycobacterium avium
GGEHRRSAA

SEQ ID NO: 35351 - protein, 6 aa, Mycobacterium avium
GGEKAL

SEQ ID NO: 35352 - protein, 5 aa, Mycobacterium avium
GGEKV

SEQ ID NO: 35353 - protein, 5 aa, Mycobacterium avium
GGEPL

SEQ ID NO: 35354 - protein, 7 aa, Mycobacterium avium
GGEPTVR

SEQ ID NO: 35355 - protein, 6 aa, Mycobacterium avium
GGERAE

SEQ ID NO: 35356 - protein, 16 aa, Mycobacterium avium
GGERDPGKRAPMGATA

SEQ ID NO: 35357 - protein, 10 aa, Mycobacterium avium
GGERKNDPDW

SEQ ID NO: 35358 - protein, 14 aa, Mycobacterium avium
GGERVNEKAPKDRD

SEQ ID NO: 35359 - protein, 17 aa, Mycobacterium avium
GGESTRPGATRIDPRVE

SEQ ID NO: 35360 - protein, 6 aa, Mycobacterium avium
GGFDPN

SEQ ID NO: 35361 - protein, 7 aa, Mycobacterium avium
GGFEGNA

SEQ ID NO: 35362 - protein, 9 aa, Mycobacterium avium
GGFPGTATS

SEQ ID NO: 35363 - protein, 6 aa, Mycobacterium avium
GGFRRG

SEQ ID NO: 35364 - protein, 14 aa, Mycobacterium avium
GGFTSYDDNATRAQ

SEQ ID NO: 35365 - protein, 4 aa, Mycobacterium avium
GGGA

SEQ ID NO: 35366 - protein, 8 aa, Mycobacterium avium
GGGAAAGT

SEQ ID NO: 35367 - protein, 8 aa, Mycobacterium avium
GGGAATDV

SEQ ID NO: 35368 - protein, 6 aa, Mycobacterium avium
GGGAGA

SEQ ID NO: 35369 - protein, 7 aa, Mycobacterium avium
GGGANEI

SEQ ID NO: 35370 - protein, 7 aa, Mycobacterium avium
GGGANYR

SEQ ID NO: 35371 - protein, 10 aa, Mycobacterium avium
GGGAPSLAEA

SEQ ID NO: 35372 - protein, 11 aa, Mycobacterium avium
GGGAPTQEDSR

SEQ ID NO: 35373 - protein, 4 aa, Mycobacterium avium
GGGD

SEQ ID NO: 35374 - protein, 8 aa, Mycobacterium avium
GGGDPEEL

SEQ ID NO: 35375 - protein, 16 aa, Mycobacterium avium
GGGEAPTAASWGAANR

SEQ ID NO: 35376 - protein, 7 aa, Mycobacterium avium
GGGERKT

SEQ ID NO: 35377 - protein, 8 aa, Mycobacterium avium
GGGGGNFG

SEQ ID NO: 35378 - protein, 9 aa, Mycobacterium avium
GGGGPGVGP

SEQ ID NO: 35379 - protein, 5 aa, Mycobacterium avium
GGGGS

SEQ ID NO: 35380 - protein, 22 aa, Mycobacterium avium
GGGGTRRRSAPAHRAQRPPRLS

SEQ ID NO: 35381 - protein, 5 aa, Mycobacterium avium
GGGGV

SEQ ID NO: 35382 - protein, 10 aa, Mycobacterium avium
GGGGYPAARA

SEQ ID NO: 35383 - protein, 4 aa, Mycobacterium avium
GGGI

SEQ ID NO: 35384 - protein, 4 aa, Mycobacterium avium
GGGL

SEQ ID NO: 35385 - protein, 5 aa, Mycobacterium avium
GGGLA

SEQ ID NO: 35386 - protein, 6 aa, Mycobacterium avium
GGGLGQ

SEQ ID NO: 35387 - protein, 6 aa, Mycobacterium avium
GGGLGR

SEQ ID NO: 35388 - protein, 13 aa, Mycobacterium avium
GGGMANATIIERL

SEQ ID NO: 35389 - protein, 14 aa, Mycobacterium avium
GGGMGSATVIEVAG

SEQ ID NO: 35390 - protein, 4 aa, Mycobacterium avium
GGGP

SEQ ID NO: 35391 - protein, 8 aa, Mycobacterium avium
GGGPGDPE

SEQ ID NO: 35392 - protein, 6 aa, Mycobacterium avium
GGGPGY

SEQ ID NO: 35393 - protein, 10 aa, Mycobacterium avium
GGGPSGQAGA

SEQ ID NO: 35394 - protein, 13 aa, Mycobacterium avium
GGGPVAGCMLLTC

SEQ ID NO: 35395 - protein, 16 aa, Mycobacterium avium
GGGQERDIRSGTADVA

SEQ ID NO: 35396 - protein, 8 aa, Mycobacterium avium
GGGRAKAL

SEQ ID NO: 35397 - protein, 15 aa, Mycobacterium avium
GGGSGMARPGAVSRA

SEQ ID NO: 35398 - protein, 5 aa, Mycobacterium avium
GGGSN

SEQ ID NO: 35399 - protein, 9 aa, Mycobacterium avium
GGGSPRDTL

SEQ ID NO: 35400 - protein, 6 aa, Mycobacterium avium
GGGSTE

SEQ ID NO: 35401 - protein, 5 aa, Mycobacterium avium
GGGSV

SEQ ID NO: 35402 - protein, 4 aa, Mycobacterium avium
GGGT

SEQ ID NO: 35403 - protein, 5 aa, Mycobacterium avium
GGGTR

SEQ ID NO: 35404 - protein, 5 aa, Mycobacterium avium
GGGTT

SEQ ID NO: 35405 - protein, 4 aa, Mycobacterium avium
GGGV

SEQ ID NO: 35406 - protein, 5 aa, Mycobacterium avium
GGGVD

SEQ ID NO: 35407 - protein, 4 aa, Mycobacterium avium
GGHA

SEQ ID NO: 35408 - protein, 12 aa, Mycobacterium avium
GGHAGAADNEQV

SEQ ID NO: 35409 - protein, 10 aa, Mycobacterium avium
GGHDVPETKI

SEQ ID NO: 35410 - protein, 5 aa, Mycobacterium avium
GGHDY

SEQ ID NO: 35411 - protein, 4 aa, Mycobacterium avium
GGHR

SEQ ID NO: 35412 - protein, 8 aa, Mycobacterium avium
GGHRAGNG

SEQ ID NO: 35413 - protein, 12 aa, Mycobacterium avium
GGHTRDHGKAPV

SEQ ID NO: 35414 - protein, 14 aa, Mycobacterium avium
GGIETGQALTSNTD

SEQ ID NO: 35415 - protein, 4 aa, Mycobacterium avium
GGIG

SEQ ID NO: 35416 - protein, 7 aa, Mycobacterium avium
GGIGDRS

SEQ ID NO: 35417 - protein, 8 aa, Mycobacterium avium
GGIGSGQQ

SEQ ID NO: 35418 - protein, 9 aa, Mycobacterium avium
GGIRDDDSL

SEQ ID NO: 35419 - protein, 12 aa, Mycobacterium avium
GGITADSDPDAE

SEQ ID NO: 35420 - protein, 6 aa, Mycobacterium avium
GGITET

SEQ ID NO: 35421 - protein, 10 aa, Mycobacterium avium
GGKAGTGKSA

SEQ ID NO: 35422 - protein, 18 aa, Mycobacterium avium
GGKEAEQRAASSVKERHG

SEQ ID NO: 35423 - protein, 9 aa, Mycobacterium avium
GGKGANQAV

SEQ ID NO: 35424 - protein, 8 aa, Mycobacterium avium
GGKGPGHE

SEQ ID NO: 35425 - protein, 9 aa, Mycobacterium avium
GGKLPPPVH

SEQ ID NO: 35426 - protein, 7 aa, Mycobacterium avium
GGKNVAP

SEQ ID NO: 35427 - protein, 9 aa, Mycobacterium avium
GGKPPEPGQ

SEQ ID NO: 35428 - protein, 11 aa, Mycobacterium avium
GGKQTPEDRRR

SEQ ID NO: 35429 - protein, 6 aa, Mycobacterium avium
GGKSPN

SEQ ID NO: 35430 - protein, 9 aa, Mycobacterium avium
GGKSTFEGF

SEQ ID NO: 35431 - protein, 6 aa, Mycobacterium avium
GGKSTI

SEQ ID NO: 35432 - protein, 13 aa, Mycobacterium avium
GGKVAPGETERDA

SEQ ID NO: 35433 - protein, 13 aa, Mycobacterium avium
GGLADQESAGKVT

SEQ ID NO: 35434 - protein, 8 aa, Mycobacterium avium
GGLDQEPE

SEQ ID NO: 35435 - protein, 5 aa, Mycobacterium avium
GGLDS

SEQ ID NO: 35436 - protein, 6 aa, Mycobacterium avium
GGLGPD

SEQ ID NO: 35437 - protein, 9 aa, Mycobacterium avium
GGLGPTADD

SEQ ID NO: 35438 - protein, 9 aa, Mycobacterium avium
GGLKTDERA

SEQ ID NO: 35439 - protein, 8 aa, Mycobacterium avium
GGLNPAGL

SEQ ID NO: 35440 - protein, 6 aa, Mycobacterium avium
GGLPPK

SEQ ID NO: 35441 - protein, 5 aa, Mycobacterium avium
GGLPS

SEQ ID NO: 35442 - protein, 7 aa, Mycobacterium avium
GGLPTNE

SEQ ID NO: 35443 - protein, 11 aa, Mycobacterium avium
GGLQGGGLGYA

SEQ ID NO: 35444 - protein, 14 aa, Mycobacterium avium
GGLRPGRTEREVSR

SEQ ID NO: 35445 - protein, 11 aa, Mycobacterium avium
GGLSGGDDAAQ

SEQ ID NO: 35446 - protein, 10 aa, Mycobacterium avium
GGMAGGSADA

SEQ ID NO: 35447 - protein, 13 aa, Mycobacterium avium
GGMANNVGLELKV

SEQ ID NO: 35448 - protein, 9 aa, Mycobacterium avium
GGMESGHAY

SEQ ID NO: 35449 - protein, 5 aa, Mycobacterium avium
GGMPG

SEQ ID NO: 35450 - protein, 5 aa, Mycobacterium avium
GGMRT

SEQ ID NO: 35451 - protein, 6 aa, Mycobacterium avium
GGMSDN

SEQ ID NO: 35452 - protein, 13 aa, Mycobacterium avium
GGNAGPSPTDGWG

SEQ ID NO: 35453 - protein, 7 aa, Mycobacterium avium
GGNDNAR

SEQ ID NO: 35454 - protein, 9 aa, Mycobacterium avium
GGNDTTTGM

SEQ ID NO: 35455 - protein, 5 aa, Mycobacterium avium
GGNGI

SEQ ID NO: 35456 - protein, 7 aa, Mycobacterium avium
GGNNAGH

SEQ ID NO: 35457 - protein, 7 aa, Mycobacterium avium
GGNPQYD

SEQ ID NO: 35458 - protein, 5 aa, Mycobacterium avium
GGNRG

SEQ ID NO: 35459 - protein, 4 aa, Mycobacterium avium
GGNV

SEQ ID NO: 35460 - protein, 8 aa, Mycobacterium avium
GGNVPGKK

SEQ ID NO: 35461 - protein, 6 aa, Mycobacterium avium
GGPAGA

SEQ ID NO: 35462 - protein, 5 aa, Mycobacterium avium
GGPAI

SEQ ID NO: 35463 - protein, 8 aa, Mycobacterium avium
GGPAPRPV

SEQ ID NO: 35464 - protein, 7 aa, Mycobacterium avium
GGPASDR

SEQ ID NO: 35465 - protein, 10 aa, Mycobacterium avium
GGPAVTNDGV

SEQ ID NO: 35466 - protein, 9 aa, Mycobacterium avium
GGPEGPEQV

SEQ ID NO: 35467 - protein, 7 aa, Mycobacterium avium
GGPEPAP

SEQ ID NO: 35468 - protein, 18 aa, Mycobacterium avium
GGPERLDKHRNKGKLDAR

SEQ ID NO: 35469 - protein, 4 aa, Mycobacterium avium
GGPF

SEQ ID NO: 35470 - protein, 8 aa, Mycobacterium avium
GGPGAASW

SEQ ID NO: 35471 - protein, 8 aa, Mycobacterium avium
GGPGARYV

SEQ ID NO: 35472 - protein, 5 aa, Mycobacterium avium
GGPGE

SEQ ID NO: 35473 - protein, 7 aa, Mycobacterium avium
GGPGQGA

SEQ ID NO: 35474 - protein, 6 aa, Mycobacterium avium
GGPGRS

SEQ ID NO: 35475 - protein, 9 aa, Mycobacterium avium
GGPGTGKSS

SEQ ID NO: 35476 - protein, 9 aa, Mycobacterium avium
GGPHPYTGA

SEQ ID NO: 35477 - protein, 8 aa, Mycobacterium avium
GGPLATPD

SEQ ID NO: 35478 - protein, 6 aa, Mycobacterium avium
GGPPHE

SEQ ID NO: 35479 - protein, 5 aa, Mycobacterium avium
GGPPR

SEQ ID NO: 35480 - protein, 9 aa, Mycobacterium avium
GGPPTPETA

SEQ ID NO: 35481 - protein, 5 aa, Mycobacterium avium
GGPQI

SEQ ID NO: 35482 - protein, 5 aa, Mycobacterium avium
GGPQR

SEQ ID NO: 35483 - protein, 6 aa, Mycobacterium avium
GGPQTY

SEQ ID NO: 35484 - protein, 8 aa, Mycobacterium avium
GGPRGGVH

SEQ ID NO: 35485 - protein, 4 aa, Mycobacterium avium
GGPS

SEQ ID NO: 35486 - protein, 15 aa, Mycobacterium avium
GGPSSVYEPGAPQLD

SEQ ID NO: 35487 - protein, 5 aa, Mycobacterium avium
GGPTL

SEQ ID NO: 35488 - protein, 5 aa, Mycobacterium avium
GGPVD

SEQ ID NO: 35489 - protein, 12 aa, Mycobacterium avium
GGPVSNNKGISL

SEQ ID NO: 35490 - protein, 7 aa, Mycobacterium avium
GGQAGDR

SEQ ID NO: 35491 - protein, 25 aa, Mycobacterium avium
GGQAPALSKLGGSDWANTKTKARRA

SEQ ID NO: 35492 - protein, 11 aa, Mycobacterium avium
GGQDPGAQSSV

SEQ ID NO: 35493 - protein, 10 aa, Mycobacterium avium
GGQEGLASTD

SEQ ID NO: 35494 - protein, 8 aa, Mycobacterium avium
GGQESMTK

SEQ ID NO: 35495 - protein, 6 aa, Mycobacterium avium
GGQGLG

SEQ ID NO: 35496 - protein, 5 aa, Mycobacterium avium
GGQGS

SEQ ID NO: 35497 - protein, 7 aa, Mycobacterium avium
GGQNAHT

SEQ ID NO: 35498 - protein, 5 aa, Mycobacterium avium
GGQPV

SEQ ID NO: 35499 - protein, 6 aa, Mycobacterium avium
GGQPVD

SEQ ID NO: 35500 - protein, 6 aa, Mycobacterium avium
GGQTAL

SEQ ID NO: 35501 - protein, 9 aa, Mycobacterium avium
GGQTSAESY

SEQ ID NO: 35502 - protein, 14 aa, Mycobacterium avium
GGQVPAGMFPEAQR

SEQ ID NO: 35503 - protein, 4 aa, Mycobacterium avium
GGRA

SEQ ID NO: 35504 - protein, 6 aa, Mycobacterium avium
GGREMT

SEQ ID NO: 35505 - protein, 6 aa, Mycobacterium avium
GGRGGS

SEQ ID NO: 35506 - protein, 13 aa, Mycobacterium avium
GGRGIRVDVVDTD

SEQ ID NO: 35507 - protein, 7 aa, Mycobacterium avium
GGRGLST

SEQ ID NO: 35508 - protein, 12 aa, Mycobacterium avium
GGRGPDGKPYGA

SEQ ID NO: 35509 - protein, 9 aa, Mycobacterium avium
GGRGVGSAE

SEQ ID NO: 35510 - protein, 4 aa, Mycobacterium avium
GGRH

SEQ ID NO: 35511 - protein, 7 aa, Mycobacterium avium
GGRLGDG

SEQ ID NO: 35512 - protein, 6 aa, Mycobacterium avium
GGRNLA

SEQ ID NO: 35513 - protein, 6 aa, Mycobacterium avium
GGRNRA

SEQ ID NO: 35514 - protein, 8 aa, Mycobacterium avium
GGRPADTP

SEQ ID NO: 35515 - protein, 8 aa, Mycobacterium avium
GGRPEGLD

SEQ ID NO: 35516 - protein, 12 aa, Mycobacterium avium
GGRPLPLPEPAS

SEQ ID NO: 35517 - protein, 7 aa, Mycobacterium avium
GGRQASA

SEQ ID NO: 35518 - protein, 13 aa, Mycobacterium avium
GGRQLPNTDPDGR

SEQ ID NO: 35519 - protein, 9 aa, Mycobacterium avium
GGRRADNDL

SEQ ID NO: 35520 - protein, 7 aa, Mycobacterium avium
GGRSGGL

SEQ ID NO: 35521 - protein, 6 aa, Mycobacterium avium
GGRSMT

SEQ ID NO: 35522 - protein, 13 aa, Mycobacterium avium
GGRSNSGEGGEDV

SEQ ID NO: 35523 - protein, 14 aa, Mycobacterium avium
GGRTVGAGRVVKII

SEQ ID NO: 35524 - protein, 4 aa, Mycobacterium avium
GGRW

SEQ ID NO: 35525 - protein, 6 aa, Mycobacterium avium
GGRYQP

SEQ ID NO: 35526 - protein, 5 aa, Mycobacterium avium
GGSAF

SEQ ID NO: 35527 - protein, 6 aa, Mycobacterium avium
GGSAGG

SEQ ID NO: 35528 - protein, 8 aa, Mycobacterium avium
GGSAGGHL

SEQ ID NO: 35529 - protein, 6 aa, Mycobacterium avium
GGSARL

SEQ ID NO: 35530 - protein, 6 aa, Mycobacterium avium
GGSAVD

SEQ ID NO: 35531 - protein, 4 aa, Mycobacterium avium
GGSD

SEQ ID NO: 35532 - protein, 5 aa, Mycobacterium avium
GGSDL

SEQ ID NO: 35533 - protein, 10 aa, Mycobacterium avium
GGSGALAGHP

SEQ ID NO: 35534 - protein, 8 aa, Mycobacterium avium
GGSGGPAL

SEQ ID NO: 35535 - protein, 14 aa, Mycobacterium avium
GGSGRDTGKRHPTI

SEQ ID NO: 35536 - protein, 9 aa, Mycobacterium avium
GGSGRNMAE

SEQ ID NO: 35537 - protein, 5 aa, Mycobacterium avium
GGSGY

SEQ ID NO: 35538 - protein, 9 aa, Mycobacterium avium
GGSIPDTDI

SEQ ID NO: 35539 - protein, 4 aa, Mycobacterium avium
GGSL

SEQ ID NO: 35540 - protein, 5 aa, Mycobacterium avium
GGSLE

SEQ ID NO: 35541 - protein, 4 aa, Mycobacterium avium
GGSP

SEQ ID NO: 35542 - protein, 7 aa, Mycobacterium avium
GGSPDAE

SEQ ID NO: 35543 - protein, 5 aa, Mycobacterium avium
GGSPL

SEQ ID NO: 35544 - protein, 6 aa, Mycobacterium avium
GGSRGI

SEQ ID NO: 35545 - protein, 19 aa, Mycobacterium avium
GGSRKAALSQLSEAEAGSR

SEQ ID NO: 35546 - protein, 17 aa, Mycobacterium avium
GGSSGFVSDEDAAELSR

SEQ ID NO: 35547 - protein, 6 aa, Mycobacterium avium
GGSTVA

SEQ ID NO: 35548 - protein, 7 aa, Mycobacterium avium
GGSYDPD

SEQ ID NO: 35549 - protein, 11 aa, Mycobacterium avium
GGTAPGAREHA

SEQ ID NO: 35550 - protein, 8 aa, Mycobacterium avium
GGTASQAD

SEQ ID NO: 35551 - protein, 8 aa, Mycobacterium avium
GGTDAKSF

SEQ ID NO: 35552 - protein, 12 aa, Mycobacterium avium
GGTDLPATKAET

SEQ ID NO: 35553 - protein, 28 aa, Mycobacterium avium
GGTDTGAEWPGFSSDRARSASSPGADAE

SEQ ID NO: 35554 - protein, 7 aa, Mycobacterium avium
GGTEAVE

SEQ ID NO: 35555 - protein, 5 aa, Mycobacterium avium
GGTEN

SEQ ID NO: 35556 - protein, 6 aa, Mycobacterium avium
GGTERI

SEQ ID NO: 35557 - protein, 8 aa, Mycobacterium avium
GGTESDNL

SEQ ID NO: 35558 - protein, 4 aa, Mycobacterium avium
GGTF

SEQ ID NO: 35559 - protein, 7 aa, Mycobacterium avium
GGTFGGN

SEQ ID NO: 35560 - protein, 9 aa, Mycobacterium avium
GGTGGFGDK

SEQ ID NO: 35561 - protein, 13 aa, Mycobacterium avium
GGTGQLESTVSDE

SEQ ID NO: 35562 - protein, 6 aa, Mycobacterium avium
GGTGVE

SEQ ID NO: 35563 - protein, 5 aa, Mycobacterium avium
GGTMP

SEQ ID NO: 35564 - protein, 7 aa, Mycobacterium avium
GGTNEVQ

SEQ ID NO: 35565 - protein, 6 aa, Mycobacterium avium
GGTPPF

SEQ ID NO: 35566 - protein, 8 aa, Mycobacterium avium
GGTPSLLG

SEQ ID NO: 35567 - protein, 7 aa, Mycobacterium avium
GGTSEVQ

SEQ ID NO: 35568 - protein, 8 aa, Mycobacterium avium
GGTSGIGN

SEQ ID NO: 35569 - protein, 9 aa, Mycobacterium avium
GGTTAGLGH

SEQ ID NO: 35570 - protein, 11 aa, Mycobacterium avium
GGTTGAPKRTV

SEQ ID NO: 35571 - protein, 12 aa, Mycobacterium avium
GGTVGRGGGPSY

SEQ ID NO: 35572 - protein, 8 aa, Mycobacterium avium
GGTVNPDK

SEQ ID NO: 35573 - protein, 5 aa, Mycobacterium avium
GGTVS

SEQ ID NO: 35574 - protein, 29 aa, Mycobacterium avium
GGTWGLPGGARDSHETPEETAVREANEEA

SEQ ID NO: 35575 - protein, 5 aa, Mycobacterium avium
GGVAG

SEQ ID NO: 35576 - protein, 8 aa, Mycobacterium avium
GGVASARS

SEQ ID NO: 35577 - protein, 14 aa, Mycobacterium avium
GGVDERDRNADLGG

SEQ ID NO: 35578 - protein, 6 aa, Mycobacterium avium
GGVDSA

SEQ ID NO: 35579 - protein, 10 aa, Mycobacterium avium
GGVDSTALYP

SEQ ID NO: 35580 - protein, 6 aa, Mycobacterium avium
GGVGKT

SEQ ID NO: 35581 - protein, 8 aa, Mycobacterium avium
GGVGKTTI

SEQ ID NO: 35582 - protein, 14 aa, Mycobacterium avium
GGVGNPAAASREQQ

SEQ ID NO: 35583 - protein, 13 aa, Mycobacterium avium
GGVPDGPWPDAAA

SEQ ID NO: 35584 - protein, 7 aa, Mycobacterium avium
GGVSAGA

SEQ ID NO: 35585 - protein, 5 aa, Mycobacterium avium
GGVSP

SEQ ID NO: 35586 - protein, 11 aa, Mycobacterium avium
GGVSTPATQDA

SEQ ID NO: 35587 - protein, 8 aa, Mycobacterium avium
GGVTGSAA

SEQ ID NO: 35588 - protein, 5 aa, Mycobacterium avium
GGVTK

SEQ ID NO: 35589 - protein, 4 aa, Mycobacterium avium
GGWG

SEQ ID NO: 35590 - protein, 9 aa, Mycobacterium avium
GGWGPADSP

SEQ ID NO: 35591 - protein, 6 aa, Mycobacterium avium
GGYDEP

SEQ ID NO: 35592 - protein, 7 aa, Mycobacterium avium
GGYGGDS

SEQ ID NO: 35593 - protein, 6 aa, Mycobacterium avium
GGYGNS

SEQ ID NO: 35594 - protein, 4 aa, Mycobacterium avium
GGYP

SEQ ID NO: 35595 - protein, 7 aa, Mycobacterium avium
GGYPHRP

SEQ ID NO: 35596 - protein, 5 aa, Mycobacterium avium
GGYRI

SEQ ID NO: 35597 - protein, 6 aa, Mycobacterium avium
GGYSES

SEQ ID NO: 35598 - protein, 9 aa, Mycobacterium avium
GGYSREEAN

SEQ ID NO: 35599 - protein, 12 aa, Mycobacterium avium
GHAAATGKSVDL

SEQ ID NO: 35600 - protein, 5 aa, Mycobacterium avium
GHDDP

SEQ ID NO: 35601 - protein, 4 aa, Mycobacterium avium
GHDQ

SEQ ID NO: 35602 - protein, 12 aa, Mycobacterium avium
GHDRDGNGGLPG

SEQ ID NO: 35603 - protein, 5 aa, Mycobacterium avium
GHDRE

SEQ ID NO: 35604 - protein, 12 aa, Mycobacterium avium
GHDTTSATISGG

SEQ ID NO: 35605 - protein, 6 aa, Mycobacterium avium
GHEPDN

SEQ ID NO: 35606 - protein, 6 aa, Mycobacterium avium
GHERDH

SEQ ID NO: 35607 - protein, 13 aa, Mycobacterium avium
GHGAADWSKRPLP

SEQ ID NO: 35608 - protein, 11 aa, Mycobacterium avium
GHGASPTSKPL

SEQ ID NO: 35609 - protein, 5 aa, Mycobacterium avium
GHGDA

SEQ ID NO: 35610 - protein, 9 aa, Mycobacterium avium
GHGESAAGR

SEQ ID NO: 35611 - protein, 13 aa, Mycobacterium avium
GHGESDWSGDGDY

SEQ ID NO: 35612 - protein, 10 aa, Mycobacterium avium
GHGGTREGMT

SEQ ID NO: 35613 - protein, 10 aa, Mycobacterium avium
GHGPPAAEAA

SEQ ID NO: 35614 - protein, 8 aa, Mycobacterium avium
GHGRHEEI

SEQ ID NO: 35615 - protein, 7 aa, Mycobacterium avium
GHGRPDA

SEQ ID NO: 35616 - protein, 7 aa, Mycobacterium avium
GHGTGTV

SEQ ID NO: 35617 - protein, 7 aa, Mycobacterium avium
GHKLSDD

SEQ ID NO: 35618 - protein, 6 aa, Mycobacterium avium
GHKPLD

SEQ ID NO: 35619 - protein, 7 aa, Mycobacterium avium
GHPLGAT

SEQ ID NO: 35620 - protein, 13 aa, Mycobacterium avium
GHPNSVGPNKRPY

SEQ ID NO: 35621 - protein, 5 aa, Mycobacterium avium
GHPPP

SEQ ID NO: 35622 - protein, 13 aa, Mycobacterium avium
GHPPYGHNGERAL

SEQ ID NO: 35623 - protein, 10 aa, Mycobacterium avium
GHPQRKDYPL

SEQ ID NO: 35624 - protein, 13 aa, Mycobacterium avium
GHPRAADRDGAIR

SEQ ID NO: 35625 - protein, 15 aa, Mycobacterium avium
GHPRSNGCSYADSPH

SEQ ID NO: 35626 - protein, 10 aa, Mycobacterium avium
GHRANPVATG

SEQ ID NO: 35627 - protein, 9 aa, Mycobacterium avium
GHRGAAARQ

SEQ ID NO: 35628 - protein, 11 aa, Mycobacterium avium
GHRPDVAEPAR

SEQ ID NO: 35629 - protein, 5 aa, Mycobacterium avium
GHRPE

SEQ ID NO: 35630 - protein, 10 aa, Mycobacterium avium
GHSDDAADEF

SEQ ID NO: 35631 - protein, 12 aa, Mycobacterium avium
GHSETAANQDFD

SEQ ID NO: 35632 - protein, 6 aa, Mycobacterium avium
GHSPKT

SEQ ID NO: 35633 - protein, 11 aa, Mycobacterium avium
GHSTGADPASH

SEQ ID NO: 35634 - protein, 6 aa, Mycobacterium avium
GHTAGA

SEQ ID NO: 35635 - protein, 14 aa, Mycobacterium avium
GHTPSAEVPTPRDL

SEQ ID NO: 35636 - protein, 7 aa, Mycobacterium avium
GHTSSSP

SEQ ID NO: 35637 - protein, 6 aa, Mycobacterium avium
GHVATE

SEQ ID NO: 35638 - protein, 7 aa, Mycobacterium avium
GHYSGAA

SEQ ID NO: 35639 - protein, 7 aa, Mycobacterium avium
GIADTGI

SEQ ID NO: 35640 - protein, 13 aa, Mycobacterium avium
GIAGPGPDGRPRY

SEQ ID NO: 35641 - protein, 6 aa, Mycobacterium avium
GIAPGD

SEQ ID NO: 35642 - protein, 18 aa, Mycobacterium avium
GIASDGTEVIGEPAAQRG

SEQ ID NO: 35643 - protein, 7 aa, Mycobacterium avium
GIATPAD

SEQ ID NO: 35644 - protein, 10 aa, Mycobacterium avium
GIDADSDEAL

SEQ ID NO: 35645 - protein, 10 aa, Mycobacterium avium
GIDPAEVTPG

SEQ ID NO: 35646 - protein, 6 aa, Mycobacterium avium
GIDPDD

SEQ ID NO: 35647 - protein, 6 aa, Mycobacterium avium
GIDPGQ

SEQ ID NO: 35648 - protein, 12 aa, Mycobacterium avium
GIDPPEGPLRAL

SEQ ID NO: 35649 - protein, 8 aa, Mycobacterium avium
GIDPQPLR

SEQ ID NO: 35650 - protein, 13 aa, Mycobacterium avium
GIDYDSAEAGFQP

SEQ ID NO: 35651 - protein, 4 aa, Mycobacterium avium
GIEE

SEQ ID NO: 35652 - protein, 7 aa, Mycobacterium avium
GIEPRSS

SEQ ID NO: 35653 - protein, 12 aa, Mycobacterium avium
GIEPSEVTPEKS

SEQ ID NO: 35654 - protein, 6 aa, Mycobacterium avium
GIGGNS

SEQ ID NO: 35655 - protein, 5 aa, Mycobacterium avium
GIGLT

SEQ ID NO: 35656 - protein, 17 aa, Mycobacterium avium
GIGNGGDTLDKTSEEDW

SEQ ID NO: 35657 - protein, 17 aa, Mycobacterium avium
GIGNGGQTLDKTSEDDW

SEQ ID NO: 35658 - protein, 5 aa, Mycobacterium avium
GIGPG

SEQ ID NO: 35659 - protein, 17 aa, Mycobacterium avium
GIGRPARQRTTDYTPLA

SEQ ID NO: 35660 - protein, 7 aa, Mycobacterium avium
GIHPGGI

SEQ ID NO: 35661 - protein, 7 aa, Mycobacterium avium
GIKDTSD

SEQ ID NO: 35662 - protein, 9 aa, Mycobacterium avium
GIKGSDTAA

SEQ ID NO: 35663 - protein, 7 aa, Mycobacterium avium
GINPGEA

SEQ ID NO: 35664 - protein, 6 aa, Mycobacterium avium
GIPAAP

SEQ ID NO: 35665 - protein, 17 aa, Mycobacterium avium
GIPAEARDSVNRATMTD

SEQ ID NO: 35666 - protein, 11 aa, Mycobacterium avium
GIPDRDARGQR

SEQ ID NO: 35667 - protein, 7 aa, Mycobacterium avium
GIPEEQA

SEQ ID NO: 35668 - protein, 15 aa, Mycobacterium avium
GIPPTRRGSDEFGSG

SEQ ID NO: 35669 - protein, 6 aa, Mycobacterium avium
GIQAGG

SEQ ID NO: 35670 - protein, 8 aa, Mycobacterium avium
GIQSGRDV

SEQ ID NO: 35671 - protein, 8 aa, Mycobacterium avium
GIQSPRGA

SEQ ID NO: 35672 - protein, 5 aa, Mycobacterium avium
GIRDG

SEQ ID NO: 35673 - protein, 6 aa, Mycobacterium avium
GIRKST

SEQ ID NO: 35674 - protein, 10 aa, Mycobacterium avium
GIRPAPGYPA

SEQ ID NO: 35675 - protein, 5 aa, Mycobacterium avium
GIRRE

SEQ ID NO: 35676 - protein, 8 aa, Mycobacterium avium
GIRRGTPM

SEQ ID NO: 35677 - protein, 6 aa, Mycobacterium avium
GIRTGM

SEQ ID NO: 35678 - protein, 7 aa, Mycobacterium avium
GISGRES

SEQ ID NO: 35679 - protein, 9 aa, Mycobacterium avium
GISPAGAPF

SEQ ID NO: 35680 - protein, 6 aa, Mycobacterium avium
GISRKA

SEQ ID NO: 35681 - protein, 9 aa, Mycobacterium avium
GISRSDTAG

SEQ ID NO: 35682 - protein, 5 aa, Mycobacterium avium
GISSP

SEQ ID NO: 35683 - protein, 11 aa, Mycobacterium avium
GITGSDGASHN

SEQ ID NO: 35684 - protein, 4 aa, Mycobacterium avium
GITP

SEQ ID NO: 35685 - protein, 5 aa, Mycobacterium avium
GITTG

SEQ ID NO: 35686 - protein, 8 aa, Mycobacterium avium
GITTPEGL

SEQ ID NO: 35687 - protein, 22 aa, Mycobacterium avium
GKAASTAHGNYTGAMSKNLGMW

SEQ ID NO: 35688 - protein, 7 aa, Mycobacterium avium
GKAGAKR

SEQ ID NO: 35689 - protein, 11 aa, Mycobacterium avium
GKAGFDSMNTK

SEQ ID NO: 35690 - protein, 7 aa, Mycobacterium avium
GKAGGRI

SEQ ID NO: 35691 - protein, 12 aa, Mycobacterium avium
GKAGSETEYGSA

SEQ ID NO: 35692 - protein, 10 aa, Mycobacterium avium
GKAPATPTGT

SEQ ID NO: 35693 - protein, 16 aa, Mycobacterium avium
GKAPHWTGAANSARTY

SEQ ID NO: 35694 - protein, 11 aa, Mycobacterium avium
GKAPKARLDGQ

SEQ ID NO: 35695 - protein, 9 aa, Mycobacterium avium
GKAQPGQIA

SEQ ID NO: 35696 - protein, 9 aa, Mycobacterium avium
GKASAFTAG

SEQ ID NO: 35697 - protein, 7 aa, Mycobacterium avium
GKATPEA

SEQ ID NO: 35698 - protein, 5 aa, Mycobacterium avium
GKAVQ

SEQ ID NO: 35699 - protein, 13 aa, Mycobacterium avium
GKAVVSAGSREAM

SEQ ID NO: 35700 - protein, 7 aa, Mycobacterium avium
GKCGSCS

SEQ ID NO: 35701 - protein, 6 aa, Mycobacterium avium
GKDEDE

SEQ ID NO: 35702 - protein, 11 aa, Mycobacterium avium
GKEKSLAPTPL

SEQ ID NO: 35703 - protein, 7 aa, Mycobacterium avium
GKESHAA

SEQ ID NO: 35704 - protein, 5 aa, Mycobacterium avium
GKESI

SEQ ID NO: 35705 - protein, 14 aa, Mycobacterium avium
GKFGGENSGYNVSG

SEQ ID NO: 35706 - protein, 8 aa, Mycobacterium avium
GKGDTEGA

SEQ ID NO: 35707 - protein, 4 aa, Mycobacterium avium
GKGG

SEQ ID NO: 35708 - protein, 18 aa, Mycobacterium avium
GKGGKAGPRAKLVGQHPR

SEQ ID NO: 35709 - protein, 7 aa, Mycobacterium avium
GKGGKQR

SEQ ID NO: 35710 - protein, 7 aa, Mycobacterium avium
GKGKRIA

SEQ ID NO: 35711 - protein, 9 aa, Mycobacterium avium
GKGPGATSI

SEQ ID NO: 35712 - protein, 7 aa, Mycobacterium avium
GKGRGVD

SEQ ID NO: 35713 - protein, 8 aa, Mycobacterium avium
GKGRTAAE

SEQ ID NO: 35714 - protein, 7 aa, Mycobacterium avium
GKHREPI

SEQ ID NO: 35715 - protein, 17 aa, Mycobacterium avium
GKIAPDLARPEERAALP

SEQ ID NO: 35716 - protein, 19 aa, Mycobacterium avium
GKKAYDKRQDLAQRDAQRE

SEQ ID NO: 35717 - protein, 8 aa, Mycobacterium avium
GKKVESRQ

SEQ ID NO: 35718 - protein, 8 aa, Mycobacterium avium
GKLAQGAQ

SEQ ID NO: 35719 - protein, 8 aa, Mycobacterium avium
GKLDDTPE

SEQ ID NO: 35720 - protein, 8 aa, Mycobacterium avium
GKLGSDPA

SEQ ID NO: 35721 - protein, 5 aa, Mycobacterium avium
GKLPS

SEQ ID NO: 35722 - protein, 8 aa, Mycobacterium avium
GKLSDPRP

SEQ ID NO: 35723 - protein, 7 aa, Mycobacterium avium
GKLSNKL

SEQ ID NO: 35724 - protein, 6 aa, Mycobacterium avium
GKLTAR

SEQ ID NO: 35725 - protein, 13 aa, Mycobacterium avium
GKLTGYGGGLDRK

SEQ ID NO: 35726 - protein, 11 aa, Mycobacterium avium
GKNFSAGHDLG

SEQ ID NO: 35727 - protein, 9 aa, Mycobacterium avium
GKNIARDGQ

SEQ ID NO: 35728 - protein, 6 aa, Mycobacterium avium
GKNIHE

SEQ ID NO: 35729 - protein, 8 aa, Mycobacterium avium
GKNMSPAN

SEQ ID NO: 35730 - protein, 10 aa, Mycobacterium avium
GKNMSPTNIE

SEQ ID NO: 35731 - protein, 7 aa, Mycobacterium avium
GKPAPCP

SEQ ID NO: 35732 - protein, 9 aa, Mycobacterium avium
GKPAPSVSQ

SEQ ID NO: 35733 - protein, 13 aa, Mycobacterium avium
GKPATRRHEPNGG

SEQ ID NO: 35734 - protein, 11 aa, Mycobacterium avium
GKPCGREANTA

SEQ ID NO: 35735 - protein, 4 aa, Mycobacterium avium
GKPE

SEQ ID NO: 35736 - protein, 5 aa, Mycobacterium avium
GKPGR

SEQ ID NO: 35737 - protein, 6 aa, Mycobacterium avium
GKPIRE

SEQ ID NO: 35738 - protein, 11 aa, Mycobacterium avium
GKPITSGSGRI

SEQ ID NO: 35739 - protein, 7 aa, Mycobacterium avium
GKPLDGP

SEQ ID NO: 35740 - protein, 12 aa, Mycobacterium avium
GKPRSEWPADTV

SEQ ID NO: 35741 - protein, 13 aa, Mycobacterium avium
GKPTDQLPGPGRQ

SEQ ID NO: 35742 - protein, 6 aa, Mycobacterium avium
GKQGRF

SEQ ID NO: 35743 - protein, 5 aa, Mycobacterium avium
GKQIP

SEQ ID NO: 35744 - protein, 8 aa, Mycobacterium avium
GKQRPGSI

SEQ ID NO: 35745 - protein, 5 aa, Mycobacterium avium
GKRKG

SEQ ID NO: 35746 - protein, 7 aa, Mycobacterium avium
GKRPSVR

SEQ ID NO: 35747 - protein, 11 aa, Mycobacterium avium
GKRRPGPDDEA

SEQ ID NO: 35748 - protein, 12 aa, Mycobacterium avium
GKRRSNQAEAGI

SEQ ID NO: 35749 - protein, 7 aa, Mycobacterium avium
GKRTLAE

SEQ ID NO: 35750 - protein, 14 aa, Mycobacterium avium
GKRVEDGIRAANLG

SEQ ID NO: 35751 - protein, 5 aa, Mycobacterium avium
GKSAS

SEQ ID NO: 35752 - protein, 6 aa, Mycobacterium avium
GKSEYG

SEQ ID NO: 35753 - protein, 7 aa, Mycobacterium avium
GKSIPLS

SEQ ID NO: 35754 - protein, 12 aa, Mycobacterium avium
GKSLKNSISPDE

SEQ ID NO: 35755 - protein, 11 aa, Mycobacterium avium
GKSSRPGRNQT

SEQ ID NO: 35756 - protein, 6 aa, Mycobacterium avium
GKTAEQ

SEQ ID NO: 35757 - protein, 5 aa, Mycobacterium avium
GKTGI

SEQ ID NO: 35758 - protein, 25 aa, Mycobacterium avium
GKTHGAGDADLVGPEPEAAPIEQQG

SEQ ID NO: 35759 - protein, 7 aa, Mycobacterium avium
GKTIPAN

SEQ ID NO: 35760 - protein, 9 aa, Mycobacterium avium
GKTLSDPNR

SEQ ID NO: 35761 - protein, 6 aa, Mycobacterium avium
GKTQAK

SEQ ID NO: 35762 - protein, 4 aa, Mycobacterium avium
GKTT

SEQ ID NO: 35763 - protein, 7 aa, Mycobacterium avium
GKTTLGE

SEQ ID NO: 35764 - protein, 6 aa, Mycobacterium avium
GKTTLT

SEQ ID NO: 35765 - protein, 20 aa, Mycobacterium avium
GKVDSGSQVINSTKGKKERL

SEQ ID NO: 35766 - protein, 7 aa, Mycobacterium avium
GKVEGSI

SEQ ID NO: 35767 - protein, 10 aa, Mycobacterium avium
GKVKPQERKP

SEQ ID NO: 35768 - protein, 7 aa, Mycobacterium avium
GKWGGTF

SEQ ID NO: 35769 - protein, 6 aa, Mycobacterium avium
GKWTEE

SEQ ID NO: 35770 - protein, 13 aa, Mycobacterium avium
GKYPPPPGASETI

SEQ ID NO: 35771 - protein, 8 aa, Mycobacterium avium
GKYPSTEF

SEQ ID NO: 35772 - protein, 4 aa, Mycobacterium avium
GKYT

SEQ ID NO: 35773 - protein, 5 aa, Mycobacterium avium
GLADE

SEQ ID NO: 35774 - protein, 8 aa, Mycobacterium avium
GLAEASDD

SEQ ID NO: 35775 - protein, 6 aa, Mycobacterium avium
GLAELS

SEQ ID NO: 35776 - protein, 8 aa, Mycobacterium avium
GLAESPSA

SEQ ID NO: 35777 - protein, 8 aa, Mycobacterium avium
GLAGATTY

SEQ ID NO: 35778 - protein, 8 aa, Mycobacterium avium
GLAKPDGV

SEQ ID NO: 35779 - protein, 7 aa, Mycobacterium avium
GLAPDGR

SEQ ID NO: 35780 - protein, 9 aa, Mycobacterium avium
GLAPGTQFE

SEQ ID NO: 35781 - protein, 6 aa, Mycobacterium avium
GLAPNG

SEQ ID NO: 35782 - protein, 7 aa, Mycobacterium avium
GLAPQGE

SEQ ID NO: 35783 - protein, 7 aa, Mycobacterium avium
GLAQGQK

SEQ ID NO: 35784 - protein, 6 aa, Mycobacterium avium
GLARPG

SEQ ID NO: 35785 - protein, 9 aa, Mycobacterium avium
GLARPQGDR

SEQ ID NO: 35786 - protein, 4 aa, Mycobacterium avium
GLDE

SEQ ID NO: 35787 - protein, 5 aa, Mycobacterium avium
GLDES

SEQ ID NO: 35788 - protein, 8 aa, Mycobacterium avium
GLDGGADD

SEQ ID NO: 35789 - protein, 5 aa, Mycobacterium avium
GLDGI

SEQ ID NO: 35790 - protein, 5 aa, Mycobacterium avium
GLDGR

SEQ ID NO: 35791 - protein, 12 aa, Mycobacterium avium
GLDNGDLDRTHR

SEQ ID NO: 35792 - protein, 7 aa, Mycobacterium avium
GLDNQDT

SEQ ID NO: 35793 - protein, 13 aa, Mycobacterium avium
GLDPDFGRGQSAY

SEQ ID NO: 35794 - protein, 4 aa, Mycobacterium avium
GLDQ

SEQ ID NO: 35795 - protein, 9 aa, Mycobacterium avium
GLDRANASG

SEQ ID NO: 35796 - protein, 13 aa, Mycobacterium avium
GLDSNNSPLPIPD

SEQ ID NO: 35797 - protein, 4 aa, Mycobacterium avium
GLDT

SEQ ID NO: 35798 - protein, 8 aa, Mycobacterium avium
GLDTGKET

SEQ ID NO: 35799 - protein, 9 aa, Mycobacterium avium
GLESPTHGG

SEQ ID NO: 35800 - protein, 8 aa, Mycobacterium avium
GLETNSAR

SEQ ID NO: 35801 - protein, 5 aa, Mycobacterium avium
GLETR

SEQ ID NO: 35802 - protein, 4 aa, Mycobacterium avium
GLGA

SEQ ID NO: 35803 - protein, 5 aa, Mycobacterium avium
GLGAP

SEQ ID NO: 35804 - protein, 6 aa, Mycobacterium avium
GLGDRG

SEQ ID NO: 35805 - protein, 7 aa, Mycobacterium avium
GLGEGPL

SEQ ID NO: 35806 - protein, 10 aa, Mycobacterium avium
GLGEQSGFGR

SEQ ID NO: 35807 - protein, 5 aa, Mycobacterium avium
GLGGA

SEQ ID NO: 35808 - protein, 7 aa, Mycobacterium avium
GLGGEPR

SEQ ID NO: 35809 - protein, 6 aa, Mycobacterium avium
GLGGGL

SEQ ID NO: 35810 - protein, 11 aa, Mycobacterium avium
GLGGPGREHEA

SEQ ID NO: 35811 - protein, 16 aa, Mycobacterium avium
GLGGSDRKIEQALKPG

SEQ ID NO: 35812 - protein, 10 aa, Mycobacterium avium
GLGPAPAHGS

SEQ ID NO: 35813 - protein, 7 aa, Mycobacterium avium
GLGPDDL

SEQ ID NO: 35814 - protein, 6 aa, Mycobacterium avium
GLGRKG

SEQ ID NO: 35815 - protein, 10 aa, Mycobacterium avium
GLGSPAGATR

SEQ ID NO: 35816 - protein, 7 aa, Mycobacterium avium
GLGSQEK

SEQ ID NO: 35817 - protein, 7 aa, Mycobacterium avium
GLGSSRP

SEQ ID NO: 35818 - protein, 9 aa, Mycobacterium avium
GLGTADEVG

SEQ ID NO: 35819 - protein, 11 aa, Mycobacterium avium
GLGTAERERNI

SEQ ID NO: 35820 - protein, 4 aa, Mycobacterium avium
GLHR

SEQ ID NO: 35821 - protein, 5 aa, Mycobacterium avium
GLKGQ

SEQ ID NO: 35822 - protein, 16 aa, Mycobacterium avium
GLKPAEAAAGGSDDSW

SEQ ID NO: 35823 - protein, 7 aa, Mycobacterium avium
GLKPTDI

SEQ ID NO: 35824 - protein, 9 aa, Mycobacterium avium
GLKPYSRDT

SEQ ID NO: 35825 - protein, 6 aa, Mycobacterium avium
GLKTTA

SEQ ID NO: 35826 - protein, 11 aa, Mycobacterium avium
GLPADPRTDEY

SEQ ID NO: 35827 - protein, 9 aa, Mycobacterium avium
GLPAGEAAA

SEQ ID NO: 35828 - protein, 8 aa, Mycobacterium avium
GLPAPTGR

SEQ ID NO: 35829 - protein, 10 aa, Mycobacterium avium
GLPDRKDVKD

SEQ ID NO: 35830 - protein, 20 aa, Mycobacterium avium
GLPEPPEEQVDESAPVSPAL

SEQ ID NO: 35831 - protein, 4 aa, Mycobacterium avium
GLPG

SEQ ID NO: 35832 - protein, 8 aa, Mycobacterium avium
GLPGAEGR

SEQ ID NO: 35833 - protein, 9 aa, Mycobacterium avium
GLPGRPTPV

SEQ ID NO: 35834 - protein, 8 aa, Mycobacterium avium
GLPGSPWH

SEQ ID NO: 35835 - protein, 13 aa, Mycobacterium avium
GLPKGDPPPPLPE

SEQ ID NO: 35836 - protein, 7 aa, Mycobacterium avium
GLPKGSV

SEQ ID NO: 35837 - protein, 4 aa, Mycobacterium avium
GLPP

SEQ ID NO: 35838 - protein, 15 aa, Mycobacterium avium
GLPPAGVTDLSSRSR

SEQ ID NO: 35839 - protein, 5 aa, Mycobacterium avium
GLPPE

SEQ ID NO: 35840 - protein, 5 aa, Mycobacterium avium
GLPPG

SEQ ID NO: 35841 - protein, 12 aa, Mycobacterium avium
GLPPGEPAWTDG

SEQ ID NO: 35842 - protein, 5 aa, Mycobacterium avium
GLPPT

SEQ ID NO: 35843 - protein, 7 aa, Mycobacterium avium
GLPRSSA

SEQ ID NO: 35844 - protein, 10 aa, Mycobacterium avium
GLPSDPAAQI

SEQ ID NO: 35845 - protein, 14 aa, Mycobacterium avium
GLPSSPGVTGATAA

SEQ ID NO: 35846 - protein, 15 aa, Mycobacterium avium
GLPTGRGGKFTASEI

SEQ ID NO: 35847 - protein, 10 aa, Mycobacterium avium
GLQPSHNPQV

SEQ ID NO: 35848 - protein, 7 aa, Mycobacterium avium
GLRAKGG

SEQ ID NO: 35849 - protein, 4 aa, Mycobacterium avium
GLRD

SEQ ID NO: 35850 - protein, 7 aa, Mycobacterium avium
GLRDDEG

SEQ ID NO: 35851 - protein, 6 aa, Mycobacterium avium
GLREGD

SEQ ID NO: 35852 - protein, 7 aa, Mycobacterium avium
GLRGAEN

SEQ ID NO: 35853 - protein, 6 aa, Mycobacterium avium
GLRGQG

SEQ ID NO: 35854 - protein, 8 aa, Mycobacterium avium
GLRKPSAD

SEQ ID NO: 35855 - protein, 13 aa, Mycobacterium avium
GLRPDKEASEVVR

SEQ ID NO: 35856 - protein, 15 aa, Mycobacterium avium
GLRPGSIADANDAAQ

SEQ ID NO: 35857 - protein, 5 aa, Mycobacterium avium
GLRPS

SEQ ID NO: 35858 - protein, 9 aa, Mycobacterium avium
GLRRGDAVT

SEQ ID NO: 35859 - protein, 8 aa, Mycobacterium avium
GLRRSGRT

SEQ ID NO: 35860 - protein, 4 aa, Mycobacterium avium
GLRT

SEQ ID NO: 35861 - protein, 10 aa, Mycobacterium avium
GLRTAQAHSP

SEQ ID NO: 35862 - protein, 8 aa, Mycobacterium avium
GLRTGPDG

SEQ ID NO: 35863 - protein, 5 aa, Mycobacterium avium
GLSAA

SEQ ID NO: 35864 - protein, 14 aa, Mycobacterium avium
GLSDASPAALAADP

SEQ ID NO: 35865 - protein, 19 aa, Mycobacterium avium
GLSDDKLDRRPGELSGGEC

SEQ ID NO: 35866 - protein, 8 aa, Mycobacterium avium
GLSDEDRQ

SEQ ID NO: 35867 - protein, 19 aa, Mycobacterium avium
GLSESRKAARRTLGEGGVS

SEQ ID NO: 35868 - protein, 9 aa, Mycobacterium avium
GLSPDQAAD

SEQ ID NO: 35869 - protein, 8 aa, Mycobacterium avium
GLSPEDAF

SEQ ID NO: 35870 - protein, 7 aa, Mycobacterium avium
GLSPKDV

SEQ ID NO: 35871 - protein, 7 aa, Mycobacterium avium
GLSPSAP

SEQ ID NO: 35872 - protein, 8 aa, Mycobacterium avium
GLSPSQDE

SEQ ID NO: 35873 - protein, 22 aa, Mycobacterium avium
GLSQGDVVESGPNADIKPGNNL

SEQ ID NO: 35874 - protein, 11 aa, Mycobacterium avium
GLSRSDSPDRF

SEQ ID NO: 35875 - protein, 4 aa, Mycobacterium avium
GLSS

SEQ ID NO: 35876 - protein, 18 aa, Mycobacterium avium
GLSSRQAAAEPVSRTVIM

SEQ ID NO: 35877 - protein, 9 aa, Mycobacterium avium
GLTETSSAI

SEQ ID NO: 35878 - protein, 5 aa, Mycobacterium avium
GLTPR

SEQ ID NO: 35879 - protein, 5 aa, Mycobacterium avium
GLTPS

SEQ ID NO: 35880 - protein, 7 aa, Mycobacterium avium
GLTPSQT

SEQ ID NO: 35881 - protein, 7 aa, Mycobacterium avium
GLVGRGG

SEQ ID NO: 35882 - protein, 8 aa, Mycobacterium avium
GMADQSRT

SEQ ID NO: 35883 - protein, 22 aa, Mycobacterium avium
GMAEADARARIAAQASDEQRRA

SEQ ID NO: 35884 - protein, 5 aa, Mycobacterium avium
GMAPP

SEQ ID NO: 35885 - protein, 36 aa, Mycobacterium avium
GMCNPDDDAPVVDGPPPEAASQRDSRSAAQRNHDGL

SEQ ID NO: 35886 - protein, 8 aa, Mycobacterium avium
GMDTGGVE

SEQ ID NO: 35887 - protein, 7 aa, Mycobacterium avium
GMGGSQR

SEQ ID NO: 35888 - protein, 5 aa, Mycobacterium avium
GMGRE

SEQ ID NO: 35889 - protein, 6 aa, Mycobacterium avium
GMGREG

SEQ ID NO: 35890 - protein, 8 aa, Mycobacterium avium
GMPAPPPL

SEQ ID NO: 35891 - protein, 14 aa, Mycobacterium avium
GMPDPAKQAARYPH

SEQ ID NO: 35892 - protein, 13 aa, Mycobacterium avium
GMPDPEPATGEAP

SEQ ID NO: 35893 - protein, 7 aa, Mycobacterium avium
GMQPDDE

SEQ ID NO: 35894 - protein, 24 aa, Mycobacterium avium
GMSATPEGAFGPLPTQDESVSADD

SEQ ID NO: 35895 - protein, 8 aa, Mycobacterium avium
GMSDNPRV

SEQ ID NO: 35896 - protein, 9 aa, Mycobacterium avium
GMSSGKSAR

SEQ ID NO: 35897 - protein, 11 aa, Mycobacterium avium
GMTGTAQTEAA

SEQ ID NO: 35898 - protein, 7 aa, Mycobacterium avium
GMTPPEV

SEQ ID NO: 35899 - protein, 17 aa, Mycobacterium avium
GNAGERGSADTVRDTRG

SEQ ID NO: 35900 - protein, 7 aa, Mycobacterium avium
GNAGKAG

SEQ ID NO: 35901 - protein, 5 aa, Mycobacterium avium
GNAGN

SEQ ID NO: 35902 - protein, 4 aa, Mycobacterium avium
GNAI

SEQ ID NO: 35903 - protein, 8 aa, Mycobacterium avium
GNALPRTR

SEQ ID NO: 35904 - protein, 8 aa, Mycobacterium avium
GNAMTDDT

SEQ ID NO: 35905 - protein, 6 aa, Mycobacterium avium
GNASRG

SEQ ID NO: 35906 - protein, 4 aa, Mycobacterium avium
GNDR

SEQ ID NO: 35907 - protein, 9 aa, Mycobacterium avium
GNDTTRQTI

SEQ ID NO: 35908 - protein, 7 aa, Mycobacterium avium
GNEQQRR

SEQ ID NO: 35909 - protein, 12 aa, Mycobacterium avium
GNESTDGTGGAV

SEQ ID NO: 35910 - protein, 9 aa, Mycobacterium avium
GNETTRNSI

SEQ ID NO: 35911 - protein, 10 aa, Mycobacterium avium
GNETTRNSIT

SEQ ID NO: 35912 - protein, 13 aa, Mycobacterium avium
GNGDSSDAGPSVI

SEQ ID NO: 35913 - protein, 8 aa, Mycobacterium avium
GNGGMTPK

SEQ ID NO: 35914 - protein, 11 aa, Mycobacterium avium
GNGGSAAEAQH

SEQ ID NO: 35915 - protein, 4 aa, Mycobacterium avium
GNGL

SEQ ID NO: 35916 - protein, 11 aa, Mycobacterium avium
GNGLKDPDTAL

SEQ ID NO: 35917 - protein, 6 aa, Mycobacterium avium
GNGLRR

SEQ ID NO: 35918 - protein, 6 aa, Mycobacterium avium
GNGSTI

SEQ ID NO: 35919 - protein, 6 aa, Mycobacterium avium
GNGTST

SEQ ID NO: 35920 - protein, 6 aa, Mycobacterium avium
GNGVGD

SEQ ID NO: 35921 - protein, 15 aa, Mycobacterium avium
GNGYTESDVRNGARA

SEQ ID NO: 35922 - protein, 8 aa, Mycobacterium avium
GNHTFQAN

SEQ ID NO: 35923 - protein, 4 aa, Mycobacterium avium
GNIP

SEQ ID NO: 35924 - protein, 8 aa, Mycobacterium avium
GNIYEKDG

SEQ ID NO: 35925 - protein, 8 aa, Mycobacterium avium
GNLGDGRD

SEQ ID NO: 35926 - protein, 8 aa, Mycobacterium avium
GNLPTAPA

SEQ ID NO: 35927 - protein, 8 aa, Mycobacterium avium
GNNDVSRY

SEQ ID NO: 35928 - protein, 4 aa, Mycobacterium avium
GNNH

SEQ ID NO: 35929 - protein, 5 aa, Mycobacterium avium
GNNNF

SEQ ID NO: 35930 - protein, 7 aa, Mycobacterium avium
GNNPVRE

SEQ ID NO: 35931 - protein, 6 aa, Mycobacterium avium
GNNQNA

SEQ ID NO: 35932 - protein, 5 aa, Mycobacterium avium
GNNSS

SEQ ID NO: 35933 - protein, 15 aa, Mycobacterium avium
GNPASRHDDSHSPAL

SEQ ID NO: 35934 - protein, 7 aa, Mycobacterium avium
GNPDEVA

SEQ ID NO: 35935 - protein, 6 aa, Mycobacterium avium
GNPDGA

SEQ ID NO: 35936 - protein, 11 aa, Mycobacterium avium
GNPEGKSKREL

SEQ ID NO: 35937 - protein, 11 aa, Mycobacterium avium
GNPEIEEGKGF

SEQ ID NO: 35938 - protein, 4 aa, Mycobacterium avium
GNPF

SEQ ID NO: 35939 - protein, 9 aa, Mycobacterium avium
GNPPEFGGR

SEQ ID NO: 35940 - protein, 9 aa, Mycobacterium avium
GNPRLGAGR

SEQ ID NO: 35941 - protein, 9 aa, Mycobacterium avium
GNPSEATAS

SEQ ID NO: 35942 - protein, 4 aa, Mycobacterium avium
GNPT

SEQ ID NO: 35943 - protein, 7 aa, Mycobacterium avium
GNPTTDV

SEQ ID NO: 35944 - protein, 13 aa, Mycobacterium avium
GNPVSPRTTQARE

SEQ ID NO: 35945 - protein, 11 aa, Mycobacterium avium
GNPYADKPRLD

SEQ ID NO: 35946 - protein, 7 aa, Mycobacterium avium
GNPYPAY

SEQ ID NO: 35947 - protein, 11 aa, Mycobacterium avium
GNQHDAEDLTQ

SEQ ID NO: 35948 - protein, 9 aa, Mycobacterium avium
GNQQADGMS

SEQ ID NO: 35949 - protein, 11 aa, Mycobacterium avium
GNRGIRPESKF

SEQ ID NO: 35950 - protein, 9 aa, Mycobacterium avium
GNRLDTAGL

SEQ ID NO: 35951 - protein, 9 aa, Mycobacterium avium
GNRNFEGRI

SEQ ID NO: 35952 - protein, 6 aa, Mycobacterium avium
GNRQVP

SEQ ID NO: 35953 - protein, 8 aa, Mycobacterium avium
GNRSIGAA

SEQ ID NO: 35954 - protein, 5 aa, Mycobacterium avium
GNRSY

SEQ ID NO: 35955 - protein, 16 aa, Mycobacterium avium
GNRTEHRPAELSGGQM

SEQ ID NO: 35956 - protein, 7 aa, Mycobacterium avium
GNSAPRV

SEQ ID NO: 35957 - protein, 5 aa, Mycobacterium avium
GNSAQ

SEQ ID NO: 35958 - protein, 4 aa, Mycobacterium avium
GNSK

SEQ ID NO: 35959 - protein, 10 aa, Mycobacterium avium
GNSKCPPNPG

SEQ ID NO: 35960 - protein, 9 aa, Mycobacterium avium
GNSLPPDTV

SEQ ID NO: 35961 - protein, 10 aa, Mycobacterium avium
GNSSQISDGA

SEQ ID NO: 35962 - protein, 10 aa, Mycobacterium avium
GNSSQISDGS

SEQ ID NO: 35963 - protein, 6 aa, Mycobacterium avium
GNSYYR

SEQ ID NO: 35964 - protein, 6 aa, Mycobacterium avium
GNTGGG

SEQ ID NO: 35965 - protein, 5 aa, Mycobacterium avium
GNTGR

SEQ ID NO: 35966 - protein, 12 aa, Mycobacterium avium
GNTHESSNGYKT

SEQ ID NO: 35967 - protein, 7 aa, Mycobacterium avium
GNTYRNP

SEQ ID NO: 35968 - protein, 10 aa, Mycobacterium avium
GNVEGAQQAY

SEQ ID NO: 35969 - protein, 4 aa, Mycobacterium avium
GNVG

SEQ ID NO: 35970 - protein, 11 aa, Mycobacterium avium
GPAAGGHRGTF

SEQ ID NO: 35971 - protein, 9 aa, Mycobacterium avium
GPAAPLDGT

SEQ ID NO: 35972 - protein, 6 aa, Mycobacterium avium
GPAAYT

SEQ ID NO: 35973 - protein, 7 aa, Mycobacterium avium
GPADGAS

SEQ ID NO: 35974 - protein, 6 aa, Mycobacterium avium
GPADIA

SEQ ID NO: 35975 - protein, 5 aa, Mycobacterium avium
GPADK

SEQ ID NO: 35976 - protein, 6 aa, Mycobacterium avium
GPADRA

SEQ ID NO: 35977 - protein, 8 aa, Mycobacterium avium
GPAEHAGP

SEQ ID NO: 35978 - protein, 6 aa, Mycobacterium avium
GPAENP

SEQ ID NO: 35979 - protein, 17 aa, Mycobacterium avium
GPAEPSADGVADPVGDG

SEQ ID NO: 35980 - protein, 10 aa, Mycobacterium avium
GPAGAPDSIV

SEQ ID NO: 35981 - protein, 8 aa, Mycobacterium avium
GPAGTGKT

SEQ ID NO: 35982 - protein, 6 aa, Mycobacterium avium
GPAGVG

SEQ ID NO: 35983 - protein, 9 aa, Mycobacterium avium
GPAGVGKTE

SEQ ID NO: 35984 - protein, 9 aa, Mycobacterium avium
GPAHPTPAG

SEQ ID NO: 35985 - protein, 8 aa, Mycobacterium avium
GPAIAGGT

SEQ ID NO: 35986 - protein, 5 aa, Mycobacterium avium
GPAIG

SEQ ID NO: 35987 - protein, 8 aa, Mycobacterium avium
GPAKPSRA

SEQ ID NO: 35988 - protein, 6 aa, Mycobacterium avium
GPALAA

SEQ ID NO: 35989 - protein, 6 aa, Mycobacterium avium
GPAPAG

SEQ ID NO: 35990 - protein, 8 aa, Mycobacterium avium
GPAPAPVK

SEQ ID NO: 35991 - protein, 9 aa, Mycobacterium avium
GPAPRDTGP

SEQ ID NO: 35992 - protein, 8 aa, Mycobacterium avium
GPAPTSVH

SEQ ID NO: 35993 - protein, 10 aa, Mycobacterium avium
GPAWSGDAAA

SEQ ID NO: 35994 - protein, 22 aa, Mycobacterium avium
GPAYNTGSPWGYSPKGATGVPT

SEQ ID NO: 35995 - protein, 8 aa, Mycobacterium avium
GPCGPSSE

SEQ ID NO: 35996 - protein, 16 aa, Mycobacterium avium
GPDALADTRQSGGGED

SEQ ID NO: 35997 - protein, 24 aa, Mycobacterium avium
GPDALPAKADDIASPSWAQSSAPH

SEQ ID NO: 35998 - protein, 7 aa, Mycobacterium avium
GPDAPVE

SEQ ID NO: 35999 - protein, 5 aa, Mycobacterium avium
GPDDC

SEQ ID NO: 36000 - protein, 6 aa, Mycobacterium avium
GPDDGR

SEQ ID NO: 36001 - protein, 6 aa, Mycobacterium avium
GPDFPT

SEQ ID NO: 36002 - protein, 5 aa, Mycobacterium avium
GPDGA

SEQ ID NO: 36003 - protein, 7 aa, Mycobacterium avium
GPDGDDI

SEQ ID NO: 36004 - protein, 11 aa, Mycobacterium avium
GPDGPERLPAD

SEQ ID NO: 36005 - protein, 8 aa, Mycobacterium avium
GPDGTNRY

SEQ ID NO: 36006 - protein, 5 aa, Mycobacterium avium
GPDGV

SEQ ID NO: 36007 - protein, 5 aa, Mycobacterium avium
GPDIS

SEQ ID NO: 36008 - protein, 4 aa, Mycobacterium avium
GPDL

SEQ ID NO: 36009 - protein, 6 aa, Mycobacterium avium
GPDLGG

SEQ ID NO: 36010 - protein, 13 aa, Mycobacterium avium
GPDPLRDDADPSW

SEQ ID NO: 36011 - protein, 4 aa, Mycobacterium avium
GPDR

SEQ ID NO: 36012 - protein, 5 aa, Mycobacterium avium
GPDRE

SEQ ID NO: 36013 - protein, 8 aa, Mycobacterium avium
GPDSKTAL

SEQ ID NO: 36014 - protein, 6 aa, Mycobacterium avium
GPDVGG

SEQ ID NO: 36015 - protein, 5 aa, Mycobacterium avium
GPDVN

SEQ ID NO: 36016 - protein, 7 aa, Mycobacterium avium
GPDVQEG

SEQ ID NO: 36017 - protein, 7 aa, Mycobacterium avium
GPDVTDH

SEQ ID NO: 36018 - protein, 4 aa, Mycobacterium avium
GPDY

SEQ ID NO: 36019 - protein, 5 aa, Mycobacterium avium
GPDYS

SEQ ID NO: 36020 - protein, 14 aa, Mycobacterium avium
GPEETTPADEVPGA

SEQ ID NO: 36021 - protein, 5 aa, Mycobacterium avium
GPEFG

SEQ ID NO: 36022 - protein, 11 aa, Mycobacterium avium
GPEGGAEGGTV

SEQ ID NO: 36023 - protein, 20 aa, Mycobacterium avium
GPEHPHTAQQPIPYEIKQVA

SEQ ID NO: 36024 - protein, 14 aa, Mycobacterium avium
GPEIASGELKTEEI

SEQ ID NO: 36025 - protein, 14 aa, Mycobacterium avium
GPEKAVADAEHRPD

SEQ ID NO: 36026 - protein, 5 aa, Mycobacterium avium
GPELG

SEQ ID NO: 36027 - protein, 4 aa, Mycobacterium avium
GPEN

SEQ ID NO: 36028 - protein, 9 aa, Mycobacterium avium
GPENAGEAF

SEQ ID NO: 36029 - protein, 8 aa, Mycobacterium avium
GPEPGTTT

SEQ ID NO: 36030 - protein, 4 aa, Mycobacterium avium
GPEQ

SEQ ID NO: 36031 - protein, 15 aa, Mycobacterium avium
GPESGPPGGGPPTDA

SEQ ID NO: 36032 - protein, 9 aa, Mycobacterium avium
GPESSGKTT

SEQ ID NO: 36033 - protein, 12 aa, Mycobacterium avium
GPEVGALGADDR

SEQ ID NO: 36034 - protein, 4 aa, Mycobacterium avium
GPEY

SEQ ID NO: 36035 - protein, 9 aa, Mycobacterium avium
GPGAAGTFE

SEQ ID NO: 36036 - protein, 8 aa, Mycobacterium avium
GPGALPSD

SEQ ID NO: 36037 - protein, 6 aa, Mycobacterium avium
GPGAPA

SEQ ID NO: 36038 - protein, 5 aa, Mycobacterium avium
GPGAT

SEQ ID NO: 36039 - protein, 7 aa, Mycobacterium avium
GPGATAL

SEQ ID NO: 36040 - protein, 5 aa, Mycobacterium avium
GPGDT

SEQ ID NO: 36041 - protein, 7 aa, Mycobacterium avium
GPGDTWS

SEQ ID NO: 36042 - protein, 9 aa, Mycobacterium avium
GPGEAPKLI

SEQ ID NO: 36043 - protein, 9 aa, Mycobacterium avium
GPGEAREAD

SEQ ID NO: 36044 - protein, 11 aa, Mycobacterium avium
GPGGPEGLPSP

SEQ ID NO: 36045 - protein, 9 aa, Mycobacterium avium
GPGHGGPGL

SEQ ID NO: 36046 - protein, 4 aa, Mycobacterium avium
GPGK

SEQ ID NO: 36047 - protein, 9 aa, Mycobacterium avium
GPGKGNAMG

SEQ ID NO: 36048 - protein, 6 aa, Mycobacterium avium
GPGLGT

SEQ ID NO: 36049 - protein, 19 aa, Mycobacterium avium
GPGPRSPESVEGWDRSLTN

SEQ ID NO: 36050 - protein, 4 aa, Mycobacterium avium
GPGR

SEQ ID NO: 36051 - protein, 6 aa, Mycobacterium avium
GPGREL

SEQ ID NO: 36052 - protein, 10 aa, Mycobacterium avium
GPGSPRGGNV

SEQ ID NO: 36053 - protein, 5 aa, Mycobacterium avium
GPGSV

SEQ ID NO: 36054 - protein, 6 aa, Mycobacterium avium
GPGVTE

SEQ ID NO: 36055 - protein, 5 aa, Mycobacterium avium
GPGWP

SEQ ID NO: 36056 - protein, 4 aa, Mycobacterium avium
GPHA

SEQ ID NO: 36057 - protein, 5 aa, Mycobacterium avium
GPHGP

SEQ ID NO: 36058 - protein, 5 aa, Mycobacterium avium
GPHGV

SEQ ID NO: 36059 - protein, 4 aa, Mycobacterium avium
GPHR

SEQ ID NO: 36060 - protein, 5 aa, Mycobacterium avium
GPHSR

SEQ ID NO: 36061 - protein, 6 aa, Mycobacterium avium
GPHTQT

SEQ ID NO: 36062 - protein, 7 aa, Mycobacterium avium
GPIDDGE

SEQ ID NO: 36063 - protein, 6 aa, Mycobacterium avium
GPIDGP

SEQ ID NO: 36064 - protein, 7 aa, Mycobacterium avium
GPIPPDR

SEQ ID NO: 36065 - protein, 6 aa, Mycobacterium avium
GPITAD

SEQ ID NO: 36066 - protein, 7 aa, Mycobacterium avium
GPITSAA

SEQ ID NO: 36067 - protein, 4 aa, Mycobacterium avium
GPIV

SEQ ID NO: 36068 - protein, 8 aa, Mycobacterium avium
GPKAISGA

SEQ ID NO: 36069 - protein, 9 aa, Mycobacterium avium
GPKALKDNG

SEQ ID NO: 36070 - protein, 5 aa, Mycobacterium avium
GPKFS

SEQ ID NO: 36071 - protein, 12 aa, Mycobacterium avium
GPKNGDNDQESA

SEQ ID NO: 36072 - protein, 5 aa, Mycobacterium avium
GPKNV

SEQ ID NO: 36073 - protein, 7 aa, Mycobacterium avium
GPKPADI

SEQ ID NO: 36074 - protein, 7 aa, Mycobacterium avium
GPKQTAL

SEQ ID NO: 36075 - protein, 6 aa, Mycobacterium avium
GPKTIR

SEQ ID NO: 36076 - protein, 8 aa, Mycobacterium avium
GPLAQTAG

SEQ ID NO: 36077 - protein, 8 aa, Mycobacterium avium
GPLDTAGA

SEQ ID NO: 36078 - protein, 9 aa, Mycobacterium avium
GPLHGGAPA

SEQ ID NO: 36079 - protein, 6 aa, Mycobacterium avium
GPLKAP

SEQ ID NO: 36080 - protein, 5 aa, Mycobacterium avium
GPLPS

SEQ ID NO: 36081 - protein, 8 aa, Mycobacterium avium
GPLRGDRE

SEQ ID NO: 36082 - protein, 8 aa, Mycobacterium avium
GPLSGDPY

SEQ ID NO: 36083 - protein, 10 aa, Mycobacterium avium
GPLSGLPPLS

SEQ ID NO: 36084 - protein, 4 aa, Mycobacterium avium
GPMG

SEQ ID NO: 36085 - protein, 10 aa, Mycobacterium avium
GPMGDAGLTG

SEQ ID NO: 36086 - protein, 7 aa, Mycobacterium avium
GPMGGTD

SEQ ID NO: 36087 - protein, 4 aa, Mycobacterium avium
GPND

SEQ ID NO: 36088 - protein, 10 aa, Mycobacterium avium
GPNGAGKSTA

SEQ ID NO: 36089 - protein, 9 aa, Mycobacterium avium
GPNGAGKTT

SEQ ID NO: 36090 - protein, 11 aa, Mycobacterium avium
GPNGAGKTTTV

SEQ ID NO: 36091 - protein, 9 aa, Mycobacterium avium
GPNGPNKTL

SEQ ID NO: 36092 - protein, 11 aa, Mycobacterium avium
GPNGSGKSTLS

SEQ ID NO: 36093 - protein, 9 aa, Mycobacterium avium
GPNGSGKTS

SEQ ID NO: 36094 - protein, 7 aa, Mycobacterium avium
GPNPGDI

SEQ ID NO: 36095 - protein, 5 aa, Mycobacterium avium
GPNTN

SEQ ID NO: 36096 - protein, 11 aa, Mycobacterium avium
GPNVTSVRPGD

SEQ ID NO: 36097 - protein, 5 aa, Mycobacterium avium
GPPAY

SEQ ID NO: 36098 - protein, 5 aa, Mycobacterium avium
GPPDG

SEQ ID NO: 36099 - protein, 5 aa, Mycobacterium avium
GPPDV

SEQ ID NO: 36100 - protein, 7 aa, Mycobacterium avium
GPPEAAE

SEQ ID NO: 36101 - protein, 4 aa, Mycobacterium avium
GPPG

SEQ ID NO: 36102 - protein, 13 aa, Mycobacterium avium
GPPGATARSDTRT

SEQ ID NO: 36103 - protein, 8 aa, Mycobacterium avium
GPPGHRGE

SEQ ID NO: 36104 - protein, 8 aa, Mycobacterium avium
GPPGLGKT

SEQ ID NO: 36105 - protein, 7 aa, Mycobacterium avium
GPPGTAE

SEQ ID NO: 36106 - protein, 9 aa, Mycobacterium avium
GPPGTGKTT

SEQ ID NO: 36107 - protein, 7 aa, Mycobacterium avium
GPPGVGK

SEQ ID NO: 36108 - protein, 8 aa, Mycobacterium avium
GPPPDEPN

SEQ ID NO: 36109 - protein, 9 aa, Mycobacterium avium
GPPPDSPRE

SEQ ID NO: 36110 - protein, 6 aa, Mycobacterium avium
GPPREL

SEQ ID NO: 36111 - protein, 7 aa, Mycobacterium avium
GPPRPLT

SEQ ID NO: 36112 - protein, 11 aa, Mycobacterium avium
GPPSPAKDYTG

SEQ ID NO: 36113 - protein, 4 aa, Mycobacterium avium
GPPT

SEQ ID NO: 36114 - protein, 24 aa, Mycobacterium avium
GPPVVKESTGEDISKEDLGGPDVA

SEQ ID NO: 36115 - protein, 13 aa, Mycobacterium avium
GPQAALRARQESA

SEQ ID NO: 36116 - protein, 6 aa, Mycobacterium avium
GPQAED

SEQ ID NO: 36117 - protein, 4 aa, Mycobacterium avium
GPQG

SEQ ID NO: 36118 - protein, 11 aa, Mycobacterium avium
GPQKGADTATV

SEQ ID NO: 36119 - protein, 7 aa, Mycobacterium avium
GPQPDGR

SEQ ID NO: 36120 - protein, 11 aa, Mycobacterium avium
GPQRPPIGGLD

SEQ ID NO: 36121 - protein, 8 aa, Mycobacterium avium
GPQSRAER

SEQ ID NO: 36122 - protein, 4 aa, Mycobacterium avium
GPQV

SEQ ID NO: 36123 - protein, 4 aa, Mycobacterium avium
GPQW

SEQ ID NO: 36124 - protein, 7 aa, Mycobacterium avium
GPREQAI

SEQ ID NO: 36125 - protein, 4 aa, Mycobacterium avium
GPRF

SEQ ID NO: 36126 - protein, 5 aa, Mycobacterium avium
GPRFS

SEQ ID NO: 36127 - protein, 5 aa, Mycobacterium avium
GPRGE

SEQ ID NO: 36128 - protein, 4 aa, Mycobacterium avium
GPRK

SEQ ID NO: 36129 - protein, 5 aa, Mycobacterium avium
GPRKM

SEQ ID NO: 36130 - protein, 5 aa, Mycobacterium avium
GPRPD

SEQ ID NO: 36131 - protein, 7 aa, Mycobacterium avium
GPRPDTS

SEQ ID NO: 36132 - protein, 5 aa, Mycobacterium avium
GPRRK

SEQ ID NO: 36133 - protein, 12 aa, Mycobacterium avium
GPRRSLLRRRLS

SEQ ID NO: 36134 - protein, 12 aa, Mycobacterium avium
GPRTYSDRRGHP

SEQ ID NO: 36135 - protein, 7 aa, Mycobacterium avium
GPSAGHG

SEQ ID NO: 36136 - protein, 8 aa, Mycobacterium avium
GPSGAGKS

SEQ ID NO: 36137 - protein, 8 aa, Mycobacterium avium
GPSGCGKS

SEQ ID NO: 36138 - protein, 6 aa, Mycobacterium avium
GPSGNY

SEQ ID NO: 36139 - protein, 10 aa, Mycobacterium avium
GPSGSGKSTL

SEQ ID NO: 36140 - protein, 4 aa, Mycobacterium avium
GPSH

SEQ ID NO: 36141 - protein, 11 aa, Mycobacterium avium
GPSKDAQGTRR

SEQ ID NO: 36142 - protein, 8 aa, Mycobacterium avium
GPSKGRGY

SEQ ID NO: 36143 - protein, 8 aa, Mycobacterium avium
GPSRERSI

SEQ ID NO: 36144 - protein, 7 aa, Mycobacterium avium
GPSSGLT

SEQ ID NO: 36145 - protein, 5 aa, Mycobacterium avium
GPSSK

SEQ ID NO: 36146 - protein, 4 aa, Mycobacterium avium
GPTA

SEQ ID NO: 36147 - protein, 6 aa, Mycobacterium avium
GPTAAR

SEQ ID NO: 36148 - protein, 4 aa, Mycobacterium avium
GPTE

SEQ ID NO: 36149 - protein, 5 aa, Mycobacterium avium
GPTET

SEQ ID NO: 36150 - protein, 4 aa, Mycobacterium avium
GPTG

SEQ ID NO: 36151 - protein, 6 aa, Mycobacterium avium
GPTGAT

SEQ ID NO: 36152 - protein, 7 aa, Mycobacterium avium
GPTGGLG

SEQ ID NO: 36153 - protein, 12 aa, Mycobacterium avium
GPTGLTSEVPAA

SEQ ID NO: 36154 - protein, 9 aa, Mycobacterium avium
GPTGNQRDE

SEQ ID NO: 36155 - protein, 8 aa, Mycobacterium avium
GPTPATRK

SEQ ID NO: 36156 - protein, 6 aa, Mycobacterium avium
GPTPSE

SEQ ID NO: 36157 - protein, 11 aa, Mycobacterium avium
GPTSTENRGSP

SEQ ID NO: 36158 - protein, 7 aa, Mycobacterium avium
GPTTDIE

SEQ ID NO: 36159 - protein, 7 aa, Mycobacterium avium
GPTTDYN

SEQ ID NO: 36160 - protein, 5 aa, Mycobacterium avium
GPVAG

SEQ ID NO: 36161 - protein, 9 aa, Mycobacterium avium
GPVDGPRGW

SEQ ID NO: 36162 - protein, 8 aa, Mycobacterium avium
GPVGGDEL

SEQ ID NO: 36163 - protein, 19 aa, Mycobacterium avium
GPVGKAGKAGARDRADDLA

SEQ ID NO: 36164 - protein, 13 aa, Mycobacterium avium
GPVRTDLPDDAEA

SEQ ID NO: 36165 - protein, 7 aa, Mycobacterium avium
GPVTGPS

SEQ ID NO: 36166 - protein, 9 aa, Mycobacterium avium
GPVTPDPAR

SEQ ID NO: 36167 - protein, 6 aa, Mycobacterium avium
GPWVGP

SEQ ID NO: 36168 - protein, 12 aa, Mycobacterium avium
GPYAAASSAPIV

SEQ ID NO: 36169 - protein, 13 aa, Mycobacterium avium
GPYDDAPTAPGSA

SEQ ID NO: 36170 - protein, 4 aa, Mycobacterium avium
GPYE

SEQ ID NO: 36171 - protein, 5 aa, Mycobacterium avium
GPYVE

SEQ ID NO: 36172 - protein, 5 aa, Mycobacterium avium
GPYVG

SEQ ID NO: 36173 - protein, 5 aa, Mycobacterium avium
GQAAE

SEQ ID NO: 36174 - protein, 6 aa, Mycobacterium avium
GQAGIG

SEQ ID NO: 36175 - protein, 9 aa, Mycobacterium avium
GQAGPPLAG

SEQ ID NO: 36176 - protein, 6 aa, Mycobacterium avium
GQAGVA

SEQ ID NO: 36177 - protein, 9 aa, Mycobacterium avium
GQANYGAAK

SEQ ID NO: 36178 - protein, 5 aa, Mycobacterium avium
GQAQP

SEQ ID NO: 36179 - protein, 10 aa, Mycobacterium avium
GQATGRQVEN

SEQ ID NO: 36180 - protein, 6 aa, Mycobacterium avium
GQATTV

SEQ ID NO: 36181 - protein, 7 aa, Mycobacterium avium
GQCPPRQ

SEQ ID NO: 36182 - protein, 4 aa, Mycobacterium avium
GQDC

SEQ ID NO: 36183 - protein, 10 aa, Mycobacterium avium
GQDGHDRGQK

SEQ ID NO: 36184 - protein, 5 aa, Mycobacterium avium
GQDLS

SEQ ID NO: 36185 - protein, 6 aa, Mycobacterium avium
GQDTYE

SEQ ID NO: 36186 - protein, 4 aa, Mycobacterium avium
GQDW

SEQ ID NO: 36187 - protein, 8 aa, Mycobacterium avium
GQEAAQVG

SEQ ID NO: 36188 - protein, 5 aa, Mycobacterium avium
GQEDL

SEQ ID NO: 36189 - protein, 5 aa, Mycobacterium avium
GQEEQ

SEQ ID NO: 36190 - protein, 4 aa, Mycobacterium avium
GQEG

SEQ ID NO: 36191 - protein, 6 aa, Mycobacterium avium
GQERPF

SEQ ID NO: 36192 - protein, 7 aa, Mycobacterium avium
GQETTAK

SEQ ID NO: 36193 - protein, 26 aa, Mycobacterium avium
GQFRRGKPAPLKDAADEAVADPDSPV

SEQ ID NO: 36194 - protein, 6 aa, Mycobacterium avium
GQGGED

SEQ ID NO: 36195 - protein, 9 aa, Mycobacterium avium
GQGGLSRNL

SEQ ID NO: 36196 - protein, 15 aa, Mycobacterium avium
GQGGYIGREDAANLT

SEQ ID NO: 36197 - protein, 9 aa, Mycobacterium avium
GQGLNTGVQ

SEQ ID NO: 36198 - protein, 8 aa, Mycobacterium avium
GQGSQTLG

SEQ ID NO: 36199 - protein, 9 aa, Mycobacterium avium
GQGSSRPPR

SEQ ID NO: 36200 - protein, 4 aa, Mycobacterium avium
GQHL

SEQ ID NO: 36201 - protein, 7 aa, Mycobacterium avium
GQHPGSA

SEQ ID NO: 36202 - protein, 7 aa, Mycobacterium avium
GQIAGDS

SEQ ID NO: 36203 - protein, 4 aa, Mycobacterium avium
GQIE

SEQ ID NO: 36204 - protein, 10 aa, Mycobacterium avium
GQIGDGREAA

SEQ ID NO: 36205 - protein, 8 aa, Mycobacterium avium
GQIPNQGI

SEQ ID NO: 36206 - protein, 6 aa, Mycobacterium avium
GQLAGY

SEQ ID NO: 36207 - protein, 6 aa, Mycobacterium avium
GQLPAQ

SEQ ID NO: 36208 - protein, 9 aa, Mycobacterium avium
GQNGQGAAA

SEQ ID NO: 36209 - protein, 4 aa, Mycobacterium avium
GQPA

SEQ ID NO: 36210 - protein, 5 aa, Mycobacterium avium
GQPCR

SEQ ID NO: 36211 - protein, 5 aa, Mycobacterium avium
GQPER

SEQ ID NO: 36212 - protein, 6 aa, Mycobacterium avium
GQPGDG

SEQ ID NO: 36213 - protein, 9 aa, Mycobacterium avium
GQPGGESGF

SEQ ID NO: 36214 - protein, 7 aa, Mycobacterium avium
GQPGIEE

SEQ ID NO: 36215 - protein, 7 aa, Mycobacterium avium
GQPGQEV

SEQ ID NO: 36216 - protein, 8 aa, Mycobacterium avium
GQPGREDL

SEQ ID NO: 36217 - protein, 13 aa, Mycobacterium avium
GQPIDGQGDIETD

SEQ ID NO: 36218 - protein, 5 aa, Mycobacterium avium
GQPIP

SEQ ID NO: 36219 - protein, 5 aa, Mycobacterium avium
GQPIS

SEQ ID NO: 36220 - protein, 5 aa, Mycobacterium avium
GQPPR

SEQ ID NO: 36221 - protein, 7 aa, Mycobacterium avium
GQPQLGG

SEQ ID NO: 36222 - protein, 11 aa, Mycobacterium avium
GQPRAGRRAAA

SEQ ID NO: 36223 - protein, 18 aa, Mycobacterium avium
GQPTGGTGKPSLAPDPVN

SEQ ID NO: 36224 - protein, 7 aa, Mycobacterium avium
GQPTMTV

SEQ ID NO: 36225 - protein, 6 aa, Mycobacterium avium
GQPTVT

SEQ ID NO: 36226 - protein, 11 aa, Mycobacterium avium
GQPVDDPEIPA

SEQ ID NO: 36227 - protein, 5 aa, Mycobacterium avium
GQPVH

SEQ ID NO: 36228 - protein, 7 aa, Mycobacterium avium
GQPWQKD

SEQ ID NO: 36229 - protein, 6 aa, Mycobacterium avium
GQPYPD

SEQ ID NO: 36230 - protein, 5 aa, Mycobacterium avium
GQQAM

SEQ ID NO: 36231 - protein, 9 aa, Mycobacterium avium
GQQDPKARV

SEQ ID NO: 36232 - protein, 5 aa, Mycobacterium avium
GQQDS

SEQ ID NO: 36233 - protein, 4 aa, Mycobacterium avium
GQQS

SEQ ID NO: 36234 - protein, 7 aa, Mycobacterium avium
GQRKPMA

SEQ ID NO: 36235 - protein, 4 aa, Mycobacterium avium
GQRS

SEQ ID NO: 36236 - protein, 6 aa, Mycobacterium avium
GQRSGV

SEQ ID NO: 36237 - protein, 5 aa, Mycobacterium avium
GQRVD

SEQ ID NO: 36238 - protein, 4 aa, Mycobacterium avium
GQRY

SEQ ID NO: 36239 - protein, 5 aa, Mycobacterium avium
GQSEA

SEQ ID NO: 36240 - protein, 5 aa, Mycobacterium avium
GQSGA

SEQ ID NO: 36241 - protein, 14 aa, Mycobacterium avium
GQSLDRDGEKIARE

SEQ ID NO: 36242 - protein, 6 aa, Mycobacterium avium
GQSPTV

SEQ ID NO: 36243 - protein, 4 aa, Mycobacterium avium
GQSW

SEQ ID NO: 36244 - protein, 7 aa, Mycobacterium avium
GQTAYGA

SEQ ID NO: 36245 - protein, 7 aa, Mycobacterium avium
GQTERGL

SEQ ID NO: 36246 - protein, 9 aa, Mycobacterium avium
GQTGKTVSP

SEQ ID NO: 36247 - protein, 14 aa, Mycobacterium avium
GQTGPFRRRPATPL

SEQ ID NO: 36248 - protein, 13 aa, Mycobacterium avium
GQTGYDGLPATDV

SEQ ID NO: 36249 - protein, 7 aa, Mycobacterium avium
GQTLDPD

SEQ ID NO: 36250 - protein, 6 aa, Mycobacterium avium
GQTLPS

SEQ ID NO: 36251 - protein, 6 aa, Mycobacterium avium
GQTPDG

SEQ ID NO: 36252 - protein, 6 aa, Mycobacterium avium
GQTPLG

SEQ ID NO: 36253 - protein, 9 aa, Mycobacterium avium
GQTQASSRF

SEQ ID NO: 36254 - protein, 6 aa, Mycobacterium avium
GQTQGY

SEQ ID NO: 36255 - protein, 8 aa, Mycobacterium avium
GQVDDDED

SEQ ID NO: 36256 - protein, 21 aa, Mycobacterium avium
GQVPESPSTPTPQPSECADPT

SEQ ID NO: 36257 - protein, 7 aa, Mycobacterium avium
GQYPPSD

SEQ ID NO: 36258 - protein, 5 aa, Mycobacterium avium
GQYPR

SEQ ID NO: 36259 - protein, 4 aa, Mycobacterium avium
GRAA

SEQ ID NO: 36260 - protein, 8 aa, Mycobacterium avium
GRAAAAAA

SEQ ID NO: 36261 - protein, 6 aa, Mycobacterium avium
GRAAEA

SEQ ID NO: 36262 - protein, 14 aa, Mycobacterium avium
GRAAGPQGVGAHRD

SEQ ID NO: 36263 - protein, 10 aa, Mycobacterium avium
GRAAPSPDAL

SEQ ID NO: 36264 - protein, 9 aa, Mycobacterium avium
GRADNKPQF

SEQ ID NO: 36265 - protein, 8 aa, Mycobacterium avium
GRAERDPA

SEQ ID NO: 36266 - protein, 9 aa, Mycobacterium avium
GRAERGAAS

SEQ ID NO: 36267 - protein, 9 aa, Mycobacterium avium
GRAFSGGYD

SEQ ID NO: 36268 - protein, 9 aa, Mycobacterium avium
GRAHTERGD

SEQ ID NO: 36269 - protein, 8 aa, Mycobacterium avium
GRAISGRA

SEQ ID NO: 36270 - protein, 6 aa, Mycobacterium avium
GRARPD

SEQ ID NO: 36271 - protein, 6 aa, Mycobacterium avium
GRARRT

SEQ ID NO: 36272 - protein, 4 aa, Mycobacterium avium
GRAT

SEQ ID NO: 36273 - protein, 15 aa, Mycobacterium avium
GRATGVTDRAGANAE

SEQ ID NO: 36274 - protein, 9 aa, Mycobacterium avium
GRATQPTAH

SEQ ID NO: 36275 - protein, 8 aa, Mycobacterium avium
GRAVGDPH

SEQ ID NO: 36276 - protein, 7 aa, Mycobacterium avium
GRCPGDD

SEQ ID NO: 36277 - protein, 5 aa, Mycobacterium avium
GRCRD

SEQ ID NO: 36278 - protein, 13 aa, Mycobacterium avium
GRDAVSEVPKDRW

SEQ ID NO: 36279 - protein, 7 aa, Mycobacterium avium
GRDDGGL

SEQ ID NO: 36280 - protein, 8 aa, Mycobacterium avium
GRDDPLPA

SEQ ID NO: 36281 - protein, 4 aa, Mycobacterium avium
GRDE

SEQ ID NO: 36282 - protein, 6 aa, Mycobacterium avium
GRDEPL

SEQ ID NO: 36283 - protein, 7 aa, Mycobacterium avium
GRDGDDL

SEQ ID NO: 36284 - protein, 6 aa, Mycobacterium avium
GRDGKL

SEQ ID NO: 36285 - protein, 6 aa, Mycobacterium avium
GRDGTV

SEQ ID NO: 36286 - protein, 12 aa, Mycobacterium avium
GRDHPTVAAPRT

SEQ ID NO: 36287 - protein, 7 aa, Mycobacterium avium
GRDIDPR

SEQ ID NO: 36288 - protein, 15 aa, Mycobacterium avium
GRDPEHNFSASALME

SEQ ID NO: 36289 - protein, 8 aa, Mycobacterium avium
GRDPMQPR

SEQ ID NO: 36290 - protein, 6 aa, Mycobacterium avium
GRDPNK

SEQ ID NO: 36291 - protein, 9 aa, Mycobacterium avium
GRDPNPHVG

SEQ ID NO: 36292 - protein, 10 aa, Mycobacterium avium
GRDPRAAAQG

SEQ ID NO: 36293 - protein, 6 aa, Mycobacterium avium
GRDPSF

SEQ ID NO: 36294 - protein, 14 aa, Mycobacterium avium
GRDQVSPQAGRDAA

SEQ ID NO: 36295 - protein, 6 aa, Mycobacterium avium
GRDRDA

SEQ ID NO: 36296 - protein, 4 aa, Mycobacterium avium
GREA

SEQ ID NO: 36297 - protein, 13 aa, Mycobacterium avium
GREARARTRMKEG

SEQ ID NO: 36298 - protein, 16 aa, Mycobacterium avium
GREATDEELAAESGIP

SEQ ID NO: 36299 - protein, 11 aa, Mycobacterium avium
GREEATETARR

SEQ ID NO: 36300 - protein, 8 aa, Mycobacterium avium
GREETLDA

SEQ ID NO: 36301 - protein, 4 aa, Mycobacterium avium
GREG

SEQ ID NO: 36302 - protein, 5 aa, Mycobacterium avium
GRENP

SEQ ID NO: 36303 - protein, 6 aa, Mycobacterium avium
GREPIT

SEQ ID NO: 36304 - protein, 7 aa, Mycobacterium avium
GREPSRA

SEQ ID NO: 36305 - protein, 5 aa, Mycobacterium avium
GREQF

SEQ ID NO: 36306 - protein, 6 aa, Mycobacterium avium
GREQTL

SEQ ID NO: 36307 - protein, 9 aa, Mycobacterium avium
GRERRSDDL

SEQ ID NO: 36308 - protein, 8 aa, Mycobacterium avium
GRETQPHI

SEQ ID NO: 36309 - protein, 8 aa, Mycobacterium avium
GRGAGPHK

SEQ ID NO: 36310 - protein, 22 aa, Mycobacterium avium
GRGAQEGRTAFSAPGGGTRVGE

SEQ ID NO: 36311 - protein, 7 aa, Mycobacterium avium
GRGARTV

SEQ ID NO: 36312 - protein, 13 aa, Mycobacterium avium
GRGDKEGGDGAAV

SEQ ID NO: 36313 - protein, 4 aa, Mycobacterium avium
GRGE

SEQ ID NO: 36314 - protein, 18 aa, Mycobacterium avium
GRGEKPGLSQVQDDPPTR

SEQ ID NO: 36315 - protein, 6 aa, Mycobacterium avium
GRGERA

SEQ ID NO: 36316 - protein, 5 aa, Mycobacterium avium
GRGFN

SEQ ID NO: 36317 - protein, 4 aa, Mycobacterium avium
GRGG

SEQ ID NO: 36318 - protein, 5 aa, Mycobacterium avium
GRGGE

SEQ ID NO: 36319 - protein, 5 aa, Mycobacterium avium
GRGGH

SEQ ID NO: 36320 - protein, 9 aa, Mycobacterium avium
GRGGRTATA

SEQ ID NO: 36321 - protein, 6 aa, Mycobacterium avium
GRGGVR

SEQ ID NO: 36322 - protein, 5 aa, Mycobacterium avium
GRGIS

SEQ ID NO: 36323 - protein, 11 aa, Mycobacterium avium
GRGKGEVSRAD

SEQ ID NO: 36324 - protein, 7 aa, Mycobacterium avium
GRGNPDG

SEQ ID NO: 36325 - protein, 12 aa, Mycobacterium avium
GRGPESAAGPDL

SEQ ID NO: 36326 - protein, 7 aa, Mycobacterium avium
GRGPGGK

SEQ ID NO: 36327 - protein, 5 aa, Mycobacterium avium
GRGPV

SEQ ID NO: 36328 - protein, 8 aa, Mycobacterium avium
GRGSAANS

SEQ ID NO: 36329 - protein, 11 aa, Mycobacterium avium
GRGTPGGQADV

SEQ ID NO: 36330 - protein, 6 aa, Mycobacterium avium
GRGVEP

SEQ ID NO: 36331 - protein, 15 aa, Mycobacterium avium
GRHDPSGFSDWLTVA

SEQ ID NO: 36332 - protein, 4 aa, Mycobacterium avium
GRHN

SEQ ID NO: 36333 - protein, 9 aa, Mycobacterium avium
GRIEPAPRR

SEQ ID NO: 36334 - protein, 9 aa, Mycobacterium avium
GRISKPTGD

SEQ ID NO: 36335 - protein, 10 aa, Mycobacterium avium
GRKDRVDALT

SEQ ID NO: 36336 - protein, 7 aa, Mycobacterium avium
GRKGGLI

SEQ ID NO: 36337 - protein, 5 aa, Mycobacterium avium
GRKPH

SEQ ID NO: 36338 - protein, 6 aa, Mycobacterium avium
GRKPVD

SEQ ID NO: 36339 - protein, 4 aa, Mycobacterium avium
GRKT

SEQ ID NO: 36340 - protein, 6 aa, Mycobacterium avium
GRLDRD

SEQ ID NO: 36341 - protein, 11 aa, Mycobacterium avium
GRLGDEAQSRF

SEQ ID NO: 36342 - protein, 11 aa, Mycobacterium avium
GRLNPERITES

SEQ ID NO: 36343 - protein, 6 aa, Mycobacterium avium
GRLPST

SEQ ID NO: 36344 - protein, 7 aa, Mycobacterium avium
GRLSGTK

SEQ ID NO: 36345 - protein, 6 aa, Mycobacterium avium
GRLSRQ

SEQ ID NO: 36346 - protein, 16 aa, Mycobacterium avium
GRMSGAASGAAAPADL

SEQ ID NO: 36347 - protein, 7 aa, Mycobacterium avium
GRNATTV

SEQ ID NO: 36348 - protein, 4 aa, Mycobacterium avium
GRNG

SEQ ID NO: 36349 - protein, 8 aa, Mycobacterium avium
GRNQSGRA

SEQ ID NO: 36350 - protein, 11 aa, Mycobacterium avium
GRNSFEGRRTQ

SEQ ID NO: 36351 - protein, 6 aa, Mycobacterium avium
GRPAAL

SEQ ID NO: 36352 - protein, 8 aa, Mycobacterium avium
GRPADGAP

SEQ ID NO: 36353 - protein, 8 aa, Mycobacterium avium
GRPADRAA

SEQ ID NO: 36354 - protein, 7 aa, Mycobacterium avium
GRPAESD

SEQ ID NO: 36355 - protein, 9 aa, Mycobacterium avium
GRPAESREV

SEQ ID NO: 36356 - protein, 8 aa, Mycobacterium avium
GRPDARDH

SEQ ID NO: 36357 - protein, 5 aa, Mycobacterium avium
GRPDD

SEQ ID NO: 36358 - protein, 5 aa, Mycobacterium avium
GRPDE

SEQ ID NO: 36359 - protein, 12 aa, Mycobacterium avium
GRPDEAGAGGMG

SEQ ID NO: 36360 - protein, 13 aa, Mycobacterium avium
GRPDPARDARATY

SEQ ID NO: 36361 - protein, 7 aa, Mycobacterium avium
GRPDPAV

SEQ ID NO: 36362 - protein, 5 aa, Mycobacterium avium
GRPET

SEQ ID NO: 36363 - protein, 4 aa, Mycobacterium avium
GRPG

SEQ ID NO: 36364 - protein, 6 aa, Mycobacterium avium
GRPGDG

SEQ ID NO: 36365 - protein, 5 aa, Mycobacterium avium
GRPGH

SEQ ID NO: 36366 - protein, 12 aa, Mycobacterium avium
GRPGSLPTGPVP

SEQ ID NO: 36367 - protein, 11 aa, Mycobacterium avium
GRPKNGPDPAL

SEQ ID NO: 36368 - protein, 7 aa, Mycobacterium avium
GRPLPRA

SEQ ID NO: 36369 - protein, 18 aa, Mycobacterium avium
GRPNIRTRGRAAQMGGHD

SEQ ID NO: 36370 - protein, 4 aa, Mycobacterium avium
GRPP

SEQ ID NO: 36371 - protein, 7 aa, Mycobacterium avium
GRPPDAI

SEQ ID NO: 36372 - protein, 10 aa, Mycobacterium avium
GRPPGRKDPA

SEQ ID NO: 36373 - protein, 5 aa, Mycobacterium avium
GRPPR

SEQ ID NO: 36374 - protein, 15 aa, Mycobacterium avium
GRPPSDADLAGPAAS

SEQ ID NO: 36375 - protein, 8 aa, Mycobacterium avium
GRPQPGET

SEQ ID NO: 36376 - protein, 4 aa, Mycobacterium avium
GRPR

SEQ ID NO: 36377 - protein, 7 aa, Mycobacterium avium
GRPSDRL

SEQ ID NO: 36378 - protein, 7 aa, Mycobacterium avium
GRPSTYS

SEQ ID NO: 36379 - protein, 5 aa, Mycobacterium avium
GRPTQ

SEQ ID NO: 36380 - protein, 7 aa, Mycobacterium avium
GRQEYAT

SEQ ID NO: 36381 - protein, 4 aa, Mycobacterium avium
GRQG

SEQ ID NO: 36382 - protein, 19 aa, Mycobacterium avium
GRQRAGRPAARPAKLSREG

SEQ ID NO: 36383 - protein, 10 aa, Mycobacterium avium
GRQSGLAAQG

SEQ ID NO: 36384 - protein, 4 aa, Mycobacterium avium
GRQV

SEQ ID NO: 36385 - protein, 9 aa, Mycobacterium avium
GRQVEAGQT

SEQ ID NO: 36386 - protein, 9 aa, Mycobacterium avium
GRQVRSDVG

SEQ ID NO: 36387 - protein, 5 aa, Mycobacterium avium
GRRDD

SEQ ID NO: 36388 - protein, 4 aa, Mycobacterium avium
GRRG

SEQ ID NO: 36389 - protein, 8 aa, Mycobacterium avium
GRRGGSAM

SEQ ID NO: 36390 - protein, 6 aa, Mycobacterium avium
GRRGGV

SEQ ID NO: 36391 - protein, 8 aa, Mycobacterium avium
GRRGTTTD

SEQ ID NO: 36392 - protein, 5 aa, Mycobacterium avium
GRRLT

SEQ ID NO: 36393 - protein, 7 aa, Mycobacterium avium
GRRPGAR

SEQ ID NO: 36394 - protein, 7 aa, Mycobacterium avium
GRRPGLR

SEQ ID NO: 36395 - protein, 14 aa, Mycobacterium avium
GRRPLTESDPPGVP

SEQ ID NO: 36396 - protein, 21 aa, Mycobacterium avium
GRRPSPGTGAYGAAKAGLESL

SEQ ID NO: 36397 - protein, 6 aa, Mycobacterium avium
GRRPTV

SEQ ID NO: 36398 - protein, 7 aa, Mycobacterium avium
GRRQPAA

SEQ ID NO: 36399 - protein, 5 aa, Mycobacterium avium
GRRRD

SEQ ID NO: 36400 - protein, 5 aa, Mycobacterium avium
GRRRE

SEQ ID NO: 36401 - protein, 8 aa, Mycobacterium avium
GRRRGLQP

SEQ ID NO: 36402 - protein, 8 aa, Mycobacterium avium
GRRRHPSW

SEQ ID NO: 36403 - protein, 4 aa, Mycobacterium avium
GRRS

SEQ ID NO: 36404 - protein, 8 aa, Mycobacterium avium
GRRSEAHR

SEQ ID NO: 36405 - protein, 8 aa, Mycobacterium avium
GRRTPGEG

SEQ ID NO: 36406 - protein, 7 aa, Mycobacterium avium
GRSAEQR

SEQ ID NO: 36407 - protein, 7 aa, Mycobacterium avium
GRSATFD

SEQ ID NO: 36408 - protein, 5 aa, Mycobacterium avium
GRSDN

SEQ ID NO: 36409 - protein, 7 aa, Mycobacterium avium
GRSEEDY

SEQ ID NO: 36410 - protein, 4 aa, Mycobacterium avium
GRSG

SEQ ID NO: 36411 - protein, 6 aa, Mycobacterium avium
GRSGDF

SEQ ID NO: 36412 - protein, 13 aa, Mycobacterium avium
GRSGGAPETVQHN

SEQ ID NO: 36413 - protein, 7 aa, Mycobacterium avium
GRSIRRP

SEQ ID NO: 36414 - protein, 26 aa, Mycobacterium avium
GRSKRELAAAEGISPSAVSQRAGRDG

SEQ ID NO: 36415 - protein, 11 aa, Mycobacterium avium
GRSKVNSDVDA

SEQ ID NO: 36416 - protein, 6 aa, Mycobacterium avium
GRSNEH

SEQ ID NO: 36417 - protein, 4 aa, Mycobacterium avium
GRSR

SEQ ID NO: 36418 - protein, 11 aa, Mycobacterium avium
GRSRRDGQTPH

SEQ ID NO: 36419 - protein, 8 aa, Mycobacterium avium
GRSTMTKS

SEQ ID NO: 36420 - protein, 9 aa, Mycobacterium avium
GRSTVEDAT

SEQ ID NO: 36421 - protein, 4 aa, Mycobacterium avium
GRSV

SEQ ID NO: 36422 - protein, 11 aa, Mycobacterium avium
GRSVPAKSLGD

SEQ ID NO: 36423 - protein, 6 aa, Mycobacterium avium
GRSVRS

SEQ ID NO: 36424 - protein, 13 aa, Mycobacterium avium
GRSYGDNAQNGGG

SEQ ID NO: 36425 - protein, 7 aa, Mycobacterium avium
GRTAPSV

SEQ ID NO: 36426 - protein, 9 aa, Mycobacterium avium
GRTASRETA

SEQ ID NO: 36427 - protein, 9 aa, Mycobacterium avium
GRTDEDTPL

SEQ ID NO: 36428 - protein, 5 aa, Mycobacterium avium
GRTDW

SEQ ID NO: 36429 - protein, 7 aa, Mycobacterium avium
GRTEETF

SEQ ID NO: 36430 - protein, 8 aa, Mycobacterium avium
GRTEFAGP

SEQ ID NO: 36431 - protein, 5 aa, Mycobacterium avium
GRTGE

SEQ ID NO: 36432 - protein, 8 aa, Mycobacterium avium
GRTGRAEL

SEQ ID NO: 36433 - protein, 6 aa, Mycobacterium avium
GRTGRV

SEQ ID NO: 36434 - protein, 13 aa, Mycobacterium avium
GRTPAASELQDPR

SEQ ID NO: 36435 - protein, 17 aa, Mycobacterium avium
GRTPAPMGKSNNYPRSV

SEQ ID NO: 36436 - protein, 14 aa, Mycobacterium avium
GRTPARVTGPDPVP

SEQ ID NO: 36437 - protein, 5 aa, Mycobacterium avium
GRTPE

SEQ ID NO: 36438 - protein, 7 aa, Mycobacterium avium
GRTPNGV

SEQ ID NO: 36439 - protein, 10 aa, Mycobacterium avium
GRTQQNLARR

SEQ ID NO: 36440 - protein, 7 aa, Mycobacterium avium
GRTRVPA

SEQ ID NO: 36441 - protein, 8 aa, Mycobacterium avium
GRTSAPLT

SEQ ID NO: 36442 - protein, 6 aa, Mycobacterium avium
GRTVAG

SEQ ID NO: 36443 - protein, 7 aa, Mycobacterium avium
GRVNPDK

SEQ ID NO: 36444 - protein, 7 aa, Mycobacterium avium
GRVQEPT

SEQ ID NO: 36445 - protein, 15 aa, Mycobacterium avium
GRVQQEEHNAEGTRI

SEQ ID NO: 36446 - protein, 4 aa, Mycobacterium avium
GRVS

SEQ ID NO: 36447 - protein, 7 aa, Mycobacterium avium
GRVTREE

SEQ ID NO: 36448 - protein, 7 aa, Mycobacterium avium
GRVTREP

SEQ ID NO: 36449 - protein, 19 aa, Mycobacterium avium
GRWATERGMSRTDGHKAGE

SEQ ID NO: 36450 - protein, 23 aa, Mycobacterium avium
GSAAARAVKGDVQRSLRNFVELY

SEQ ID NO: 36451 - protein, 8 aa, Mycobacterium avium
GSAAATEN

SEQ ID NO: 36452 - protein, 10 aa, Mycobacterium avium
GSAAEPGTVG

SEQ ID NO: 36453 - protein, 12 aa, Mycobacterium avium
GSAAGNSPIPYN

SEQ ID NO: 36454 - protein, 9 aa, Mycobacterium avium
GSAAPPPEV

SEQ ID NO: 36455 - protein, 9 aa, Mycobacterium avium
GSAAPTADE

SEQ ID NO: 36456 - protein, 17 aa, Mycobacterium avium
GSAAQADPLSGLTEQER

SEQ ID NO: 36457 - protein, 7 aa, Mycobacterium avium
GSAAQKE

SEQ ID NO: 36458 - protein, 12 aa, Mycobacterium avium
GSAASDVDDPRG

SEQ ID NO: 36459 - protein, 8 aa, Mycobacterium avium
GSAATVGK

SEQ ID NO: 36460 - protein, 10 aa, Mycobacterium avium
GSAEFGEADL

SEQ ID NO: 36461 - protein, 9 aa, Mycobacterium avium
GSAEPAANR

SEQ ID NO: 36462 - protein, 11 aa, Mycobacterium avium
GSAEQAQSLAQ

SEQ ID NO: 36463 - protein, 9 aa, Mycobacterium avium
GSAESLNAS

SEQ ID NO: 36464 - protein, 8 aa, Mycobacterium avium
GSAEYETP

SEQ ID NO: 36465 - protein, 6 aa, Mycobacterium avium
GSAGAK

SEQ ID NO: 36466 - protein, 8 aa, Mycobacterium avium
GSAGTTHP

SEQ ID NO: 36467 - protein, 8 aa, Mycobacterium avium
GSANRDAS

SEQ ID NO: 36468 - protein, 10 aa, Mycobacterium avium
GSAPPLDPGL

SEQ ID NO: 36469 - protein, 9 aa, Mycobacterium avium
GSAPPQRSA

SEQ ID NO: 36470 - protein, 9 aa, Mycobacterium avium
GSAPTEGTY

SEQ ID NO: 36471 - protein, 6 aa, Mycobacterium avium
GSAPVD

SEQ ID NO: 36472 - protein, 9 aa, Mycobacterium avium
GSASAPAVR

SEQ ID NO: 36473 - protein, 4 aa, Mycobacterium avium
GSAT

SEQ ID NO: 36474 - protein, 5 aa, Mycobacterium avium
GSATD

SEQ ID NO: 36475 - protein, 13 aa, Mycobacterium avium
GSATVGRARAVAP

SEQ ID NO: 36476 - protein, 18 aa, Mycobacterium avium
GSAYGDKGAERDVGGYDG

SEQ ID NO: 36477 - protein, 6 aa, Mycobacterium avium
GSAYGL

SEQ ID NO: 36478 - protein, 7 aa, Mycobacterium avium
GSDAGTM

SEQ ID NO: 36479 - protein, 5 aa, Mycobacterium avium
GSDAY

SEQ ID NO: 36480 - protein, 17 aa, Mycobacterium avium
GSDDSEFKRGSSNEDQL

SEQ ID NO: 36481 - protein, 7 aa, Mycobacterium avium
GSDEEFN

SEQ ID NO: 36482 - protein, 9 aa, Mycobacterium avium
GSDEGGHDA

SEQ ID NO: 36483 - protein, 8 aa, Mycobacterium avium
GSDEQKQR

SEQ ID NO: 36484 - protein, 6 aa, Mycobacterium avium
GSDGNP

SEQ ID NO: 36485 - protein, 6 aa, Mycobacterium avium
GSDGNV

SEQ ID NO: 36486 - protein, 10 aa, Mycobacterium avium
GSDGTQATAI

SEQ ID NO: 36487 - protein, 11 aa, Mycobacterium avium
GSDGVTASHSA

SEQ ID NO: 36488 - protein, 4 aa, Mycobacterium avium
GSDI

SEQ ID NO: 36489 - protein, 15 aa, Mycobacterium avium
GSDLRQRVPDPPGGL

SEQ ID NO: 36490 - protein, 6 aa, Mycobacterium avium
GSDPNW

SEQ ID NO: 36491 - protein, 5 aa, Mycobacterium avium
GSDQW

SEQ ID NO: 36492 - protein, 8 aa, Mycobacterium avium
GSDSFSDP

SEQ ID NO: 36493 - protein, 6 aa, Mycobacterium avium
GSDTHS

SEQ ID NO: 36494 - protein, 8 aa, Mycobacterium avium
GSDTTKNA

SEQ ID NO: 36495 - protein, 13 aa, Mycobacterium avium
GSDTVRTNANADA

SEQ ID NO: 36496 - protein, 5 aa, Mycobacterium avium
GSDVP

SEQ ID NO: 36497 - protein, 8 aa, Mycobacterium avium
GSEADYTY

SEQ ID NO: 36498 - protein, 16 aa, Mycobacterium avium
GSEAITRREAEPAATA

SEQ ID NO: 36499 - protein, 7 aa, Mycobacterium avium
GSEAQRR

SEQ ID NO: 36500 - protein, 9 aa, Mycobacterium avium
GSEDDASDF

SEQ ID NO: 36501 - protein, 7 aa, Mycobacterium avium
GSEDGYL

SEQ ID NO: 36502 - protein, 8 aa, Mycobacterium avium
GSEEEAPL

SEQ ID NO: 36503 - protein, 7 aa, Mycobacterium avium
GSEGDFE

SEQ ID NO: 36504 - protein, 32 aa, Mycobacterium avium
GSEGRQGKLDAAETEREHAASEHSQVGRRARA

SEQ ID NO: 36505 - protein, 8 aa, Mycobacterium avium
GSEKSPGF

SEQ ID NO: 36506 - protein, 8 aa, Mycobacterium avium
GSEKTGQF

SEQ ID NO: 36507 - protein, 8 aa, Mycobacterium avium
GSELARKV

SEQ ID NO: 36508 - protein, 4 aa, Mycobacterium avium
GSEM

SEQ ID NO: 36509 - protein, 7 aa, Mycobacterium avium
GSEQGRG

SEQ ID NO: 36510 - protein, 8 aa, Mycobacterium avium
GSEQQKRT

SEQ ID NO: 36511 - protein, 6 aa, Mycobacterium avium
GSETVS

SEQ ID NO: 36512 - protein, 13 aa, Mycobacterium avium
GSFSADARGRFPG

SEQ ID NO: 36513 - protein, 5 aa, Mycobacterium avium
GSGAL

SEQ ID NO: 36514 - protein, 12 aa, Mycobacterium avium
GSGARPGTSPKV

SEQ ID NO: 36515 - protein, 14 aa, Mycobacterium avium
GSGATPFARGGDGL

SEQ ID NO: 36516 - protein, 9 aa, Mycobacterium avium
GSGDNGGDA

SEQ ID NO: 36517 - protein, 11 aa, Mycobacterium avium
GSGDWDQTKTD

SEQ ID NO: 36518 - protein, 4 aa, Mycobacterium avium
GSGE

SEQ ID NO: 36519 - protein, 5 aa, Mycobacterium avium
GSGEI

SEQ ID NO: 36520 - protein, 9 aa, Mycobacterium avium
GSGEKKTIP

SEQ ID NO: 36521 - protein, 7 aa, Mycobacterium avium
GSGEKRT

SEQ ID NO: 36522 - protein, 7 aa, Mycobacterium avium
GSGENLN

SEQ ID NO: 36523 - protein, 8 aa, Mycobacterium avium
GSGGDYQF

SEQ ID NO: 36524 - protein, 9 aa, Mycobacterium avium
GSGGGIGQA

SEQ ID NO: 36525 - protein, 5 aa, Mycobacterium avium
GSGGT

SEQ ID NO: 36526 - protein, 6 aa, Mycobacterium avium
GSGIGR

SEQ ID NO: 36527 - protein, 5 aa, Mycobacterium avium
GSGKP

SEQ ID NO: 36528 - protein, 9 aa, Mycobacterium avium
GSGNAGPAV

SEQ ID NO: 36529 - protein, 9 aa, Mycobacterium avium
GSGNESADR

SEQ ID NO: 36530 - protein, 9 aa, Mycobacterium avium
GSGNGEQIA

SEQ ID NO: 36531 - protein, 6 aa, Mycobacterium avium
GSGNSL

SEQ ID NO: 36532 - protein, 8 aa, Mycobacterium avium
GSGPDRAI

SEQ ID NO: 36533 - protein, 5 aa, Mycobacterium avium
GSGPL

SEQ ID NO: 36534 - protein, 5 aa, Mycobacterium avium
GSGPR

SEQ ID NO: 36535 - protein, 16 aa, Mycobacterium avium
GSGQIKTGAPARSERV

SEQ ID NO: 36536 - protein, 5 aa, Mycobacterium avium
GSGRT

SEQ ID NO: 36537 - protein, 4 aa, Mycobacterium avium
GSGS

SEQ ID NO: 36538 - protein, 14 aa, Mycobacterium avium
GSGTGTGGEPRWGG

SEQ ID NO: 36539 - protein, 6 aa, Mycobacterium avium
GSGTLA

SEQ ID NO: 36540 - protein, 8 aa, Mycobacterium avium
GSGTSEKT

SEQ ID NO: 36541 - protein, 6 aa, Mycobacterium avium
GSGTVP

SEQ ID NO: 36542 - protein, 11 aa, Mycobacterium avium
GSHGGARSARD

SEQ ID NO: 36543 - protein, 7 aa, Mycobacterium avium
GSHPAQL

SEQ ID NO: 36544 - protein, 9 aa, Mycobacterium avium
GSHPPRAAT

SEQ ID NO: 36545 - protein, 6 aa, Mycobacterium avium
GSHSGL

SEQ ID NO: 36546 - protein, 4 aa, Mycobacterium avium
GSID

SEQ ID NO: 36547 - protein, 4 aa, Mycobacterium avium
GSIG

SEQ ID NO: 36548 - protein, 18 aa, Mycobacterium avium
GSIKSGITDATGGYIPED

SEQ ID NO: 36549 - protein, 8 aa, Mycobacterium avium
GSIPDGSR

SEQ ID NO: 36550 - protein, 12 aa, Mycobacterium avium
GSIPTTTSGKIR

SEQ ID NO: 36551 - protein, 6 aa, Mycobacterium avium
GSKEHA

SEQ ID NO: 36552 - protein, 6 aa, Mycobacterium avium
GSKIES

SEQ ID NO: 36553 - protein, 9 aa, Mycobacterium avium
GSKTPGHPE

SEQ ID NO: 36554 - protein, 5 aa, Mycobacterium avium
GSKVD

SEQ ID NO: 36555 - protein, 17 aa, Mycobacterium avium
GSLAEPGVGVDTGQARP

SEQ ID NO: 36556 - protein, 10 aa, Mycobacterium avium
GSLAPRTDRR

SEQ ID NO: 36557 - protein, 6 aa, Mycobacterium avium
GSLEDY

SEQ ID NO: 36558 - protein, 4 aa, Mycobacterium avium
GSLG

SEQ ID NO: 36559 - protein, 11 aa, Mycobacterium avium
GSLGQDSGFGR

SEQ ID NO: 36560 - protein, 6 aa, Mycobacterium avium
GSLKSS

SEQ ID NO: 36561 - protein, 7 aa, Mycobacterium avium
GSLPGAV

SEQ ID NO: 36562 - protein, 6 aa, Mycobacterium avium
GSLRRD

SEQ ID NO: 36563 - protein, 5 aa, Mycobacterium avium
GSLSG

SEQ ID NO: 36564 - protein, 6 aa, Mycobacterium avium
GSMGGA

SEQ ID NO: 36565 - protein, 9 aa, Mycobacterium avium
GSNTSSLPI

SEQ ID NO: 36566 - protein, 8 aa, Mycobacterium avium
GSNTSTLP

SEQ ID NO: 36567 - protein, 6 aa, Mycobacterium avium
GSPAEL

SEQ ID NO: 36568 - protein, 13 aa, Mycobacterium avium
GSPASALGPRQRA

SEQ ID NO: 36569 - protein, 4 aa, Mycobacterium avium
GSPD

SEQ ID NO: 36570 - protein, 6 aa, Mycobacterium avium
GSPEDP

SEQ ID NO: 36571 - protein, 21 aa, Mycobacterium avium
GSPEEREAAAAQPEADRSGAG

SEQ ID NO: 36572 - protein, 9 aa, Mycobacterium avium
GSPERLSGK

SEQ ID NO: 36573 - protein, 7 aa, Mycobacterium avium
GSPEVTN

SEQ ID NO: 36574 - protein, 15 aa, Mycobacterium avium
GSPGFRGDPAGPPIA

SEQ ID NO: 36575 - protein, 9 aa, Mycobacterium avium
GSPLAGDSL

SEQ ID NO: 36576 - protein, 7 aa, Mycobacterium avium
GSPLSDR

SEQ ID NO: 36577 - protein, 21 aa, Mycobacterium avium
GSPMGRTRDAAPGAPADRPVP

SEQ ID NO: 36578 - protein, 6 aa, Mycobacterium avium
GSPPAE

SEQ ID NO: 36579 - protein, 7 aa, Mycobacterium avium
GSPPEAG

SEQ ID NO: 36580 - protein, 8 aa, Mycobacterium avium
GSPPISNL

SEQ ID NO: 36581 - protein, 7 aa, Mycobacterium avium
GSPPNRR

SEQ ID NO: 36582 - protein, 12 aa, Mycobacterium avium
GSPSQARKHADA

SEQ ID NO: 36583 - protein, 9 aa, Mycobacterium avium
GSPSQPLPG

SEQ ID NO: 36584 - protein, 5 aa, Mycobacterium avium
GSQAI

SEQ ID NO: 36585 - protein, 9 aa, Mycobacterium avium
GSQASNDQL

SEQ ID NO: 36586 - protein, 6 aa, Mycobacterium avium
GSQGHA

SEQ ID NO: 36587 - protein, 4 aa, Mycobacterium avium
GSQI

SEQ ID NO: 36588 - protein, 8 aa, Mycobacterium avium
GSQQAYEA

SEQ ID NO: 36589 - protein, 20 aa, Mycobacterium avium
GSQSAGPGGAGPGSRKGTTR

SEQ ID NO: 36590 - protein, 4 aa, Mycobacterium avium
GSQW

SEQ ID NO: 36591 - protein, 5 aa, Mycobacterium avium
GSRAA

SEQ ID NO: 36592 - protein, 10 aa, Mycobacterium avium
GSRDEGATVA

SEQ ID NO: 36593 - protein, 10 aa, Mycobacterium avium
GSRGPRESKY

SEQ ID NO: 36594 - protein, 4 aa, Mycobacterium avium
GSRI

SEQ ID NO: 36595 - protein, 8 aa, Mycobacterium avium
GSRKQLAA

SEQ ID NO: 36596 - protein, 4 aa, Mycobacterium avium
GSRM

SEQ ID NO: 36597 - protein, 6 aa, Mycobacterium avium
GSRNAP

SEQ ID NO: 36598 - protein, 4 aa, Mycobacterium avium
GSRP

SEQ ID NO: 36599 - protein, 7 aa, Mycobacterium avium
GSRPAAL

SEQ ID NO: 36600 - protein, 13 aa, Mycobacterium avium
GSRPTSRKPTESI

SEQ ID NO: 36601 - protein, 7 aa, Mycobacterium avium
GSRQGLA

SEQ ID NO: 36602 - protein, 5 aa, Mycobacterium avium
GSRRK

SEQ ID NO: 36603 - protein, 7 aa, Mycobacterium avium
GSRRSGF

SEQ ID NO: 36604 - protein, 7 aa, Mycobacterium avium
GSRSPVR

SEQ ID NO: 36605 - protein, 8 aa, Mycobacterium avium
GSRTDVAG

SEQ ID NO: 36606 - protein, 7 aa, Mycobacterium avium
GSRTGQF

SEQ ID NO: 36607 - protein, 10 aa, Mycobacterium avium
GSRTPRTDRE

SEQ ID NO: 36608 - protein, 5 aa, Mycobacterium avium
GSSAL

SEQ ID NO: 36609 - protein, 7 aa, Mycobacterium avium
GSSAVGR

SEQ ID NO: 36610 - protein, 9 aa, Mycobacterium avium
GSSDPQRIG

SEQ ID NO: 36611 - protein, 6 aa, Mycobacterium avium
GSSDRA

SEQ ID NO: 36612 - protein, 6 aa, Mycobacterium avium
GSSEKA

SEQ ID NO: 36613 - protein, 15 aa, Mycobacterium avium
GSSGAPETKADSAPW

SEQ ID NO: 36614 - protein, 8 aa, Mycobacterium avium
GSSGKGGE

SEQ ID NO: 36615 - protein, 8 aa, Mycobacterium avium
GSSGPQGA

SEQ ID NO: 36616 - protein, 6 aa, Mycobacterium avium
GSSIEG

SEQ ID NO: 36617 - protein, 7 aa, Mycobacterium avium
GSSITSE

SEQ ID NO: 36618 - protein, 5 aa, Mycobacterium avium
GSSKH

SEQ ID NO: 36619 - protein, 4 aa, Mycobacterium avium
GSSM

SEQ ID NO: 36620 - protein, 6 aa, Mycobacterium avium
GSSPEA

SEQ ID NO: 36621 - protein, 5 aa, Mycobacterium avium
GSSPG

SEQ ID NO: 36622 - protein, 14 aa, Mycobacterium avium
GSSRAEAQRRYEEQ

SEQ ID NO: 36623 - protein, 7 aa, Mycobacterium avium
GSSRRYA

SEQ ID NO: 36624 - protein, 10 aa, Mycobacterium avium
GSSSATRSNQ

SEQ ID NO: 36625 - protein, 11 aa, Mycobacterium avium
GSSSGTTTTKD

SEQ ID NO: 36626 - protein, 7 aa, Mycobacterium avium
GSSSHQK

SEQ ID NO: 36627 - protein, 10 aa, Mycobacterium avium
GSSSPEAIHP

SEQ ID NO: 36628 - protein, 8 aa, Mycobacterium avium
GSSSPGLE

SEQ ID NO: 36629 - protein, 15 aa, Mycobacterium avium
GSSTENSAYGPTRNP

SEQ ID NO: 36630 - protein, 6 aa, Mycobacterium avium
GSSYNT

SEQ ID NO: 36631 - protein, 6 aa, Mycobacterium avium
GSTDFT

SEQ ID NO: 36632 - protein, 18 aa, Mycobacterium avium
GSTDTAGAPEQSTPDEVN

SEQ ID NO: 36633 - protein, 6 aa, Mycobacterium avium
GSTEVG

SEQ ID NO: 36634 - protein, 6 aa, Mycobacterium avium
GSTPVE

SEQ ID NO: 36635 - protein, 8 aa, Mycobacterium avium
GSTRSINA

SEQ ID NO: 36636 - protein, 4 aa, Mycobacterium avium
GSTV

SEQ ID NO: 36637 - protein, 8 aa, Mycobacterium avium
GSVGGASH

SEQ ID NO: 36638 - protein, 9 aa, Mycobacterium avium
GSVGGSTGV

SEQ ID NO: 36639 - protein, 6 aa, Mycobacterium avium
GSVGRN

SEQ ID NO: 36640 - protein, 4 aa, Mycobacterium avium
GSVI

SEQ ID NO: 36641 - protein, 7 aa, Mycobacterium avium
GSVPDGD

SEQ ID NO: 36642 - protein, 8 aa, Mycobacterium avium
GSVPVAGG

SEQ ID NO: 36643 - protein, 6 aa, Mycobacterium avium
GSVRSE

SEQ ID NO: 36644 - protein, 9 aa, Mycobacterium avium
GSVSKEQRA

SEQ ID NO: 36645 - protein, 4 aa, Mycobacterium avium
GSWE

SEQ ID NO: 36646 - protein, 4 aa, Mycobacterium avium
GSWP

SEQ ID NO: 36647 - protein, 12 aa, Mycobacterium avium
GSWSGRVQPPLA

SEQ ID NO: 36648 - protein, 4 aa, Mycobacterium avium
GSYP

SEQ ID NO: 36649 - protein, 7 aa, Mycobacterium avium
GTAADEL

SEQ ID NO: 36650 - protein, 26 aa, Mycobacterium avium
GTAALTGDPDGPPTLPGYSSADNSTG

SEQ ID NO: 36651 - protein, 13 aa, Mycobacterium avium
GTAAPEATTPALG

SEQ ID NO: 36652 - protein, 5 aa, Mycobacterium avium
GTAAQ

SEQ ID NO: 36653 - protein, 6 aa, Mycobacterium avium
GTAAQP

SEQ ID NO: 36654 - protein, 20 aa, Mycobacterium avium
GTAARAGQAAAQARAAAAAH

SEQ ID NO: 36655 - protein, 6 aa, Mycobacterium avium
GTAASY

SEQ ID NO: 36656 - protein, 5 aa, Mycobacterium avium
GTAAW

SEQ ID NO: 36657 - protein, 5 aa, Mycobacterium avium
GTADA

SEQ ID NO: 36658 - protein, 10 aa, Mycobacterium avium
GTADKRQVEN

SEQ ID NO: 36659 - protein, 8 aa, Mycobacterium avium
GTADPAAI

SEQ ID NO: 36660 - protein, 8 aa, Mycobacterium avium
GTADPAEL

SEQ ID NO: 36661 - protein, 9 aa, Mycobacterium avium
GTADPAEVR

SEQ ID NO: 36662 - protein, 4 aa, Mycobacterium avium
GTAE

SEQ ID NO: 36663 - protein, 7 aa, Mycobacterium avium
GTAEAPG

SEQ ID NO: 36664 - protein, 5 aa, Mycobacterium avium
GTAEE

SEQ ID NO: 36665 - protein, 8 aa, Mycobacterium avium
GTAEGDGA

SEQ ID NO: 36666 - protein, 10 aa, Mycobacterium avium
GTAGAPGELD

SEQ ID NO: 36667 - protein, 9 aa, Mycobacterium avium
GTAGEAPDH

SEQ ID NO: 36668 - protein, 13 aa, Mycobacterium avium
GTAGNISARRSDG

SEQ ID NO: 36669 - protein, 27 aa, Mycobacterium avium
GTAGRKSRFSGDDAKRPLDKRGRAQAE

SEQ ID NO: 36670 - protein, 7 aa, Mycobacterium avium
GTAGTAT

SEQ ID NO: 36671 - protein, 7 aa, Mycobacterium avium
GTAGYNA

SEQ ID NO: 36672 - protein, 8 aa, Mycobacterium avium
GTAGYSEQ

SEQ ID NO: 36673 - protein, 14 aa, Mycobacterium avium
GTAKSDRTGTGTRS

SEQ ID NO: 36674 - protein, 9 aa, Mycobacterium avium
GTALGGGTE

SEQ ID NO: 36675 - protein, 7 aa, Mycobacterium avium
GTAPTGP

SEQ ID NO: 36676 - protein, 15 aa, Mycobacterium avium
GTARREDGEIVSSGG

SEQ ID NO: 36677 - protein, 11 aa, Mycobacterium avium
GTASTAALDRR

SEQ ID NO: 36678 - protein, 6 aa, Mycobacterium avium
GTATDG

SEQ ID NO: 36679 - protein, 6 aa, Mycobacterium avium
GTATFG

SEQ ID NO: 36680 - protein, 6 aa, Mycobacterium avium
GTATRP

SEQ ID NO: 36681 - protein, 5 aa, Mycobacterium avium
GTATS

SEQ ID NO: 36682 - protein, 15 aa, Mycobacterium avium
GTAVGTGLNAPDGFG

SEQ ID NO: 36683 - protein, 5 aa, Mycobacterium avium
GTAVS

SEQ ID NO: 36684 - protein, 8 aa, Mycobacterium avium
GTAVTPAS

SEQ ID NO: 36685 - protein, 5 aa, Mycobacterium avium
GTAYA

SEQ ID NO: 36686 - protein, 5 aa, Mycobacterium avium
GTAYD

SEQ ID NO: 36687 - protein, 11 aa, Mycobacterium avium
GTCTPHDGPAD

SEQ ID NO: 36688 - protein, 5 aa, Mycobacterium avium
GTDAA

SEQ ID NO: 36689 - protein, 15 aa, Mycobacterium avium
GTDAAIGDTDQLPGK

SEQ ID NO: 36690 - protein, 14 aa, Mycobacterium avium
GTDAPAIPHGRNAD

SEQ ID NO: 36691 - protein, 7 aa, Mycobacterium avium
GTDDQPA

SEQ ID NO: 36692 - protein, 7 aa, Mycobacterium avium
GTDEGLT

SEQ ID NO: 36693 - protein, 9 aa, Mycobacterium avium
GTDNESPAE

SEQ ID NO: 36694 - protein, 11 aa, Mycobacterium avium
GTDPATGRRRG

SEQ ID NO: 36695 - protein, 6 aa, Mycobacterium avium
GTDPQH

SEQ ID NO: 36696 - protein, 9 aa, Mycobacterium avium
GTDPSPEAA

SEQ ID NO: 36697 - protein, 9 aa, Mycobacterium avium
GTDSGGPVR

SEQ ID NO: 36698 - protein, 6 aa, Mycobacterium avium
GTDSHT

SEQ ID NO: 36699 - protein, 4 aa, Mycobacterium avium
GTDT

SEQ ID NO: 36700 - protein, 10 aa, Mycobacterium avium
GTDTAGHERT

SEQ ID NO: 36701 - protein, 11 aa, Mycobacterium avium
GTDTEDGVPPG

SEQ ID NO: 36702 - protein, 9 aa, Mycobacterium avium
GTDTTRNQV

SEQ ID NO: 36703 - protein, 5 aa, Mycobacterium avium
GTDVP

SEQ ID NO: 36704 - protein, 4 aa, Mycobacterium avium
GTEA

SEQ ID NO: 36705 - protein, 10 aa, Mycobacterium avium
GTEAGGHTGE

SEQ ID NO: 36706 - protein, 12 aa, Mycobacterium avium
GTEAGRAAAQAG

SEQ ID NO: 36707 - protein, 6 aa, Mycobacterium avium
GTEANE

SEQ ID NO: 36708 - protein, 14 aa, Mycobacterium avium
GTEEFADRQRRTLS

SEQ ID NO: 36709 - protein, 7 aa, Mycobacterium avium
GTEEQRD

SEQ ID NO: 36710 - protein, 12 aa, Mycobacterium avium
GTEGFAGTTIGP

SEQ ID NO: 36711 - protein, 12 aa, Mycobacterium avium
GTEGPYTGTGGA

SEQ ID NO: 36712 - protein, 4 aa, Mycobacterium avium
GTEI

SEQ ID NO: 36713 - protein, 4 aa, Mycobacterium avium
GTEL

SEQ ID NO: 36714 - protein, 9 aa, Mycobacterium avium
GTENPDGAL

SEQ ID NO: 36715 - protein, 25 aa, Mycobacterium avium
GTEPGGASAPDGGAVRSKSTPTDPV

SEQ ID NO: 36716 - protein, 7 aa, Mycobacterium avium
GTEPPAE

SEQ ID NO: 36717 - protein, 18 aa, Mycobacterium avium
GTERPFTGEYTDTKTEGV

SEQ ID NO: 36718 - protein, 4 aa, Mycobacterium avium
GTFD

SEQ ID NO: 36719 - protein, 5 aa, Mycobacterium avium
GTFGS

SEQ ID NO: 36720 - protein, 12 aa, Mycobacterium avium
GTFGSRQEEAQR

SEQ ID NO: 36721 - protein, 4 aa, Mycobacterium avium
GTFT

SEQ ID NO: 36722 - protein, 10 aa, Mycobacterium avium
GTGAAAETGV

SEQ ID NO: 36723 - protein, 15 aa, Mycobacterium avium
GTGAPRELSDKEHPL

SEQ ID NO: 36724 - protein, 6 aa, Mycobacterium avium
GTGATG

SEQ ID NO: 36725 - protein, 5 aa, Mycobacterium avium
GTGGA

SEQ ID NO: 36726 - protein, 15 aa, Mycobacterium avium
GTGGEDEGESDAESV

SEQ ID NO: 36727 - protein, 5 aa, Mycobacterium avium
GTGGG

SEQ ID NO: 36728 - protein, 12 aa, Mycobacterium avium
GTGGKDLSVEQA

SEQ ID NO: 36729 - protein, 8 aa, Mycobacterium avium
GTGGPSAM

SEQ ID NO: 36730 - protein, 7 aa, Mycobacterium avium
GTGGTIT

SEQ ID NO: 36731 - protein, 10 aa, Mycobacterium avium
GTGGTITGAG

SEQ ID NO: 36732 - protein, 7 aa, Mycobacterium avium
GTGGVGQ

SEQ ID NO: 36733 - protein, 4 aa, Mycobacterium avium
GTGI

SEQ ID NO: 36734 - protein, 6 aa, Mycobacterium avium
GTGPFT

SEQ ID NO: 36735 - protein, 4 aa, Mycobacterium avium
GTGQ

SEQ ID NO: 36736 - protein, 6 aa, Mycobacterium avium
GTGSNT

SEQ ID NO: 36737 - protein, 8 aa, Mycobacterium avium
GTGSSGIQ

SEQ ID NO: 36738 - protein, 10 aa, Mycobacterium avium
GTGSSGIQAT

SEQ ID NO: 36739 - protein, 9 aa, Mycobacterium avium
GTGSTASQL

SEQ ID NO: 36740 - protein, 6 aa, Mycobacterium avium
GTGSTG

SEQ ID NO: 36741 - protein, 19 aa, Mycobacterium avium
GTGTEAIEPVEGPDGSTTV

SEQ ID NO: 36742 - protein, 4 aa, Mycobacterium avium
GTGV

SEQ ID NO: 36743 - protein, 15 aa, Mycobacterium avium
GTGVTPRDVTPEATR

SEQ ID NO: 36744 - protein, 5 aa, Mycobacterium avium
GTHPG

SEQ ID NO: 36745 - protein, 6 aa, Mycobacterium avium
GTHPGA

SEQ ID NO: 36746 - protein, 14 aa, Mycobacterium avium
GTIAQSGRSGGRPA

SEQ ID NO: 36747 - protein, 10 aa, Mycobacterium avium
GTIEPGKKAD

SEQ ID NO: 36748 - protein, 4 aa, Mycobacterium avium
GTIP

SEQ ID NO: 36749 - protein, 20 aa, Mycobacterium avium
GTIPKTPSGKLRRSNSVTLV

SEQ ID NO: 36750 - protein, 8 aa, Mycobacterium avium
GTITGEHG

SEQ ID NO: 36751 - protein, 15 aa, Mycobacterium avium
GTKAQVRDTRKTLPG

SEQ ID NO: 36752 - protein, 15 aa, Mycobacterium avium
GTKEDIKEAQNNGGS

SEQ ID NO: 36753 - protein, 8 aa, Mycobacterium avium
GTKGKRYA

SEQ ID NO: 36754 - protein, 8 aa, Mycobacterium avium
GTKMKAGD

SEQ ID NO: 36755 - protein, 9 aa, Mycobacterium avium
GTKNMPGAD

SEQ ID NO: 36756 - protein, 5 aa, Mycobacterium avium
GTLGT

SEQ ID NO: 36757 - protein, 6 aa, Mycobacterium avium
GTLPGE

SEQ ID NO: 36758 - protein, 7 aa, Mycobacterium avium
GTLPPGQ

SEQ ID NO: 36759 - protein, 8 aa, Mycobacterium avium
GTLSGNPV

SEQ ID NO: 36760 - protein, 11 aa, Mycobacterium avium
GTMDTDAGPQL

SEQ ID NO: 36761 - protein, 8 aa, Mycobacterium avium
GTNCENLP

SEQ ID NO: 36762 - protein, 8 aa, Mycobacterium avium
GTNGKTSV

SEQ ID NO: 36763 - protein, 10 aa, Mycobacterium avium
GTNGKTTTTS

SEQ ID NO: 36764 - protein, 8 aa, Mycobacterium avium
GTNRYGTR

SEQ ID NO: 36765 - protein, 12 aa, Mycobacterium avium
GTNTDPYQRAEG

SEQ ID NO: 36766 - protein, 15 aa, Mycobacterium avium
GTNTSPLAGKVPGHK

SEQ ID NO: 36767 - protein, 14 aa, Mycobacterium avium
GTPAGVGPIEDGDT

SEQ ID NO: 36768 - protein, 6 aa, Mycobacterium avium
GTPAWG

SEQ ID NO: 36769 - protein, 5 aa, Mycobacterium avium
GTPDL

SEQ ID NO: 36770 - protein, 9 aa, Mycobacterium avium
GTPDTPTQH

SEQ ID NO: 36771 - protein, 11 aa, Mycobacterium avium
GTPEEATGGPM

SEQ ID NO: 36772 - protein, 5 aa, Mycobacterium avium
GTPEQ

SEQ ID NO: 36773 - protein, 7 aa, Mycobacterium avium
GTPEQKQ

SEQ ID NO: 36774 - protein, 8 aa, Mycobacterium avium
GTPERDGL

SEQ ID NO: 36775 - protein, 10 aa, Mycobacterium avium
GTPFRSDDSP

SEQ ID NO: 36776 - protein, 8 aa, Mycobacterium avium
GTPGESDE

SEQ ID NO: 36777 - protein, 9 aa, Mycobacterium avium
GTPGTAAPL

SEQ ID NO: 36778 - protein, 5 aa, Mycobacterium avium
GTPHQ

SEQ ID NO: 36779 - protein, 5 aa, Mycobacterium avium
GTPIQ

SEQ ID NO: 36780 - protein, 15 aa, Mycobacterium avium
GTPLAPAKEGDADIR

SEQ ID NO: 36781 - protein, 6 aa, Mycobacterium avium
GTPPEH

SEQ ID NO: 36782 - protein, 7 aa, Mycobacterium avium
GTPPPTW

SEQ ID NO: 36783 - protein, 10 aa, Mycobacterium avium
GTPPPYPGWP

SEQ ID NO: 36784 - protein, 6 aa, Mycobacterium avium
GTPQAV

SEQ ID NO: 36785 - protein, 9 aa, Mycobacterium avium
GTPRPVSEQ

SEQ ID NO: 36786 - protein, 4 aa, Mycobacterium avium
GTPS

SEQ ID NO: 36787 - protein, 8 aa, Mycobacterium avium
GTPTAGVR

SEQ ID NO: 36788 - protein, 4 aa, Mycobacterium avium
GTPV

SEQ ID NO: 36789 - protein, 5 aa, Mycobacterium avium
GTPVD

SEQ ID NO: 36790 - protein, 12 aa, Mycobacterium avium
GTPVPPEPDEVE

SEQ ID NO: 36791 - protein, 5 aa, Mycobacterium avium
GTQIP

SEQ ID NO: 36792 - protein, 9 aa, Mycobacterium avium
GTQQPNGYT

SEQ ID NO: 36793 - protein, 7 aa, Mycobacterium avium
GTQRERL

SEQ ID NO: 36794 - protein, 6 aa, Mycobacterium avium
GTQTGV

SEQ ID NO: 36795 - protein, 5 aa, Mycobacterium avium
GTRDL

SEQ ID NO: 36796 - protein, 12 aa, Mycobacterium avium
GTREFSTPGRDD

SEQ ID NO: 36797 - protein, 8 aa, Mycobacterium avium
GTREQMAR

SEQ ID NO: 36798 - protein, 9 aa, Mycobacterium avium
GTRGGRPAL

SEQ ID NO: 36799 - protein, 9 aa, Mycobacterium avium
GTRPAKVDN

SEQ ID NO: 36800 - protein, 11 aa, Mycobacterium avium
GTRPARPSGVE

SEQ ID NO: 36801 - protein, 6 aa, Mycobacterium avium
GTRPSQ

SEQ ID NO: 36802 - protein, 10 aa, Mycobacterium avium
GTRQGARPPL

SEQ ID NO: 36803 - protein, 4 aa, Mycobacterium avium
GTRR

SEQ ID NO: 36804 - protein, 5 aa, Mycobacterium avium
GTRRP

SEQ ID NO: 36805 - protein, 4 aa, Mycobacterium avium
GTRS

SEQ ID NO: 36806 - protein, 5 aa, Mycobacterium avium
GTRTG

SEQ ID NO: 36807 - protein, 7 aa, Mycobacterium avium
GTSAAGP

SEQ ID NO: 36808 - protein, 8 aa, Mycobacterium avium
GTSAGGSL

SEQ ID NO: 36809 - protein, 8 aa, Mycobacterium avium
GTSDISKP

SEQ ID NO: 36810 - protein, 4 aa, Mycobacterium avium
GTSE

SEQ ID NO: 36811 - protein, 6 aa, Mycobacterium avium
GTSEIQ

SEQ ID NO: 36812 - protein, 9 aa, Mycobacterium avium
GTSGHRGSA

SEQ ID NO: 36813 - protein, 11 aa, Mycobacterium avium
GTSGMKSALNG

SEQ ID NO: 36814 - protein, 8 aa, Mycobacterium avium
GTSGNPKA

SEQ ID NO: 36815 - protein, 9 aa, Mycobacterium avium
GTSGNPKAV

SEQ ID NO: 36816 - protein, 7 aa, Mycobacterium avium
GTSGPQV

SEQ ID NO: 36817 - protein, 4 aa, Mycobacterium avium
GTSN

SEQ ID NO: 36818 - protein, 10 aa, Mycobacterium avium
GTSNDEIQAA

SEQ ID NO: 36819 - protein, 8 aa, Mycobacterium avium
GTSNGQTF

SEQ ID NO: 36820 - protein, 9 aa, Mycobacterium avium
GTSRANAPS

SEQ ID NO: 36821 - protein, 19 aa, Mycobacterium avium
GTSRNADESTRRRPSQRRR

SEQ ID NO: 36822 - protein, 13 aa, Mycobacterium avium
GTSRPQGRAAPRA

SEQ ID NO: 36823 - protein, 11 aa, Mycobacterium avium
GTTAHAQRHAA

SEQ ID NO: 36824 - protein, 5 aa, Mycobacterium avium
GTTAI

SEQ ID NO: 36825 - protein, 7 aa, Mycobacterium avium
GTTEQRD

SEQ ID NO: 36826 - protein, 7 aa, Mycobacterium avium
GTTGAPK

SEQ ID NO: 36827 - protein, 15 aa, Mycobacterium avium
GTTGESPTTTDDEKR

SEQ ID NO: 36828 - protein, 6 aa, Mycobacterium avium
GTTGFP

SEQ ID NO: 36829 - protein, 7 aa, Mycobacterium avium
GTTGLPK

SEQ ID NO: 36830 - protein, 19 aa, Mycobacterium avium
GTTGTPKGAKQSGGNAGIG

SEQ ID NO: 36831 - protein, 6 aa, Mycobacterium avium
GTTKET

SEQ ID NO: 36832 - protein, 6 aa, Mycobacterium avium
GTTLTE

SEQ ID NO: 36833 - protein, 6 aa, Mycobacterium avium
GTTVDP

SEQ ID NO: 36834 - protein, 14 aa, Mycobacterium avium
GTTYQIGAEIGVIT

SEQ ID NO: 36835 - protein, 4 aa, Mycobacterium avium
GTVD

SEQ ID NO: 36836 - protein, 12 aa, Mycobacterium avium
GTVDSATGQVDH

SEQ ID NO: 36837 - protein, 6 aa, Mycobacterium avium
GTVKSR

SEQ ID NO: 36838 - protein, 5 aa, Mycobacterium avium
GTVNG

SEQ ID NO: 36839 - protein, 4 aa, Mycobacterium avium
GTVQ

SEQ ID NO: 36840 - protein, 7 aa, Mycobacterium avium
GTVRDGV

SEQ ID NO: 36841 - protein, 11 aa, Mycobacterium avium
GTVSEHNATRN

SEQ ID NO: 36842 - protein, 10 aa, Mycobacterium avium
GTVSSPDAHA

SEQ ID NO: 36843 - protein, 10 aa, Mycobacterium avium
GTYDAEKFQD

SEQ ID NO: 36844 - protein, 25 aa, Mycobacterium avium
GTYDTASAAAAARGRVTATSQRKID

SEQ ID NO: 36845 - protein, 5 aa, Mycobacterium avium
GTYSR

SEQ ID NO: 36846 - protein, 12 aa, Mycobacterium avium
GVADAELNADPA

SEQ ID NO: 36847 - protein, 8 aa, Mycobacterium avium
GVADPDSW

SEQ ID NO: 36848 - protein, 12 aa, Mycobacterium avium
GVAEADKPAARK

SEQ ID NO: 36849 - protein, 8 aa, Mycobacterium avium
GVAEPQPM

SEQ ID NO: 36850 - protein, 7 aa, Mycobacterium avium
GVAPGQT

SEQ ID NO: 36851 - protein, 6 aa, Mycobacterium avium
GVAQSG

SEQ ID NO: 36852 - protein, 4 aa, Mycobacterium avium
GVAS

SEQ ID NO: 36853 - protein, 7 aa, Mycobacterium avium
GVDAATA

SEQ ID NO: 36854 - protein, 9 aa, Mycobacterium avium
GVDATGEFA

SEQ ID NO: 36855 - protein, 12 aa, Mycobacterium avium
GVDEDTGATTFA

SEQ ID NO: 36856 - protein, 8 aa, Mycobacterium avium
GVDEQGRR

SEQ ID NO: 36857 - protein, 5 aa, Mycobacterium avium
GVDER

SEQ ID NO: 36858 - protein, 8 aa, Mycobacterium avium
GVDGEHGP

SEQ ID NO: 36859 - protein, 7 aa, Mycobacterium avium
GVDGRDP

SEQ ID NO: 36860 - protein, 6 aa, Mycobacterium avium
GVDPAA

SEQ ID NO: 36861 - protein, 8 aa, Mycobacterium avium
GVDPGPEL

SEQ ID NO: 36862 - protein, 7 aa, Mycobacterium avium
GVDPGRV

SEQ ID NO: 36863 - protein, 16 aa, Mycobacterium avium
GVDPRRPAALPAERAA

SEQ ID NO: 36864 - protein, 4 aa, Mycobacterium avium
GVDS

SEQ ID NO: 36865 - protein, 4 aa, Mycobacterium avium
GVDT

SEQ ID NO: 36866 - protein, 8 aa, Mycobacterium avium
GVDTPSAY

SEQ ID NO: 36867 - protein, 9 aa, Mycobacterium avium
GVDTTTSQT

SEQ ID NO: 36868 - protein, 5 aa, Mycobacterium avium
GVEAG

SEQ ID NO: 36869 - protein, 8 aa, Mycobacterium avium
GVEANDGD

SEQ ID NO: 36870 - protein, 6 aa, Mycobacterium avium
GVEEAR

SEQ ID NO: 36871 - protein, 9 aa, Mycobacterium avium
GVEGQAYSA

SEQ ID NO: 36872 - protein, 9 aa, Mycobacterium avium
GVEPTDNPL

SEQ ID NO: 36873 - protein, 4 aa, Mycobacterium avium
GVER

SEQ ID NO: 36874 - protein, 11 aa, Mycobacterium avium
GVERSPTDEAI

SEQ ID NO: 36875 - protein, 7 aa, Mycobacterium avium
GVETPGV

SEQ ID NO: 36876 - protein, 5 aa, Mycobacterium avium
GVEVD

SEQ ID NO: 36877 - protein, 9 aa, Mycobacterium avium
GVGDRRQIA

SEQ ID NO: 36878 - protein, 11 aa, Mycobacterium avium
GVGEDITGGLP

SEQ ID NO: 36879 - protein, 6 aa, Mycobacterium avium
GVGEDQ

SEQ ID NO: 36880 - protein, 20 aa, Mycobacterium avium
GVGEGAPGRRSRARNASGSV

SEQ ID NO: 36881 - protein, 15 aa, Mycobacterium avium
GVGGQCGQRRAGGHH

SEQ ID NO: 36882 - protein, 5 aa, Mycobacterium avium
GVGGT

SEQ ID NO: 36883 - protein, 4 aa, Mycobacterium avium
GVGH

SEQ ID NO: 36884 - protein, 13 aa, Mycobacterium avium
GVGKGSAEPHKNK

SEQ ID NO: 36885 - protein, 6 aa, Mycobacterium avium
GVGKST

SEQ ID NO: 36886 - protein, 7 aa, Mycobacterium avium
GVGKTVA

SEQ ID NO: 36887 - protein, 4 aa, Mycobacterium avium
GVGN

SEQ ID NO: 36888 - protein, 7 aa, Mycobacterium avium
GVGNGDT

SEQ ID NO: 36889 - protein, 6 aa, Mycobacterium avium
GVGPDE

SEQ ID NO: 36890 - protein, 6 aa, Mycobacterium avium
GVGPGD

SEQ ID NO: 36891 - protein, 5 aa, Mycobacterium avium
GVGPT

SEQ ID NO: 36892 - protein, 9 aa, Mycobacterium avium
GVGTPGARE

SEQ ID NO: 36893 - protein, 19 aa, Mycobacterium avium
GVHSESEGVEPSRRVVVLH

SEQ ID NO: 36894 - protein, 7 aa, Mycobacterium avium
GVISRNQ

SEQ ID NO: 36895 - protein, 7 aa, Mycobacterium avium
GVKDTVE

SEQ ID NO: 36896 - protein, 4 aa, Mycobacterium avium
GVKE

SEQ ID NO: 36897 - protein, 10 aa, Mycobacterium avium
GVKGTSGMRK

SEQ ID NO: 36898 - protein, 5 aa, Mycobacterium avium
GVKRQ

SEQ ID NO: 36899 - protein, 4 aa, Mycobacterium avium
GVMP

SEQ ID NO: 36900 - protein, 6 aa, Mycobacterium avium
GVPAEY

SEQ ID NO: 36901 - protein, 6 aa, Mycobacterium avium
GVPAGA

SEQ ID NO: 36902 - protein, 7 aa, Mycobacterium avium
GVPAPQV

SEQ ID NO: 36903 - protein, 5 aa, Mycobacterium avium
GVPGA

SEQ ID NO: 36904 - protein, 5 aa, Mycobacterium avium
GVPGD

SEQ ID NO: 36905 - protein, 8 aa, Mycobacterium avium
GVPGELGE

SEQ ID NO: 36906 - protein, 18 aa, Mycobacterium avium
GVPGQARDTMGGPGSRGL

SEQ ID NO: 36907 - protein, 11 aa, Mycobacterium avium
GVPKEGEPPLD

SEQ ID NO: 36908 - protein, 7 aa, Mycobacterium avium
GVPQPET

SEQ ID NO: 36909 - protein, 7 aa, Mycobacterium avium
GVPTAQA

SEQ ID NO: 36910 - protein, 10 aa, Mycobacterium avium
GVQGDNRTYG

SEQ ID NO: 36911 - protein, 8 aa, Mycobacterium avium
GVQGETEV

SEQ ID NO: 36912 - protein, 5 aa, Mycobacterium avium
GVQGY

SEQ ID NO: 36913 - protein, 5 aa, Mycobacterium avium
GVRAQ

SEQ ID NO: 36914 - protein, 10 aa, Mycobacterium avium
GVREAAERGD

SEQ ID NO: 36915 - protein, 15 aa, Mycobacterium avium
GVRGDGGVLKNSEGK

SEQ ID NO: 36916 - protein, 7 aa, Mycobacterium avium
GVRGGGR

SEQ ID NO: 36917 - protein, 5 aa, Mycobacterium avium
GVRHG

SEQ ID NO: 36918 - protein, 4 aa, Mycobacterium avium
GVRP

SEQ ID NO: 36919 - protein, 13 aa, Mycobacterium avium
GVRPDKSRNHKGS

SEQ ID NO: 36920 - protein, 9 aa, Mycobacterium avium
GVRRTRSKF

SEQ ID NO: 36921 - protein, 4 aa, Mycobacterium avium
GVRT

SEQ ID NO: 36922 - protein, 29 aa, Mycobacterium avium
GVRTDGPAVAAPADVDPGGAEAVAGSPEH

SEQ ID NO: 36923 - protein, 6 aa, Mycobacterium avium
GVRTKR

SEQ ID NO: 36924 - protein, 9 aa, Mycobacterium avium
GVRTPHDEV

SEQ ID NO: 36925 - protein, 6 aa, Mycobacterium avium
GVSGTS

SEQ ID NO: 36926 - protein, 9 aa, Mycobacterium avium
GVSPDGSNQ

SEQ ID NO: 36927 - protein, 21 aa, Mycobacterium avium
GVSQDTRDVTTLGRGGSDTTA

SEQ ID NO: 36928 - protein, 8 aa, Mycobacterium avium
GVSRETIQ

SEQ ID NO: 36929 - protein, 6 aa, Mycobacterium avium
GVSRPE

SEQ ID NO: 36930 - protein, 25 aa, Mycobacterium avium
GVSSPPVASPPAEPLPPPPPREQPL

SEQ ID NO: 36931 - protein, 5 aa, Mycobacterium avium
GVSSY

SEQ ID NO: 36932 - protein, 8 aa, Mycobacterium avium
GVTAPAGF

SEQ ID NO: 36933 - protein, 10 aa, Mycobacterium avium
GVTDVPPEAV

SEQ ID NO: 36934 - protein, 13 aa, Mycobacterium avium
GVTGARDAVSHAA

SEQ ID NO: 36935 - protein, 8 aa, Mycobacterium avium
GVTGEPGM

SEQ ID NO: 36936 - protein, 9 aa, Mycobacterium avium
GVTGPDAEK

SEQ ID NO: 36937 - protein, 6 aa, Mycobacterium avium
GVTGQG

SEQ ID NO: 36938 - protein, 7 aa, Mycobacterium avium
GVTKSGL

SEQ ID NO: 36939 - protein, 10 aa, Mycobacterium avium
GVTPGNDGRG

SEQ ID NO: 36940 - protein, 8 aa, Mycobacterium avium
GVTPPGWR

SEQ ID NO: 36941 - protein, 6 aa, Mycobacterium avium
GVTQGH

SEQ ID NO: 36942 - protein, 8 aa, Mycobacterium avium
GVTSGASV

SEQ ID NO: 36943 - protein, 6 aa, Mycobacterium avium
GVTSGR

SEQ ID NO: 36944 - protein, 8 aa, Mycobacterium avium
GVTSPTEM

SEQ ID NO: 36945 - protein, 11 aa, Mycobacterium avium
GVVGEPGAGLE

SEQ ID NO: 36946 - protein, 4 aa, Mycobacterium avium
GVVP

SEQ ID NO: 36947 - protein, 14 aa, Mycobacterium avium
GVVPPDDEDDSAEH

SEQ ID NO: 36948 - protein, 4 aa, Mycobacterium avium
GWAP

SEQ ID NO: 36949 - protein, 5 aa, Mycobacterium avium
GWDRT

SEQ ID NO: 36950 - protein, 7 aa, Mycobacterium avium
GWGRPDT

SEQ ID NO: 36951 - protein, 8 aa, Mycobacterium avium
GWPDGGPR

SEQ ID NO: 36952 - protein, 13 aa, Mycobacterium avium
GWPEPTGVAATND

SEQ ID NO: 36953 - protein, 9 aa, Mycobacterium avium
GWPTDEGGE

SEQ ID NO: 36954 - protein, 11 aa, Mycobacterium avium
GWPTTDPDDHA

SEQ ID NO: 36955 - protein, 5 aa, Mycobacterium avium
GWQPG

SEQ ID NO: 36956 - protein, 6 aa, Mycobacterium avium
GWQPGD

SEQ ID NO: 36957 - protein, 11 aa, Mycobacterium avium
GWRADNTDIDG

SEQ ID NO: 36958 - protein, 5 aa, Mycobacterium avium
GWSPE

SEQ ID NO: 36959 - protein, 5 aa, Mycobacterium avium
GYAAD

SEQ ID NO: 36960 - protein, 7 aa, Mycobacterium avium
GYAATTV

SEQ ID NO: 36961 - protein, 8 aa, Mycobacterium avium
GYAGLSDT

SEQ ID NO: 36962 - protein, 5 aa, Mycobacterium avium
GYAGT

SEQ ID NO: 36963 - protein, 6 aa, Mycobacterium avium
GYAPGD

SEQ ID NO: 36964 - protein, 6 aa, Mycobacterium avium
GYAPNG

SEQ ID NO: 36965 - protein, 5 aa, Mycobacterium avium
GYDAT

SEQ ID NO: 36966 - protein, 10 aa, Mycobacterium avium
GYDNAGVPTF

SEQ ID NO: 36967 - protein, 8 aa, Mycobacterium avium
GYDPLTAQ

SEQ ID NO: 36968 - protein, 6 aa, Mycobacterium avium
GYDSSG

SEQ ID NO: 36969 - protein, 5 aa, Mycobacterium avium
GYDST

SEQ ID NO: 36970 - protein, 8 aa, Mycobacterium avium
GYEEQRAA

SEQ ID NO: 36971 - protein, 16 aa, Mycobacterium avium
GYEHPGDPRQPDNTHR

SEQ ID NO: 36972 - protein, 5 aa, Mycobacterium avium
GYENK

SEQ ID NO: 36973 - protein, 8 aa, Mycobacterium avium
GYETTSGA

SEQ ID NO: 36974 - protein, 9 aa, Mycobacterium avium
GYGDDARRN

SEQ ID NO: 36975 - protein, 5 aa, Mycobacterium avium
GYGEQ

SEQ ID NO: 36976 - protein, 13 aa, Mycobacterium avium
GYGGSDKPPRGYD

SEQ ID NO: 36977 - protein, 6 aa, Mycobacterium avium
GYGKQP

SEQ ID NO: 36978 - protein, 6 aa, Mycobacterium avium
GYGPGD

SEQ ID NO: 36979 - protein, 23 aa, Mycobacterium avium
GYGQTGPDAAKAGYASVAEAASG

SEQ ID NO: 36980 - protein, 9 aa, Mycobacterium avium
GYGYPEAGQ

SEQ ID NO: 36981 - protein, 7 aa, Mycobacterium avium
GYHRRED

SEQ ID NO: 36982 - protein, 4 aa, Mycobacterium avium
GYKA

SEQ ID NO: 36983 - protein, 14 aa, Mycobacterium avium
GYKMPGGTPSSPAL

SEQ ID NO: 36984 - protein, 8 aa, Mycobacterium avium
GYKQSGWG

SEQ ID NO: 36985 - protein, 9 aa, Mycobacterium avium
GYLPDTATA

SEQ ID NO: 36986 - protein, 7 aa, Mycobacterium avium
GYPDTES

SEQ ID NO: 36987 - protein, 8 aa, Mycobacterium avium
GYPDVPTS

SEQ ID NO: 36988 - protein, 8 aa, Mycobacterium avium
GYPGDRED

SEQ ID NO: 36989 - protein, 5 aa, Mycobacterium avium
GYPKG

SEQ ID NO: 36990 - protein, 5 aa, Mycobacterium avium
GYPPE

SEQ ID NO: 36991 - protein, 4 aa, Mycobacterium avium
GYPS

SEQ ID NO: 36992 - protein, 9 aa, Mycobacterium avium
GYPTEHRAA

SEQ ID NO: 36993 - protein, 9 aa, Mycobacterium avium
GYQPDQEPF

SEQ ID NO: 36994 - protein, 6 aa, Mycobacterium avium
GYQPTL

SEQ ID NO: 36995 - protein, 11 aa, Mycobacterium avium
GYRDPGALGGY

SEQ ID NO: 36996 - protein, 5 aa, Mycobacterium avium
GYRDT

SEQ ID NO: 36997 - protein, 7 aa, Mycobacterium avium
GYRETGM

SEQ ID NO: 36998 - protein, 15 aa, Mycobacterium avium
GYRPDPATGAVNTPI

SEQ ID NO: 36999 - protein, 4 aa, Mycobacterium avium
GYRR

SEQ ID NO: 37000 - protein, 10 aa, Mycobacterium avium
GYRRRTDSKD

SEQ ID NO: 37001 - protein, 6 aa, Mycobacterium avium
GYSELT

SEQ ID NO: 37002 - protein, 7 aa, Mycobacterium avium
GYSEQER

SEQ ID NO: 37003 - protein, 16 aa, Mycobacterium avium
GYSGLTKDKLVAKLRN

SEQ ID NO: 37004 - protein, 7 aa, Mycobacterium avium
GYSGTGL

SEQ ID NO: 37005 - protein, 4 aa, Mycobacterium avium
GYSQ

SEQ ID NO: 37006 - protein, 5 aa, Mycobacterium avium
GYSQE

SEQ ID NO: 37007 - protein, 5 aa, Mycobacterium avium
GYSRK

SEQ ID NO: 37008 - protein, 5 aa, Mycobacterium avium
GYSSS

SEQ ID NO: 37009 - protein, 17 aa, Mycobacterium avium
GYTASGDPQVDETAAEI

SEQ ID NO: 37010 - protein, 5 aa, Mycobacterium avium
GYTDA

SEQ ID NO: 37011 - protein, 7 aa, Mycobacterium avium
GYTEDDK

SEQ ID NO: 37012 - protein, 6 aa, Mycobacterium avium
GYTGEH

SEQ ID NO: 37013 - protein, 19 aa, Mycobacterium avium
GYTGGDVPNATYRNHGTHA

SEQ ID NO: 37014 - protein, 9 aa, Mycobacterium avium
GYTGSPTIE

SEQ ID NO: 37015 - protein, 6 aa, Mycobacterium avium
GYTRED

SEQ ID NO: 37016 - protein, 14 aa, Mycobacterium avium
GYTSPGRVKETAED

SEQ ID NO: 37017 - protein, 6 aa, Mycobacterium avium
GYTSSL

SEQ ID NO: 37018 - protein, 11 aa, Mycobacterium avium
GYTSTVATNSE

SEQ ID NO: 37019 - protein, 5 aa, Mycobacterium avium
GYTYG

SEQ ID NO: 37020 - protein, 8 aa, Mycobacterium avium
GYVEDSGM

SEQ ID NO: 37021 - protein, 7 aa, Mycobacterium avium
HAAAQQE

SEQ ID NO: 37022 - protein, 6 aa, Mycobacterium avium
HAAATG

SEQ ID NO: 37023 - protein, 5 aa, Mycobacterium avium
HAADA

SEQ ID NO: 37024 - protein, 11 aa, Mycobacterium avium
HAADSQPPGWS

SEQ ID NO: 37025 - protein, 4 aa, Mycobacterium avium
HAAE

SEQ ID NO: 37026 - protein, 6 aa, Mycobacterium avium
HAAEGF

SEQ ID NO: 37027 - protein, 4 aa, Mycobacterium avium
HAAG

SEQ ID NO: 37028 - protein, 7 aa, Mycobacterium avium
HAATNPD

SEQ ID NO: 37029 - protein, 8 aa, Mycobacterium avium
HADDNDME

SEQ ID NO: 37030 - protein, 5 aa, Mycobacterium avium
HADED

SEQ ID NO: 37031 - protein, 4 aa, Mycobacterium avium
HADN

SEQ ID NO: 37032 - protein, 6 aa, Mycobacterium avium
HADPQS

SEQ ID NO: 37033 - protein, 19 aa, Mycobacterium avium
HADQRRTDVTTTLGPGATV

SEQ ID NO: 37034 - protein, 7 aa, Mycobacterium avium
HAEADRL

SEQ ID NO: 37035 - protein, 8 aa, Mycobacterium avium
HAELPTER

SEQ ID NO: 37036 - protein, 5 aa, Mycobacterium avium
HAERD

SEQ ID NO: 37037 - protein, 5 aa, Mycobacterium avium
HAERL

SEQ ID NO: 37038 - protein, 9 aa, Mycobacterium avium
HAETGDDRA

SEQ ID NO: 37039 - protein, 4 aa, Mycobacterium avium
HAEY

SEQ ID NO: 37040 - protein, 9 aa, Mycobacterium avium
HAFSDDSRR

SEQ ID NO: 37041 - protein, 10 aa, Mycobacterium avium
HAGAHGGPSG

SEQ ID NO: 37042 - protein, 7 aa, Mycobacterium avium
HAGGEKA

SEQ ID NO: 37043 - protein, 7 aa, Mycobacterium avium
HAGNPQV

SEQ ID NO: 37044 - protein, 7 aa, Mycobacterium avium
HAGPAAV

SEQ ID NO: 37045 - protein, 13 aa, Mycobacterium avium
HAGQHPDSATNAR

SEQ ID NO: 37046 - protein, 14 aa, Mycobacterium avium
HAGSARLAQADAAN

SEQ ID NO: 37047 - protein, 7 aa, Mycobacterium avium
HAGTLDP

SEQ ID NO: 37048 - protein, 10 aa, Mycobacterium avium
HAHGSPGHGA

SEQ ID NO: 37049 - protein, 5 aa, Mycobacterium avium
HAKGE

SEQ ID NO: 37050 - protein, 11 aa, Mycobacterium avium
HAKGQDSQQDF

SEQ ID NO: 37051 - protein, 9 aa, Mycobacterium avium
HAKTDEDKL

SEQ ID NO: 37052 - protein, 13 aa, Mycobacterium avium
HALGGGMGAQSRH

SEQ ID NO: 37053 - protein, 8 aa, Mycobacterium avium
HANEEGRA

SEQ ID NO: 37054 - protein, 11 aa, Mycobacterium avium
HAPAGDQPAAI

SEQ ID NO: 37055 - protein, 14 aa, Mycobacterium avium
HAPDGTTVRDPETL

SEQ ID NO: 37056 - protein, 19 aa, Mycobacterium avium
HAPELPQGHPVSSAPYGSA

SEQ ID NO: 37057 - protein, 5 aa, Mycobacterium avium
HAPGG

SEQ ID NO: 37058 - protein, 6 aa, Mycobacterium avium
HAPHAE

SEQ ID NO: 37059 - protein, 7 aa, Mycobacterium avium
HAPPELQ

SEQ ID NO: 37060 - protein, 8 aa, Mycobacterium avium
HAPSAWSA

SEQ ID NO: 37061 - protein, 10 aa, Mycobacterium avium
HARSEGERAA

SEQ ID NO: 37062 - protein, 9 aa, Mycobacterium avium
HARSTGPYS

SEQ ID NO: 37063 - protein, 11 aa, Mycobacterium avium
HASTAGSQLEV

SEQ ID NO: 37064 - protein, 5 aa, Mycobacterium avium
HASTK

SEQ ID NO: 37065 - protein, 10 aa, Mycobacterium avium
HATADPDTFT

SEQ ID NO: 37066 - protein, 7 aa, Mycobacterium avium
HATDPTP

SEQ ID NO: 37067 - protein, 9 aa, Mycobacterium avium
HATEFAGTA

SEQ ID NO: 37068 - protein, 5 aa, Mycobacterium avium
HATEY

SEQ ID NO: 37069 - protein, 8 aa, Mycobacterium avium
HAYGGGSQ

SEQ ID NO: 37070 - protein, 11 aa, Mycobacterium avium
HAYRGDRPMAD

SEQ ID NO: 37071 - protein, 7 aa, Mycobacterium avium
HAYTGDG

SEQ ID NO: 37072 - protein, 9 aa, Mycobacterium avium
HCESGDEIA

SEQ ID NO: 37073 - protein, 14 aa, Mycobacterium avium
HDAAAQEYGSEERA

SEQ ID NO: 37074 - protein, 6 aa, Mycobacterium avium
HDAAGR

SEQ ID NO: 37075 - protein, 6 aa, Mycobacterium avium
HDAEAF

SEQ ID NO: 37076 - protein, 5 aa, Mycobacterium avium
HDAGR

SEQ ID NO: 37077 - protein, 5 aa, Mycobacterium avium
HDASV

SEQ ID NO: 37078 - protein, 7 aa, Mycobacterium avium
HDATPSQ

SEQ ID NO: 37079 - protein, 8 aa, Mycobacterium avium
HDDGPRPT

SEQ ID NO: 37080 - protein, 8 aa, Mycobacterium avium
HDDPDQLR

SEQ ID NO: 37081 - protein, 6 aa, Mycobacterium avium
HDDPLA

SEQ ID NO: 37082 - protein, 5 aa, Mycobacterium avium
HDDPM

SEQ ID NO: 37083 - protein, 4 aa, Mycobacterium avium
HDDS

SEQ ID NO: 37084 - protein, 7 aa, Mycobacterium avium
HDDSVGE

SEQ ID NO: 37085 - protein, 7 aa, Mycobacterium avium
HDEADER

SEQ ID NO: 37086 - protein, 5 aa, Mycobacterium avium
HDEPG

SEQ ID NO: 37087 - protein, 7 aa, Mycobacterium avium
HDERTGW

SEQ ID NO: 37088 - protein, 6 aa, Mycobacterium avium
HDESKL

SEQ ID NO: 37089 - protein, 4 aa, Mycobacterium avium
HDET

SEQ ID NO: 37090 - protein, 11 aa, Mycobacterium avium
HDGAAGSAGAM

SEQ ID NO: 37091 - protein, 6 aa, Mycobacterium avium
HDGGRR

SEQ ID NO: 37092 - protein, 11 aa, Mycobacterium avium
HDGGTGATPLT

SEQ ID NO: 37093 - protein, 16 aa, Mycobacterium avium
HDGQTQTATKQVRGGF

SEQ ID NO: 37094 - protein, 8 aa, Mycobacterium avium
HDGVASGS

SEQ ID NO: 37095 - protein, 4 aa, Mycobacterium avium
HDHD

SEQ ID NO: 37096 - protein, 6 aa, Mycobacterium avium
HDHPDG

SEQ ID NO: 37097 - protein, 6 aa, Mycobacterium avium
HDHQTA

SEQ ID NO: 37098 - protein, 10 aa, Mycobacterium avium
HDKSTATTVR

SEQ ID NO: 37099 - protein, 6 aa, Mycobacterium avium
HDLDDP

SEQ ID NO: 37100 - protein, 5 aa, Mycobacterium avium
HDLGP

SEQ ID NO: 37101 - protein, 8 aa, Mycobacterium avium
HDLPPTAG

SEQ ID NO: 37102 - protein, 4 aa, Mycobacterium avium
HDLR

SEQ ID NO: 37103 - protein, 11 aa, Mycobacterium avium
HDNTSTSFAGG

SEQ ID NO: 37104 - protein, 6 aa, Mycobacterium avium
HDPAAR

SEQ ID NO: 37105 - protein, 5 aa, Mycobacterium avium
HDPAR

SEQ ID NO: 37106 - protein, 6 aa, Mycobacterium avium
HDPDKL

SEQ ID NO: 37107 - protein, 7 aa, Mycobacterium avium
HDPDQHA

SEQ ID NO: 37108 - protein, 7 aa, Mycobacterium avium
HDPEGTL

SEQ ID NO: 37109 - protein, 13 aa, Mycobacterium avium
HDPRTGDYRLGPA

SEQ ID NO: 37110 - protein, 13 aa, Mycobacterium avium
HDPRTGEQRRADA

SEQ ID NO: 37111 - protein, 4 aa, Mycobacterium avium
HDQR

SEQ ID NO: 37112 - protein, 6 aa, Mycobacterium avium
HDQTPH

SEQ ID NO: 37113 - protein, 6 aa, Mycobacterium avium
HDRARE

SEQ ID NO: 37114 - protein, 7 aa, Mycobacterium avium
HDRSEAK

SEQ ID NO: 37115 - protein, 4 aa, Mycobacterium avium
HDRT

SEQ ID NO: 37116 - protein, 7 aa, Mycobacterium avium
HDSRVGG

SEQ ID NO: 37117 - protein, 7 aa, Mycobacterium avium
HDTAGDY

SEQ ID NO: 37118 - protein, 8 aa, Mycobacterium avium
HDTDHQGK

SEQ ID NO: 37119 - protein, 4 aa, Mycobacterium avium
HDTE

SEQ ID NO: 37120 - protein, 7 aa, Mycobacterium avium
HDTLDND

SEQ ID NO: 37121 - protein, 6 aa, Mycobacterium avium
HDTPDA

SEQ ID NO: 37122 - protein, 8 aa, Mycobacterium avium
HDTPGGQL

SEQ ID NO: 37123 - protein, 5 aa, Mycobacterium avium
HDTPY

SEQ ID NO: 37124 - protein, 15 aa, Mycobacterium avium
HDTSTLANDPNETEL

SEQ ID NO: 37125 - protein, 6 aa, Mycobacterium avium
HDTTNR

SEQ ID NO: 37126 - protein, 11 aa, Mycobacterium avium
HDVGRARGGVR

SEQ ID NO: 37127 - protein, 4 aa, Mycobacterium avium
HDVH

SEQ ID NO: 37128 - protein, 15 aa, Mycobacterium avium
HEAAGAAVRAAEQRA

SEQ ID NO: 37129 - protein, 17 aa, Mycobacterium avium
HEADSSHAFSALFGGHG

SEQ ID NO: 37130 - protein, 7 aa, Mycobacterium avium
HEAENDD

SEQ ID NO: 37131 - protein, 7 aa, Mycobacterium avium
HEARTDA

SEQ ID NO: 37132 - protein, 7 aa, Mycobacterium avium
HEDPLSS

SEQ ID NO: 37133 - protein, 5 aa, Mycobacterium avium
HEDQK

SEQ ID NO: 37134 - protein, 6 aa, Mycobacterium avium
HEEARQ

SEQ ID NO: 37135 - protein, 9 aa, Mycobacterium avium
HEGAPGQQE

SEQ ID NO: 37136 - protein, 6 aa, Mycobacterium avium
HEGESD

SEQ ID NO: 37137 - protein, 4 aa, Mycobacterium avium
HEGG

SEQ ID NO: 37138 - protein, 9 aa, Mycobacterium avium
HEGGGSAHE

SEQ ID NO: 37139 - protein, 5 aa, Mycobacterium avium
HEGKG

SEQ ID NO: 37140 - protein, 8 aa, Mycobacterium avium
HEGPTAAR

SEQ ID NO: 37141 - protein, 12 aa, Mycobacterium avium
HEGQGPDHTSAR

SEQ ID NO: 37142 - protein, 14 aa, Mycobacterium avium
HEKAAAAQDSGAFD

SEQ ID NO: 37143 - protein, 14 aa, Mycobacterium avium
HEKDTAAAVAILET

SEQ ID NO: 37144 - protein, 15 aa, Mycobacterium avium
HELPDTDYRRTNPRF

SEQ ID NO: 37145 - protein, 9 aa, Mycobacterium avium
HEPDRSDAA

SEQ ID NO: 37146 - protein, 4 aa, Mycobacterium avium
HEPE

SEQ ID NO: 37147 - protein, 5 aa, Mycobacterium avium
HEPGQ

SEQ ID NO: 37148 - protein, 5 aa, Mycobacterium avium
HEPGV

SEQ ID NO: 37149 - protein, 7 aa, Mycobacterium avium
HEPRGPQ

SEQ ID NO: 37150 - protein, 9 aa, Mycobacterium avium
HEPVGSNPL

SEQ ID NO: 37151 - protein, 6 aa, Mycobacterium avium
HEQQRA

SEQ ID NO: 37152 - protein, 6 aa, Mycobacterium avium
HEQTAT

SEQ ID NO: 37153 - protein, 10 aa, Mycobacterium avium
HESDDALAGE

SEQ ID NO: 37154 - protein, 7 aa, Mycobacterium avium
HESPVKG

SEQ ID NO: 37155 - protein, 4 aa, Mycobacterium avium
HEST

SEQ ID NO: 37156 - protein, 5 aa, Mycobacterium avium
HETAH

SEQ ID NO: 37157 - protein, 6 aa, Mycobacterium avium
HETTSN

SEQ ID NO: 37158 - protein, 10 aa, Mycobacterium avium
HEVGTGGQAE

SEQ ID NO: 37159 - protein, 6 aa, Mycobacterium avium
HGADPV

SEQ ID NO: 37160 - protein, 6 aa, Mycobacterium avium
HGAEPD

SEQ ID NO: 37161 - protein, 4 aa, Mycobacterium avium
HGAP

SEQ ID NO: 37162 - protein, 9 aa, Mycobacterium avium
HGAPSEQAR

SEQ ID NO: 37163 - protein, 6 aa, Mycobacterium avium
HGATPG

SEQ ID NO: 37164 - protein, 4 aa, Mycobacterium avium
HGDA

SEQ ID NO: 37165 - protein, 7 aa, Mycobacterium avium
HGDARRT

SEQ ID NO: 37166 - protein, 7 aa, Mycobacterium avium
HGDERRQ

SEQ ID NO: 37167 - protein, 12 aa, Mycobacterium avium
HGDGPQVSGPGE

SEQ ID NO: 37168 - protein, 5 aa, Mycobacterium avium
HGDPA

SEQ ID NO: 37169 - protein, 10 aa, Mycobacterium avium
HGDPADPKTY

SEQ ID NO: 37170 - protein, 6 aa, Mycobacterium avium
HGDTNA

SEQ ID NO: 37171 - protein, 21 aa, Mycobacterium avium
HGEPAIPTTQIPADRRRPPGI

SEQ ID NO: 37172 - protein, 8 aa, Mycobacterium avium
HGEPDEEK

SEQ ID NO: 37173 - protein, 7 aa, Mycobacterium avium
HGETADA

SEQ ID NO: 37174 - protein, 4 aa, Mycobacterium avium
HGFS

SEQ ID NO: 37175 - protein, 8 aa, Mycobacterium avium
HGGDGADR

SEQ ID NO: 37176 - protein, 11 aa, Mycobacterium avium
HGGDVATGVTV

SEQ ID NO: 37177 - protein, 4 aa, Mycobacterium avium
HGGE

SEQ ID NO: 37178 - protein, 5 aa, Mycobacterium avium
HGGEV

SEQ ID NO: 37179 - protein, 4 aa, Mycobacterium avium
HGGG

SEQ ID NO: 37180 - protein, 4 aa, Mycobacterium avium
HGGP

SEQ ID NO: 37181 - protein, 11 aa, Mycobacterium avium
HGGQPWSDAGL

SEQ ID NO: 37182 - protein, 5 aa, Mycobacterium avium
HGGRE

SEQ ID NO: 37183 - protein, 21 aa, Mycobacterium avium
HGGRNAHGRITTRHKGGGHKR

SEQ ID NO: 37184 - protein, 7 aa, Mycobacterium avium
HGGRPPV

SEQ ID NO: 37185 - protein, 11 aa, Mycobacterium avium
HGGRQANGGLP

SEQ ID NO: 37186 - protein, 7 aa, Mycobacterium avium
HGGRQLD

SEQ ID NO: 37187 - protein, 6 aa, Mycobacterium avium
HGHEPP

SEQ ID NO: 37188 - protein, 4 aa, Mycobacterium avium
HGHG

SEQ ID NO: 37189 - protein, 9 aa, Mycobacterium avium
HGHPPGPTM

SEQ ID NO: 37190 - protein, 8 aa, Mycobacterium avium
HGIDPNAI

SEQ ID NO: 37191 - protein, 7 aa, Mycobacterium avium
HGKEPQW

SEQ ID NO: 37192 - protein, 4 aa, Mycobacterium avium
HGKP

SEQ ID NO: 37193 - protein, 7 aa, Mycobacterium avium
HGKTPPC

SEQ ID NO: 37194 - protein, 8 aa, Mycobacterium avium
HGLPPAEP

SEQ ID NO: 37195 - protein, 5 aa, Mycobacterium avium
HGLSD

SEQ ID NO: 37196 - protein, 5 aa, Mycobacterium avium
HGLSE

SEQ ID NO: 37197 - protein, 5 aa, Mycobacterium avium
HGMNA

SEQ ID NO: 37198 - protein, 6 aa, Mycobacterium avium
HGNDDA

SEQ ID NO: 37199 - protein, 7 aa, Mycobacterium avium
HGNQPQY

SEQ ID NO: 37200 - protein, 6 aa, Mycobacterium avium
HGNRQR

SEQ ID NO: 37201 - protein, 4 aa, Mycobacterium avium
HGPD

SEQ ID NO: 37202 - protein, 17 aa, Mycobacterium avium
HGPGSPEGEAASAQLPK

SEQ ID NO: 37203 - protein, 10 aa, Mycobacterium avium
HGPGTPVGDP

SEQ ID NO: 37204 - protein, 15 aa, Mycobacterium avium
HGPKPRDYSQRTPKK

SEQ ID NO: 37205 - protein, 9 aa, Mycobacterium avium
HGPNSGAGA

SEQ ID NO: 37206 - protein, 12 aa, Mycobacterium avium
HGPPGTGKTHTA

SEQ ID NO: 37207 - protein, 4 aa, Mycobacterium avium
HGQA

SEQ ID NO: 37208 - protein, 5 aa, Mycobacterium avium
HGQHD

SEQ ID NO: 37209 - protein, 11 aa, Mycobacterium avium
HGQNPQAACDG

SEQ ID NO: 37210 - protein, 11 aa, Mycobacterium avium
HGQPLDDERNA

SEQ ID NO: 37211 - protein, 12 aa, Mycobacterium avium
HGQSDKPRADYS

SEQ ID NO: 37212 - protein, 4 aa, Mycobacterium avium
HGRA

SEQ ID NO: 37213 - protein, 4 aa, Mycobacterium avium
HGRD

SEQ ID NO: 37214 - protein, 8 aa, Mycobacterium avium
HGRDATEV

SEQ ID NO: 37215 - protein, 6 aa, Mycobacterium avium
HGRFPT

SEQ ID NO: 37216 - protein, 7 aa, Mycobacterium avium
HGRGDSQ

SEQ ID NO: 37217 - protein, 6 aa, Mycobacterium avium
HGRGGF

SEQ ID NO: 37218 - protein, 7 aa, Mycobacterium avium
HGRPRTN

SEQ ID NO: 37219 - protein, 8 aa, Mycobacterium avium
HGRSSWSA

SEQ ID NO: 37220 - protein, 9 aa, Mycobacterium avium
HGSEEHQAG

SEQ ID NO: 37221 - protein, 4 aa, Mycobacterium avium
HGSG

SEQ ID NO: 37222 - protein, 8 aa, Mycobacterium avium
HGTDEQKQ

SEQ ID NO: 37223 - protein, 11 aa, Mycobacterium avium
HGTGTALGDPI

SEQ ID NO: 37224 - protein, 12 aa, Mycobacterium avium
HGTGTPVGDPIE

SEQ ID NO: 37225 - protein, 12 aa, Mycobacterium avium
HGTGTRLGDRTE

SEQ ID NO: 37226 - protein, 11 aa, Mycobacterium avium
HGTGTSLGDPI

SEQ ID NO: 37227 - protein, 7 aa, Mycobacterium avium
HGTPKQV

SEQ ID NO: 37228 - protein, 4 aa, Mycobacterium avium
HGTR

SEQ ID NO: 37229 - protein, 6 aa, Mycobacterium avium
HGTTQG

SEQ ID NO: 37230 - protein, 11 aa, Mycobacterium avium
HGVGPSESVEA

SEQ ID NO: 37231 - protein, 5 aa, Mycobacterium avium
HGVPR

SEQ ID NO: 37232 - protein, 5 aa, Mycobacterium avium
HGVPT

SEQ ID NO: 37233 - protein, 4 aa, Mycobacterium avium
HHDP

SEQ ID NO: 37234 - protein, 15 aa, Mycobacterium avium
HHGAPEKARERARRK

SEQ ID NO: 37235 - protein, 4 aa, Mycobacterium avium
HHKG

SEQ ID NO: 37236 - protein, 6 aa, Mycobacterium avium
HHPDGS

SEQ ID NO: 37237 - protein, 5 aa, Mycobacterium avium
HHPST

SEQ ID NO: 37238 - protein, 4 aa, Mycobacterium avium
HIET

SEQ ID NO: 37239 - protein, 5 aa, Mycobacterium avium
HIGPS

SEQ ID NO: 37240 - protein, 10 aa, Mycobacterium avium
HKAGGQDTPI

SEQ ID NO: 37241 - protein, 6 aa, Mycobacterium avium
HKGSLS

SEQ ID NO: 37242 - protein, 6 aa, Mycobacterium avium
HKIGPG

SEQ ID NO: 37243 - protein, 10 aa, Mycobacterium avium
HKKQTGGSGQ

SEQ ID NO: 37244 - protein, 5 aa, Mycobacterium avium
HKPGA

SEQ ID NO: 37245 - protein, 6 aa, Mycobacterium avium
HKPGAE

SEQ ID NO: 37246 - protein, 11 aa, Mycobacterium avium
HKPTFAPNVDG

SEQ ID NO: 37247 - protein, 5 aa, Mycobacterium avium
HKTKV

SEQ ID NO: 37248 - protein, 8 aa, Mycobacterium avium
HKYKDSRE

SEQ ID NO: 37249 - protein, 6 aa, Mycobacterium avium
HLDGST

SEQ ID NO: 37250 - protein, 6 aa, Mycobacterium avium
HLGDRA

SEQ ID NO: 37251 - protein, 8 aa, Mycobacterium avium
HLGDSRGL

SEQ ID NO: 37252 - protein, 10 aa, Mycobacterium avium
HLPPGSKPRW

SEQ ID NO: 37253 - protein, 9 aa, Mycobacterium avium
HLPRERADQ

SEQ ID NO: 37254 - protein, 6 aa, Mycobacterium avium
HLRPRS

SEQ ID NO: 37255 - protein, 7 aa, Mycobacterium avium
HLRSSQR

SEQ ID NO: 37256 - protein, 8 aa, Mycobacterium avium
HNDRGTAV

SEQ ID NO: 37257 - protein, 9 aa, Mycobacterium avium
HNEGNKDLT

SEQ ID NO: 37258 - protein, 8 aa, Mycobacterium avium
HNGAGKST

SEQ ID NO: 37259 - protein, 10 aa, Mycobacterium avium
HNGASHQDPG

SEQ ID NO: 37260 - protein, 8 aa, Mycobacterium avium
HNGSPRAL

SEQ ID NO: 37261 - protein, 18 aa, Mycobacterium avium
HNMANGEDNRDGESHNRS

SEQ ID NO: 37262 - protein, 7 aa, Mycobacterium avium
HNPAGAA

SEQ ID NO: 37263 - protein, 8 aa, Mycobacterium avium
HNPTGSVH

SEQ ID NO: 37264 - protein, 6 aa, Mycobacterium avium
HNQPRI

SEQ ID NO: 37265 - protein, 7 aa, Mycobacterium avium
HNRDNSQ

SEQ ID NO: 37266 - protein, 9 aa, Mycobacterium avium
HNREQRPIN

SEQ ID NO: 37267 - protein, 4 aa, Mycobacterium avium
HNTP

SEQ ID NO: 37268 - protein, 6 aa, Mycobacterium avium
HPAARG

SEQ ID NO: 37269 - protein, 8 aa, Mycobacterium avium
HPAATKAD

SEQ ID NO: 37270 - protein, 7 aa, Mycobacterium avium
HPADRPQ

SEQ ID NO: 37271 - protein, 4 aa, Mycobacterium avium
HPAE

SEQ ID NO: 37272 - protein, 8 aa, Mycobacterium avium
HPAHRPGD

SEQ ID NO: 37273 - protein, 7 aa, Mycobacterium avium
HPANGQP

SEQ ID NO: 37274 - protein, 8 aa, Mycobacterium avium
HPAPPGAP

SEQ ID NO: 37275 - protein, 9 aa, Mycobacterium avium
HPDAADEPV

SEQ ID NO: 37276 - protein, 7 aa, Mycobacterium avium
HPDAPGV

SEQ ID NO: 37277 - protein, 12 aa, Mycobacterium avium
HPDATLEEAQEN

SEQ ID NO: 37278 - protein, 6 aa, Mycobacterium avium
HPDAVN

SEQ ID NO: 37279 - protein, 10 aa, Mycobacterium avium
HPDDARLGPP

SEQ ID NO: 37280 - protein, 6 aa, Mycobacterium avium
HPDDER

SEQ ID NO: 37281 - protein, 7 aa, Mycobacterium avium
HPDDETL

SEQ ID NO: 37282 - protein, 7 aa, Mycobacterium avium
HPDDRAR

SEQ ID NO: 37283 - protein, 8 aa, Mycobacterium avium
HPDGLSDP

SEQ ID NO: 37284 - protein, 6 aa, Mycobacterium avium
HPDGSL

SEQ ID NO: 37285 - protein, 12 aa, Mycobacterium avium
HPDLPVDTATDD

SEQ ID NO: 37286 - protein, 6 aa, Mycobacterium avium
HPDPAM

SEQ ID NO: 37287 - protein, 4 aa, Mycobacterium avium
HPDQ

SEQ ID NO: 37288 - protein, 9 aa, Mycobacterium avium
HPDRTEGDL

SEQ ID NO: 37289 - protein, 4 aa, Mycobacterium avium
HPDT

SEQ ID NO: 37290 - protein, 5 aa, Mycobacterium avium
HPDTA

SEQ ID NO: 37291 - protein, 5 aa, Mycobacterium avium
HPDTD

SEQ ID NO: 37292 - protein, 4 aa, Mycobacterium avium
HPEE

SEQ ID NO: 37293 - protein, 10 aa, Mycobacterium avium
HPEELGTGYQ

SEQ ID NO: 37294 - protein, 4 aa, Mycobacterium avium
HPEL

SEQ ID NO: 37295 - protein, 7 aa, Mycobacterium avium
HPEPELA

SEQ ID NO: 37296 - protein, 5 aa, Mycobacterium avium
HPEQR

SEQ ID NO: 37297 - protein, 8 aa, Mycobacterium avium
HPEYQNRD

SEQ ID NO: 37298 - protein, 12 aa, Mycobacterium avium
HPEYSAPECTDP

SEQ ID NO: 37299 - protein, 10 aa, Mycobacterium avium
HPGAADAEQP

SEQ ID NO: 37300 - protein, 15 aa, Mycobacterium avium
HPGASPESGPGDPVA

SEQ ID NO: 37301 - protein, 4 aa, Mycobacterium avium
HPGG

SEQ ID NO: 37302 - protein, 6 aa, Mycobacterium avium
HPGGGA

SEQ ID NO: 37303 - protein, 6 aa, Mycobacterium avium
HPGGPK

SEQ ID NO: 37304 - protein, 6 aa, Mycobacterium avium
HPGNVN

SEQ ID NO: 37305 - protein, 8 aa, Mycobacterium avium
HPGPTKTA

SEQ ID NO: 37306 - protein, 12 aa, Mycobacterium avium
HPGPVNTPMGSG

SEQ ID NO: 37307 - protein, 17 aa, Mycobacterium avium
HPGQPQAWTPEESRFAR

SEQ ID NO: 37308 - protein, 8 aa, Mycobacterium avium
HPGQTGPY

SEQ ID NO: 37309 - protein, 4 aa, Mycobacterium avium
HPGR

SEQ ID NO: 37310 - protein, 5 aa, Mycobacterium avium
HPGRT

SEQ ID NO: 37311 - protein, 6 aa, Mycobacterium avium
HPGYSH

SEQ ID NO: 37312 - protein, 12 aa, Mycobacterium avium
HPHGDPNSGEYR

SEQ ID NO: 37313 - protein, 35 aa, Mycobacterium avium
HPHGGGEGKTSGGRHPVSPWGKPEGRTRHPNKASN

SEQ ID NO: 37314 - protein, 10 aa, Mycobacterium avium
HPHRDPRTGE

SEQ ID NO: 37315 - protein, 4 aa, Mycobacterium avium
HPIG

SEQ ID NO: 37316 - protein, 4 aa, Mycobacterium avium
HPIP

SEQ ID NO: 37317 - protein, 6 aa, Mycobacterium avium
HPISGA

SEQ ID NO: 37318 - protein, 15 aa, Mycobacterium avium
HPKVDDRAGVPAGTT

SEQ ID NO: 37319 - protein, 6 aa, Mycobacterium avium
HPLGAR

SEQ ID NO: 37320 - protein, 13 aa, Mycobacterium avium
HPMPASDGEFGSD

SEQ ID NO: 37321 - protein, 7 aa, Mycobacterium avium
HPNDPTA

SEQ ID NO: 37322 - protein, 8 aa, Mycobacterium avium
HPNEGREL

SEQ ID NO: 37323 - protein, 6 aa, Mycobacterium avium
HPNGAD

SEQ ID NO: 37324 - protein, 4 aa, Mycobacterium avium
HPNP

SEQ ID NO: 37325 - protein, 12 aa, Mycobacterium avium
HPPGKPERARTE

SEQ ID NO: 37326 - protein, 6 aa, Mycobacterium avium
HPPLSK

SEQ ID NO: 37327 - protein, 4 aa, Mycobacterium avium
HPPY

SEQ ID NO: 37328 - protein, 16 aa, Mycobacterium avium
HPRARAGLDRASGRIP

SEQ ID NO: 37329 - protein, 8 aa, Mycobacterium avium
HPRDARLG

SEQ ID NO: 37330 - protein, 6 aa, Mycobacterium avium
HPRPDF

SEQ ID NO: 37331 - protein, 6 aa, Mycobacterium avium
HPRTLG

SEQ ID NO: 37332 - protein, 12 aa, Mycobacterium avium
HPRYGDDDGWEQ

SEQ ID NO: 37333 - protein, 12 aa, Mycobacterium avium
HPSDGGRSRYTW

SEQ ID NO: 37334 - protein, 6 aa, Mycobacterium avium
HPSETV

SEQ ID NO: 37335 - protein, 6 aa, Mycobacterium avium
HPSGVE

SEQ ID NO: 37336 - protein, 5 aa, Mycobacterium avium
HPSIG

SEQ ID NO: 37337 - protein, 6 aa, Mycobacterium avium
HPSPVP

SEQ ID NO: 37338 - protein, 30 aa, Mycobacterium avium
HPSSSSDNVNSTVAKRQAAAGTAPVRQGPP

SEQ ID NO: 37339 - protein, 25 aa, Mycobacterium avium
HPTAEQAQGARRAAAACPALAIRVE

SEQ ID NO: 37340 - protein, 5 aa, Mycobacterium avium
HPTAS

SEQ ID NO: 37341 - protein, 8 aa, Mycobacterium avium
HPTDPQGE

SEQ ID NO: 37342 - protein, 4 aa, Mycobacterium avium
HPTE

SEQ ID NO: 37343 - protein, 6 aa, Mycobacterium avium
HPTEDD

SEQ ID NO: 37344 - protein, 6 aa, Mycobacterium avium
HPTESY

SEQ ID NO: 37345 - protein, 7 aa, Mycobacterium avium
HPTETRR

SEQ ID NO: 37346 - protein, 5 aa, Mycobacterium avium
HPTNV

SEQ ID NO: 37347 - protein, 15 aa, Mycobacterium avium
HPTRADALDDAARAE

SEQ ID NO: 37348 - protein, 6 aa, Mycobacterium avium
HPTTEG

SEQ ID NO: 37349 - protein, 12 aa, Mycobacterium avium
HPVPKPRPALQY

SEQ ID NO: 37350 - protein, 10 aa, Mycobacterium avium
HPVPKRGEIT

SEQ ID NO: 37351 - protein, 5 aa, Mycobacterium avium
HPVPP

SEQ ID NO: 37352 - protein, 6 aa, Mycobacterium avium
HPVTGG

SEQ ID NO: 37353 - protein, 5 aa, Mycobacterium avium
HPYEE

SEQ ID NO: 37354 - protein, 8 aa, Mycobacterium avium
HQARAQAS

SEQ ID NO: 37355 - protein, 15 aa, Mycobacterium avium
HQDDQVAQRVSGADH

SEQ ID NO: 37356 - protein, 16 aa, Mycobacterium avium
HQDGDHPINDSEEVQR

SEQ ID NO: 37357 - protein, 18 aa, Mycobacterium avium
HQDGGPNPINSSAEVQRT

SEQ ID NO: 37358 - protein, 7 aa, Mycobacterium avium
HQDGTPD

SEQ ID NO: 37359 - protein, 20 aa, Mycobacterium avium
HQDRQQERDRRLLDKSRYFD

SEQ ID NO: 37360 - protein, 9 aa, Mycobacterium avium
HQDSTGNRG

SEQ ID NO: 37361 - protein, 6 aa, Mycobacterium avium
HQDTSE

SEQ ID NO: 37362 - protein, 15 aa, Mycobacterium avium
HQGEGVASGKRDQRD

SEQ ID NO: 37363 - protein, 6 aa, Mycobacterium avium
HQGGPL

SEQ ID NO: 37364 - protein, 5 aa, Mycobacterium avium
HQGKR

SEQ ID NO: 37365 - protein, 14 aa, Mycobacterium avium
HQGNSTESPEEADA

SEQ ID NO: 37366 - protein, 17 aa, Mycobacterium avium
HQNGDHPINDSDEVQRV

SEQ ID NO: 37367 - protein, 4 aa, Mycobacterium avium
HQPD

SEQ ID NO: 37368 - protein, 13 aa, Mycobacterium avium
HQRAADREREAAR

SEQ ID NO: 37369 - protein, 8 aa, Mycobacterium avium
HQTADGRE

SEQ ID NO: 37370 - protein, 5 aa, Mycobacterium avium
HQVGE

SEQ ID NO: 37371 - protein, 5 aa, Mycobacterium avium
HRADY

SEQ ID NO: 37372 - protein, 7 aa, Mycobacterium avium
HRAGGAA

SEQ ID NO: 37373 - protein, 27 aa, Mycobacterium avium
HRASPVEDRRPLPPRTAETVAPGGQSQ

SEQ ID NO: 37374 - protein, 9 aa, Mycobacterium avium
HRDAPSRDA

SEQ ID NO: 37375 - protein, 7 aa, Mycobacterium avium
HRDDIDP

SEQ ID NO: 37376 - protein, 14 aa, Mycobacterium avium
HRDEHAEEKDGRTL

SEQ ID NO: 37377 - protein, 4 aa, Mycobacterium avium
HRDG

SEQ ID NO: 37378 - protein, 10 aa, Mycobacterium avium
HRDRAQAREL

SEQ ID NO: 37379 - protein, 7 aa, Mycobacterium avium
HRDRRPA

SEQ ID NO: 37380 - protein, 9 aa, Mycobacterium avium
HRDRTDDQV

SEQ ID NO: 37381 - protein, 7 aa, Mycobacterium avium
HRDTERS

SEQ ID NO: 37382 - protein, 8 aa, Mycobacterium avium
HRDTTRQR

SEQ ID NO: 37383 - protein, 5 aa, Mycobacterium avium
HRDWS

SEQ ID NO: 37384 - protein, 14 aa, Mycobacterium avium
HREAVRDSRIGPTR

SEQ ID NO: 37385 - protein, 6 aa, Mycobacterium avium
HREHTR

SEQ ID NO: 37386 - protein, 14 aa, Mycobacterium avium
HREKRAARFTGGSA

SEQ ID NO: 37387 - protein, 8 aa, Mycobacterium avium
HRERGQGR

SEQ ID NO: 37388 - protein, 10 aa, Mycobacterium avium
HRGDDTQERI

SEQ ID NO: 37389 - protein, 7 aa, Mycobacterium avium
HRGGDRP

SEQ ID NO: 37390 - protein, 6 aa, Mycobacterium avium
HRGPVE

SEQ ID NO: 37391 - protein, 10 aa, Mycobacterium avium
HRGSGAPDGL

SEQ ID NO: 37392 - protein, 8 aa, Mycobacterium avium
HRGSHERY

SEQ ID NO: 37393 - protein, 4 aa, Mycobacterium avium
HRGT

SEQ ID NO: 37394 - protein, 8 aa, Mycobacterium avium
HRGTGARG

SEQ ID NO: 37395 - protein, 8 aa, Mycobacterium avium
HRHSPQGT

SEQ ID NO: 37396 - protein, 6 aa, Mycobacterium avium
HRNEAA

SEQ ID NO: 37397 - protein, 6 aa, Mycobacterium avium
HRNTTA

SEQ ID NO: 37398 - protein, 4 aa, Mycobacterium avium
HRPA

SEQ ID NO: 37399 - protein, 11 aa, Mycobacterium avium
HRPADKERATK

SEQ ID NO: 37400 - protein, 5 aa, Mycobacterium avium
HRPAG

SEQ ID NO: 37401 - protein, 10 aa, Mycobacterium avium
HRPARPGTID

SEQ ID NO: 37402 - protein, 5 aa, Mycobacterium avium
HRPEV

SEQ ID NO: 37403 - protein, 6 aa, Mycobacterium avium
HRPHST

SEQ ID NO: 37404 - protein, 11 aa, Mycobacterium avium
HRPPREPADRH

SEQ ID NO: 37405 - protein, 8 aa, Mycobacterium avium
HRPRAGDR

SEQ ID NO: 37406 - protein, 30 aa, Mycobacterium avium
HRQAAAEDRKLAERKRRESAADLASPASAS

SEQ ID NO: 37407 - protein, 6 aa, Mycobacterium avium
HRQAPV

SEQ ID NO: 37408 - protein, 9 aa, Mycobacterium avium
HRQPQGDDI

SEQ ID NO: 37409 - protein, 10 aa, Mycobacterium avium
HRQRPGTAQG

SEQ ID NO: 37410 - protein, 6 aa, Mycobacterium avium
HRQRRD

SEQ ID NO: 37411 - protein, 13 aa, Mycobacterium avium
HRRPGSIGGCATP

SEQ ID NO: 37412 - protein, 6 aa, Mycobacterium avium
HRRRGY

SEQ ID NO: 37413 - protein, 11 aa, Mycobacterium avium
HRRTDSRARRL

SEQ ID NO: 37414 - protein, 7 aa, Mycobacterium avium
HRRTQRS

SEQ ID NO: 37415 - protein, 6 aa, Mycobacterium avium
HRSAGA

SEQ ID NO: 37416 - protein, 8 aa, Mycobacterium avium
HRSTEPGH

SEQ ID NO: 37417 - protein, 4 aa, Mycobacterium avium
HRTP

SEQ ID NO: 37418 - protein, 8 aa, Mycobacterium avium
HSAGSEII

SEQ ID NO: 37419 - protein, 8 aa, Mycobacterium avium
HSATSSLL

SEQ ID NO: 37420 - protein, 7 aa, Mycobacterium avium
HSAWPSK

SEQ ID NO: 37421 - protein, 11 aa, Mycobacterium avium
HSDDRDKARRL

SEQ ID NO: 37422 - protein, 11 aa, Mycobacterium avium
HSERSGEPIEP

SEQ ID NO: 37423 - protein, 7 aa, Mycobacterium avium
HSGAARM

SEQ ID NO: 37424 - protein, 5 aa, Mycobacterium avium
HSGDL

SEQ ID NO: 37425 - protein, 9 aa, Mycobacterium avium
HSGDSTDVG

SEQ ID NO: 37426 - protein, 9 aa, Mycobacterium avium
HSGKAEVKG

SEQ ID NO: 37427 - protein, 11 aa, Mycobacterium avium
HSGPAPQEEYG

SEQ ID NO: 37428 - protein, 11 aa, Mycobacterium avium
HSGYPGGLRSR

SEQ ID NO: 37429 - protein, 12 aa, Mycobacterium avium
HSHRRTSRRWNP

SEQ ID NO: 37430 - protein, 10 aa, Mycobacterium avium
HSNGDHTHGN

SEQ ID NO: 37431 - protein, 6 aa, Mycobacterium avium
HSNQTV

SEQ ID NO: 37432 - protein, 7 aa, Mycobacterium avium
HSNSSAH

SEQ ID NO: 37433 - protein, 9 aa, Mycobacterium avium
HSPDTAGGL

SEQ ID NO: 37434 - protein, 7 aa, Mycobacterium avium
HSPERRA

SEQ ID NO: 37435 - protein, 13 aa, Mycobacterium avium
HSPKGPQATGVRS

SEQ ID NO: 37436 - protein, 5 aa, Mycobacterium avium
HSQGK

SEQ ID NO: 37437 - protein, 7 aa, Mycobacterium avium
HSRPFRP

SEQ ID NO: 37438 - protein, 6 aa, Mycobacterium avium
HSSSTH

SEQ ID NO: 37439 - protein, 9 aa, Mycobacterium avium
HSTADSYQA

SEQ ID NO: 37440 - protein, 5 aa, Mycobacterium avium
HSTPG

SEQ ID NO: 37441 - protein, 4 aa, Mycobacterium avium
HSTQ

SEQ ID NO: 37442 - protein, 6 aa, Mycobacterium avium
HSTQRQ

SEQ ID NO: 37443 - protein, 4 aa, Mycobacterium avium
HSTR

SEQ ID NO: 37444 - protein, 10 aa, Mycobacterium avium
HSVDDPEPKY

SEQ ID NO: 37445 - protein, 5 aa, Mycobacterium avium
HSYKG

SEQ ID NO: 37446 - protein, 6 aa, Mycobacterium avium
HTAAAT

SEQ ID NO: 37447 - protein, 5 aa, Mycobacterium avium
HTAGG

SEQ ID NO: 37448 - protein, 13 aa, Mycobacterium avium
HTAGTSSQISDGA

SEQ ID NO: 37449 - protein, 8 aa, Mycobacterium avium
HTAPDDIP

SEQ ID NO: 37450 - protein, 5 aa, Mycobacterium avium
HTATR

SEQ ID NO: 37451 - protein, 15 aa, Mycobacterium avium
HTDENTPIPVLLAVA

SEQ ID NO: 37452 - protein, 4 aa, Mycobacterium avium
HTDP

SEQ ID NO: 37453 - protein, 4 aa, Mycobacterium avium
HTDS

SEQ ID NO: 37454 - protein, 6 aa, Mycobacterium avium
HTDTLG

SEQ ID NO: 37455 - protein, 7 aa, Mycobacterium avium
HTENASA

SEQ ID NO: 37456 - protein, 24 aa, Mycobacterium avium
HTEPGLQGDRSSAGTKPATVETGA

SEQ ID NO: 37457 - protein, 5 aa, Mycobacterium avium
HTEQG

SEQ ID NO: 37458 - protein, 4 aa, Mycobacterium avium
HTES

SEQ ID NO: 37459 - protein, 6 aa, Mycobacterium avium
HTESAA

SEQ ID NO: 37460 - protein, 7 aa, Mycobacterium avium
HTGGGEV

SEQ ID NO: 37461 - protein, 10 aa, Mycobacterium avium
HTGGNSSGIV

SEQ ID NO: 37462 - protein, 11 aa, Mycobacterium avium
HTGGNSSGIVD

SEQ ID NO: 37463 - protein, 14 aa, Mycobacterium avium
HTGPLRPSETGRPI

SEQ ID NO: 37464 - protein, 10 aa, Mycobacterium avium
HTGPVHEGDT

SEQ ID NO: 37465 - protein, 6 aa, Mycobacterium avium
HTGQPA

SEQ ID NO: 37466 - protein, 6 aa, Mycobacterium avium
HTKGPK

SEQ ID NO: 37467 - protein, 10 aa, Mycobacterium avium
HTKTTRELAS

SEQ ID NO: 37468 - protein, 14 aa, Mycobacterium avium
HTMPPTLAQGTNQA

SEQ ID NO: 37469 - protein, 5 aa, Mycobacterium avium
HTNAL

SEQ ID NO: 37470 - protein, 7 aa, Mycobacterium avium
HTNAQRT

SEQ ID NO: 37471 - protein, 6 aa, Mycobacterium avium
HTPGRT

SEQ ID NO: 37472 - protein, 5 aa, Mycobacterium avium
HTPGS

SEQ ID NO: 37473 - protein, 7 aa, Mycobacterium avium
HTPYPEL

SEQ ID NO: 37474 - protein, 6 aa, Mycobacterium avium
HTRAES

SEQ ID NO: 37475 - protein, 4 aa, Mycobacterium avium
HTRG

SEQ ID NO: 37476 - protein, 7 aa, Mycobacterium avium
HTRPEDV

SEQ ID NO: 37477 - protein, 4 aa, Mycobacterium avium
HTSP

SEQ ID NO: 37478 - protein, 8 aa, Mycobacterium avium
HTSSGTSA

SEQ ID NO: 37479 - protein, 10 aa, Mycobacterium avium
HTTGDLDAQA

SEQ ID NO: 37480 - protein, 16 aa, Mycobacterium avium
HTTPGKSQIGGASNAG

SEQ ID NO: 37481 - protein, 8 aa, Mycobacterium avium
HTTSTGTT

SEQ ID NO: 37482 - protein, 6 aa, Mycobacterium avium
HTVEPP

SEQ ID NO: 37483 - protein, 6 aa, Mycobacterium avium
HVEAGT

SEQ ID NO: 37484 - protein, 8 aa, Mycobacterium avium
HVGGNNAV

SEQ ID NO: 37485 - protein, 8 aa, Mycobacterium avium
HVGSGRGV

SEQ ID NO: 37486 - protein, 7 aa, Mycobacterium avium
HVRTGSD

SEQ ID NO: 37487 - protein, 6 aa, Mycobacterium avium
HVSAAE

SEQ ID NO: 37488 - protein, 8 aa, Mycobacterium avium
HVSEPERR

SEQ ID NO: 37489 - protein, 5 aa, Mycobacterium avium
HYDKS

SEQ ID NO: 37490 - protein, 5 aa, Mycobacterium avium
HYDPA

SEQ ID NO: 37491 - protein, 7 aa, Mycobacterium avium
HYDPDNT

SEQ ID NO: 37492 - protein, 9 aa, Mycobacterium avium
HYGAGRNQS

SEQ ID NO: 37493 - protein, 6 aa, Mycobacterium avium
HYGGGD

SEQ ID NO: 37494 - protein, 11 aa, Mycobacterium avium
HYGSPDKDPAV

SEQ ID NO: 37495 - protein, 5 aa, Mycobacterium avium
HYPAD

SEQ ID NO: 37496 - protein, 5 aa, Mycobacterium avium
HYPED

SEQ ID NO: 37497 - protein, 4 aa, Mycobacterium avium
HYRN

SEQ ID NO: 37498 - protein, 9 aa, Mycobacterium avium
IAANGGRKP

SEQ ID NO: 37499 - protein, 18 aa, Mycobacterium avium
IAASNAAVASRKSDPRLH

SEQ ID NO: 37500 - protein, 9 aa, Mycobacterium avium
IADGRHDDQ

SEQ ID NO: 37501 - protein, 7 aa, Mycobacterium avium
IAEAEGA

SEQ ID NO: 37502 - protein, 8 aa, Mycobacterium avium
IAEAGTAQ

SEQ ID NO: 37503 - protein, 7 aa, Mycobacterium avium
IAEESER

SEQ ID NO: 37504 - protein, 7 aa, Mycobacterium avium
IAEGGKR

SEQ ID NO: 37505 - protein, 6 aa, Mycobacterium avium
IAEGTT

SEQ ID NO: 37506 - protein, 4 aa, Mycobacterium avium
IAES

SEQ ID NO: 37507 - protein, 16 aa, Mycobacterium avium
IAESGGSELADELEQN

SEQ ID NO: 37508 - protein, 15 aa, Mycobacterium avium
IAETKKADLNANDID

SEQ ID NO: 37509 - protein, 4 aa, Mycobacterium avium
IAGA

SEQ ID NO: 37510 - protein, 6 aa, Mycobacterium avium
IAGAEK

SEQ ID NO: 37511 - protein, 5 aa, Mycobacterium avium
IAGEK

SEQ ID NO: 37512 - protein, 8 aa, Mycobacterium avium
IAGGASGI

SEQ ID NO: 37513 - protein, 15 aa, Mycobacterium avium
IAGIDGQGAAASGLL

SEQ ID NO: 37514 - protein, 10 aa, Mycobacterium avium
IAGKDPDYNR

SEQ ID NO: 37515 - protein, 14 aa, Mycobacterium avium
IAGNRGQTNYATTK

SEQ ID NO: 37516 - protein, 9 aa, Mycobacterium avium
IAGPDGQPL

SEQ ID NO: 37517 - protein, 5 aa, Mycobacterium avium
IAGPG

SEQ ID NO: 37518 - protein, 13 aa, Mycobacterium avium
IAGPGGGTEEKPV

SEQ ID NO: 37519 - protein, 11 aa, Mycobacterium avium
IAGPGPVDVEN

SEQ ID NO: 37520 - protein, 10 aa, Mycobacterium avium
IAGPKRPQDR

SEQ ID NO: 37521 - protein, 10 aa, Mycobacterium avium
IAGPNSDGDD

SEQ ID NO: 37522 - protein, 7 aa, Mycobacterium avium
IAGPRNA

SEQ ID NO: 37523 - protein, 15 aa, Mycobacterium avium
IAGRPAASIEQHDGQ

SEQ ID NO: 37524 - protein, 4 aa, Mycobacterium avium
IAGS

SEQ ID NO: 37525 - protein, 5 aa, Mycobacterium avium
IAGSS

SEQ ID NO: 37526 - protein, 8 aa, Mycobacterium avium
IAGTPERP

SEQ ID NO: 37527 - protein, 7 aa, Mycobacterium avium
IAKGTAA

SEQ ID NO: 37528 - protein, 9 aa, Mycobacterium avium
IAKSHDPAE

SEQ ID NO: 37529 - protein, 4 aa, Mycobacterium avium
IAKT

SEQ ID NO: 37530 - protein, 4 aa, Mycobacterium avium
IANG

SEQ ID NO: 37531 - protein, 6 aa, Mycobacterium avium
IAPDGS

SEQ ID NO: 37532 - protein, 4 aa, Mycobacterium avium
IAPG

SEQ ID NO: 37533 - protein, 11 aa, Mycobacterium avium
IAPGDDERGTV

SEQ ID NO: 37534 - protein, 8 aa, Mycobacterium avium
IAPPDAAG

SEQ ID NO: 37535 - protein, 9 aa, Mycobacterium avium
IAPPDPDGK

SEQ ID NO: 37536 - protein, 8 aa, Mycobacterium avium
IAPSGDPH

SEQ ID NO: 37537 - protein, 4 aa, Mycobacterium avium
IAPT

SEQ ID NO: 37538 - protein, 7 aa, Mycobacterium avium
IAQGDDE

SEQ ID NO: 37539 - protein, 5 aa, Mycobacterium avium
IARGR

SEQ ID NO: 37540 - protein, 12 aa, Mycobacterium avium
IARHGSSEQQQR

SEQ ID NO: 37541 - protein, 20 aa, Mycobacterium avium
IARKSENPSITRDVSGEGVQ

SEQ ID NO: 37542 - protein, 11 aa, Mycobacterium avium
IASAPSSAQHT

SEQ ID NO: 37543 - protein, 6 aa, Mycobacterium avium
IASPGS

SEQ ID NO: 37544 - protein, 10 aa, Mycobacterium avium
IASRGTLAQK

SEQ ID NO: 37545 - protein, 7 aa, Mycobacterium avium
IASTGMA

SEQ ID NO: 37546 - protein, 14 aa, Mycobacterium avium
IATDSTAAVPAPDR

SEQ ID NO: 37547 - protein, 4 aa, Mycobacterium avium
IATG

SEQ ID NO: 37548 - protein, 7 aa, Mycobacterium avium
IATGPGQ

SEQ ID NO: 37549 - protein, 9 aa, Mycobacterium avium
IATNADNPL

SEQ ID NO: 37550 - protein, 7 aa, Mycobacterium avium
IATNEPK

SEQ ID NO: 37551 - protein, 9 aa, Mycobacterium avium
IATQGAEVS

SEQ ID NO: 37552 - protein, 13 aa, Mycobacterium avium
IATTRAAAGPGPL

SEQ ID NO: 37553 - protein, 4 aa, Mycobacterium avium
IAVT

SEQ ID NO: 37554 - protein, 11 aa, Mycobacterium avium
ICNPADPNTWK

SEQ ID NO: 37555 - protein, 8 aa, Mycobacterium avium
IDADAADK

SEQ ID NO: 37556 - protein, 7 aa, Mycobacterium avium
IDAHPGD

SEQ ID NO: 37557 - protein, 7 aa, Mycobacterium avium
IDANPAS

SEQ ID NO: 37558 - protein, 5 aa, Mycobacterium avium
IDASA

SEQ ID NO: 37559 - protein, 14 aa, Mycobacterium avium
IDASDEGMADYSGP

SEQ ID NO: 37560 - protein, 4 aa, Mycobacterium avium
IDDA

SEQ ID NO: 37561 - protein, 7 aa, Mycobacterium avium
IDDPEAD

SEQ ID NO: 37562 - protein, 5 aa, Mycobacterium avium
IDEDG

SEQ ID NO: 37563 - protein, 5 aa, Mycobacterium avium
IDEGA

SEQ ID NO: 37564 - protein, 5 aa, Mycobacterium avium
IDEGP

SEQ ID NO: 37565 - protein, 4 aa, Mycobacterium avium
IDEP

SEQ ID NO: 37566 - protein, 13 aa, Mycobacterium avium
IDEPDEMSPYAPR

SEQ ID NO: 37567 - protein, 7 aa, Mycobacterium avium
IDEPRQR

SEQ ID NO: 37568 - protein, 9 aa, Mycobacterium avium
IDERADPKV

SEQ ID NO: 37569 - protein, 22 aa, Mycobacterium avium
IDESDDDGAADQNAKAPETAEG

SEQ ID NO: 37570 - protein, 24 aa, Mycobacterium avium
IDETTGAAPSDTAPNYNVAPTSTI

SEQ ID NO: 37571 - protein, 9 aa, Mycobacterium avium
IDGEKLSDE

SEQ ID NO: 37572 - protein, 11 aa, Mycobacterium avium
IDGGDTPETAR

SEQ ID NO: 37573 - protein, 22 aa, Mycobacterium avium
IDGIRSASSNKPLALPADPREI

SEQ ID NO: 37574 - protein, 12 aa, Mycobacterium avium
IDGKPTAITPAH

SEQ ID NO: 37575 - protein, 4 aa, Mycobacterium avium
IDGQ

SEQ ID NO: 37576 - protein, 20 aa, Mycobacterium avium
IDGQEVPGATAQGLSHEVGS

SEQ ID NO: 37577 - protein, 8 aa, Mycobacterium avium
IDGQPKSV

SEQ ID NO: 37578 - protein, 5 aa, Mycobacterium avium
IDGSG

SEQ ID NO: 37579 - protein, 8 aa, Mycobacterium avium
IDGSSSAI

SEQ ID NO: 37580 - protein, 9 aa, Mycobacterium avium
IDGSVTPTL

SEQ ID NO: 37581 - protein, 4 aa, Mycobacterium avium
IDGT

SEQ ID NO: 37582 - protein, 4 aa, Mycobacterium avium
IDGV

SEQ ID NO: 37583 - protein, 9 aa, Mycobacterium avium
IDKSTEKTL

SEQ ID NO: 37584 - protein, 6 aa, Mycobacterium avium
IDKTVA

SEQ ID NO: 37585 - protein, 9 aa, Mycobacterium avium
IDNEASDKA

SEQ ID NO: 37586 - protein, 6 aa, Mycobacterium avium
IDNGRE

SEQ ID NO: 37587 - protein, 6 aa, Mycobacterium avium
IDNPDS

SEQ ID NO: 37588 - protein, 10 aa, Mycobacterium avium
IDPAHTRSKL

SEQ ID NO: 37589 - protein, 7 aa, Mycobacterium avium
IDPEKTP

SEQ ID NO: 37590 - protein, 5 aa, Mycobacterium avium
IDPER

SEQ ID NO: 37591 - protein, 13 aa, Mycobacterium avium
IDPGDKSFKTSGC

SEQ ID NO: 37592 - protein, 29 aa, Mycobacterium avium
IDPGPEFTNADGSLRYPDDTLPTKPYAVP

SEQ ID NO: 37593 - protein, 7 aa, Mycobacterium avium
IDPRDTR

SEQ ID NO: 37594 - protein, 7 aa, Mycobacterium avium
IDPTPGL

SEQ ID NO: 37595 - protein, 7 aa, Mycobacterium avium
IDPTSAE

SEQ ID NO: 37596 - protein, 16 aa, Mycobacterium avium
IDQKSTNRNPRSTVGT

SEQ ID NO: 37597 - protein, 7 aa, Mycobacterium avium
IDRDGAQ

SEQ ID NO: 37598 - protein, 15 aa, Mycobacterium avium
IDREERKGKGASDHA

SEQ ID NO: 37599 - protein, 12 aa, Mycobacterium avium
IDSGGGSEEEEV

SEQ ID NO: 37600 - protein, 7 aa, Mycobacterium avium
IDSGREP

SEQ ID NO: 37601 - protein, 11 aa, Mycobacterium avium
IDSKTLDDEHR

SEQ ID NO: 37602 - protein, 16 aa, Mycobacterium avium
IDTAPGDLPRGWSDRT

SEQ ID NO: 37603 - protein, 8 aa, Mycobacterium avium
IDTEPDGA

SEQ ID NO: 37604 - protein, 6 aa, Mycobacterium avium
IDTGEK

SEQ ID NO: 37605 - protein, 7 aa, Mycobacterium avium
IDTQPTG

SEQ ID NO: 37606 - protein, 7 aa, Mycobacterium avium
IDVPTHD

SEQ ID NO: 37607 - protein, 8 aa, Mycobacterium avium
IEADPANP

SEQ ID NO: 37608 - protein, 10 aa, Mycobacterium avium
IEATKKALAR

SEQ ID NO: 37609 - protein, 5 aa, Mycobacterium avium
IEATT

SEQ ID NO: 37610 - protein, 16 aa, Mycobacterium avium
IECSTGSACTAGVAQP

SEQ ID NO: 37611 - protein, 7 aa, Mycobacterium avium
IEDPGER

SEQ ID NO: 37612 - protein, 4 aa, Mycobacterium avium
IEEG

SEQ ID NO: 37613 - protein, 32 aa, Mycobacterium avium
IEEGKGAKAGPSRQRKPAKSSAARGRTKAPAN

SEQ ID NO: 37614 - protein, 11 aa, Mycobacterium avium
IEEGQQVKRTG

SEQ ID NO: 37615 - protein, 5 aa, Mycobacterium avium
IEEGR

SEQ ID NO: 37616 - protein, 16 aa, Mycobacterium avium
IEGAQQRGETDPHVNP

SEQ ID NO: 37617 - protein, 6 aa, Mycobacterium avium
IEGGRR

SEQ ID NO: 37618 - protein, 6 aa, Mycobacterium avium
IEGQKT

SEQ ID NO: 37619 - protein, 7 aa, Mycobacterium avium
IEGTPVT

SEQ ID NO: 37620 - protein, 4 aa, Mycobacterium avium
IEIP

SEQ ID NO: 37621 - protein, 11 aa, Mycobacterium avium
IEKTDSDWDRE

SEQ ID NO: 37622 - protein, 8 aa, Mycobacterium avium
IENDPAVA

SEQ ID NO: 37623 - protein, 8 aa, Mycobacterium avium
IENGTKLG

SEQ ID NO: 37624 - protein, 10 aa, Mycobacterium avium
IEPGPAADDL

SEQ ID NO: 37625 - protein, 7 aa, Mycobacterium avium
IEPGQRY

SEQ ID NO: 37626 - protein, 5 aa, Mycobacterium avium
IEPGS

SEQ ID NO: 37627 - protein, 8 aa, Mycobacterium avium
IEPKPDAA

SEQ ID NO: 37628 - protein, 5 aa, Mycobacterium avium
IEPNT

SEQ ID NO: 37629 - protein, 4 aa, Mycobacterium avium
IEPR

SEQ ID NO: 37630 - protein, 8 aa, Mycobacterium avium
IEPRTGRQ

SEQ ID NO: 37631 - protein, 17 aa, Mycobacterium avium
IEQPPEHPDAISTAPQR

SEQ ID NO: 37632 - protein, 22 aa, Mycobacterium avium
IEQSTPLGPSLDTTTAPSTVRS

SEQ ID NO: 37633 - protein, 9 aa, Mycobacterium avium
IERAKGAPH

SEQ ID NO: 37634 - protein, 6 aa, Mycobacterium avium
IERPPE

SEQ ID NO: 37635 - protein, 8 aa, Mycobacterium avium
IERRTKES

SEQ ID NO: 37636 - protein, 7 aa, Mycobacterium avium
IERSGRS

SEQ ID NO: 37637 - protein, 9 aa, Mycobacterium avium
IERTAGDEG

SEQ ID NO: 37638 - protein, 14 aa, Mycobacterium avium
IESDPINNYYIARK

SEQ ID NO: 37639 - protein, 4 aa, Mycobacterium avium
IETE

SEQ ID NO: 37640 - protein, 15 aa, Mycobacterium avium
IETGRRACDFRQKAP

SEQ ID NO: 37641 - protein, 4 aa, Mycobacterium avium
IETS

SEQ ID NO: 37642 - protein, 10 aa, Mycobacterium avium
IETSPREKAT

SEQ ID NO: 37643 - protein, 4 aa, Mycobacterium avium
IGAD

SEQ ID NO: 37644 - protein, 8 aa, Mycobacterium avium
IGADPNKI

SEQ ID NO: 37645 - protein, 8 aa, Mycobacterium avium
IGAGGFDD

SEQ ID NO: 37646 - protein, 10 aa, Mycobacterium avium
IGAGRGKGGT

SEQ ID NO: 37647 - protein, 20 aa, Mycobacterium avium
IGAKQGTDMVKGGANQLPTS

SEQ ID NO: 37648 - protein, 9 aa, Mycobacterium avium
IGANGGAKP

SEQ ID NO: 37649 - protein, 4 aa, Mycobacterium avium
IGAT

SEQ ID NO: 37650 - protein, 7 aa, Mycobacterium avium
IGDGGRT

SEQ ID NO: 37651 - protein, 17 aa, Mycobacterium avium
IGDTPKPQIREEAARRG

SEQ ID NO: 37652 - protein, 6 aa, Mycobacterium avium
IGEALP

SEQ ID NO: 37653 - protein, 11 aa, Mycobacterium avium
IGENDAAVRRD

SEQ ID NO: 37654 - protein, 15 aa, Mycobacterium avium
IGEPEPAGRPADPPF

SEQ ID NO: 37655 - protein, 4 aa, Mycobacterium avium
IGER

SEQ ID NO: 37656 - protein, 9 aa, Mycobacterium avium
IGERGRAGL

SEQ ID NO: 37657 - protein, 4 aa, Mycobacterium avium
IGES

SEQ ID NO: 37658 - protein, 5 aa, Mycobacterium avium
IGETK

SEQ ID NO: 37659 - protein, 14 aa, Mycobacterium avium
IGFPPTPSGHTQTY

SEQ ID NO: 37660 - protein, 6 aa, Mycobacterium avium
IGGASD

SEQ ID NO: 37661 - protein, 8 aa, Mycobacterium avium
IGGDGRAK

SEQ ID NO: 37662 - protein, 6 aa, Mycobacterium avium
IGGEEA

SEQ ID NO: 37663 - protein, 6 aa, Mycobacterium avium
IGGGCP

SEQ ID NO: 37664 - protein, 14 aa, Mycobacterium avium
IGGKAERDARTDEL

SEQ ID NO: 37665 - protein, 7 aa, Mycobacterium avium
IGGPQPV

SEQ ID NO: 37666 - protein, 6 aa, Mycobacterium avium
IGGQET

SEQ ID NO: 37667 - protein, 7 aa, Mycobacterium avium
IGGQGPQ

SEQ ID NO: 37668 - protein, 9 aa, Mycobacterium avium
IGGQTTGDT

SEQ ID NO: 37669 - protein, 9 aa, Mycobacterium avium
IGGSDGAGG

SEQ ID NO: 37670 - protein, 7 aa, Mycobacterium avium
IGGTPEG

SEQ ID NO: 37671 - protein, 4 aa, Mycobacterium avium
IGND

SEQ ID NO: 37672 - protein, 6 aa, Mycobacterium avium
IGNTTA

SEQ ID NO: 37673 - protein, 5 aa, Mycobacterium avium
IGPAA

SEQ ID NO: 37674 - protein, 14 aa, Mycobacterium avium
IGPAEGATGGAEFG

SEQ ID NO: 37675 - protein, 10 aa, Mycobacterium avium
IGPAKAAYPN

SEQ ID NO: 37676 - protein, 4 aa, Mycobacterium avium
IGPD

SEQ ID NO: 37677 - protein, 8 aa, Mycobacterium avium
IGPDPATG

SEQ ID NO: 37678 - protein, 7 aa, Mycobacterium avium
IGPDPQA

SEQ ID NO: 37679 - protein, 5 aa, Mycobacterium avium
IGPDR

SEQ ID NO: 37680 - protein, 6 aa, Mycobacterium avium
IGPEES

SEQ ID NO: 37681 - protein, 8 aa, Mycobacterium avium
IGPEEYPA

SEQ ID NO: 37682 - protein, 5 aa, Mycobacterium avium
IGPGL

SEQ ID NO: 37683 - protein, 6 aa, Mycobacterium avium
IGPGPH

SEQ ID NO: 37684 - protein, 10 aa, Mycobacterium avium
IGPGQDGLDQ

SEQ ID NO: 37685 - protein, 5 aa, Mycobacterium avium
IGPKG

SEQ ID NO: 37686 - protein, 6 aa, Mycobacterium avium
IGPLDT

SEQ ID NO: 37687 - protein, 6 aa, Mycobacterium avium
IGPPIT

SEQ ID NO: 37688 - protein, 23 aa, Mycobacterium avium
IGPSSSPRPFGVTSDTGPAGGRI

SEQ ID NO: 37689 - protein, 5 aa, Mycobacterium avium
IGPTV

SEQ ID NO: 37690 - protein, 12 aa, Mycobacterium avium
IGQAKGKDSGVT

SEQ ID NO: 37691 - protein, 11 aa, Mycobacterium avium
IGQPKAGATTA

SEQ ID NO: 37692 - protein, 4 aa, Mycobacterium avium
IGQR

SEQ ID NO: 37693 - protein, 12 aa, Mycobacterium avium
IGQRQTGSGTTV

SEQ ID NO: 37694 - protein, 13 aa, Mycobacterium avium
IGRAQARLDSARP

SEQ ID NO: 37695 - protein, 6 aa, Mycobacterium avium
IGRDPK

SEQ ID NO: 37696 - protein, 4 aa, Mycobacterium avium
IGRG

SEQ ID NO: 37697 - protein, 6 aa, Mycobacterium avium
IGRGEH

SEQ ID NO: 37698 - protein, 10 aa, Mycobacterium avium
IGRRSPDGRE

SEQ ID NO: 37699 - protein, 4 aa, Mycobacterium avium
IGRS

SEQ ID NO: 37700 - protein, 8 aa, Mycobacterium avium
IGRSGRHI

SEQ ID NO: 37701 - protein, 4 aa, Mycobacterium avium
IGRT

SEQ ID NO: 37702 - protein, 10 aa, Mycobacterium avium
IGSDGAGSIR

SEQ ID NO: 37703 - protein, 6 aa, Mycobacterium avium
IGSDQT

SEQ ID NO: 37704 - protein, 13 aa, Mycobacterium avium
IGSDTGGSIRQPA

SEQ ID NO: 37705 - protein, 5 aa, Mycobacterium avium
IGSGE

SEQ ID NO: 37706 - protein, 6 aa, Mycobacterium avium
IGSPTY

SEQ ID NO: 37707 - protein, 7 aa, Mycobacterium avium
IGTASDA

SEQ ID NO: 37708 - protein, 9 aa, Mycobacterium avium
IGTATPGRV

SEQ ID NO: 37709 - protein, 5 aa, Mycobacterium avium
IGTDY

SEQ ID NO: 37710 - protein, 8 aa, Mycobacterium avium
IGTGGGQG

SEQ ID NO: 37711 - protein, 10 aa, Mycobacterium avium
IGTGQTGATY

SEQ ID NO: 37712 - protein, 5 aa, Mycobacterium avium
IGTRG

SEQ ID NO: 37713 - protein, 29 aa, Mycobacterium avium
IGTSGAEIGGAFGGEKQTGGGRESGSDSW

SEQ ID NO: 37714 - protein, 11 aa, Mycobacterium avium
IGTSSAAAAGR

SEQ ID NO: 37715 - protein, 4 aa, Mycobacterium avium
IHEY

SEQ ID NO: 37716 - protein, 5 aa, Mycobacterium avium
IHPAA

SEQ ID NO: 37717 - protein, 6 aa, Mycobacterium avium
IHSGDS

SEQ ID NO: 37718 - protein, 5 aa, Mycobacterium avium
IKAGD

SEQ ID NO: 37719 - protein, 8 aa, Mycobacterium avium
IKAGKAGL

SEQ ID NO: 37720 - protein, 6 aa, Mycobacterium avium
IKANRG

SEQ ID NO: 37721 - protein, 8 aa, Mycobacterium avium
IKASGKRD

SEQ ID NO: 37722 - protein, 4 aa, Mycobacterium avium
IKDA

SEQ ID NO: 37723 - protein, 11 aa, Mycobacterium avium
IKDANQAVSHA

SEQ ID NO: 37724 - protein, 6 aa, Mycobacterium avium
IKDSLS

SEQ ID NO: 37725 - protein, 11 aa, Mycobacterium avium
IKGVTEETTTG

SEQ ID NO: 37726 - protein, 8 aa, Mycobacterium avium
IKNGFSGN

SEQ ID NO: 37727 - protein, 14 aa, Mycobacterium avium
IKPDASRHRSTGVD

SEQ ID NO: 37728 - protein, 4 aa, Mycobacterium avium
IKPP

SEQ ID NO: 37729 - protein, 12 aa, Mycobacterium avium
IKPQARTLATDR

SEQ ID NO: 37730 - protein, 19 aa, Mycobacterium avium
IKPRDGRFGCGPSKVRPEQ

SEQ ID NO: 37731 - protein, 6 aa, Mycobacterium avium
IKPSYG

SEQ ID NO: 37732 - protein, 23 aa, Mycobacterium avium
IKQPDIKPRSRDVTDGLEKAAAR

SEQ ID NO: 37733 - protein, 7 aa, Mycobacterium avium
IKSPIDE

SEQ ID NO: 37734 - protein, 8 aa, Mycobacterium avium
IKTATGDA

SEQ ID NO: 37735 - protein, 7 aa, Mycobacterium avium
ILDSGGR

SEQ ID NO: 37736 - protein, 12 aa, Mycobacterium avium
INADTIEQAAEA

SEQ ID NO: 37737 - protein, 9 aa, Mycobacterium avium
INAGGGRAV

SEQ ID NO: 37738 - protein, 4 aa, Mycobacterium avium
INGD

SEQ ID NO: 37739 - protein, 16 aa, Mycobacterium avium
INGEQTEINGTGNGPL

SEQ ID NO: 37740 - protein, 4 aa, Mycobacterium avium
INPD

SEQ ID NO: 37741 - protein, 6 aa, Mycobacterium avium
INPGQR

SEQ ID NO: 37742 - protein, 6 aa, Mycobacterium avium
INPQAD

SEQ ID NO: 37743 - protein, 10 aa, Mycobacterium avium
INPTGPRGDR

SEQ ID NO: 37744 - protein, 10 aa, Mycobacterium avium
INSGKNPEVE

SEQ ID NO: 37745 - protein, 4 aa, Mycobacterium avium
INTN

SEQ ID NO: 37746 - protein, 4 aa, Mycobacterium avium
INTR

SEQ ID NO: 37747 - protein, 7 aa, Mycobacterium avium
INTVTGN

SEQ ID NO: 37748 - protein, 4 aa, Mycobacterium avium
IPAA

SEQ ID NO: 37749 - protein, 5 aa, Mycobacterium avium
IPAAT

SEQ ID NO: 37750 - protein, 6 aa, Mycobacterium avium
IPADPG

SEQ ID NO: 37751 - protein, 4 aa, Mycobacterium avium
IPAG

SEQ ID NO: 37752 - protein, 8 aa, Mycobacterium avium
IPAGRTDE

SEQ ID NO: 37753 - protein, 10 aa, Mycobacterium avium
IPASATGSAK

SEQ ID NO: 37754 - protein, 12 aa, Mycobacterium avium
IPASTPEDLAET

SEQ ID NO: 37755 - protein, 4 aa, Mycobacterium avium
IPAT

SEQ ID NO: 37756 - protein, 5 aa, Mycobacterium avium
IPATE

SEQ ID NO: 37757 - protein, 5 aa, Mycobacterium avium
IPATR

SEQ ID NO: 37758 - protein, 12 aa, Mycobacterium avium
IPDADAPLGPGQ

SEQ ID NO: 37759 - protein, 7 aa, Mycobacterium avium
IPDPGAT

SEQ ID NO: 37760 - protein, 19 aa, Mycobacterium avium
IPDPRERPSDREEAARQKH

SEQ ID NO: 37761 - protein, 13 aa, Mycobacterium avium
IPDSAAESFAPTE

SEQ ID NO: 37762 - protein, 5 aa, Mycobacterium avium
IPDSG

SEQ ID NO: 37763 - protein, 6 aa, Mycobacterium avium
IPEAEK

SEQ ID NO: 37764 - protein, 5 aa, Mycobacterium avium
IPEGG

SEQ ID NO: 37765 - protein, 10 aa, Mycobacterium avium
IPERSDGDAF

SEQ ID NO: 37766 - protein, 18 aa, Mycobacterium avium
IPETDGAEKGSSYNKVRG

SEQ ID NO: 37767 - protein, 4 aa, Mycobacterium avium
IPEY

SEQ ID NO: 37768 - protein, 8 aa, Mycobacterium avium
IPGAPPGL

SEQ ID NO: 37769 - protein, 9 aa, Mycobacterium avium
IPGATVEEA

SEQ ID NO: 37770 - protein, 8 aa, Mycobacterium avium
IPGENGQM

SEQ ID NO: 37771 - protein, 6 aa, Mycobacterium avium
IPGNEE

SEQ ID NO: 37772 - protein, 7 aa, Mycobacterium avium
IPGPASL

SEQ ID NO: 37773 - protein, 15 aa, Mycobacterium avium
IPGPTKVNPSGGALA

SEQ ID NO: 37774 - protein, 6 aa, Mycobacterium avium
IPGPVA

SEQ ID NO: 37775 - protein, 4 aa, Mycobacterium avium
IPGR

SEQ ID NO: 37776 - protein, 11 aa, Mycobacterium avium
IPGVGKSTSIE

SEQ ID NO: 37777 - protein, 11 aa, Mycobacterium avium
IPITTSGKVRR

SEQ ID NO: 37778 - protein, 10 aa, Mycobacterium avium
IPKGATGNTG

SEQ ID NO: 37779 - protein, 6 aa, Mycobacterium avium
IPKPGD

SEQ ID NO: 37780 - protein, 5 aa, Mycobacterium avium
IPKPT

SEQ ID NO: 37781 - protein, 8 aa, Mycobacterium avium
IPKTNPEL

SEQ ID NO: 37782 - protein, 5 aa, Mycobacterium avium
IPLED

SEQ ID NO: 37783 - protein, 9 aa, Mycobacterium avium
IPPAPRGVP

SEQ ID NO: 37784 - protein, 6 aa, Mycobacterium avium
IPPDRW

SEQ ID NO: 37785 - protein, 6 aa, Mycobacterium avium
IPPGEL

SEQ ID NO: 37786 - protein, 6 aa, Mycobacterium avium
IPPGNV

SEQ ID NO: 37787 - protein, 7 aa, Mycobacterium avium
IPPGPGQ

SEQ ID NO: 37788 - protein, 4 aa, Mycobacterium avium
IPPH

SEQ ID NO: 37789 - protein, 5 aa, Mycobacterium avium
IPPNR

SEQ ID NO: 37790 - protein, 5 aa, Mycobacterium avium
IPPQQ

SEQ ID NO: 37791 - protein, 23 aa, Mycobacterium avium
IPPSAPGSKPGEAKPTVVTNRPN

SEQ ID NO: 37792 - protein, 13 aa, Mycobacterium avium
IPPSWATATPSIR

SEQ ID NO: 37793 - protein, 4 aa, Mycobacterium avium
IPQS

SEQ ID NO: 37794 - protein, 9 aa, Mycobacterium avium
IPRGEEAGK

SEQ ID NO: 37795 - protein, 5 aa, Mycobacterium avium
IPRPE

SEQ ID NO: 37796 - protein, 11 aa, Mycobacterium avium
IPTAGAEGFEA

SEQ ID NO: 37797 - protein, 6 aa, Mycobacterium avium
IPTASR

SEQ ID NO: 37798 - protein, 7 aa, Mycobacterium avium
IPTGPGV

SEQ ID NO: 37799 - protein, 5 aa, Mycobacterium avium
IPTQD

SEQ ID NO: 37800 - protein, 6 aa, Mycobacterium avium
IPTRDD

SEQ ID NO: 37801 - protein, 5 aa, Mycobacterium avium
IPTRH

SEQ ID NO: 37802 - protein, 10 aa, Mycobacterium avium
IPTTRRAEAR

SEQ ID NO: 37803 - protein, 4 aa, Mycobacterium avium
IPVA

SEQ ID NO: 37804 - protein, 10 aa, Mycobacterium avium
IPVPRSQVRP

SEQ ID NO: 37805 - protein, 5 aa, Mycobacterium avium
IPYDS

SEQ ID NO: 37806 - protein, 8 aa, Mycobacterium avium
IPYPSARE

SEQ ID NO: 37807 - protein, 9 aa, Mycobacterium avium
IQDKGEGKN

SEQ ID NO: 37808 - protein, 20 aa, Mycobacterium avium
IQESKAGSCDIRPGRRPRGE

SEQ ID NO: 37809 - protein, 12 aa, Mycobacterium avium
IQESREACGGAG

SEQ ID NO: 37810 - protein, 9 aa, Mycobacterium avium
IQGEGGDRH

SEQ ID NO: 37811 - protein, 8 aa, Mycobacterium avium
IQGETKQR

SEQ ID NO: 37812 - protein, 7 aa, Mycobacterium avium
IQPGEAA

SEQ ID NO: 37813 - protein, 21 aa, Mycobacterium avium
IQPGGVSTALANSTLDKMPDG

SEQ ID NO: 37814 - protein, 5 aa, Mycobacterium avium
IQPGR

SEQ ID NO: 37815 - protein, 7 aa, Mycobacterium avium
IQPPGKK

SEQ ID NO: 37816 - protein, 4 aa, Mycobacterium avium
IQPT

SEQ ID NO: 37817 - protein, 9 aa, Mycobacterium avium
IQRPDGHRY

SEQ ID NO: 37818 - protein, 8 aa, Mycobacterium avium
IQRPDGIR

SEQ ID NO: 37819 - protein, 13 aa, Mycobacterium avium
IRAQGGVSRMSDP

SEQ ID NO: 37820 - protein, 12 aa, Mycobacterium avium
IRDSTSVDAPVP

SEQ ID NO: 37821 - protein, 4 aa, Mycobacterium avium
IRDT

SEQ ID NO: 37822 - protein, 4 aa, Mycobacterium avium
IREG

SEQ ID NO: 37823 - protein, 13 aa, Mycobacterium avium
IRESKTEALQTND

SEQ ID NO: 37824 - protein, 10 aa, Mycobacterium avium
IRGESENLAP

SEQ ID NO: 37825 - protein, 21 aa, Mycobacterium avium
IRGRDGKKLTDEWGDAPRAYR

SEQ ID NO: 37826 - protein, 4 aa, Mycobacterium avium
IRHP

SEQ ID NO: 37827 - protein, 11 aa, Mycobacterium avium
IRNNGSRNPEA

SEQ ID NO: 37828 - protein, 20 aa, Mycobacterium avium
IRPAGDSGFDRRHESSAGVA

SEQ ID NO: 37829 - protein, 5 aa, Mycobacterium avium
IRPDA

SEQ ID NO: 37830 - protein, 10 aa, Mycobacterium avium
IRPDGRHDAA

SEQ ID NO: 37831 - protein, 5 aa, Mycobacterium avium
IRPDT

SEQ ID NO: 37832 - protein, 7 aa, Mycobacterium avium
IRPGKGE

SEQ ID NO: 37833 - protein, 8 aa, Mycobacterium avium
IRPTDTAG

SEQ ID NO: 37834 - protein, 9 aa, Mycobacterium avium
IRQDRDAEI

SEQ ID NO: 37835 - protein, 14 aa, Mycobacterium avium
IRRGPDAAIEDYRS

SEQ ID NO: 37836 - protein, 8 aa, Mycobacterium avium
IRRGRDAE

SEQ ID NO: 37837 - protein, 17 aa, Mycobacterium avium
IRRTRAGLKDPKRPSGS

SEQ ID NO: 37838 - protein, 4 aa, Mycobacterium avium
IRSG

SEQ ID NO: 37839 - protein, 6 aa, Mycobacterium avium
IRSGAD

SEQ ID NO: 37840 - protein, 7 aa, Mycobacterium avium
IRSSESV

SEQ ID NO: 37841 - protein, 20 aa, Mycobacterium avium
IRTAGGKGYASRTSASRRYR

SEQ ID NO: 37842 - protein, 4 aa, Mycobacterium avium
IRTD

SEQ ID NO: 37843 - protein, 18 aa, Mycobacterium avium
IRTDGAARAARLLVARLA

SEQ ID NO: 37844 - protein, 11 aa, Mycobacterium avium
IRTKDGAETNI

SEQ ID NO: 37845 - protein, 12 aa, Mycobacterium avium
ISADPKATGAAR

SEQ ID NO: 37846 - protein, 11 aa, Mycobacterium avium
ISAEQRSDGSF

SEQ ID NO: 37847 - protein, 4 aa, Mycobacterium avium
ISAG

SEQ ID NO: 37848 - protein, 7 aa, Mycobacterium avium
ISAGPLS

SEQ ID NO: 37849 - protein, 5 aa, Mycobacterium avium
ISASD

SEQ ID NO: 37850 - protein, 6 aa, Mycobacterium avium
ISDDEW

SEQ ID NO: 37851 - protein, 6 aa, Mycobacterium avium
ISDPRN

SEQ ID NO: 37852 - protein, 9 aa, Mycobacterium avium
ISDTPGLPH

SEQ ID NO: 37853 - protein, 6 aa, Mycobacterium avium
ISDTTA

SEQ ID NO: 37854 - protein, 7 aa, Mycobacterium avium
ISDVRQG

SEQ ID NO: 37855 - protein, 12 aa, Mycobacterium avium
ISEGEGGEVSPK

SEQ ID NO: 37856 - protein, 11 aa, Mycobacterium avium
ISEGGGVYSRE

SEQ ID NO: 37857 - protein, 9 aa, Mycobacterium avium
ISERATADE

SEQ ID NO: 37858 - protein, 25 aa, Mycobacterium avium
ISGGEEGALNGPSIMPGGPAESYRS

SEQ ID NO: 37859 - protein, 8 aa, Mycobacterium avium
ISGKKGER

SEQ ID NO: 37860 - protein, 11 aa, Mycobacterium avium
ISGNGKRSTTR

SEQ ID NO: 37861 - protein, 5 aa, Mycobacterium avium
ISHSH

SEQ ID NO: 37862 - protein, 9 aa, Mycobacterium avium
ISKAADAVS

SEQ ID NO: 37863 - protein, 8 aa, Mycobacterium avium
ISKGERVS

SEQ ID NO: 37864 - protein, 7 aa, Mycobacterium avium
ISNSTDV

SEQ ID NO: 37865 - protein, 5 aa, Mycobacterium avium
ISPAD

SEQ ID NO: 37866 - protein, 8 aa, Mycobacterium avium
ISPDSYPT

SEQ ID NO: 37867 - protein, 5 aa, Mycobacterium avium
ISPEQ

SEQ ID NO: 37868 - protein, 6 aa, Mycobacterium avium
ISPERA

SEQ ID NO: 37869 - protein, 7 aa, Mycobacterium avium
ISPKTYQ

SEQ ID NO: 37870 - protein, 14 aa, Mycobacterium avium
ISPRKVNKPVTGQY

SEQ ID NO: 37871 - protein, 9 aa, Mycobacterium avium
ISPRPPEVP

SEQ ID NO: 37872 - protein, 7 aa, Mycobacterium avium
ISPRRSG

SEQ ID NO: 37873 - protein, 12 aa, Mycobacterium avium
ISQSHAEGAPDD

SEQ ID NO: 37874 - protein, 8 aa, Mycobacterium avium
ISRAGTNA

SEQ ID NO: 37875 - protein, 5 aa, Mycobacterium avium
ISREG

SEQ ID NO: 37876 - protein, 8 aa, Mycobacterium avium
ISRQEQDE

SEQ ID NO: 37877 - protein, 9 aa, Mycobacterium avium
ISRRPANPE

SEQ ID NO: 37878 - protein, 12 aa, Mycobacterium avium
ISRTVTSGGTFG

SEQ ID NO: 37879 - protein, 5 aa, Mycobacterium avium
ISSGE

SEQ ID NO: 37880 - protein, 19 aa, Mycobacterium avium
ISSPPGGGTRVHWTAPLLD

SEQ ID NO: 37881 - protein, 14 aa, Mycobacterium avium
ISSTGPAPVASGSS

SEQ ID NO: 37882 - protein, 10 aa, Mycobacterium avium
ISTEEAKEQM

SEQ ID NO: 37883 - protein, 9 aa, Mycobacterium avium
ISTPDAPSI

SEQ ID NO: 37884 - protein, 23 aa, Mycobacterium avium
ISTTSTDGNDRPSEPVVIESITI

SEQ ID NO: 37885 - protein, 13 aa, Mycobacterium avium
ITANLGDTKRPVV

SEQ ID NO: 37886 - protein, 11 aa, Mycobacterium avium
ITAPNARGERV

SEQ ID NO: 37887 - protein, 5 aa, Mycobacterium avium
ITAPR

SEQ ID NO: 37888 - protein, 10 aa, Mycobacterium avium
ITASATDSLS

SEQ ID NO: 37889 - protein, 12 aa, Mycobacterium avium
ITDASGRTLSGQ

SEQ ID NO: 37890 - protein, 6 aa, Mycobacterium avium
ITDEDA

SEQ ID NO: 37891 - protein, 13 aa, Mycobacterium avium
ITDEGGRRPPSHR

SEQ ID NO: 37892 - protein, 6 aa, Mycobacterium avium
ITDNST

SEQ ID NO: 37893 - protein, 8 aa, Mycobacterium avium
ITDPSRIA

SEQ ID NO: 37894 - protein, 8 aa, Mycobacterium avium
ITDTGTPL

SEQ ID NO: 37895 - protein, 6 aa, Mycobacterium avium
ITEEHG

SEQ ID NO: 37896 - protein, 7 aa, Mycobacterium avium
ITEEQKR

SEQ ID NO: 37897 - protein, 13 aa, Mycobacterium avium
ITEESGEPADPAR

SEQ ID NO: 37898 - protein, 4 aa, Mycobacterium avium
ITGE

SEQ ID NO: 37899 - protein, 4 aa, Mycobacterium avium
ITGG

SEQ ID NO: 37900 - protein, 10 aa, Mycobacterium avium
ITGGKPMDRK

SEQ ID NO: 37901 - protein, 6 aa, Mycobacterium avium
ITGGSD

SEQ ID NO: 37902 - protein, 5 aa, Mycobacterium avium
ITGPA

SEQ ID NO: 37903 - protein, 12 aa, Mycobacterium avium
ITGPDTEREHGG

SEQ ID NO: 37904 - protein, 19 aa, Mycobacterium avium
ITGTDTGTGAAAGGDAAET

SEQ ID NO: 37905 - protein, 9 aa, Mycobacterium avium
ITGTRGTSA

SEQ ID NO: 37906 - protein, 4 aa, Mycobacterium avium
ITHR

SEQ ID NO: 37907 - protein, 7 aa, Mycobacterium avium
ITKTSDV

SEQ ID NO: 37908 - protein, 9 aa, Mycobacterium avium
ITNSGTDIT

SEQ ID NO: 37909 - protein, 7 aa, Mycobacterium avium
ITPDEAR

SEQ ID NO: 37910 - protein, 5 aa, Mycobacterium avium
ITPDG

SEQ ID NO: 37911 - protein, 12 aa, Mycobacterium avium
ITPSSKKKPRPM

SEQ ID NO: 37912 - protein, 6 aa, Mycobacterium avium
ITPSTT

SEQ ID NO: 37913 - protein, 8 aa, Mycobacterium avium
ITPTGGHL

SEQ ID NO: 37914 - protein, 9 aa, Mycobacterium avium
ITPTPTPDL

SEQ ID NO: 37915 - protein, 10 aa, Mycobacterium avium
ITQGKGSVIE

SEQ ID NO: 37916 - protein, 7 aa, Mycobacterium avium
ITRAGGE

SEQ ID NO: 37917 - protein, 5 aa, Mycobacterium avium
ITRDA

SEQ ID NO: 37918 - protein, 7 aa, Mycobacterium avium
ITRGDAE

SEQ ID NO: 37919 - protein, 13 aa, Mycobacterium avium
ITRTGRALGPGPL

SEQ ID NO: 37920 - protein, 9 aa, Mycobacterium avium
ITSEAAGEV

SEQ ID NO: 37921 - protein, 10 aa, Mycobacterium avium
ITSTRGRSIT

SEQ ID NO: 37922 - protein, 12 aa, Mycobacterium avium
ITTERNHNRRTR

SEQ ID NO: 37923 - protein, 8 aa, Mycobacterium avium
IVEPGGDA

SEQ ID NO: 37924 - protein, 4 aa, Mycobacterium avium
IVPP

SEQ ID NO: 37925 - protein, 5 aa, Mycobacterium avium
IVPPA

SEQ ID NO: 37926 - protein, 11 aa, Mycobacterium avium
IVSPGTGFDTH

SEQ ID NO: 37927 - protein, 4 aa, Mycobacterium avium
IYDA

SEQ ID NO: 37928 - protein, 4 aa, Mycobacterium avium
IYEA

SEQ ID NO: 37929 - protein, 8 aa, Mycobacterium avium
IYGGSNEI

SEQ ID NO: 37930 - protein, 10 aa, Mycobacterium avium
IYGHPRNPYA

SEQ ID NO: 37931 - protein, 6 aa, Mycobacterium avium
IYGPGV

SEQ ID NO: 37932 - protein, 5 aa, Mycobacterium avium
IYPDT

SEQ ID NO: 37933 - protein, 12 aa, Mycobacterium avium
KAAAARRARAEL

SEQ ID NO: 37934 - protein, 8 aa, Mycobacterium avium
KAAADSAE

SEQ ID NO: 37935 - protein, 5 aa, Mycobacterium avium
KAAAE

SEQ ID NO: 37936 - protein, 8 aa, Mycobacterium avium
KAAAENPP

SEQ ID NO: 37937 - protein, 12 aa, Mycobacterium avium
KAAAGEAATGCA

SEQ ID NO: 37938 - protein, 8 aa, Mycobacterium avium
KAAASGLS

SEQ ID NO: 37939 - protein, 8 aa, Mycobacterium avium
KAAATTET

SEQ ID NO: 37940 - protein, 5 aa, Mycobacterium avium
KAADA

SEQ ID NO: 37941 - protein, 7 aa, Mycobacterium avium
KAAEGHD

SEQ ID NO: 37942 - protein, 6 aa, Mycobacterium avium
KAAEGY

SEQ ID NO: 37943 - protein, 13 aa, Mycobacterium avium
KAAETAQAEAEAA

SEQ ID NO: 37944 - protein, 17 aa, Mycobacterium avium
KAAGGPKPRAGRDPVNQ

SEQ ID NO: 37945 - protein, 9 aa, Mycobacterium avium
KAAGRPDDE

SEQ ID NO: 37946 - protein, 9 aa, Mycobacterium avium
KAAGRQRNL

SEQ ID NO: 37947 - protein, 7 aa, Mycobacterium avium
KAALKDS

SEQ ID NO: 37948 - protein, 10 aa, Mycobacterium avium
KAANAGPSRD

SEQ ID NO: 37949 - protein, 11 aa, Mycobacterium avium
KAANDASHEHP

SEQ ID NO: 37950 - protein, 14 aa, Mycobacterium avium
KAANEDGTFKSDEE

SEQ ID NO: 37951 - protein, 10 aa, Mycobacterium avium
KAANTQPQYF

SEQ ID NO: 37952 - protein, 9 aa, Mycobacterium avium
KAAPAGAGG

SEQ ID NO: 37953 - protein, 7 aa, Mycobacterium avium
KAAQHSW

SEQ ID NO: 37954 - protein, 4 aa, Mycobacterium avium
KAAR

SEQ ID NO: 37955 - protein, 9 aa, Mycobacterium avium
KAARDEAGV

SEQ ID NO: 37956 - protein, 8 aa, Mycobacterium avium
KAATDKPF

SEQ ID NO: 37957 - protein, 8 aa, Mycobacterium avium
KAATGATV

SEQ ID NO: 37958 - protein, 8 aa, Mycobacterium avium
KAATLGDD

SEQ ID NO: 37959 - protein, 7 aa, Mycobacterium avium
KAATSAR

SEQ ID NO: 37960 - protein, 12 aa, Mycobacterium avium
KADAPSGTATRT

SEQ ID NO: 37961 - protein, 9 aa, Mycobacterium avium
KADGTQDEI

SEQ ID NO: 37962 - protein, 13 aa, Mycobacterium avium
KADPEKVNPNGGA

SEQ ID NO: 37963 - protein, 11 aa, Mycobacterium avium
KADRDGAEQTV

SEQ ID NO: 37964 - protein, 6 aa, Mycobacterium avium
KADTAL

SEQ ID NO: 37965 - protein, 9 aa, Mycobacterium avium
KADTSGVEA

SEQ ID NO: 37966 - protein, 10 aa, Mycobacterium avium
KAEAAAEAKE

SEQ ID NO: 37967 - protein, 6 aa, Mycobacterium avium
KAEFDG

SEQ ID NO: 37968 - protein, 7 aa, Mycobacterium avium
KAEPGGL

SEQ ID NO: 37969 - protein, 20 aa, Mycobacterium avium
KAERRLTDTALKDLKKRVEA

SEQ ID NO: 37970 - protein, 11 aa, Mycobacterium avium
KAEVELPSPYA

SEQ ID NO: 37971 - protein, 4 aa, Mycobacterium avium
KAFG

SEQ ID NO: 37972 - protein, 8 aa, Mycobacterium avium
KAGAEGQV

SEQ ID NO: 37973 - protein, 16 aa, Mycobacterium avium
KAGARPATLSGGQQQR

SEQ ID NO: 37974 - protein, 10 aa, Mycobacterium avium
KAGATAADLG

SEQ ID NO: 37975 - protein, 7 aa, Mycobacterium avium
KAGELTP

SEQ ID NO: 37976 - protein, 6 aa, Mycobacterium avium
KAGEQL

SEQ ID NO: 37977 - protein, 19 aa, Mycobacterium avium
KAGESEATKWESSGEGTYT

SEQ ID NO: 37978 - protein, 8 aa, Mycobacterium avium
KAGGPNLD

SEQ ID NO: 37979 - protein, 4 aa, Mycobacterium avium
KAGI

SEQ ID NO: 37980 - protein, 14 aa, Mycobacterium avium
KAGKKINKDDGIQR

SEQ ID NO: 37981 - protein, 6 aa, Mycobacterium avium
KAGLPD

SEQ ID NO: 37982 - protein, 16 aa, Mycobacterium avium
KAGPAIKAGDALAPAA

SEQ ID NO: 37983 - protein, 7 aa, Mycobacterium avium
KAGPALE

SEQ ID NO: 37984 - protein, 10 aa, Mycobacterium avium
KAGSAAGGAV

SEQ ID NO: 37985 - protein, 6 aa, Mycobacterium avium
KAGSRN

SEQ ID NO: 37986 - protein, 11 aa, Mycobacterium avium
KAGTARPISDD

SEQ ID NO: 37987 - protein, 5 aa, Mycobacterium avium
KAGVD

SEQ ID NO: 37988 - protein, 7 aa, Mycobacterium avium
KAGVRDA

SEQ ID NO: 37989 - protein, 13 aa, Mycobacterium avium
KAIRANKEAIDAD

SEQ ID NO: 37990 - protein, 7 aa, Mycobacterium avium
KAKALGL

SEQ ID NO: 37991 - protein, 6 aa, Mycobacterium avium
KAKELG

SEQ ID NO: 37992 - protein, 8 aa, Mycobacterium avium
KAKSQKAI

SEQ ID NO: 37993 - protein, 8 aa, Mycobacterium avium
KALGGRPV

SEQ ID NO: 37994 - protein, 8 aa, Mycobacterium avium
KALGPNSR

SEQ ID NO: 37995 - protein, 6 aa, Mycobacterium avium
KALPGD

SEQ ID NO: 37996 - protein, 15 aa, Mycobacterium avium
KALQRGKTTEEKSKS

SEQ ID NO: 37997 - protein, 7 aa, Mycobacterium avium
KALTDAG

SEQ ID NO: 37998 - protein, 9 aa, Mycobacterium avium
KAMGTGPNV

SEQ ID NO: 37999 - protein, 4 aa, Mycobacterium avium
KAMP

SEQ ID NO: 38000 - protein, 10 aa, Mycobacterium avium
KANAENPAGS

SEQ ID NO: 38001 - protein, 4 aa, Mycobacterium avium
KAND

SEQ ID NO: 38002 - protein, 6 aa, Mycobacterium avium
KANMAY

SEQ ID NO: 38003 - protein, 9 aa, Mycobacterium avium
KANSEEMPK

SEQ ID NO: 38004 - protein, 4 aa, Mycobacterium avium
KAPI

SEQ ID NO: 38005 - protein, 4 aa, Mycobacterium avium
KAPK

SEQ ID NO: 38006 - protein, 15 aa, Mycobacterium avium
KAPKTAPLAGNSIAT

SEQ ID NO: 38007 - protein, 7 aa, Mycobacterium avium
KAPNRRG

SEQ ID NO: 38008 - protein, 5 aa, Mycobacterium avium
KAPSD

SEQ ID NO: 38009 - protein, 5 aa, Mycobacterium avium
KAPSV

SEQ ID NO: 38010 - protein, 14 aa, Mycobacterium avium
KAPTGTEVRSSARL

SEQ ID NO: 38011 - protein, 12 aa, Mycobacterium avium
KAPTVGGTTAVS

SEQ ID NO: 38012 - protein, 7 aa, Mycobacterium avium
KAPYTTL

SEQ ID NO: 38013 - protein, 9 aa, Mycobacterium avium
KAQDPKGGR

SEQ ID NO: 38014 - protein, 22 aa, Mycobacterium avium
KAQGRHSNIGYDAPEDMEATKS

SEQ ID NO: 38015 - protein, 8 aa, Mycobacterium avium
KAQKQARY

SEQ ID NO: 38016 - protein, 5 aa, Mycobacterium avium
KAQQL

SEQ ID NO: 38017 - protein, 7 aa, Mycobacterium avium
KARAGEI

SEQ ID NO: 38018 - protein, 9 aa, Mycobacterium avium
KARARGTGH

SEQ ID NO: 38019 - protein, 8 aa, Mycobacterium avium
KAREAGHD

SEQ ID NO: 38020 - protein, 8 aa, Mycobacterium avium
KAREPGDD

SEQ ID NO: 38021 - protein, 8 aa, Mycobacterium avium
KAREVRGA

SEQ ID NO: 38022 - protein, 5 aa, Mycobacterium avium
KARGD

SEQ ID NO: 38023 - protein, 5 aa, Mycobacterium avium
KARKD

SEQ ID NO: 38024 - protein, 6 aa, Mycobacterium avium
KARLGD

SEQ ID NO: 38025 - protein, 6 aa, Mycobacterium avium
KARQRT

SEQ ID NO: 38026 - protein, 10 aa, Mycobacterium avium
KARRNEAASS

SEQ ID NO: 38027 - protein, 7 aa, Mycobacterium avium
KASAAMT

SEQ ID NO: 38028 - protein, 6 aa, Mycobacterium avium
KASDYH

SEQ ID NO: 38029 - protein, 10 aa, Mycobacterium avium
KASEKPESSL

SEQ ID NO: 38030 - protein, 19 aa, Mycobacterium avium
KASETAENVYEGHDRATGA

SEQ ID NO: 38031 - protein, 9 aa, Mycobacterium avium
KASGGIRTA

SEQ ID NO: 38032 - protein, 15 aa, Mycobacterium avium
KASGYGRELGPEGLD

SEQ ID NO: 38033 - protein, 6 aa, Mycobacterium avium
KASREV

SEQ ID NO: 38034 - protein, 22 aa, Mycobacterium avium
KATGLGGAASKQMTFETSSPAH

SEQ ID NO: 38035 - protein, 9 aa, Mycobacterium avium
KATGTPGAL

SEQ ID NO: 38036 - protein, 5 aa, Mycobacterium avium
KATPE

SEQ ID NO: 38037 - protein, 6 aa, Mycobacterium avium
KATPLR

SEQ ID NO: 38038 - protein, 7 aa, Mycobacterium avium
KATQEDP

SEQ ID NO: 38039 - protein, 9 aa, Mycobacterium avium
KATRQPLTE

SEQ ID NO: 38040 - protein, 6 aa, Mycobacterium avium
KAVADG

SEQ ID NO: 38041 - protein, 5 aa, Mycobacterium avium
KAVQA

SEQ ID NO: 38042 - protein, 7 aa, Mycobacterium avium
KAVRPAY

SEQ ID NO: 38043 - protein, 6 aa, Mycobacterium avium
KAVRTD

SEQ ID NO: 38044 - protein, 7 aa, Mycobacterium avium
KAVTDRP

SEQ ID NO: 38045 - protein, 13 aa, Mycobacterium avium
KAVTESDNRASEQ

SEQ ID NO: 38046 - protein, 12 aa, Mycobacterium avium
KAYGGQGLPDGT

SEQ ID NO: 38047 - protein, 5 aa, Mycobacterium avium
KAYSA

SEQ ID NO: 38048 - protein, 5 aa, Mycobacterium avium
KCTPC

SEQ ID NO: 38049 - protein, 5 aa, Mycobacterium avium
KDAGE

SEQ ID NO: 38050 - protein, 9 aa, Mycobacterium avium
KDAGGRAVA

SEQ ID NO: 38051 - protein, 7 aa, Mycobacterium avium
KDANSSM

SEQ ID NO: 38052 - protein, 8 aa, Mycobacterium avium
KDAPPLPA

SEQ ID NO: 38053 - protein, 4 aa, Mycobacterium avium
KDAQ

SEQ ID NO: 38054 - protein, 13 aa, Mycobacterium avium
KDAQARAGATALA

SEQ ID NO: 38055 - protein, 7 aa, Mycobacterium avium
KDARAKG

SEQ ID NO: 38056 - protein, 7 aa, Mycobacterium avium
KDARQRL

SEQ ID NO: 38057 - protein, 5 aa, Mycobacterium avium
KDDAI

SEQ ID NO: 38058 - protein, 8 aa, Mycobacterium avium
KDDPTGEK

SEQ ID NO: 38059 - protein, 11 aa, Mycobacterium avium
KDEDGKPRFSA

SEQ ID NO: 38060 - protein, 6 aa, Mycobacterium avium
KDEEAP

SEQ ID NO: 38061 - protein, 8 aa, Mycobacterium avium
KDEGGRHT

SEQ ID NO: 38062 - protein, 17 aa, Mycobacterium avium
KDETTIVEGAGDSDAIA

SEQ ID NO: 38063 - protein, 9 aa, Mycobacterium avium
KDEYPATAA

SEQ ID NO: 38064 - protein, 10 aa, Mycobacterium avium
KDGAIAGPRS

SEQ ID NO: 38065 - protein, 22 aa, Mycobacterium avium
KDGEAGEDEVGRAEKDLDKTTH

SEQ ID NO: 38066 - protein, 9 aa, Mycobacterium avium
KDGEYDETD

SEQ ID NO: 38067 - protein, 7 aa, Mycobacterium avium
KDGGSVE

SEQ ID NO: 38068 - protein, 6 aa, Mycobacterium avium
KDGGVL

SEQ ID NO: 38069 - protein, 10 aa, Mycobacterium avium
KDGKPKPTPI

SEQ ID NO: 38070 - protein, 9 aa, Mycobacterium avium
KDGNSQELK

SEQ ID NO: 38071 - protein, 6 aa, Mycobacterium avium
KDGRPV

SEQ ID NO: 38072 - protein, 4 aa, Mycobacterium avium
KDGS

SEQ ID NO: 38073 - protein, 7 aa, Mycobacterium avium
KDGSGGR

SEQ ID NO: 38074 - protein, 6 aa, Mycobacterium avium
KDGSVK

SEQ ID NO: 38075 - protein, 11 aa, Mycobacterium avium
KDHNPASGPHR

SEQ ID NO: 38076 - protein, 10 aa, Mycobacterium avium
KDIDAARAEK

SEQ ID NO: 38077 - protein, 8 aa, Mycobacterium avium
KDIESADK

SEQ ID NO: 38078 - protein, 6 aa, Mycobacterium avium
KDKELR

SEQ ID NO: 38079 - protein, 9 aa, Mycobacterium avium
KDKFTPPRY

SEQ ID NO: 38080 - protein, 8 aa, Mycobacterium avium
KDKGAKGK

SEQ ID NO: 38081 - protein, 12 aa, Mycobacterium avium
KDKGTGKENTIK

SEQ ID NO: 38082 - protein, 7 aa, Mycobacterium avium
KDKPMED

SEQ ID NO: 38083 - protein, 9 aa, Mycobacterium avium
KDKQSPEQL

SEQ ID NO: 38084 - protein, 10 aa, Mycobacterium avium
KDLPTADDPR

SEQ ID NO: 38085 - protein, 6 aa, Mycobacterium avium
KDLTEG

SEQ ID NO: 38086 - protein, 5 aa, Mycobacterium avium
KDNGR

SEQ ID NO: 38087 - protein, 9 aa, Mycobacterium avium
KDNTAGTDE

SEQ ID NO: 38088 - protein, 6 aa, Mycobacterium avium
KDPDEI

SEQ ID NO: 38089 - protein, 8 aa, Mycobacterium avium
KDPDELSD

SEQ ID NO: 38090 - protein, 7 aa, Mycobacterium avium
KDPEGMK

SEQ ID NO: 38091 - protein, 7 aa, Mycobacterium avium
KDPETAA

SEQ ID NO: 38092 - protein, 6 aa, Mycobacterium avium
KDPGYS

SEQ ID NO: 38093 - protein, 5 aa, Mycobacterium avium
KDPQD

SEQ ID NO: 38094 - protein, 4 aa, Mycobacterium avium
KDPR

SEQ ID NO: 38095 - protein, 6 aa, Mycobacterium avium
KDPRMK

SEQ ID NO: 38096 - protein, 7 aa, Mycobacterium avium
KDQDGNV

SEQ ID NO: 38097 - protein, 6 aa, Mycobacterium avium
KDRHGR

SEQ ID NO: 38098 - protein, 9 aa, Mycobacterium avium
KDRNPQWSP

SEQ ID NO: 38099 - protein, 7 aa, Mycobacterium avium
KDRRAER

SEQ ID NO: 38100 - protein, 5 aa, Mycobacterium avium
KDRRS

SEQ ID NO: 38101 - protein, 6 aa, Mycobacterium avium
KDRSQV

SEQ ID NO: 38102 - protein, 4 aa, Mycobacterium avium
KDRT

SEQ ID NO: 38103 - protein, 7 aa, Mycobacterium avium
KDSGIGS

SEQ ID NO: 38104 - protein, 4 aa, Mycobacterium avium
KDSI

SEQ ID NO: 38105 - protein, 6 aa, Mycobacterium avium
KDSIAT

SEQ ID NO: 38106 - protein, 6 aa, Mycobacterium avium
KDSPLR

SEQ ID NO: 38107 - protein, 13 aa, Mycobacterium avium
KDSPPSFDPSQVA

SEQ ID NO: 38108 - protein, 6 aa, Mycobacterium avium
KDSTRQ

SEQ ID NO: 38109 - protein, 13 aa, Mycobacterium avium
KDTTTGDTLSDPN

SEQ ID NO: 38110 - protein, 4 aa, Mycobacterium avium
KDTV

SEQ ID NO: 38111 - protein, 9 aa, Mycobacterium avium
KDVIKSGGE

SEQ ID NO: 38112 - protein, 5 aa, Mycobacterium avium
KDVPD

SEQ ID NO: 38113 - protein, 5 aa, Mycobacterium avium
KDVTG

SEQ ID NO: 38114 - protein, 7 aa, Mycobacterium avium
KDWTPTQ

SEQ ID NO: 38115 - protein, 14 aa, Mycobacterium avium
KDYTGTGNSLNPRH

SEQ ID NO: 38116 - protein, 20 aa, Mycobacterium avium
KEAADDAKAKLEAAGATVTV

SEQ ID NO: 38117 - protein, 6 aa, Mycobacterium avium
KEAGAA

SEQ ID NO: 38118 - protein, 8 aa, Mycobacterium avium
KEAGLQSY

SEQ ID NO: 38119 - protein, 6 aa, Mycobacterium avium
KEAPDR

SEQ ID NO: 38120 - protein, 8 aa, Mycobacterium avium
KEATPRGK

SEQ ID NO: 38121 - protein, 8 aa, Mycobacterium avium
KEDEIGPA

SEQ ID NO: 38122 - protein, 4 aa, Mycobacterium avium
KEDG

SEQ ID NO: 38123 - protein, 7 aa, Mycobacterium avium
KEDKEGR

SEQ ID NO: 38124 - protein, 8 aa, Mycobacterium avium
KEDLKSTV

SEQ ID NO: 38125 - protein, 9 aa, Mycobacterium avium
KEDRSWREG

SEQ ID NO: 38126 - protein, 7 aa, Mycobacterium avium
KEEETNE

SEQ ID NO: 38127 - protein, 7 aa, Mycobacterium avium
KEGAEER

SEQ ID NO: 38128 - protein, 4 aa, Mycobacterium avium
KEGD

SEQ ID NO: 38129 - protein, 6 aa, Mycobacterium avium
KEGEEK

SEQ ID NO: 38130 - protein, 6 aa, Mycobacterium avium
KEGLRK

SEQ ID NO: 38131 - protein, 23 aa, Mycobacterium avium
KEGLSTGLGDEGGFAPDVAGTTA

SEQ ID NO: 38132 - protein, 5 aa, Mycobacterium avium
KEGQT

SEQ ID NO: 38133 - protein, 6 aa, Mycobacterium avium
KEGSYA

SEQ ID NO: 38134 - protein, 6 aa, Mycobacterium avium
KEGTGA

SEQ ID NO: 38135 - protein, 6 aa, Mycobacterium avium
KEGVAD

SEQ ID NO: 38136 - protein, 10 aa, Mycobacterium avium
KEHGGGGGSV

SEQ ID NO: 38137 - protein, 5 aa, Mycobacterium avium
KEIGP

SEQ ID NO: 38138 - protein, 7 aa, Mycobacterium avium
KEIPEDG

SEQ ID NO: 38139 - protein, 9 aa, Mycobacterium avium
KEKDEAVKG

SEQ ID NO: 38140 - protein, 8 aa, Mycobacterium avium
KELDGDGV

SEQ ID NO: 38141 - protein, 10 aa, Mycobacterium avium
KELEEAGGQA

SEQ ID NO: 38142 - protein, 8 aa, Mycobacterium avium
KELRNGST

SEQ ID NO: 38143 - protein, 7 aa, Mycobacterium avium
KENAEHP

SEQ ID NO: 38144 - protein, 6 aa, Mycobacterium avium
KENYPA

SEQ ID NO: 38145 - protein, 7 aa, Mycobacterium avium
KEPDAQL

SEQ ID NO: 38146 - protein, 7 aa, Mycobacterium avium
KEPIGSK

SEQ ID NO: 38147 - protein, 6 aa, Mycobacterium avium
KEPMEV

SEQ ID NO: 38148 - protein, 8 aa, Mycobacterium avium
KEQARAGH

SEQ ID NO: 38149 - protein, 5 aa, Mycobacterium avium
KEQKV

SEQ ID NO: 38150 - protein, 8 aa, Mycobacterium avium
KERAAELG

SEQ ID NO: 38151 - protein, 16 aa, Mycobacterium avium
KERAHQAGAKNVDERP

SEQ ID NO: 38152 - protein, 16 aa, Mycobacterium avium
KERGFNRGQQTHEEVS

SEQ ID NO: 38153 - protein, 7 aa, Mycobacterium avium
KERGIDA

SEQ ID NO: 38154 - protein, 8 aa, Mycobacterium avium
KERREGDV

SEQ ID NO: 38155 - protein, 10 aa, Mycobacterium avium
KERRNATGND

SEQ ID NO: 38156 - protein, 11 aa, Mycobacterium avium
KERSGDIPDSE

SEQ ID NO: 38157 - protein, 4 aa, Mycobacterium avium
KESH

SEQ ID NO: 38158 - protein, 5 aa, Mycobacterium avium
KESLA

SEQ ID NO: 38159 - protein, 7 aa, Mycobacterium avium
KESNPYN

SEQ ID NO: 38160 - protein, 12 aa, Mycobacterium avium
KESRKRAESAEI

SEQ ID NO: 38161 - protein, 4 aa, Mycobacterium avium
KEST

SEQ ID NO: 38162 - protein, 5 aa, Mycobacterium avium
KETGV

SEQ ID NO: 38163 - protein, 11 aa, Mycobacterium avium
KEYGGQDRSPM

SEQ ID NO: 38164 - protein, 8 aa, Mycobacterium avium
KEYGGRGF

SEQ ID NO: 38165 - protein, 16 aa, Mycobacterium avium
KEYGSGSSRDWAAKGT

SEQ ID NO: 38166 - protein, 4 aa, Mycobacterium avium
KEYP

SEQ ID NO: 38167 - protein, 6 aa, Mycobacterium avium
KEYQDL

SEQ ID NO: 38168 - protein, 8 aa, Mycobacterium avium
KFASRDRD

SEQ ID NO: 38169 - protein, 13 aa, Mycobacterium avium
KFGGDSLAETRRN

SEQ ID NO: 38170 - protein, 20 aa, Mycobacterium avium
KFTREEQDQYAARSHQRAAA

SEQ ID NO: 38171 - protein, 8 aa, Mycobacterium avium
KFTSEESH

SEQ ID NO: 38172 - protein, 14 aa, Mycobacterium avium
KGAAAQRIQHDPLS

SEQ ID NO: 38173 - protein, 14 aa, Mycobacterium avium
KGADAIKADHTDLY

SEQ ID NO: 38174 - protein, 6 aa, Mycobacterium avium
KGAEEL

SEQ ID NO: 38175 - protein, 6 aa, Mycobacterium avium
KGAGLG

SEQ ID NO: 38176 - protein, 8 aa, Mycobacterium avium
KGAPMPAP

SEQ ID NO: 38177 - protein, 9 aa, Mycobacterium avium
KGAPRADSR

SEQ ID NO: 38178 - protein, 5 aa, Mycobacterium avium
KGARI

SEQ ID NO: 38179 - protein, 10 aa, Mycobacterium avium
KGASEGAGLG

SEQ ID NO: 38180 - protein, 11 aa, Mycobacterium avium
KGASPKGGSLE

SEQ ID NO: 38181 - protein, 7 aa, Mycobacterium avium
KGATTAD

SEQ ID NO: 38182 - protein, 7 aa, Mycobacterium avium
KGAVADA

SEQ ID NO: 38183 - protein, 4 aa, Mycobacterium avium
KGDG

SEQ ID NO: 38184 - protein, 7 aa, Mycobacterium avium
KGDKAGN

SEQ ID NO: 38185 - protein, 15 aa, Mycobacterium avium
KGDPTLNATELLKAS

SEQ ID NO: 38186 - protein, 6 aa, Mycobacterium avium
KGDSVT

SEQ ID NO: 38187 - protein, 8 aa, Mycobacterium avium
KGDVGEDI

SEQ ID NO: 38188 - protein, 8 aa, Mycobacterium avium
KGEDRKQR

SEQ ID NO: 38189 - protein, 9 aa, Mycobacterium avium
KGEEPQTEW

SEQ ID NO: 38190 - protein, 8 aa, Mycobacterium avium
KGEKRSGL

SEQ ID NO: 38191 - protein, 19 aa, Mycobacterium avium
KGELPSTLQRSSAKAQRTF

SEQ ID NO: 38192 - protein, 7 aa, Mycobacterium avium
KGEQKSD

SEQ ID NO: 38193 - protein, 9 aa, Mycobacterium avium
KGETSGHTQ

SEQ ID NO: 38194 - protein, 6 aa, Mycobacterium avium
KGGADD

SEQ ID NO: 38195 - protein, 6 aa, Mycobacterium avium
KGGAGW

SEQ ID NO: 38196 - protein, 12 aa, Mycobacterium avium
KGGDHQVPGARK

SEQ ID NO: 38197 - protein, 9 aa, Mycobacterium avium
KGGTGKSTI

SEQ ID NO: 38198 - protein, 11 aa, Mycobacterium avium
KGGVGKTTSTI

SEQ ID NO: 38199 - protein, 10 aa, Mycobacterium avium
KGHASTIEGE

SEQ ID NO: 38200 - protein, 16 aa, Mycobacterium avium
KGHETGQRTGEHTRPF

SEQ ID NO: 38201 - protein, 4 aa, Mycobacterium avium
KGIA

SEQ ID NO: 38202 - protein, 64 aa, Mycobacterium avium
KGIDNEAPAMTYSGPSEDGSAQVQRNGGDAKTPAGVPAGASRRERRAAARQQGRGAKPPKSVKR

SEQ ID NO: 38203 - protein, 6 aa, Mycobacterium avium
KGISRD

SEQ ID NO: 38204 - protein, 7 aa, Mycobacterium avium
KGKAQIG

SEQ ID NO: 38205 - protein, 9 aa, Mycobacterium avium
KGKHGPLRR

SEQ ID NO: 38206 - protein, 9 aa, Mycobacterium avium
KGKNAAEVV

SEQ ID NO: 38207 - protein, 6 aa, Mycobacterium avium
KGKRFN

SEQ ID NO: 38208 - protein, 8 aa, Mycobacterium avium
KGKRSATI

SEQ ID NO: 38209 - protein, 7 aa, Mycobacterium avium
KGKVKEV

SEQ ID NO: 38210 - protein, 4 aa, Mycobacterium avium
KGLN

SEQ ID NO: 38211 - protein, 7 aa, Mycobacterium avium
KGLTEGT

SEQ ID NO: 38212 - protein, 9 aa, Mycobacterium avium
KGLTGTGYD

SEQ ID NO: 38213 - protein, 14 aa, Mycobacterium avium
KGNNPLERGTMDSA

SEQ ID NO: 38214 - protein, 19 aa, Mycobacterium avium
KGPDQQKPAGVLSGGERNR

SEQ ID NO: 38215 - protein, 6 aa, Mycobacterium avium
KGPGGA

SEQ ID NO: 38216 - protein, 10 aa, Mycobacterium avium
KGPGSGRETA

SEQ ID NO: 38217 - protein, 8 aa, Mycobacterium avium
KGPMGTSQ

SEQ ID NO: 38218 - protein, 14 aa, Mycobacterium avium
KGPSITPRPPQGQP

SEQ ID NO: 38219 - protein, 6 aa, Mycobacterium avium
KGQETY

SEQ ID NO: 38220 - protein, 21 aa, Mycobacterium avium
KGQYSPTSEVGKITKSTPMGS

SEQ ID NO: 38221 - protein, 10 aa, Mycobacterium avium
KGRAHGLPTP

SEQ ID NO: 38222 - protein, 6 aa, Mycobacterium avium
KGRMEE

SEQ ID NO: 38223 - protein, 14 aa, Mycobacterium avium
KGSAGLSFGSPEEK

SEQ ID NO: 38224 - protein, 5 aa, Mycobacterium avium
KGSAL

SEQ ID NO: 38225 - protein, 7 aa, Mycobacterium avium
KGSLGGN

SEQ ID NO: 38226 - protein, 34 aa, Mycobacterium avium
KGSTLDSTIGKTMGKPRYKSSTTTRNLRTLVKVL

SEQ ID NO: 38227 - protein, 8 aa, Mycobacterium avium
KGTAGAAV

SEQ ID NO: 38228 - protein, 9 aa, Mycobacterium avium
KGTDASGRR

SEQ ID NO: 38229 - protein, 8 aa, Mycobacterium avium
KGTGNAEL

SEQ ID NO: 38230 - protein, 9 aa, Mycobacterium avium
KGTGSYDYS

SEQ ID NO: 38231 - protein, 10 aa, Mycobacterium avium
KGTIDSATKA

SEQ ID NO: 38232 - protein, 7 aa, Mycobacterium avium
KGTMTAA

SEQ ID NO: 38233 - protein, 8 aa, Mycobacterium avium
KGTSGIDL

SEQ ID NO: 38234 - protein, 7 aa, Mycobacterium avium
KGTTSGY

SEQ ID NO: 38235 - protein, 6 aa, Mycobacterium avium
KGVEKD

SEQ ID NO: 38236 - protein, 5 aa, Mycobacterium avium
KGVGP

SEQ ID NO: 38237 - protein, 7 aa, Mycobacterium avium
KGVPAGQ

SEQ ID NO: 38238 - protein, 16 aa, Mycobacterium avium
KGVRDNGKYYYFYLER

SEQ ID NO: 38239 - protein, 4 aa, Mycobacterium avium
KGWG

SEQ ID NO: 38240 - protein, 4 aa, Mycobacterium avium
KGYD

SEQ ID NO: 38241 - protein, 7 aa, Mycobacterium avium
KGYDGRT

SEQ ID NO: 38242 - protein, 11 aa, Mycobacterium avium
KGYQQGDPYGN

SEQ ID NO: 38243 - protein, 10 aa, Mycobacterium avium
KGYSTPAHSA

SEQ ID NO: 38244 - protein, 5 aa, Mycobacterium avium
KHDEV

SEQ ID NO: 38245 - protein, 11 aa, Mycobacterium avium
KHEPIDDGIGR

SEQ ID NO: 38246 - protein, 8 aa, Mycobacterium avium
KHERTGSR

SEQ ID NO: 38247 - protein, 15 aa, Mycobacterium avium
KHGDQLYSEDGSRVD

SEQ ID NO: 38248 - protein, 12 aa, Mycobacterium avium
KHGHPAKNNYGS

SEQ ID NO: 38249 - protein, 10 aa, Mycobacterium avium
KHGHPPPNGL

SEQ ID NO: 38250 - protein, 9 aa, Mycobacterium avium
KHGLDSEEA

SEQ ID NO: 38251 - protein, 8 aa, Mycobacterium avium
KHGQGSPF

SEQ ID NO: 38252 - protein, 8 aa, Mycobacterium avium
KHIDGQGR

SEQ ID NO: 38253 - protein, 8 aa, Mycobacterium avium
KHPDGRPH

SEQ ID NO: 38254 - protein, 7 aa, Mycobacterium avium
KHPERGY

SEQ ID NO: 38255 - protein, 6 aa, Mycobacterium avium
KHPGEQ

SEQ ID NO: 38256 - protein, 11 aa, Mycobacterium avium
KHPPPQTYQEA

SEQ ID NO: 38257 - protein, 13 aa, Mycobacterium avium
KHPRGAFTDDPAK

SEQ ID NO: 38258 - protein, 9 aa, Mycobacterium avium
KHPRGAFTE

SEQ ID NO: 38259 - protein, 9 aa, Mycobacterium avium
KHSTGGVGD

SEQ ID NO: 38260 - protein, 6 aa, Mycobacterium avium
KHSVNN

SEQ ID NO: 38261 - protein, 8 aa, Mycobacterium avium
KHTEYRTR

SEQ ID NO: 38262 - protein, 6 aa, Mycobacterium avium
KIADDG

SEQ ID NO: 38263 - protein, 5 aa, Mycobacterium avium
KIAES

SEQ ID NO: 38264 - protein, 12 aa, Mycobacterium avium
KIAKDRGIGGPV

SEQ ID NO: 38265 - protein, 10 aa, Mycobacterium avium
KIDEDSDVDR

SEQ ID NO: 38266 - protein, 12 aa, Mycobacterium avium
KIEPAGGEISRS

SEQ ID NO: 38267 - protein, 8 aa, Mycobacterium avium
KIEPPQGD

SEQ ID NO: 38268 - protein, 8 aa, Mycobacterium avium
KIGGDSRP

SEQ ID NO: 38269 - protein, 5 aa, Mycobacterium avium
KIGGE

SEQ ID NO: 38270 - protein, 11 aa, Mycobacterium avium
KIGTTGRGIGP

SEQ ID NO: 38271 - protein, 7 aa, Mycobacterium avium
KINEPRF

SEQ ID NO: 38272 - protein, 7 aa, Mycobacterium avium
KIRDDPR

SEQ ID NO: 38273 - protein, 21 aa, Mycobacterium avium
KIRSGRGSRPRTKTRPEHADA

SEQ ID NO: 38274 - protein, 5 aa, Mycobacterium avium
KIRTR

SEQ ID NO: 38275 - protein, 12 aa, Mycobacterium avium
KISEAPVNSEER

SEQ ID NO: 38276 - protein, 5 aa, Mycobacterium avium
KITPA

SEQ ID NO: 38277 - protein, 6 aa, Mycobacterium avium
KITPRE

SEQ ID NO: 38278 - protein, 6 aa, Mycobacterium avium
KITPSM

SEQ ID NO: 38279 - protein, 8 aa, Mycobacterium avium
KKAAAGEI

SEQ ID NO: 38280 - protein, 8 aa, Mycobacterium avium
KKAPTPTI

SEQ ID NO: 38281 - protein, 14 aa, Mycobacterium avium
KKDPFSARPLEGPR

SEQ ID NO: 38282 - protein, 7 aa, Mycobacterium avium
KKEYGQE

SEQ ID NO: 38283 - protein, 17 aa, Mycobacterium avium
KKGGLSGYPSRSESEHD

SEQ ID NO: 38284 - protein, 4 aa, Mycobacterium avium
KKGN

SEQ ID NO: 38285 - protein, 18 aa, Mycobacterium avium
KKGQKTRRREKKNVPHGA

SEQ ID NO: 38286 - protein, 10 aa, Mycobacterium avium
KKGSGTQEVA

SEQ ID NO: 38287 - protein, 7 aa, Mycobacterium avium
KKHRDHR

SEQ ID NO: 38288 - protein, 8 aa, Mycobacterium avium
KKIKTRQA

SEQ ID NO: 38289 - protein, 6 aa, Mycobacterium avium
KKKAAE

SEQ ID NO: 38290 - protein, 9 aa, Mycobacterium avium
KKLAKNPLK

SEQ ID NO: 38291 - protein, 11 aa, Mycobacterium avium
KKNRRNDPDRL

SEQ ID NO: 38292 - protein, 7 aa, Mycobacterium avium
KKPADTH

SEQ ID NO: 38293 - protein, 8 aa, Mycobacterium avium
KKPHPSGD

SEQ ID NO: 38294 - protein, 26 aa, Mycobacterium avium
KKPKPRKRGGHGGATASGDAVTAPMQ

SEQ ID NO: 38295 - protein, 13 aa, Mycobacterium avium
KKQAQESIAAEAT

SEQ ID NO: 38296 - protein, 12 aa, Mycobacterium avium
KKQDGAVKVILK

SEQ ID NO: 38297 - protein, 6 aa, Mycobacterium avium
KKRLGY

SEQ ID NO: 38298 - protein, 9 aa, Mycobacterium avium
KKSIGPDKV

SEQ ID NO: 38299 - protein, 5 aa, Mycobacterium avium
KKSLA

SEQ ID NO: 38300 - protein, 6 aa, Mycobacterium avium
KKSVGQ

SEQ ID NO: 38301 - protein, 10 aa, Mycobacterium avium
KKVTKNGSEV

SEQ ID NO: 38302 - protein, 7 aa, Mycobacterium avium
KKWGTRA

SEQ ID NO: 38303 - protein, 8 aa, Mycobacterium avium
KKYTAQEI

SEQ ID NO: 38304 - protein, 7 aa, Mycobacterium avium
KLADGRT

SEQ ID NO: 38305 - protein, 14 aa, Mycobacterium avium
KLAEAKQSHSGRAA

SEQ ID NO: 38306 - protein, 6 aa, Mycobacterium avium
KLAGTP

SEQ ID NO: 38307 - protein, 7 aa, Mycobacterium avium
KLAPDFD

SEQ ID NO: 38308 - protein, 9 aa, Mycobacterium avium
KLAPKGTGA

SEQ ID NO: 38309 - protein, 8 aa, Mycobacterium avium
KLASGDVN

SEQ ID NO: 38310 - protein, 4 aa, Mycobacterium avium
KLDG

SEQ ID NO: 38311 - protein, 6 aa, Mycobacterium avium
KLDPND

SEQ ID NO: 38312 - protein, 17 aa, Mycobacterium avium
KLENGTKAIYNPHYEIQ

SEQ ID NO: 38313 - protein, 5 aa, Mycobacterium avium
KLGDA

SEQ ID NO: 38314 - protein, 5 aa, Mycobacterium avium
KLGDD

SEQ ID NO: 38315 - protein, 7 aa, Mycobacterium avium
KLGKETG

SEQ ID NO: 38316 - protein, 13 aa, Mycobacterium avium
KLGPDEAGLEPAY

SEQ ID NO: 38317 - protein, 9 aa, Mycobacterium avium
KLGRGPAVT

SEQ ID NO: 38318 - protein, 11 aa, Mycobacterium avium
KLGTRSVASGE

SEQ ID NO: 38319 - protein, 5 aa, Mycobacterium avium
KLNGL

SEQ ID NO: 38320 - protein, 5 aa, Mycobacterium avium
KLNPG

SEQ ID NO: 38321 - protein, 6 aa, Mycobacterium avium
KLPDDP

SEQ ID NO: 38322 - protein, 6 aa, Mycobacterium avium
KLPDGW

SEQ ID NO: 38323 - protein, 7 aa, Mycobacterium avium
KLPKSTL

SEQ ID NO: 38324 - protein, 8 aa, Mycobacterium avium
KLPPPASQ

SEQ ID NO: 38325 - protein, 4 aa, Mycobacterium avium
KLPT

SEQ ID NO: 38326 - protein, 6 aa, Mycobacterium avium
KLRPKI

SEQ ID NO: 38327 - protein, 16 aa, Mycobacterium avium
KLRQAAADCNAVILAG

SEQ ID NO: 38328 - protein, 6 aa, Mycobacterium avium
KLSGRD

SEQ ID NO: 38329 - protein, 7 aa, Mycobacterium avium
KLSGSHR

SEQ ID NO: 38330 - protein, 9 aa, Mycobacterium avium
KLSPTVDMT

SEQ ID NO: 38331 - protein, 4 aa, Mycobacterium avium
KLTS

SEQ ID NO: 38332 - protein, 7 aa, Mycobacterium avium
KMQEQVS

SEQ ID NO: 38333 - protein, 7 aa, Mycobacterium avium
KNAAGVT

SEQ ID NO: 38334 - protein, 8 aa, Mycobacterium avium
KNAGPGGT

SEQ ID NO: 38335 - protein, 8 aa, Mycobacterium avium
KNDAEEAQ

SEQ ID NO: 38336 - protein, 7 aa, Mycobacterium avium
KNDGHAD

SEQ ID NO: 38337 - protein, 7 aa, Mycobacterium avium
KNFAGDG

SEQ ID NO: 38338 - protein, 12 aa, Mycobacterium avium
KNFRNGALNPNA

SEQ ID NO: 38339 - protein, 13 aa, Mycobacterium avium
KNFRNGARNPNAF

SEQ ID NO: 38340 - protein, 9 aa, Mycobacterium avium
KNGDSRVPT

SEQ ID NO: 38341 - protein, 7 aa, Mycobacterium avium
KNGLTED

SEQ ID NO: 38342 - protein, 5 aa, Mycobacterium avium
KNGPY

SEQ ID NO: 38343 - protein, 12 aa, Mycobacterium avium
KNHPHPSGKPVT

SEQ ID NO: 38344 - protein, 8 aa, Mycobacterium avium
KNKDNRDD

SEQ ID NO: 38345 - protein, 6 aa, Mycobacterium avium
KNKGVQ

SEQ ID NO: 38346 - protein, 9 aa, Mycobacterium avium
KNMEGSDDI

SEQ ID NO: 38347 - protein, 5 aa, Mycobacterium avium
KNPGL

SEQ ID NO: 38348 - protein, 7 aa, Mycobacterium avium
KNPRVEL

SEQ ID NO: 38349 - protein, 12 aa, Mycobacterium avium
KNQSSDVGPRAI

SEQ ID NO: 38350 - protein, 6 aa, Mycobacterium avium
KNREAG

SEQ ID NO: 38351 - protein, 5 aa, Mycobacterium avium
KNRNN

SEQ ID NO: 38352 - protein, 8 aa, Mycobacterium avium
KNRRNDPD

SEQ ID NO: 38353 - protein, 8 aa, Mycobacterium avium
KNSDESKL

SEQ ID NO: 38354 - protein, 14 aa, Mycobacterium avium
KNSGIGRENGPEGV

SEQ ID NO: 38355 - protein, 16 aa, Mycobacterium avium
KNSRHGLQNPNARYRK

SEQ ID NO: 38356 - protein, 10 aa, Mycobacterium avium
KNVPTSRSES

SEQ ID NO: 38357 - protein, 17 aa, Mycobacterium avium
KNYAGTSPLTVASGRKR

SEQ ID NO: 38358 - protein, 6 aa, Mycobacterium avium
KPAAYT

SEQ ID NO: 38359 - protein, 5 aa, Mycobacterium avium
KPADI

SEQ ID NO: 38360 - protein, 8 aa, Mycobacterium avium
KPAEETPL

SEQ ID NO: 38361 - protein, 13 aa, Mycobacterium avium
KPAEGVPGTERTP

SEQ ID NO: 38362 - protein, 8 aa, Mycobacterium avium
KPAHVQSA

SEQ ID NO: 38363 - protein, 4 aa, Mycobacterium avium
KPAR

SEQ ID NO: 38364 - protein, 8 aa, Mycobacterium avium
KPASRDDA

SEQ ID NO: 38365 - protein, 6 aa, Mycobacterium avium
KPDAEK

SEQ ID NO: 38366 - protein, 7 aa, Mycobacterium avium
KPDARGA

SEQ ID NO: 38367 - protein, 16 aa, Mycobacterium avium
KPDEPFQPYARDPETL

SEQ ID NO: 38368 - protein, 8 aa, Mycobacterium avium
KPDETAAA

SEQ ID NO: 38369 - protein, 8 aa, Mycobacterium avium
KPDGSRDA

SEQ ID NO: 38370 - protein, 21 aa, Mycobacterium avium
KPDQYANPEGPASHYATTGPE

SEQ ID NO: 38371 - protein, 9 aa, Mycobacterium avium
KPEAEGGFS

SEQ ID NO: 38372 - protein, 10 aa, Mycobacterium avium
KPEDLANGAS

SEQ ID NO: 38373 - protein, 5 aa, Mycobacterium avium
KPEDW

SEQ ID NO: 38374 - protein, 8 aa, Mycobacterium avium
KPEGVGQT

SEQ ID NO: 38375 - protein, 6 aa, Mycobacterium avium
KPEIAQ

SEQ ID NO: 38376 - protein, 7 aa, Mycobacterium avium
KPENKRA

SEQ ID NO: 38377 - protein, 15 aa, Mycobacterium avium
KPEPHNEIPQAQSAH

SEQ ID NO: 38378 - protein, 7 aa, Mycobacterium avium
KPERQRG

SEQ ID NO: 38379 - protein, 7 aa, Mycobacterium avium
KPESVDT

SEQ ID NO: 38380 - protein, 6 aa, Mycobacterium avium
KPEVVS

SEQ ID NO: 38381 - protein, 5 aa, Mycobacterium avium
KPFGL

SEQ ID NO: 38382 - protein, 7 aa, Mycobacterium avium
KPFPPPC

SEQ ID NO: 38383 - protein, 4 aa, Mycobacterium avium
KPGD

SEQ ID NO: 38384 - protein, 10 aa, Mycobacterium avium
KPGEPLPADA

SEQ ID NO: 38385 - protein, 7 aa, Mycobacterium avium
KPGGGER

SEQ ID NO: 38386 - protein, 12 aa, Mycobacterium avium
KPGGQQGGEPAP

SEQ ID NO: 38387 - protein, 8 aa, Mycobacterium avium
KPGKGPAF

SEQ ID NO: 38388 - protein, 6 aa, Mycobacterium avium
KPGRHG

SEQ ID NO: 38389 - protein, 10 aa, Mycobacterium avium
KPGSGPRQPG

SEQ ID NO: 38390 - protein, 4 aa, Mycobacterium avium
KPGV

SEQ ID NO: 38391 - protein, 7 aa, Mycobacterium avium
KPGYGED

SEQ ID NO: 38392 - protein, 20 aa, Mycobacterium avium
KPIGTAEFGTRTETKNVNSL

SEQ ID NO: 38393 - protein, 10 aa, Mycobacterium avium
KPKGMDEEMT

SEQ ID NO: 38394 - protein, 13 aa, Mycobacterium avium
KPLAGADPRSGRW

SEQ ID NO: 38395 - protein, 6 aa, Mycobacterium avium
KPLART

SEQ ID NO: 38396 - protein, 5 aa, Mycobacterium avium
KPLEE

SEQ ID NO: 38397 - protein, 15 aa, Mycobacterium avium
KPLGGPDGGNGGRGG

SEQ ID NO: 38398 - protein, 12 aa, Mycobacterium avium
KPLGRVSRPAEQ

SEQ ID NO: 38399 - protein, 8 aa, Mycobacterium avium
KPLPTPGE

SEQ ID NO: 38400 - protein, 6 aa, Mycobacterium avium
KPLPVD

SEQ ID NO: 38401 - protein, 8 aa, Mycobacterium avium
KPLQPADE

SEQ ID NO: 38402 - protein, 5 aa, Mycobacterium avium
KPLRG

SEQ ID NO: 38403 - protein, 9 aa, Mycobacterium avium
KPMSAERAK

SEQ ID NO: 38404 - protein, 21 aa, Mycobacterium avium
KPNADHKPSDSASKPKRRKGV

SEQ ID NO: 38405 - protein, 8 aa, Mycobacterium avium
KPNVGKSS

SEQ ID NO: 38406 - protein, 7 aa, Mycobacterium avium
KPPEGMT

SEQ ID NO: 38407 - protein, 5 aa, Mycobacterium avium
KPPEL

SEQ ID NO: 38408 - protein, 7 aa, Mycobacterium avium
KPPPFEE

SEQ ID NO: 38409 - protein, 10 aa, Mycobacterium avium
KPQELTESGE

SEQ ID NO: 38410 - protein, 7 aa, Mycobacterium avium
KPRPSDI

SEQ ID NO: 38411 - protein, 5 aa, Mycobacterium avium
KPRQV

SEQ ID NO: 38412 - protein, 17 aa, Mycobacterium avium
KPRTGDGPLEATKEGRG

SEQ ID NO: 38413 - protein, 9 aa, Mycobacterium avium
KPSASKGRY

SEQ ID NO: 38414 - protein, 14 aa, Mycobacterium avium
KPSRGLAPYGPQTG

SEQ ID NO: 38415 - protein, 6 aa, Mycobacterium avium
KPSVTA

SEQ ID NO: 38416 - protein, 7 aa, Mycobacterium avium
KPTKGQI

SEQ ID NO: 38417 - protein, 5 aa, Mycobacterium avium
KPTQD

SEQ ID NO: 38418 - protein, 28 aa, Mycobacterium avium
KPTTRTRRLEGRTTVSANDTKRVNSLLN

SEQ ID NO: 38419 - protein, 5 aa, Mycobacterium avium
KPTVR

SEQ ID NO: 38420 - protein, 6 aa, Mycobacterium avium
KPTVSG

SEQ ID NO: 38421 - protein, 4 aa, Mycobacterium avium
KPTY

SEQ ID NO: 38422 - protein, 7 aa, Mycobacterium avium
KPTYGTV

SEQ ID NO: 38423 - protein, 11 aa, Mycobacterium avium
KPVGRRGQDGL

SEQ ID NO: 38424 - protein, 23 aa, Mycobacterium avium
KPVSGPSGNPAGPLWPESRTCHP

SEQ ID NO: 38425 - protein, 5 aa, Mycobacterium avium
KPYRA

SEQ ID NO: 38426 - protein, 6 aa, Mycobacterium avium
KQAEAY

SEQ ID NO: 38427 - protein, 8 aa, Mycobacterium avium
KQAEEATD

SEQ ID NO: 38428 - protein, 12 aa, Mycobacterium avium
KQAIGRATNNVA

SEQ ID NO: 38429 - protein, 5 aa, Mycobacterium avium
KQAKD

SEQ ID NO: 38430 - protein, 7 aa, Mycobacterium avium
KQARQAA

SEQ ID NO: 38431 - protein, 10 aa, Mycobacterium avium
KQAVGKNFRS

SEQ ID NO: 38432 - protein, 4 aa, Mycobacterium avium
KQDL

SEQ ID NO: 38433 - protein, 8 aa, Mycobacterium avium
KQDSTTAT

SEQ ID NO: 38434 - protein, 8 aa, Mycobacterium avium
KQELGPGV

SEQ ID NO: 38435 - protein, 15 aa, Mycobacterium avium
KQETRGKILGGSSAA

SEQ ID NO: 38436 - protein, 6 aa, Mycobacterium avium
KQIDGA

SEQ ID NO: 38437 - protein, 5 aa, Mycobacterium avium
KQKAR

SEQ ID NO: 38438 - protein, 4 aa, Mycobacterium avium
KQKH

SEQ ID NO: 38439 - protein, 7 aa, Mycobacterium avium
KQKVGQI

SEQ ID NO: 38440 - protein, 6 aa, Mycobacterium avium
KQLEED

SEQ ID NO: 38441 - protein, 6 aa, Mycobacterium avium
KQLSPR

SEQ ID NO: 38442 - protein, 5 aa, Mycobacterium avium
KQLTD

SEQ ID NO: 38443 - protein, 8 aa, Mycobacterium avium
KQNPMSTS

SEQ ID NO: 38444 - protein, 6 aa, Mycobacterium avium
KQNTSS

SEQ ID NO: 38445 - protein, 4 aa, Mycobacterium avium
KQPA

SEQ ID NO: 38446 - protein, 9 aa, Mycobacterium avium
KQPGESRDQ

SEQ ID NO: 38447 - protein, 9 aa, Mycobacterium avium
KQQATRERR

SEQ ID NO: 38448 - protein, 8 aa, Mycobacterium avium
KQQRPASA

SEQ ID NO: 38449 - protein, 25 aa, Mycobacterium avium
KQRAQAASGPAGGPAPADGGPGISA

SEQ ID NO: 38450 - protein, 7 aa, Mycobacterium avium
KQRGAKG

SEQ ID NO: 38451 - protein, 7 aa, Mycobacterium avium
KQSESNA

SEQ ID NO: 38452 - protein, 6 aa, Mycobacterium avium
KQTERP

SEQ ID NO: 38453 - protein, 6 aa, Mycobacterium avium
KQVTPA

SEQ ID NO: 38454 - protein, 4 aa, Mycobacterium avium
KQWP

SEQ ID NO: 38455 - protein, 10 aa, Mycobacterium avium
KQYPGELSGG

SEQ ID NO: 38456 - protein, 9 aa, Mycobacterium avium
KRAAAAQRF

SEQ ID NO: 38457 - protein, 8 aa, Mycobacterium avium
KRAEPTDD

SEQ ID NO: 38458 - protein, 9 aa, Mycobacterium avium
KRAERQPQA

SEQ ID NO: 38459 - protein, 4 aa, Mycobacterium avium
KRAG

SEQ ID NO: 38460 - protein, 9 aa, Mycobacterium avium
KRAQQAERI

SEQ ID NO: 38461 - protein, 20 aa, Mycobacterium avium
KRASPSAGSLATIADPAKLA

SEQ ID NO: 38462 - protein, 9 aa, Mycobacterium avium
KRDDKLARA

SEQ ID NO: 38463 - protein, 4 aa, Mycobacterium avium
KRDP

SEQ ID NO: 38464 - protein, 8 aa, Mycobacterium avium
KRDPKGLY

SEQ ID NO: 38465 - protein, 5 aa, Mycobacterium avium
KRDSE

SEQ ID NO: 38466 - protein, 6 aa, Mycobacterium avium
KRDTVG

SEQ ID NO: 38467 - protein, 8 aa, Mycobacterium avium
KRENADEK

SEQ ID NO: 38468 - protein, 5 aa, Mycobacterium avium
KRESL

SEQ ID NO: 38469 - protein, 10 aa, Mycobacterium avium
KRFRRTGTGK

SEQ ID NO: 38470 - protein, 5 aa, Mycobacterium avium
KRGGS

SEQ ID NO: 38471 - protein, 6 aa, Mycobacterium avium
KRGPGI

SEQ ID NO: 38472 - protein, 6 aa, Mycobacterium avium
KRGPLP

SEQ ID NO: 38473 - protein, 4 aa, Mycobacterium avium
KRGR

SEQ ID NO: 38474 - protein, 5 aa, Mycobacterium avium
KRGRR

SEQ ID NO: 38475 - protein, 4 aa, Mycobacterium avium
KRGS

SEQ ID NO: 38476 - protein, 8 aa, Mycobacterium avium
KRGYGTAA

SEQ ID NO: 38477 - protein, 23 aa, Mycobacterium avium
KRGYTTGQVRDRESGDPAATTIE

SEQ ID NO: 38478 - protein, 8 aa, Mycobacterium avium
KRHDATAK

SEQ ID NO: 38479 - protein, 13 aa, Mycobacterium avium
KRHRQGRRTAREN

SEQ ID NO: 38480 - protein, 8 aa, Mycobacterium avium
KRKPIATG

SEQ ID NO: 38481 - protein, 13 aa, Mycobacterium avium
KRLGADKGMQIGS

SEQ ID NO: 38482 - protein, 16 aa, Mycobacterium avium
KRLGARTSGYDVRPEV

SEQ ID NO: 38483 - protein, 10 aa, Mycobacterium avium
KRLGENRKRD

SEQ ID NO: 38484 - protein, 7 aa, Mycobacterium avium
KRNKDKP

SEQ ID NO: 38485 - protein, 4 aa, Mycobacterium avium
KRPA

SEQ ID NO: 38486 - protein, 5 aa, Mycobacterium avium
KRPDR

SEQ ID NO: 38487 - protein, 7 aa, Mycobacterium avium
KRPGTGD

SEQ ID NO: 38488 - protein, 8 aa, Mycobacterium avium
KRPKAEIK

SEQ ID NO: 38489 - protein, 8 aa, Mycobacterium avium
KRPRGSQL

SEQ ID NO: 38490 - protein, 6 aa, Mycobacterium avium
KRPYDE

SEQ ID NO: 38491 - protein, 17 aa, Mycobacterium avium
KRQASPGHAFSPDTPWQ

SEQ ID NO: 38492 - protein, 4 aa, Mycobacterium avium
KRQP

SEQ ID NO: 38493 - protein, 6 aa, Mycobacterium avium
KRRAAA

SEQ ID NO: 38494 - protein, 5 aa, Mycobacterium avium
KRRDE

SEQ ID NO: 38495 - protein, 9 aa, Mycobacterium avium
KRRTPKAAF

SEQ ID NO: 38496 - protein, 7 aa, Mycobacterium avium
KRRVPAT

SEQ ID NO: 38497 - protein, 11 aa, Mycobacterium avium
KRSARGQGHTT

SEQ ID NO: 38498 - protein, 13 aa, Mycobacterium avium
KRSDSTTSPPGIS

SEQ ID NO: 38499 - protein, 5 aa, Mycobacterium avium
KRSED

SEQ ID NO: 38500 - protein, 8 aa, Mycobacterium avium
KRSGYGRE

SEQ ID NO: 38501 - protein, 10 aa, Mycobacterium avium
KRSPAGKPDY

SEQ ID NO: 38502 - protein, 8 aa, Mycobacterium avium
KRTAQKVA

SEQ ID NO: 38503 - protein, 7 aa, Mycobacterium avium
KRTEADE

SEQ ID NO: 38504 - protein, 5 aa, Mycobacterium avium
KRTGQ

SEQ ID NO: 38505 - protein, 8 aa, Mycobacterium avium
KRTLQDNG

SEQ ID NO: 38506 - protein, 7 aa, Mycobacterium avium
KRTRGGK

SEQ ID NO: 38507 - protein, 5 aa, Mycobacterium avium
KRVPG

SEQ ID NO: 38508 - protein, 10 aa, Mycobacterium avium
KRWPEERTTW

SEQ ID NO: 38509 - protein, 9 aa, Mycobacterium avium
KRYATAGKQ

SEQ ID NO: 38510 - protein, 9 aa, Mycobacterium avium
KRYDNTQYR

SEQ ID NO: 38511 - protein, 9 aa, Mycobacterium avium
KRYDRQAPR

SEQ ID NO: 38512 - protein, 18 aa, Mycobacterium avium
KRYPGTGERELAQPYGAT

SEQ ID NO: 38513 - protein, 9 aa, Mycobacterium avium
KSADPETKS

SEQ ID NO: 38514 - protein, 7 aa, Mycobacterium avium
KSALGAG

SEQ ID NO: 38515 - protein, 11 aa, Mycobacterium avium
KSATDLGGLPG

SEQ ID NO: 38516 - protein, 6 aa, Mycobacterium avium
KSAVMG

SEQ ID NO: 38517 - protein, 6 aa, Mycobacterium avium
KSDEVL

SEQ ID NO: 38518 - protein, 5 aa, Mycobacterium avium
KSDLE

SEQ ID NO: 38519 - protein, 7 aa, Mycobacterium avium
KSDPDLA

SEQ ID NO: 38520 - protein, 20 aa, Mycobacterium avium
KSDYPDGVADHDRPLAPRGI

SEQ ID NO: 38521 - protein, 10 aa, Mycobacterium avium
KSELRGNPAL

SEQ ID NO: 38522 - protein, 6 aa, Mycobacterium avium
KSEPYC

SEQ ID NO: 38523 - protein, 5 aa, Mycobacterium avium
KSETL

SEQ ID NO: 38524 - protein, 5 aa, Mycobacterium avium
KSGAA

SEQ ID NO: 38525 - protein, 7 aa, Mycobacterium avium
KSGADAI

SEQ ID NO: 38526 - protein, 10 aa, Mycobacterium avium
KSGAIKTNIR

SEQ ID NO: 38527 - protein, 11 aa, Mycobacterium avium
KSGASARGQAA

SEQ ID NO: 38528 - protein, 5 aa, Mycobacterium avium
KSGDI

SEQ ID NO: 38529 - protein, 10 aa, Mycobacterium avium
KSGDPAQRAA

SEQ ID NO: 38530 - protein, 8 aa, Mycobacterium avium
KSGDPRAA

SEQ ID NO: 38531 - protein, 9 aa, Mycobacterium avium
KSGEGGEES

SEQ ID NO: 38532 - protein, 5 aa, Mycobacterium avium
KSGLS

SEQ ID NO: 38533 - protein, 8 aa, Mycobacterium avium
KSGRSEGA

SEQ ID NO: 38534 - protein, 5 aa, Mycobacterium avium
KSGTL

SEQ ID NO: 38535 - protein, 5 aa, Mycobacterium avium
KSGTV

SEQ ID NO: 38536 - protein, 11 aa, Mycobacterium avium
KSHPADDGGKA

SEQ ID NO: 38537 - protein, 8 aa, Mycobacterium avium
KSHPGGGD

SEQ ID NO: 38538 - protein, 8 aa, Mycobacterium avium
KSKGRPAI

SEQ ID NO: 38539 - protein, 9 aa, Mycobacterium avium
KSKNASAAY

SEQ ID NO: 38540 - protein, 5 aa, Mycobacterium avium
KSLLP

SEQ ID NO: 38541 - protein, 6 aa, Mycobacterium avium
KSLPER

SEQ ID NO: 38542 - protein, 11 aa, Mycobacterium avium
KSLRQGADSTT

SEQ ID NO: 38543 - protein, 6 aa, Mycobacterium avium
KSLRSR

SEQ ID NO: 38544 - protein, 8 aa, Mycobacterium avium
KSLSGGMR

SEQ ID NO: 38545 - protein, 7 aa, Mycobacterium avium
KSLSGSA

SEQ ID NO: 38546 - protein, 12 aa, Mycobacterium avium
KSMTPTSLGGTP

SEQ ID NO: 38547 - protein, 6 aa, Mycobacterium avium
KSPAGA

SEQ ID NO: 38548 - protein, 8 aa, Mycobacterium avium
KSQDPQRY

SEQ ID NO: 38549 - protein, 9 aa, Mycobacterium avium
KSQGSQADE

SEQ ID NO: 38550 - protein, 5 aa, Mycobacterium avium
KSQIG

SEQ ID NO: 38551 - protein, 6 aa, Mycobacterium avium
KSQKQV

SEQ ID NO: 38552 - protein, 9 aa, Mycobacterium avium
KSQSGRPVP

SEQ ID NO: 38553 - protein, 7 aa, Mycobacterium avium
KSRDYDD

SEQ ID NO: 38554 - protein, 7 aa, Mycobacterium avium
KSRFTQG

SEQ ID NO: 38555 - protein, 18 aa, Mycobacterium avium
KSRVDAGGFEGRRPDQPQ

SEQ ID NO: 38556 - protein, 8 aa, Mycobacterium avium
KSRVQGAD

SEQ ID NO: 38557 - protein, 5 aa, Mycobacterium avium
KSSAG

SEQ ID NO: 38558 - protein, 15 aa, Mycobacterium avium
KSSITPRDALASAGK

SEQ ID NO: 38559 - protein, 14 aa, Mycobacterium avium
KSSLGAGLASPGHI

SEQ ID NO: 38560 - protein, 6 aa, Mycobacterium avium
KSSPTC

SEQ ID NO: 38561 - protein, 7 aa, Mycobacterium avium
KSTPGMR

SEQ ID NO: 38562 - protein, 6 aa, Mycobacterium avium
KSWQES

SEQ ID NO: 38563 - protein, 6 aa, Mycobacterium avium
KSYGGA

SEQ ID NO: 38564 - protein, 7 aa, Mycobacterium avium
KSYGKGS

SEQ ID NO: 38565 - protein, 4 aa, Mycobacterium avium
KSYR

SEQ ID NO: 38566 - protein, 9 aa, Mycobacterium avium
KTAAAQAGG

SEQ ID NO: 38567 - protein, 7 aa, Mycobacterium avium
KTAARRA

SEQ ID NO: 38568 - protein, 8 aa, Mycobacterium avium
KTAGDSGK

SEQ ID NO: 38569 - protein, 5 aa, Mycobacterium avium
KTAKA

SEQ ID NO: 38570 - protein, 4 aa, Mycobacterium avium
KTAP

SEQ ID NO: 38571 - protein, 14 aa, Mycobacterium avium
KTAVQRNSGKNTAK

SEQ ID NO: 38572 - protein, 7 aa, Mycobacterium avium
KTAVSSS

SEQ ID NO: 38573 - protein, 7 aa, Mycobacterium avium
KTDGIAT

SEQ ID NO: 38574 - protein, 5 aa, Mycobacterium avium
KTDRF

SEQ ID NO: 38575 - protein, 7 aa, Mycobacterium avium
KTDVPGL

SEQ ID NO: 38576 - protein, 9 aa, Mycobacterium avium
KTEADGEPR

SEQ ID NO: 38577 - protein, 14 aa, Mycobacterium avium
KTEPIGPGTSPERG

SEQ ID NO: 38578 - protein, 18 aa, Mycobacterium avium
KTESGSPIPSYDAAREEI

SEQ ID NO: 38579 - protein, 7 aa, Mycobacterium avium
KTFTAPA

SEQ ID NO: 38580 - protein, 4 aa, Mycobacterium avium
KTGA

SEQ ID NO: 38581 - protein, 7 aa, Mycobacterium avium
KTGKAEK

SEQ ID NO: 38582 - protein, 7 aa, Mycobacterium avium
KTGKPGH

SEQ ID NO: 38583 - protein, 6 aa, Mycobacterium avium
KTGKVA

SEQ ID NO: 38584 - protein, 13 aa, Mycobacterium avium
KTGNAQPPKDPTL

SEQ ID NO: 38585 - protein, 7 aa, Mycobacterium avium
KTGNQRA

SEQ ID NO: 38586 - protein, 5 aa, Mycobacterium avium
KTGPA

SEQ ID NO: 38587 - protein, 5 aa, Mycobacterium avium
KTGQH

SEQ ID NO: 38588 - protein, 6 aa, Mycobacterium avium
KTGRPY

SEQ ID NO: 38589 - protein, 4 aa, Mycobacterium avium
KTGV

SEQ ID NO: 38590 - protein, 6 aa, Mycobacterium avium
KTGYTT

SEQ ID NO: 38591 - protein, 5 aa, Mycobacterium avium
KTHPA

SEQ ID NO: 38592 - protein, 8 aa, Mycobacterium avium
KTIESGSL

SEQ ID NO: 38593 - protein, 4 aa, Mycobacterium avium
KTIG

SEQ ID NO: 38594 - protein, 5 aa, Mycobacterium avium
KTKNN

SEQ ID NO: 38595 - protein, 6 aa, Mycobacterium avium
KTLGED

SEQ ID NO: 38596 - protein, 4 aa, Mycobacterium avium
KTND

SEQ ID NO: 38597 - protein, 18 aa, Mycobacterium avium
KTNERARLRNKSVKSSLR

SEQ ID NO: 38598 - protein, 8 aa, Mycobacterium avium
KTNTPRNF

SEQ ID NO: 38599 - protein, 6 aa, Mycobacterium avium
KTPEGY

SEQ ID NO: 38600 - protein, 7 aa, Mycobacterium avium
KTPEQSL

SEQ ID NO: 38601 - protein, 7 aa, Mycobacterium avium
KTPLQKR

SEQ ID NO: 38602 - protein, 5 aa, Mycobacterium avium
KTPPT

SEQ ID NO: 38603 - protein, 8 aa, Mycobacterium avium
KTPYGQPE

SEQ ID NO: 38604 - protein, 5 aa, Mycobacterium avium
KTPYH

SEQ ID NO: 38605 - protein, 4 aa, Mycobacterium avium
KTQD

SEQ ID NO: 38606 - protein, 4 aa, Mycobacterium avium
KTQT

SEQ ID NO: 38607 - protein, 5 aa, Mycobacterium avium
KTQTT

SEQ ID NO: 38608 - protein, 10 aa, Mycobacterium avium
KTRNPDEVSA

SEQ ID NO: 38609 - protein, 7 aa, Mycobacterium avium
KTRRPSV

SEQ ID NO: 38610 - protein, 9 aa, Mycobacterium avium
KTRTQFGQP

SEQ ID NO: 38611 - protein, 5 aa, Mycobacterium avium
KTSPA

SEQ ID NO: 38612 - protein, 7 aa, Mycobacterium avium
KTTDLAE

SEQ ID NO: 38613 - protein, 12 aa, Mycobacterium avium
KTTEPKARALRP

SEQ ID NO: 38614 - protein, 5 aa, Mycobacterium avium
KTTSV

SEQ ID NO: 38615 - protein, 5 aa, Mycobacterium avium
KTTTL

SEQ ID NO: 38616 - protein, 6 aa, Mycobacterium avium
KTTTVD

SEQ ID NO: 38617 - protein, 4 aa, Mycobacterium avium
KTTV

SEQ ID NO: 38618 - protein, 5 aa, Mycobacterium avium
KTVAP

SEQ ID NO: 38619 - protein, 8 aa, Mycobacterium avium
KTVAPGPL

SEQ ID NO: 38620 - protein, 8 aa, Mycobacterium avium
KTWATNGG

SEQ ID NO: 38621 - protein, 5 aa, Mycobacterium avium
KTYEE

SEQ ID NO: 38622 - protein, 5 aa, Mycobacterium avium
KTYGG

SEQ ID NO: 38623 - protein, 6 aa, Mycobacterium avium
KTYNAG

SEQ ID NO: 38624 - protein, 4 aa, Mycobacterium avium
KVAA

SEQ ID NO: 38625 - protein, 13 aa, Mycobacterium avium
KVAEAAAGVPLGE

SEQ ID NO: 38626 - protein, 10 aa, Mycobacterium avium
KVAEPGQTLA

SEQ ID NO: 38627 - protein, 6 aa, Mycobacterium avium
KVAGER

SEQ ID NO: 38628 - protein, 4 aa, Mycobacterium avium
KVAP

SEQ ID NO: 38629 - protein, 10 aa, Mycobacterium avium
KVDAKQPGDY

SEQ ID NO: 38630 - protein, 9 aa, Mycobacterium avium
KVDGADGPD

SEQ ID NO: 38631 - protein, 11 aa, Mycobacterium avium
KVDSDKAEADA

SEQ ID NO: 38632 - protein, 8 aa, Mycobacterium avium
KVEDGKTD

SEQ ID NO: 38633 - protein, 8 aa, Mycobacterium avium
KVEGDTSV

SEQ ID NO: 38634 - protein, 6 aa, Mycobacterium avium
KVEGNE

SEQ ID NO: 38635 - protein, 8 aa, Mycobacterium avium
KVERRSAR

SEQ ID NO: 38636 - protein, 4 aa, Mycobacterium avium
KVGE

SEQ ID NO: 38637 - protein, 15 aa, Mycobacterium avium
KVGEAPKQSGVALPG

SEQ ID NO: 38638 - protein, 7 aa, Mycobacterium avium
KVGEDDV

SEQ ID NO: 38639 - protein, 5 aa, Mycobacterium avium
KVGNE

SEQ ID NO: 38640 - protein, 7 aa, Mycobacterium avium
KVGRDAG

SEQ ID NO: 38641 - protein, 12 aa, Mycobacterium avium
KVHYGDKTPVSL

SEQ ID NO: 38642 - protein, 14 aa, Mycobacterium avium
KVKPGGHYDAQHFA

SEQ ID NO: 38643 - protein, 5 aa, Mycobacterium avium
KVNDE

SEQ ID NO: 38644 - protein, 6 aa, Mycobacterium avium
KVPAAE

SEQ ID NO: 38645 - protein, 6 aa, Mycobacterium avium
KVPGRT

SEQ ID NO: 38646 - protein, 7 aa, Mycobacterium avium
KVPGTAM

SEQ ID NO: 38647 - protein, 7 aa, Mycobacterium avium
KVPKDRV

SEQ ID NO: 38648 - protein, 4 aa, Mycobacterium avium
KVPP

SEQ ID NO: 38649 - protein, 10 aa, Mycobacterium avium
KVPRERSAEL

SEQ ID NO: 38650 - protein, 9 aa, Mycobacterium avium
KVPSEEVPA

SEQ ID NO: 38651 - protein, 7 aa, Mycobacterium avium
KVPTPLP

SEQ ID NO: 38652 - protein, 19 aa, Mycobacterium avium
KVRAGYDAPFPDKTYQAGA

SEQ ID NO: 38653 - protein, 22 aa, Mycobacterium avium
KVREAGDAGWSDPQAQARAEQF

SEQ ID NO: 38654 - protein, 15 aa, Mycobacterium avium
KVRESRIDDRGQEFP

SEQ ID NO: 38655 - protein, 9 aa, Mycobacterium avium
KVSETTEHG

SEQ ID NO: 38656 - protein, 8 aa, Mycobacterium avium
KVSGGSTF

SEQ ID NO: 38657 - protein, 9 aa, Mycobacterium avium
KVSPSPPRV

SEQ ID NO: 38658 - protein, 7 aa, Mycobacterium avium
KVTAPDG

SEQ ID NO: 38659 - protein, 4 aa, Mycobacterium avium
KVTE

SEQ ID NO: 38660 - protein, 8 aa, Mycobacterium avium
KVTSDELG

SEQ ID NO: 38661 - protein, 8 aa, Mycobacterium avium
KVTSEELG

SEQ ID NO: 38662 - protein, 6 aa, Mycobacterium avium
KWGSDR

SEQ ID NO: 38663 - protein, 15 aa, Mycobacterium avium
KYEPATGPDGTPGPD

SEQ ID NO: 38664 - protein, 7 aa, Mycobacterium avium
KYGGRDA

SEQ ID NO: 38665 - protein, 8 aa, Mycobacterium avium
KYGGRRPE

SEQ ID NO: 38666 - protein, 5 aa, Mycobacterium avium
KYGKV

SEQ ID NO: 38667 - protein, 6 aa, Mycobacterium avium
KYGNER

SEQ ID NO: 38668 - protein, 6 aa, Mycobacterium avium
KYGNKI

SEQ ID NO: 38669 - protein, 12 aa, Mycobacterium avium
KYGNPADPETGE

SEQ ID NO: 38670 - protein, 6 aa, Mycobacterium avium
KYNVNG

SEQ ID NO: 38671 - protein, 10 aa, Mycobacterium avium
KYPDGSTPPV

SEQ ID NO: 38672 - protein, 4 aa, Mycobacterium avium
KYRD

SEQ ID NO: 38673 - protein, 5 aa, Mycobacterium avium
KYRDE

SEQ ID NO: 38674 - protein, 5 aa, Mycobacterium avium
KYRDT

SEQ ID NO: 38675 - protein, 9 aa, Mycobacterium avium
KYSSPQTDF

SEQ ID NO: 38676 - protein, 6 aa, Mycobacterium avium
LAAAAG

SEQ ID NO: 38677 - protein, 13 aa, Mycobacterium avium
LAAASGVDGAPQV

SEQ ID NO: 38678 - protein, 17 aa, Mycobacterium avium
LAAATTDRLRRQTEAHR

SEQ ID NO: 38679 - protein, 7 aa, Mycobacterium avium
LAAEGKR

SEQ ID NO: 38680 - protein, 8 aa, Mycobacterium avium
LAAGASTA

SEQ ID NO: 38681 - protein, 6 aa, Mycobacterium avium
LAAGDA

SEQ ID NO: 38682 - protein, 7 aa, Mycobacterium avium
LAAGDRS

SEQ ID NO: 38683 - protein, 18 aa, Mycobacterium avium
LAAGGGAAAPAAAAPTQA

SEQ ID NO: 38684 - protein, 10 aa, Mycobacterium avium
LAAGGGAAHD

SEQ ID NO: 38685 - protein, 8 aa, Mycobacterium avium
LAAQDNGK

SEQ ID NO: 38686 - protein, 7 aa, Mycobacterium avium
LAAQTTK

SEQ ID NO: 38687 - protein, 4 aa, Mycobacterium avium
LAAR

SEQ ID NO: 38688 - protein, 5 aa, Mycobacterium avium
LAASP

SEQ ID NO: 38689 - protein, 11 aa, Mycobacterium avium
LAATDGPSGVE

SEQ ID NO: 38690 - protein, 7 aa, Mycobacterium avium
LAATDNP

SEQ ID NO: 38691 - protein, 6 aa, Mycobacterium avium
LADDED

SEQ ID NO: 38692 - protein, 7 aa, Mycobacterium avium
LADDSTI

SEQ ID NO: 38693 - protein, 4 aa, Mycobacterium avium
LADG

SEQ ID NO: 38694 - protein, 7 aa, Mycobacterium avium
LADGKAA

SEQ ID NO: 38695 - protein, 11 aa, Mycobacterium avium
LADGPRAATAW

SEQ ID NO: 38696 - protein, 7 aa, Mycobacterium avium
LADPDHA

SEQ ID NO: 38697 - protein, 7 aa, Mycobacterium avium
LADPGSA

SEQ ID NO: 38698 - protein, 9 aa, Mycobacterium avium
LADPPAPGS

SEQ ID NO: 38699 - protein, 6 aa, Mycobacterium avium
LADQAE

SEQ ID NO: 38700 - protein, 9 aa, Mycobacterium avium
LADTPEKIR

SEQ ID NO: 38701 - protein, 9 aa, Mycobacterium avium
LAEAPEAVD

SEQ ID NO: 38702 - protein, 7 aa, Mycobacterium avium
LAEARAK

SEQ ID NO: 38703 - protein, 21 aa, Mycobacterium avium
LAEERGVTAEISTASESPNHR

SEQ ID NO: 38704 - protein, 6 aa, Mycobacterium avium
LAEGAG

SEQ ID NO: 38705 - protein, 6 aa, Mycobacterium avium
LAEGPV

SEQ ID NO: 38706 - protein, 6 aa, Mycobacterium avium
LAEPGP

SEQ ID NO: 38707 - protein, 7 aa, Mycobacterium avium
LAEPPTA

SEQ ID NO: 38708 - protein, 11 aa, Mycobacterium avium
LAEQPGPVTID

SEQ ID NO: 38709 - protein, 15 aa, Mycobacterium avium
LAERGAYGRPRASSR

SEQ ID NO: 38710 - protein, 10 aa, Mycobacterium avium
LAESDGDFDK

SEQ ID NO: 38711 - protein, 9 aa, Mycobacterium avium
LAESRHRAS

SEQ ID NO: 38712 - protein, 8 aa, Mycobacterium avium
LAETPSPD

SEQ ID NO: 38713 - protein, 6 aa, Mycobacterium avium
LAETST

SEQ ID NO: 38714 - protein, 6 aa, Mycobacterium avium
LAGAER

SEQ ID NO: 38715 - protein, 20 aa, Mycobacterium avium
LAGAPAGAAPVGGGTRAPEL

SEQ ID NO: 38716 - protein, 14 aa, Mycobacterium avium
LAGASGQGNYAAGN

SEQ ID NO: 38717 - protein, 19 aa, Mycobacterium avium
LAGDARAQADSTAADNSFS

SEQ ID NO: 38718 - protein, 12 aa, Mycobacterium avium
LAGDGRPAESIE

SEQ ID NO: 38719 - protein, 7 aa, Mycobacterium avium
LAGDSGA

SEQ ID NO: 38720 - protein, 6 aa, Mycobacterium avium
LAGEDA

SEQ ID NO: 38721 - protein, 7 aa, Mycobacterium avium
LAGEPIT

SEQ ID NO: 38722 - protein, 6 aa, Mycobacterium avium
LAGESL

SEQ ID NO: 38723 - protein, 21 aa, Mycobacterium avium
LAGGEADDAESRLPQLTQGQR

SEQ ID NO: 38724 - protein, 4 aa, Mycobacterium avium
LAGN

SEQ ID NO: 38725 - protein, 6 aa, Mycobacterium avium
LAGNPI

SEQ ID NO: 38726 - protein, 9 aa, Mycobacterium avium
LAGPEIPSG

SEQ ID NO: 38727 - protein, 6 aa, Mycobacterium avium
LAGPGG

SEQ ID NO: 38728 - protein, 17 aa, Mycobacterium avium
LAGPVKSVTTAEGETVR

SEQ ID NO: 38729 - protein, 6 aa, Mycobacterium avium
LAGRPD

SEQ ID NO: 38730 - protein, 11 aa, Mycobacterium avium
LAGRPSPEADT

SEQ ID NO: 38731 - protein, 7 aa, Mycobacterium avium
LAGSGAR

SEQ ID NO: 38732 - protein, 6 aa, Mycobacterium avium
LAGTPV

SEQ ID NO: 38733 - protein, 8 aa, Mycobacterium avium
LAGTQSAG

SEQ ID NO: 38734 - protein, 7 aa, Mycobacterium avium
LAGVSGS

SEQ ID NO: 38735 - protein, 11 aa, Mycobacterium avium
LAKAAEGDIDA

SEQ ID NO: 38736 - protein, 14 aa, Mycobacterium avium
LAKETSSTKQDATV

SEQ ID NO: 38737 - protein, 7 aa, Mycobacterium avium
LAKTGAA

SEQ ID NO: 38738 - protein, 42 aa, Mycobacterium avium
LANAGSSVLSSTPKPPKTAGEKVTDEGEGGNQIAQYLVGQKI

SEQ ID NO: 38739 - protein, 7 aa, Mycobacterium avium
LANDGSV

SEQ ID NO: 38740 - protein, 8 aa, Mycobacterium avium
LANGATAE

SEQ ID NO: 38741 - protein, 12 aa, Mycobacterium avium
LANPPKDKADRD

SEQ ID NO: 38742 - protein, 9 aa, Mycobacterium avium
LANTRAASL

SEQ ID NO: 38743 - protein, 4 aa, Mycobacterium avium
LAPA

SEQ ID NO: 38744 - protein, 6 aa, Mycobacterium avium
LAPADA

SEQ ID NO: 38745 - protein, 12 aa, Mycobacterium avium
LAPAPNRYATAA

SEQ ID NO: 38746 - protein, 6 aa, Mycobacterium avium
LAPDEV

SEQ ID NO: 38747 - protein, 6 aa, Mycobacterium avium
LAPEGA

SEQ ID NO: 38748 - protein, 8 aa, Mycobacterium avium
LAPEGTPF

SEQ ID NO: 38749 - protein, 12 aa, Mycobacterium avium
LAPGMGSPPIGV

SEQ ID NO: 38750 - protein, 8 aa, Mycobacterium avium
LAPGPHET

SEQ ID NO: 38751 - protein, 5 aa, Mycobacterium avium
LAPGT

SEQ ID NO: 38752 - protein, 6 aa, Mycobacterium avium
LAPGWP

SEQ ID NO: 38753 - protein, 11 aa, Mycobacterium avium
LAPKGSGTEVT

SEQ ID NO: 38754 - protein, 7 aa, Mycobacterium avium
LAPPATA

SEQ ID NO: 38755 - protein, 8 aa, Mycobacterium avium
LAPPGTRR

SEQ ID NO: 38756 - protein, 6 aa, Mycobacterium avium
LAPPPE

SEQ ID NO: 38757 - protein, 5 aa, Mycobacterium avium
LAPRD

SEQ ID NO: 38758 - protein, 14 aa, Mycobacterium avium
LAPRRGQSFDSGVT

SEQ ID NO: 38759 - protein, 15 aa, Mycobacterium avium
LAPSDASELKARAEA

SEQ ID NO: 38760 - protein, 12 aa, Mycobacterium avium
LAPSVAAETARR

SEQ ID NO: 38761 - protein, 11 aa, Mycobacterium avium
LAPTDGADPRA

SEQ ID NO: 38762 - protein, 17 aa, Mycobacterium avium
LAPTGDRRMSANPHANG

SEQ ID NO: 38763 - protein, 8 aa, Mycobacterium avium
LAQGSAEE

SEQ ID NO: 38764 - protein, 7 aa, Mycobacterium avium
LAQGSVQ

SEQ ID NO: 38765 - protein, 5 aa, Mycobacterium avium
LAQHD

SEQ ID NO: 38766 - protein, 12 aa, Mycobacterium avium
LAQHGDQRRATT

SEQ ID NO: 38767 - protein, 7 aa, Mycobacterium avium
LAQPTGV

SEQ ID NO: 38768 - protein, 9 aa, Mycobacterium avium
LAQRVPSDE

SEQ ID NO: 38769 - protein, 7 aa, Mycobacterium avium
LAQTGTP

SEQ ID NO: 38770 - protein, 7 aa, Mycobacterium avium
LAQTPDT

SEQ ID NO: 38771 - protein, 10 aa, Mycobacterium avium
LARDKDNLGR

SEQ ID NO: 38772 - protein, 5 aa, Mycobacterium avium
LAREG

SEQ ID NO: 38773 - protein, 18 aa, Mycobacterium avium
LAREPRRGPRLPVQQIHS

SEQ ID NO: 38774 - protein, 6 aa, Mycobacterium avium
LARGEL

SEQ ID NO: 38775 - protein, 6 aa, Mycobacterium avium
LARGKS

SEQ ID NO: 38776 - protein, 17 aa, Mycobacterium avium
LARKAADEFSTPDKPRY

SEQ ID NO: 38777 - protein, 7 aa, Mycobacterium avium
LARPTST

SEQ ID NO: 38778 - protein, 7 aa, Mycobacterium avium
LARQSEL

SEQ ID NO: 38779 - protein, 9 aa, Mycobacterium avium
LARRNANGD

SEQ ID NO: 38780 - protein, 6 aa, Mycobacterium avium
LARRNS

SEQ ID NO: 38781 - protein, 6 aa, Mycobacterium avium
LARSEK

SEQ ID NO: 38782 - protein, 7 aa, Mycobacterium avium
LARSEPE

SEQ ID NO: 38783 - protein, 6 aa, Mycobacterium avium
LARTGG

SEQ ID NO: 38784 - protein, 15 aa, Mycobacterium avium
LARTNYGATLAGQGV

SEQ ID NO: 38785 - protein, 5 aa, Mycobacterium avium
LASAS

SEQ ID NO: 38786 - protein, 8 aa, Mycobacterium avium
LASDGSVE

SEQ ID NO: 38787 - protein, 10 aa, Mycobacterium avium
LASEKKCGHL

SEQ ID NO: 38788 - protein, 4 aa, Mycobacterium avium
LASG

SEQ ID NO: 38789 - protein, 5 aa, Mycobacterium avium
LASGR

SEQ ID NO: 38790 - protein, 8 aa, Mycobacterium avium
LASPGPSE

SEQ ID NO: 38791 - protein, 7 aa, Mycobacterium avium
LASSSTI

SEQ ID NO: 38792 - protein, 7 aa, Mycobacterium avium
LASTASG

SEQ ID NO: 38793 - protein, 21 aa, Mycobacterium avium
LASYDGRNRVNPPLREAADAA

SEQ ID NO: 38794 - protein, 4 aa, Mycobacterium avium
LATD

SEQ ID NO: 38795 - protein, 5 aa, Mycobacterium avium
LATDE

SEQ ID NO: 38796 - protein, 11 aa, Mycobacterium avium
LATDGEKAAAR

SEQ ID NO: 38797 - protein, 5 aa, Mycobacterium avium
LATGT

SEQ ID NO: 38798 - protein, 7 aa, Mycobacterium avium
LATPEEL

SEQ ID NO: 38799 - protein, 6 aa, Mycobacterium avium
LATRSE

SEQ ID NO: 38800 - protein, 10 aa, Mycobacterium avium
LCSGSGSGLR

SEQ ID NO: 38801 - protein, 8 aa, Mycobacterium avium
LDAANADQ

SEQ ID NO: 38802 - protein, 6 aa, Mycobacterium avium
LDADEA

SEQ ID NO: 38803 - protein, 9 aa, Mycobacterium avium
LDADTEEAA

SEQ ID NO: 38804 - protein, 20 aa, Mycobacterium avium
LDAEEAAARAARRGQSAGAP

SEQ ID NO: 38805 - protein, 8 aa, Mycobacterium avium
LDAGADDY

SEQ ID NO: 38806 - protein, 8 aa, Mycobacterium avium
LDAPPAEM

SEQ ID NO: 38807 - protein, 13 aa, Mycobacterium avium
LDAQPGRRAEISP

SEQ ID NO: 38808 - protein, 12 aa, Mycobacterium avium
LDATDTDSDSGR

SEQ ID NO: 38809 - protein, 7 aa, Mycobacterium avium
LDATETA

SEQ ID NO: 38810 - protein, 7 aa, Mycobacterium avium
LDAYERG

SEQ ID NO: 38811 - protein, 5 aa, Mycobacterium avium
LDDDE

SEQ ID NO: 38812 - protein, 10 aa, Mycobacterium avium
LDDEPDYGAA

SEQ ID NO: 38813 - protein, 13 aa, Mycobacterium avium
LDDPNADTGKTTQ

SEQ ID NO: 38814 - protein, 8 aa, Mycobacterium avium
LDDRPEVR

SEQ ID NO: 38815 - protein, 6 aa, Mycobacterium avium
LDDSGP

SEQ ID NO: 38816 - protein, 8 aa, Mycobacterium avium
LDDTSKSA

SEQ ID NO: 38817 - protein, 7 aa, Mycobacterium avium
LDEAAGK

SEQ ID NO: 38818 - protein, 6 aa, Mycobacterium avium
LDEAGC

SEQ ID NO: 38819 - protein, 7 aa, Mycobacterium avium
LDEAGNV

SEQ ID NO: 38820 - protein, 6 aa, Mycobacterium avium
LDEESA

SEQ ID NO: 38821 - protein, 19 aa, Mycobacterium avium
LDEGKDAPGPSDSASAPPT

SEQ ID NO: 38822 - protein, 7 aa, Mycobacterium avium
LDEPGPG

SEQ ID NO: 38823 - protein, 4 aa, Mycobacterium avium
LDEQ

SEQ ID NO: 38824 - protein, 4 aa, Mycobacterium avium
LDER

SEQ ID NO: 38825 - protein, 12 aa, Mycobacterium avium
LDERSSAGSYDD

SEQ ID NO: 38826 - protein, 6 aa, Mycobacterium avium
LDETGG

SEQ ID NO: 38827 - protein, 18 aa, Mycobacterium avium
LDETTSRGQYTAGWQGGE

SEQ ID NO: 38828 - protein, 7 aa, Mycobacterium avium
LDGARPD

SEQ ID NO: 38829 - protein, 5 aa, Mycobacterium avium
LDGDL

SEQ ID NO: 38830 - protein, 9 aa, Mycobacterium avium
LDGEKLSDD

SEQ ID NO: 38831 - protein, 8 aa, Mycobacterium avium
LDGEPDAA

SEQ ID NO: 38832 - protein, 9 aa, Mycobacterium avium
LDGEPQYKT

SEQ ID NO: 38833 - protein, 8 aa, Mycobacterium avium
LDGGDQVV

SEQ ID NO: 38834 - protein, 8 aa, Mycobacterium avium
LDGHDRGA

SEQ ID NO: 38835 - protein, 4 aa, Mycobacterium avium
LDGK

SEQ ID NO: 38836 - protein, 9 aa, Mycobacterium avium
LDGNEIKTN

SEQ ID NO: 38837 - protein, 5 aa, Mycobacterium avium
LDGNY

SEQ ID NO: 38838 - protein, 8 aa, Mycobacterium avium
LDGPGDAD

SEQ ID NO: 38839 - protein, 8 aa, Mycobacterium avium
LDGPPDGI

SEQ ID NO: 38840 - protein, 5 aa, Mycobacterium avium
LDGPT

SEQ ID NO: 38841 - protein, 9 aa, Mycobacterium avium
LDGQTPVEV

SEQ ID NO: 38842 - protein, 8 aa, Mycobacterium avium
LDGRADPG

SEQ ID NO: 38843 - protein, 8 aa, Mycobacterium avium
LDGREAVD

SEQ ID NO: 38844 - protein, 10 aa, Mycobacterium avium
LDGRPTDLPG

SEQ ID NO: 38845 - protein, 9 aa, Mycobacterium avium
LDGRRGPQV

SEQ ID NO: 38846 - protein, 7 aa, Mycobacterium avium
LDGRTVR

SEQ ID NO: 38847 - protein, 8 aa, Mycobacterium avium
LDGSGAAR

SEQ ID NO: 38848 - protein, 15 aa, Mycobacterium avium
LDGSPASGGSAAQSV

SEQ ID NO: 38849 - protein, 7 aa, Mycobacterium avium
LDGSPMR

SEQ ID NO: 38850 - protein, 5 aa, Mycobacterium avium
LDGYS

SEQ ID NO: 38851 - protein, 10 aa, Mycobacterium avium
LDLPEDASPA

SEQ ID NO: 38852 - protein, 10 aa, Mycobacterium avium
LDLPPEAEEL

SEQ ID NO: 38853 - protein, 7 aa, Mycobacterium avium
LDNEQHQ

SEQ ID NO: 38854 - protein, 9 aa, Mycobacterium avium
LDPAGEKAQ

SEQ ID NO: 38855 - protein, 6 aa, Mycobacterium avium
LDPAGL

SEQ ID NO: 38856 - protein, 22 aa, Mycobacterium avium
LDPAGYGQRPHPSTDAPRTDRD

SEQ ID NO: 38857 - protein, 11 aa, Mycobacterium avium
LDPASLAGSQT

SEQ ID NO: 38858 - protein, 12 aa, Mycobacterium avium
LDPASRGPHASK

SEQ ID NO: 38859 - protein, 5 aa, Mycobacterium avium
LDPAT

SEQ ID NO: 38860 - protein, 8 aa, Mycobacterium avium
LDPDASLG

SEQ ID NO: 38861 - protein, 7 aa, Mycobacterium avium
LDPEKAS

SEQ ID NO: 38862 - protein, 5 aa, Mycobacterium avium
LDPEY

SEQ ID NO: 38863 - protein, 6 aa, Mycobacterium avium
LDPGAE

SEQ ID NO: 38864 - protein, 13 aa, Mycobacterium avium
LDPGAGVAARGGH

SEQ ID NO: 38865 - protein, 7 aa, Mycobacterium avium
LDPGKLP

SEQ ID NO: 38866 - protein, 5 aa, Mycobacterium avium
LDPHG

SEQ ID NO: 38867 - protein, 10 aa, Mycobacterium avium
LDPLDDDDTR

SEQ ID NO: 38868 - protein, 18 aa, Mycobacterium avium
LDPLGGNTIPPAPPPAMA

SEQ ID NO: 38869 - protein, 7 aa, Mycobacterium avium
LDPMDTE

SEQ ID NO: 38870 - protein, 7 aa, Mycobacterium avium
LDPPTGR

SEQ ID NO: 38871 - protein, 8 aa, Mycobacterium avium
LDPPTGVR

SEQ ID NO: 38872 - protein, 6 aa, Mycobacterium avium
LDPQGQ

SEQ ID NO: 38873 - protein, 6 aa, Mycobacterium avium
LDPRRI

SEQ ID NO: 38874 - protein, 4 aa, Mycobacterium avium
LDPS

SEQ ID NO: 38875 - protein, 7 aa, Mycobacterium avium
LDPSEAV

SEQ ID NO: 38876 - protein, 6 aa, Mycobacterium avium
LDPSED

SEQ ID NO: 38877 - protein, 5 aa, Mycobacterium avium
LDPSM

SEQ ID NO: 38878 - protein, 7 aa, Mycobacterium avium
LDPSPAI

SEQ ID NO: 38879 - protein, 12 aa, Mycobacterium avium
LDPSQPDDAPAR

SEQ ID NO: 38880 - protein, 5 aa, Mycobacterium avium
LDPST

SEQ ID NO: 38881 - protein, 10 aa, Mycobacterium avium
LDPVETPDEY

SEQ ID NO: 38882 - protein, 9 aa, Mycobacterium avium
LDQPDTGTV

SEQ ID NO: 38883 - protein, 11 aa, Mycobacterium avium
LDQSGPTVSQT

SEQ ID NO: 38884 - protein, 9 aa, Mycobacterium avium
LDRDGRGQV

SEQ ID NO: 38885 - protein, 4 aa, Mycobacterium avium
LDRG

SEQ ID NO: 38886 - protein, 6 aa, Mycobacterium avium
LDRPSQ

SEQ ID NO: 38887 - protein, 7 aa, Mycobacterium avium
LDRQPAA

SEQ ID NO: 38888 - protein, 9 aa, Mycobacterium avium
LDRTSTGAG

SEQ ID NO: 38889 - protein, 9 aa, Mycobacterium avium
LDSAQQDRL

SEQ ID NO: 38890 - protein, 4 aa, Mycobacterium avium
LDSD

SEQ ID NO: 38891 - protein, 9 aa, Mycobacterium avium
LDSEPGSNV

SEQ ID NO: 38892 - protein, 5 aa, Mycobacterium avium
LDSPL

SEQ ID NO: 38893 - protein, 7 aa, Mycobacterium avium
LDSTTDQ

SEQ ID NO: 38894 - protein, 11 aa, Mycobacterium avium
LDTDKIEASYR

SEQ ID NO: 38895 - protein, 9 aa, Mycobacterium avium
LDTDSADRM

SEQ ID NO: 38896 - protein, 6 aa, Mycobacterium avium
LDTPAS

SEQ ID NO: 38897 - protein, 22 aa, Mycobacterium avium
LDTQGVKNRKQARSRYGAKKEK

SEQ ID NO: 38898 - protein, 4 aa, Mycobacterium avium
LDTR

SEQ ID NO: 38899 - protein, 4 aa, Mycobacterium avium
LDTT

SEQ ID NO: 38900 - protein, 7 aa, Mycobacterium avium
LDVDADG

SEQ ID NO: 38901 - protein, 5 aa, Mycobacterium avium
LDVDT

SEQ ID NO: 38902 - protein, 17 aa, Mycobacterium avium
LDVPPAEGHVPGKEEEL

SEQ ID NO: 38903 - protein, 10 aa, Mycobacterium avium
LDVSGPGQAI

SEQ ID NO: 38904 - protein, 10 aa, Mycobacterium avium
LEADESLPTM

SEQ ID NO: 38905 - protein, 7 aa, Mycobacterium avium
LEADNRG

SEQ ID NO: 38906 - protein, 22 aa, Mycobacterium avium
LEAEGAKADARRKVRDSGEREM

SEQ ID NO: 38907 - protein, 6 aa, Mycobacterium avium
LEAGAD

SEQ ID NO: 38908 - protein, 9 aa, Mycobacterium avium
LEAGDDRSV

SEQ ID NO: 38909 - protein, 8 aa, Mycobacterium avium
LEANGGPR

SEQ ID NO: 38910 - protein, 5 aa, Mycobacterium avium
LEAPD

SEQ ID NO: 38911 - protein, 4 aa, Mycobacterium avium
LEAQ

SEQ ID NO: 38912 - protein, 5 aa, Mycobacterium avium
LEASG

SEQ ID NO: 38913 - protein, 11 aa, Mycobacterium avium
LEATPDKRTTT

SEQ ID NO: 38914 - protein, 13 aa, Mycobacterium avium
LEDGTDVARGRRG

SEQ ID NO: 38915 - protein, 8 aa, Mycobacterium avium
LEDRGVDT

SEQ ID NO: 38916 - protein, 7 aa, Mycobacterium avium
LEEAQTA

SEQ ID NO: 38917 - protein, 6 aa, Mycobacterium avium
LEEETG

SEQ ID NO: 38918 - protein, 7 aa, Mycobacterium avium
LEEGGAM

SEQ ID NO: 38919 - protein, 6 aa, Mycobacterium avium
LEETTL

SEQ ID NO: 38920 - protein, 5 aa, Mycobacterium avium
LEGEG

SEQ ID NO: 38921 - protein, 7 aa, Mycobacterium avium
LEGEMGD

SEQ ID NO: 38922 - protein, 10 aa, Mycobacterium avium
LEGFGRPDGF

SEQ ID NO: 38923 - protein, 7 aa, Mycobacterium avium
LEGGEGP

SEQ ID NO: 38924 - protein, 9 aa, Mycobacterium avium
LEGGPRPTH

SEQ ID NO: 38925 - protein, 9 aa, Mycobacterium avium
LEGKEGDRG

SEQ ID NO: 38926 - protein, 12 aa, Mycobacterium avium
LEGPSYTRPPSW

SEQ ID NO: 38927 - protein, 5 aa, Mycobacterium avium
LEGQG

SEQ ID NO: 38928 - protein, 6 aa, Mycobacterium avium
LEHGAS

(The sequence listing continues in the following parts.)

What is claimed is:

1. A method for treating cancer in a subject comprising:
obtaining a first gene expression profile of a first cancer sample having a first cancer type, wherein the first cancer type is selected from the group consisting of colon cancer, rectal cancer, head and neck cancer, and lung cancer;
obtaining a second gene expression profile of a second cancer sample having a second cancer type, wherein the second cancer type is different from the first cancer type;
obtaining a third gene expression profile of a third cancer sample having a third cancer type, wherein the third cancer type is different from the first and the second cancer type;
comparing said first gene expression profile with said second gene expression profile;
selecting $N_1$ genes that are most differentially expressed in the first and the second gene expression profiles to generate first pairwise differentially expressed genes (DEGs), wherein $N_1$ is an integer between 10 and 100;
comparing said first gene expression profile with said third gene expression profile;
selecting $N_2$ genes that are most differentially expressed in the first and the third gene expression profiles to generate second pairwise DEGs, wherein $N_2$ is an integer between 10 and 100;
comparing said second gene expression profile with said third gene expression profile;
selecting $N_3$ genes that are most differentially expressed in the second and the third gene expression profiles to generate third pairwise DEGs, wherein $N_3$ is an integer between 10 and 100;
generating a set of signature genes that comprises the first, second and third pairwise DEGs;
generating a machine learning classifier based on the set of signature genes, wherein the machine learning classifier receives an input comprising expression levels of the set of signature genes and provides an output comprising cancer type;
obtaining a sample from the subject;
obtaining expression levels of the set of signature genes in the sample;
determining that the subject has a cancer of the first cancer type based on the expression levels of the set of signature genes in the subject sample using the machine learning classifier; and
administering to the subject a therapeutically effective amount of a drug suitable for treating the first cancer type,
wherein the drug is selected from the group consisting of (a) Bevacizumab, Capecitabine, Cetuximab, 5-FU, Fluorouracil Injection, Irinotecan hydrochloride, Leucovorin Calcium, Oxaliplatin, Panitumumab, Ramucirumab, Regorafenib, Trifluridine and Tipiracil hydrochloride, and Ziv-aflibercept when the first cancer type is colon cancer or rectal cancer, (b) Bleomycin, Cetuximab, Docetaxel, Hydroxyurea, Methotrexate, and Pembrolizumab when the first cancer type is head and neck cancer, and (c) Afatinib dimaleate, Alectinib, Bevacizumab, Carboplatin, Ceritinib, Docetaxel, Erlotinib, Everolimus, Gefitinib, Gemcitabine Hydrochloride, Mechlorethamine hydrochloride, Methotrexate, Necitumumab, Nivolumab, Osimertinib, Paclitaxel, Pembrolizumab, Pemetrexed disodium, Ramucirumab, and Vinorelbine Tartrate when the first cancer type is lung cancer.

2. The method of claim 1, wherein the first, second or third cancer sample is a surgical removal sample or biopsy sample from a cancer patient or a patient derived xenograft (PDX).

3. The method of claim 1, wherein $N_1=N_2=N_3$.

4. The method of claim 1, wherein $N_1$, $N_2$ or $N_3$ are around 50.

5. The method of claim 1, wherein the first gene expression profile, the second gene profile or the third gene profile is obtained by transcriptome RNA sequencing or microarray.

6. The method of claim 1, wherein the first gene expression profile, the second gene profile or the third gene profile is obtained from the cancer genome atlas (TCGA) dataset.

7. The method of claim 1, wherein the $N_1$, $N_2$ or $N_3$ genes most differentially expressed are selected by ranking using t-test, or Mann-Whitney U test.

8. The method of claim 1, wherein the second or third cancer type is acute lymphoblastic leukemia (ALL), acute myeloid leukemia, adrenocortical carcinoma, anal cancer, astrocytoma, childhood cerebellar or cerebral, basal-cell carcinoma, bile duct cancer, bladder cancer, bone tumor, brain cancer, cerebellar astrocytoma, cerebral astrocytoma/malignant glioma, ependymoma, medulloblastoma, supratentorial primitive neuroectodermal tumors, visual pathway and hypothalamic glioma, breast cancer, Burkitt's lymphoma, cervical cancer, chronic lymphocytic leukemia, chronic myelogenous leukemia, colon cancer, emphysema, endometrial cancer, ependymoma, esophageal cancer, Ewing's sarcoma, retinoblastoma, gastric (stomach) cancer, glioma, head and neck cancer, heart cancer, Hodgkin lymphoma, islet cell carcinoma (endocrine pancreas), Kaposi sarcoma, kidney cancer, laryngeal cancer, leukaemia, liver cancer, lung cancer, neuroblastoma, non-Hodgkin lymphoma, ovarian cancer, pancreatic cancer, pharyngeal cancer, prostate cancer, rectal cancer, renal cell carcinoma (kidney cancer), retinoblastoma, Ewing family of tumors, skin cancer, stomach cancer, testicular cancer, throat cancer, thyroid cancer, vaginal cancer, colon adenocarcinoma, rectum adenocarcinoma, lung adenocarcinoma, lung squamous cell carcinoma, head and neck squamous cell carcinoma, liver hepatocellular carcinoma, or pancreatic adenocarcinoma.

9. The method of claim 1, wherein the set of signature genes has m genes, wherein m is an integer between 5 to 5000.

10. The method of claim 1, wherein the machine learning classifier is a support vector machine.

* * * * *